United States Patent 11,096,956 (ANTISENSE OLIGOMERS AND USES THEREOF) - sequence listing, part 4

SEQ ID NO: 8632 - RNA, 18 nt, Artificial Sequence
  Description of Artificial Sequence: Synthetic oligonucleotide
uucucuugauuugcaucc

SEQ ID NO: 8633 - RNA, 18 nt, Artificial Sequence
  Description of Artificial Sequence: Synthetic oligonucleotide
cguauuucucuugauuug

SEQ ID NO: 8634 - RNA, 18 nt, Artificial Sequence
  Description of Artificial Sequence: Synthetic oligonucleotide
cuguucguauuucucuug

SEQ ID NO: 8635 - RNA, 18 nt, Artificial Sequence
  Description of Artificial Sequence: Synthetic oligonucleotide
gaacacuguucguauuuc

SEQ ID NO: 8636 - RNA, 18 nt, Artificial Sequence
  Description of Artificial Sequence: Synthetic oligonucleotide
uucaggaacacuguucgu

SEQ ID NO: 8637 - RNA, 18 nt, Artificial Sequence
  Description of Artificial Sequence: Synthetic oligonucleotide
gcgguuucaggaacacug

SEQ ID NO: 8638 - RNA, 18 nt, Artificial Sequence
  Description of Artificial Sequence: Synthetic oligonucleotide
cuggagcgguuucaggaa

SEQ ID NO: 8639 - RNA, 18 nt, Artificial Sequence
  Description of Artificial Sequence: Synthetic oligonucleotide
ugcagcuggagcgguuuc

SEQ ID NO: 8640 - RNA, 18 nt, Artificial Sequence
  Description of Artificial Sequence: Synthetic oligonucleotide
gggauugcagcuggagcg

SEQ ID NO: 8641 - RNA, 18 nt, Artificial Sequence
  Description of Artificial Sequence: Synthetic oligonucleotide
ucucagggauugcagcug

SEQ ID NO: 8642 - RNA, 18 nt, Artificial Sequence
  Description of Artificial Sequence: Synthetic oligonucleotide
uuuggucucagggauugc

SEQ ID NO: 8643 - RNA, 18 nt, Artificial Sequence
  Description of Artificial Sequence: Synthetic oligonucleotide
uuucuuuuggucucaggg

SEQ ID NO: 8644 - RNA, 18 nt, Artificial Sequence
  Description of Artificial Sequence: Synthetic oligonucleotide
cugcguuucuuuuggucu

SEQ ID NO: 8645 - RNA, 18 nt, Artificial Sequence
  Description of Artificial Sequence: Synthetic oligonucleotide
gaacucugcguuucuuuu

SEQ ID NO: 8646 - RNA, 18 nt, Artificial Sequence
  Description of Artificial Sequence: Synthetic oligonucleotide
gugaggaacucugcguuu

SEQ ID NO: 8647 - RNA, 18 nt, Artificial Sequence
  Description of Artificial Sequence: Synthetic oligonucleotide
uacaggugaggaacucug

SEQ ID NO: 8648 - RNA, 18 nt, Artificial Sequence
  Description of Artificial Sequence: Synthetic oligonucleotide
uauauuacaggugaggaa

SEQ ID NO: 8649 - RNA, 18 nt, Artificial Sequence
  Description of Artificial Sequence: Synthetic oligonucleotide
guggguauauuacaggug

SEQ ID NO: 8650 - RNA, 18 nt, Artificial Sequence
  Description of Artificial Sequence: Synthetic oligonucleotide
uugauguggguauauuac

SEQ ID NO: 8651 - RNA, 18 nt, Artificial Sequence
  Description of Artificial Sequence: Synthetic oligonucleotide
ggcauuugauguggguau

SEQ ID NO: 8652 - RNA, 18 nt, Artificial Sequence
  Description of Artificial Sequence: Synthetic oligonucleotide
uuugaggcauuugaugug

SEQ ID NO: 8653 - RNA, 18 nt, Artificial Sequence
  Description of Artificial Sequence: Synthetic oligonucleotide
uguuauuugaggcauuug

SEQ ID NO: 8654 - RNA, 18 nt, Artificial Sequence
  Description of Artificial Sequence: Synthetic oligonucleotide
uaccauguuauuugaggc

SEQ ID NO: 8655 - RNA, 18 nt, Artificial Sequence
  Description of Artificial Sequence: Synthetic oligonucleotide
gugguuaccauguuauuu

SEQ ID NO: 8656 - RNA, 18 nt, Artificial Sequence
  Description of Artificial Sequence: Synthetic oligonucleotide
uuucugugguuaccaugu

SEQ ID NO: 8657 - RNA, 18 nt, Artificial Sequence
  Description of Artificial Sequence: Synthetic oligonucleotide
cacuuuuucugugguuac

SEQ ID NO: 8658 - RNA, 18 nt, Artificial Sequence
  Description of Artificial Sequence: Synthetic oligonucleotide
uucuccacuuuuucugug

SEQ ID NO: 8659 - RNA, 18 nt, Artificial Sequence
  Description of Artificial Sequence: Synthetic oligonucleotide
gcccauucuccacuuuuu

SEQ ID NO: 8660 - RNA, 18 nt, Artificial Sequence
  Description of Artificial Sequence: Synthetic oligonucleotide
uuccugcccauucuccac

SEQ ID NO: 8661 - RNA, 18 nt, Artificial Sequence
  Description of Artificial Sequence: Synthetic oligonucleotide
acagguuccugcccauuc

SEQ ID NO: 8662 - RNA, 18 nt, Artificial Sequence
  Description of Artificial Sequence: Synthetic oligonucleotide
uuaugacagguuccugcc

SEQ ID NO: 8663 - RNA, 18 nt, Artificial Sequence
  Description of Artificial Sequence: Synthetic oligonucleotide
uaacuuuaugacagguuc

SEQ ID NO: 8664 - RNA, 18 nt, Artificial Sequence
  Description of Artificial Sequence: Synthetic oligonucleotide
uuuucuaacuuuaugaca

SEQ ID NO: 8665 - RNA, 18 nt, Artificial Sequence
  Description of Artificial Sequence: Synthetic oligonucleotide
gccuguuuucuaacuuua

SEQ ID NO: 8666 - RNA, 18 nt, Artificial Sequence
  Description of Artificial Sequence: Synthetic oligonucleotide
cucuugccuguuuucuaa

SEQ ID NO: 8667 - RNA, 18 nt, Artificial Sequence
  Description of Artificial Sequence: Synthetic oligonucleotide
cuggccucuugccuguuu

SEQ ID NO: 8668 - RNA, 18 nt, Artificial Sequence
  Description of Artificial Sequence: Synthetic oligonucleotide
cuggucuggccucuugcc

SEQ ID NO: 8669 - RNA, 18 nt, Artificial Sequence
  Description of Artificial Sequence: Synthetic oligonucleotide
ugguucuggucuggccuc

SEQ ID NO: 8670 - RNA, 18 nt, Artificial Sequence
  Description of Artificial Sequence: Synthetic oligonucleotide
cuugcugguucuggucug

SEQ ID NO: 8671 - RNA, 18 nt, Artificial Sequence
  Description of Artificial Sequence: Synthetic oligonucleotide
ucagucuugcugguucug

SEQ ID NO: 8672 - RNA, 18 nt, Artificial Sequence
  Description of Artificial Sequence: Synthetic oligonucleotide
ugguuucagucuugcugg

SEQ ID NO: 8673 - RNA, 18 nt, Artificial Sequence
  Description of Artificial Sequence: Synthetic oligonucleotide
acaggugguuucagucuu

SEQ ID NO: 8674 - RNA, 18 nt, Artificial Sequence
  Description of Artificial Sequence: Synthetic oligonucleotide
aaugaacaggugguuuca

SEQ ID NO: 8675 - RNA, 18 nt, Artificial Sequence
  Description of Artificial Sequence: Synthetic oligonucleotide
auuguaaugaacaggugg

SEQ ID NO: 8676 - RNA, 18 nt, Artificial Sequence
  Description of Artificial Sequence: Synthetic oligonucleotide
gggccauuguaaugaaca

SEQ ID NO: 8677 - RNA, 18 nt, Artificial Sequence
  Description of Artificial Sequence: Synthetic oligonucleotide
auacccugcuuuugaggg

SEQ ID NO: 8678 - RNA, 18 nt, Artificial Sequence
  Description of Artificial Sequence: Synthetic oligonucleotide
aacauacccugcuuuuga

SEQ ID NO: 8679 - RNA, 18 nt, Artificial Sequence
  Description of Artificial Sequence: Synthetic oligonucleotide
aagucaacauacccugcu

SEQ ID NO: 8680 - RNA, 18 nt, Artificial Sequence
  Description of Artificial Sequence: Synthetic oligonucleotide
uuucaaagucaacauacc

SEQ ID NO: 8681 - RNA, 18 nt, Artificial Sequence
  Description of Artificial Sequence: Synthetic oligonucleotide
gccauuuucaaagucaac

SEQ ID NO: 8682 - RNA, 18 nt, Artificial Sequence
  Description of Artificial Sequence: Synthetic oligonucleotide
cacuggccauuuucaaag

SEQ ID NO: 8683 - RNA, 18 nt, Artificial Sequence
  Description of Artificial Sequence: Synthetic oligonucleotide
uggcccacuggccauuuu

SEQ ID NO: 8684 - RNA, 18 nt, Artificial Sequence
  Description of Artificial Sequence: Synthetic oligonucleotide
aucuguggcccacuggcc

SEQ ID NO: 8685 - RNA, 18 nt, Artificial Sequence
  Description of Artificial Sequence: Synthetic oligonucleotide
augucaucuguggcccac

SEQ ID NO: 8686 - RNA, 18 nt, Artificial Sequence
  Description of Artificial Sequence: Synthetic oligonucleotide
cugggaugucaucugugg

SEQ ID NO: 8687 - RNA, 18 nt, Artificial Sequence
  Description of Artificial Sequence: Synthetic oligonucleotide
gucaucugggaugucauc

SEQ ID NO: 8688 - RNA, 18 nt, Artificial Sequence
  Description of Artificial Sequence: Synthetic oligonucleotide
uucaagucaucugggaug

SEQ ID NO: 8689 - RNA, 18 nt, Artificial Sequence
  Description of Artificial Sequence: Synthetic oligonucleotide
uacuauucaagucaucug

SEQ ID NO: 8690 - RNA, 18 nt, Artificial Sequence
  Description of Artificial Sequence: Synthetic oligonucleotide
gcggauacuauucaaguc

SEQ ID NO: 8691 - RNA, 18 nt, Artificial Sequence
  Description of Artificial Sequence: Synthetic oligonucleotide
gcugcgcggauacuauuc

SEQ ID NO: 8692 - RNA, 18 nt, Artificial Sequence
  Description of Artificial Sequence: Synthetic oligonucleotide
cuggugcugcgcggauac

SEQ ID NO: 8693 - RNA, 18 nt, Artificial Sequence
  Description of Artificial Sequence: Synthetic oligonucleotide
cucaccuggugcugcgcg

SEQ ID NO: 8694 - RNA, 18 nt, Artificial Sequence
  Description of Artificial Sequence: Synthetic oligonucleotide
cgaaacucaccuggugcu

SEQ ID NO: 8695 - RNA, 18 nt, Artificial Sequence
  Description of Artificial Sequence: Synthetic oligonucleotide
uggcucgaaacucaccug

SEQ ID NO: 8696 - RNA, 18 nt, Artificial Sequence
  Description of Artificial Sequence: Synthetic oligonucleotide
caugauggcucgaaacuc

SEQ ID NO: 8697 - RNA, 18 nt, Artificial Sequence
  Description of Artificial Sequence: Synthetic oligonucleotide
aucuccaugauggcucga

SEQ ID NO: 8698 - RNA, 18 nt, Artificial Sequence
  Description of Artificial Sequence: Synthetic oligonucleotide
agggcaucuccaugaugg

SEQ ID NO: 8699 - RNA, 18 nt, Artificial Sequence
  Description of Artificial Sequence: Synthetic oligonucleotide
gaaggagggcaucuccau

SEQ ID NO: 8700 - RNA, 18 nt, Artificial Sequence
  Description of Artificial Sequence: Synthetic oligonucleotide
cuguagaaggagggcauc

SEQ ID NO: 8701 - RNA, 18 nt, Artificial Sequence
  Description of Artificial Sequence: Synthetic oligonucleotide
caugacuguagaaggagg

SEQ ID NO: 8702 - RNA, 18 nt, Artificial Sequence
  Description of Artificial Sequence: Synthetic oligonucleotide
caagccaugacuguagaa

SEQ ID NO: 8703 - RNA, 18 nt, Artificial Sequence
  Description of Artificial Sequence: Synthetic oligonucleotide
cguggcaagccaugacug

SEQ ID NO: 8704 - RNA, 18 nt, Artificial Sequence
  Description of Artificial Sequence: Synthetic oligonucleotide
aacaccguggcaagccau

SEQ ID NO: 8705 - RNA, 18 nt, Artificial Sequence
  Description of Artificial Sequence: Synthetic oligonucleotide
gggugaacaccguggcaa

SEQ ID NO: 8706 - RNA, 18 nt, Artificial Sequence
  Description of Artificial Sequence: Synthetic oligonucleotide
uuguagggugaacaccgu

SEQ ID NO: 8707 - RNA, 18 nt, Artificial Sequence
  Description of Artificial Sequence: Synthetic oligonucleotide
guuucuuguagggugaac

SEQ ID NO: 8708 - RNA, 18 nt, Artificial Sequence
  Description of Artificial Sequence: Synthetic oligonucleotide
ugucaguuucuuguaggg

SEQ ID NO: 8709 - RNA, 18 nt, Artificial Sequence
  Description of Artificial Sequence: Synthetic oligonucleotide
cacucugucaguuucuug

SEQ ID NO: 8710 - RNA, 18 nt, Artificial Sequence
  Description of Artificial Sequence: Synthetic oligonucleotide
gcuggcacucugucaguu

SEQ ID NO: 8711 - RNA, 18 nt, Artificial Sequence
  Description of Artificial Sequence: Synthetic oligonucleotide
cuucagcuggcacucugu

SEQ ID NO: 8712 - RNA, 18 nt, Artificial Sequence
  Description of Artificial Sequence: Synthetic oligonucleotide
ggguucuucagcuggcac

SEQ ID NO: 8713 - RNA, 18 nt, Artificial Sequence
  Description of Artificial Sequence: Synthetic oligonucleotide
uaacagcccgcugauggg

SEQ ID NO: 8714 - RNA, 18 nt, Artificial Sequence
  Description of Artificial Sequence: Synthetic oligonucleotide
cuaacagcccgcugaugg

SEQ ID NO: 8715 - RNA, 18 nt, Artificial Sequence
  Description of Artificial Sequence: Synthetic oligonucleotide
auauucuaacagcccgcu

SEQ ID NO: 8716 - RNA, 18 nt, Artificial Sequence
  Description of Artificial Sequence: Synthetic oligonucleotide
ugggcauauucuaacagc

SEQ ID NO: 8717 - RNA, 18 nt, Artificial Sequence
  Description of Artificial Sequence: Synthetic oligonucleotide
cgaacugggcauauucua

SEQ ID NO: 8718 - RNA, 18 nt, Artificial Sequence
  Description of Artificial Sequence: Synthetic oligonucleotide
acuagcgaacugggcaua

SEQ ID NO: 8719 - RNA, 18 nt, Artificial Sequence
  Description of Artificial Sequence: Synthetic oligonucleotide
guuugacuagcgaacugg

SEQ ID NO: 8720 - RNA, 18 nt, Artificial Sequence
  Description of Artificial Sequence: Synthetic oligonucleotide
cacagguuugacuagcga

SEQ ID NO: 8721 - RNA, 18 nt, Artificial Sequence
  Description of Artificial Sequence: Synthetic oligonucleotide
gaacucacagguuugacu

SEQ ID NO: 8722 - RNA, 18 nt, Artificial Sequence
  Description of Artificial Sequence: Synthetic oligonucleotide
auguugaacucacagguu

SEQ ID NO: 8723 - RNA, 18 nt, Artificial Sequence
  Description of Artificial Sequence: Synthetic oligonucleotide
cuaucauguugaacucac

SEQ ID NO: 8724 - RNA, 18 nt, Artificial Sequence
  Description of Artificial Sequence: Synthetic oligonucleotide
cugcucuaucauguugaa

SEQ ID NO: 8725 - RNA, 18 nt, Artificial Sequence
  Description of Artificial Sequence: Synthetic oligonucleotide
ccacucugcucuaucaug

SEQ ID NO: 8726 - RNA, 18 nt, Artificial Sequence
  Description of Artificial Sequence: Synthetic oligonucleotide
gugguccacucugcucua

SEQ ID NO: 8727 - RNA, 18 nt, Artificial Sequence
  Description of Artificial Sequence: Synthetic oligonucleotide
acaguuccuggguggucu

SEQ ID NO: 8728 - RNA, 18 nt, Artificial Sequence
  Description of Artificial Sequence: Synthetic oligonucleotide
uagguacaguuccugggu

SEQ ID NO: 8729 - RNA, 18 nt, Artificial Sequence
  Description of Artificial Sequence: Synthetic oligonucleotide
aacccuagguacaguucc

SEQ ID NO: 8730 - RNA, 18 nt, Artificial Sequence
  Description of Artificial Sequence: Synthetic oligonucleotide
accccaacccuagguaca

SEQ ID NO: 8731 - RNA, 18 nt, Artificial Sequence
  Description of Artificial Sequence: Synthetic oligonucleotide
accugaccccaacccuag

SEQ ID NO: 8732 - RNA, 18 nt, Artificial Sequence
  Description of Artificial Sequence: Synthetic oligonucleotide
aaagcaccugaccccaac

SEQ ID NO: 8733 - RNA, 18 nt, Artificial Sequence
  Description of Artificial Sequence: Synthetic oligonucleotide
gagcaaaagcaccugacc

SEQ ID NO: 8734 - RNA, 18 nt, Artificial Sequence
  Description of Artificial Sequence: Synthetic oligonucleotide
gucaggagcaaaagcacc

SEQ ID NO: 8735 - RNA, 18 nt, Artificial Sequence
  Description of Artificial Sequence: Synthetic oligonucleotide
acugcgucaggagcaaaa

SEQ ID NO: 8736 - RNA, 18 nt, Artificial Sequence
  Description of Artificial Sequence: Synthetic oligonucleotide
ccaagacugcgucaggag

SEQ ID NO: 8737 - RNA, 18 nt, Artificial Sequence
  Description of Artificial Sequence: Synthetic oligonucleotide
aucagccaagacugcguc

SEQ ID NO: 8738 - RNA, 18 nt, Artificial Sequence
  Description of Artificial Sequence: Synthetic oligonucleotide
cacaaaucagccaagacu

SEQ ID NO: 8739 - RNA, 18 nt, Artificial Sequence
  Description of Artificial Sequence: Synthetic oligonucleotide
cugcucacaaaucagcca

SEQ ID NO: 8740 - RNA, 18 nt, Artificial Sequence
  Description of Artificial Sequence: Synthetic oligonucleotide
cagcacugcucacaaauc

SEQ ID NO: 8741 - RNA, 18 nt, Artificial Sequence
  Description of Artificial Sequence: Synthetic oligonucleotide
ccaaacagcacugcucac

SEQ ID NO: 8742 - RNA, 18 nt, Artificial Sequence
  Description of Artificial Sequence: Synthetic oligonucleotide
cgccaccaaacagcacug

SEQ ID NO: 8743 - RNA, 18 nt, Artificial Sequence
  Description of Artificial Sequence: Synthetic oligonucleotide
auaggcgccaccaaacag

SEQ ID NO: 8744 - RNA, 18 nt, Artificial Sequence
  Description of Artificial Sequence: Synthetic oligonucleotide
aaaagauaggcgccacca

SEQ ID NO: 8745 - RNA, 18 nt, Artificial Sequence
  Description of Artificial Sequence: Synthetic oligonucleotide
ggaggaaaagauaggcgc

SEQ ID NO: 8746 - RNA, 18 nt, Artificial Sequence
  Description of Artificial Sequence: Synthetic oligonucleotide
gggaaggaggaaaagaua

SEQ ID NO: 8747 - RNA, 18 nt, Artificial Sequence
  Description of Artificial Sequence: Synthetic oligonucleotide
cagaagggaaggaggaaa

SEQ ID NO: 8748 - RNA, 18 nt, Artificial Sequence
  Description of Artificial Sequence: Synthetic oligonucleotide
aaaggcagaagggaagga

SEQ ID NO: 8749 - RNA, 18 nt, Artificial Sequence
  Description of Artificial Sequence: Synthetic oligonucleotide
agcuaaaaggcagaaggg

SEQ ID NO: 8750 - RNA, 18 nt, Artificial Sequence
  Description of Artificial Sequence: Synthetic oligonucleotide
aauuuagcuaaaaggcag

SEQ ID NO: 8751 - RNA, 18 nt, Artificial Sequence
  Description of Artificial Sequence: Synthetic oligonucleotide
gggaauuuagcuaaaagg

SEQ ID NO: 8752 - RNA, 18 nt, Artificial Sequence
  Description of Artificial Sequence: Synthetic oligonucleotide
gaaagggccaaucaaggg

SEQ ID NO: 8753 - RNA, 18 nt, Artificial Sequence
  Description of Artificial Sequence: Synthetic oligonucleotide
cuggagaaagggccaauc

SEQ ID NO: 8754 - RNA, 18 nt, Artificial Sequence
  Description of Artificial Sequence: Synthetic oligonucleotide
aauaucuggagaaagggc

SEQ ID NO: 8755 - RNA, 18 nt, Artificial Sequence
  Description of Artificial Sequence: Synthetic oligonucleotide
ugcucaauaucuggagaa

SEQ ID NO: 8756 - RNA, 18 nt, Artificial Sequence
  Description of Artificial Sequence: Synthetic oligonucleotide
uucccugcucaauaucug

SEQ ID NO: 8757 - RNA, 18 nt, Artificial Sequence
  Description of Artificial Sequence: Synthetic oligonucleotide
cuauauucccugcucaau

SEQ ID NO: 8758 - RNA, 18 nt, Artificial Sequence
  Description of Artificial Sequence: Synthetic oligonucleotide
aaggucuauauucccugc

SEQ ID NO: 8759 - RNA, 18 nt, Artificial Sequence
  Description of Artificial Sequence: Synthetic oligonucleotide
gguccaaggucuauauuc

SEQ ID NO: 8760 - RNA, 18 nt, Artificial Sequence
  Description of Artificial Sequence: Synthetic oligonucleotide
uggcugguccaaggucua

SEQ ID NO: 8761 - RNA, 18 nt, Artificial Sequence
  Description of Artificial Sequence: Synthetic oligonucleotide
gauucuggcugguccaag

SEQ ID NO: 8762 - RNA, 18 nt, Artificial Sequence
  Description of Artificial Sequence: Synthetic oligonucleotide
gccaagauucuggcuggu

SEQ ID NO: 8763 - RNA, 18 nt, Artificial Sequence
  Description of Artificial Sequence: Synthetic oligonucleotide
guucagccaagauucugg

SEQ ID NO: 8764 - RNA, 18 nt, Artificial Sequence
  Description of Artificial Sequence: Synthetic oligonucleotide
cccuuguucagccaagau

SEQ ID NO: 8765 - RNA, 18 nt, Artificial Sequence
  Description of Artificial Sequence: Synthetic oligonucleotide
ccucccccuuguucagcc

SEQ ID NO: 8766 - RNA, 18 nt, Artificial Sequence
  Description of Artificial Sequence: Synthetic oligonucleotide
gucaaccucccccuuguu

SEQ ID NO: 8767 - RNA, 18 nt, Artificial Sequence
  Description of Artificial Sequence: Synthetic oligonucleotide
acagagucaaccuccccc

SEQ ID NO: 8768 - RNA, 18 nt, Artificial Sequence
  Description of Artificial Sequence: Synthetic oligonucleotide
agccaacagagucaaccu

SEQ ID NO: 8769 - RNA, 18 nt, Artificial Sequence
  Description of Artificial Sequence: Synthetic oligonucleotide
auuacagccaacagaguc

SEQ ID NO: 8770 - RNA, 18 nt, Artificial Sequence
  Description of Artificial Sequence: Synthetic oligonucleotide
gcuucauuacagccaaca

SEQ ID NO: 8771 - RNA, 18 nt, Artificial Sequence
  Description of Artificial Sequence: Synthetic oligonucleotide
aagaagcuucauuacagc

SEQ ID NO: 8772 - RNA, 18 nt, Artificial Sequence
  Description of Artificial Sequence: Synthetic oligonucleotide
uucuaaagaagcuucauu

SEQ ID NO: 8773 - RNA, 18 nt, Artificial Sequence
  Description of Artificial Sequence: Synthetic oligonucleotide
aucauuucuaaagaagcu

SEQ ID NO: 8774 - RNA, 18 nt, Artificial Sequence
  Description of Artificial Sequence: Synthetic oligonucleotide
aaccaaucauuucuaaag

SEQ ID NO: 8775 - RNA, 18 nt, Artificial Sequence
  Description of Artificial Sequence: Synthetic oligonucleotide
gccaaaaccaaucauuuc

SEQ ID NO: 8776 - RNA, 18 nt, Artificial Sequence
  Description of Artificial Sequence: Synthetic oligonucleotide
guacggccaaaaccaauc

SEQ ID NO: 8777 - RNA, 18 nt, Artificial Sequence
  Description of Artificial Sequence: Synthetic oligonucleotide
accgcguacggccaaaac

SEQ ID NO: 8778 - RNA, 18 nt, Artificial Sequence
  Description of Artificial Sequence: Synthetic oligonucleotide
gagccaccgcguacggcc

SEQ ID NO: 8779 - RNA, 18 nt, Artificial Sequence
  Description of Artificial Sequence: Synthetic oligonucleotide
ggcaugagccaccgcgua

SEQ ID NO: 8780 - RNA, 18 nt, Artificial Sequence
  Description of Artificial Sequence: Synthetic oligonucleotide
uuacaggcaugagccacc

SEQ ID NO: 8781 - RNA, 18 nt, Artificial Sequence
  Description of Artificial Sequence: Synthetic oligonucleotide
ugggauuacaggcaugag

SEQ ID NO: 8782 - RNA, 18 nt, Artificial Sequence
  Description of Artificial Sequence: Synthetic oligonucleotide
agugcugggauuacaggc

SEQ ID NO: 8783 - RNA, 18 nt, Artificial Sequence
  Description of Artificial Sequence: Synthetic oligonucleotide
caaaaagugcugggauua

SEQ ID NO: 8784 - RNA, 18 nt, Artificial Sequence
  Description of Artificial Sequence: Synthetic oligonucleotide
ggccucaaaaagugcugg

SEQ ID NO: 8785 - RNA, 18 nt, Artificial Sequence
  Description of Artificial Sequence: Synthetic oligonucleotide
gccucggccucaaaaagu

SEQ ID NO: 8786 - RNA, 18 nt, Artificial Sequence
  Description of Artificial Sequence: Synthetic oligonucleotide
ugccugccucggccucaa

SEQ ID NO: 8787 - RNA, 18 nt, Artificial Sequence
  Description of Artificial Sequence: Synthetic oligonucleotide
ugauaugccugccucggc

SEQ ID NO: 8788 - RNA, 18 nt, Artificial Sequence
  Description of Artificial Sequence: Synthetic oligonucleotide
ccucgugauaugccugcc

SEQ ID NO: 8789 - RNA, 18 nt, Artificial Sequence
  Description of Artificial Sequence: Synthetic oligonucleotide
ccugaccucgugauaugc

SEQ ID NO: 8790 - RNA, 18 nt, Artificial Sequence
  Description of Artificial Sequence: Synthetic oligonucleotide
aaacuccugaccucguga

SEQ ID NO: 8791 - RNA, 18 nt, Artificial Sequence
  Description of Artificial Sequence: Synthetic oligonucleotide
gucucaaacuccugaccu

SEQ ID NO: 8792 - RNA, 18 nt, Artificial Sequence
  Description of Artificial Sequence: Synthetic oligonucleotide
ggcuggucucaaacuccu

SEQ ID NO: 8793 - RNA, 18 nt, Artificial Sequence
  Description of Artificial Sequence: Synthetic oligonucleotide
ggccaggcuggucucaaa

SEQ ID NO: 8794 - RNA, 18 nt, Artificial Sequence
  Description of Artificial Sequence: Synthetic oligonucleotide
auguuggccaggcugguc

SEQ ID NO: 8795 - RNA, 18 nt, Artificial Sequence
  Description of Artificial Sequence: Synthetic oligonucleotide
ucaccauguuggccaggc

SEQ ID NO: 8796 - RNA, 18 nt, Artificial Sequence
  Description of Artificial Sequence: Synthetic oligonucleotide
ggguuucaccauguuggc

SEQ ID NO: 8797 - RNA, 18 nt, Artificial Sequence
  Description of Artificial Sequence: Synthetic oligonucleotide
agacaggguuucaccaug

SEQ ID NO: 8798 - RNA, 18 nt, Artificial Sequence
  Description of Artificial Sequence: Synthetic oligonucleotide
aguagagacaggguuuca

SEQ ID NO: 8799 - RNA, 18 nt, Artificial Sequence
  Description of Artificial Sequence: Synthetic oligonucleotide
uuuuuaguagagacaggg

SEQ ID NO: 8800 - RNA, 18 nt, Artificial Sequence
  Description of Artificial Sequence: Synthetic oligonucleotide
uuguauuuuuaguagaga

SEQ ID NO: 8801 - RNA, 18 nt, Artificial Sequence
  Description of Artificial Sequence: Synthetic oligonucleotide
aauuuuuguauuuuuagu

SEQ ID NO: 8802 - RNA, 18 nt, Artificial Sequence
  Description of Artificial Sequence: Synthetic oligonucleotide
cagcuaauuuuuguauuu

SEQ ID NO: 8803 - RNA, 18 nt, Artificial Sequence
  Description of Artificial Sequence: Synthetic oligonucleotide
acgcccagcuaauuuuug

SEQ ID NO: 8804 - RNA, 18 nt, Artificial Sequence
  Description of Artificial Sequence: Synthetic oligonucleotide
ccaccacgcccagcuaau

SEQ ID NO: 8805 - RNA, 18 nt, Artificial Sequence
  Description of Artificial Sequence: Synthetic oligonucleotide
gcacgccaccacgcccag

SEQ ID NO: 8806 - RNA, 18 nt, Artificial Sequence
  Description of Artificial Sequence: Synthetic oligonucleotide
caggugcacgccaccacg

SEQ ID NO: 8807 - RNA, 18 nt, Artificial Sequence
  Description of Artificial Sequence: Synthetic oligonucleotide
gacuacaggugcacgcca

SEQ ID NO: 8808 - RNA, 18 nt, Artificial Sequence
  Description of Artificial Sequence: Synthetic oligonucleotide
gcugggacuacaggugca

SEQ ID NO: 8809 - RNA, 18 nt, Artificial Sequence
  Description of Artificial Sequence: Synthetic oligonucleotide
gaguagcugggacuacag

SEQ ID NO: 8810 - RNA, 18 nt, Artificial Sequence
  Description of Artificial Sequence: Synthetic oligonucleotide
uuccugaguagcugggac

SEQ ID NO: 8811 - RNA, 18 nt, Artificial Sequence
  Description of Artificial Sequence: Synthetic oligonucleotide
ucagcuuccugaguagcu

SEQ ID NO: 8812 - RNA, 18 nt, Artificial Sequence
  Description of Artificial Sequence: Synthetic oligonucleotide
cugucucagcuuccugag

SEQ ID NO: 8813 - RNA, 18 nt, Artificial Sequence
  Description of Artificial Sequence: Synthetic oligonucleotide
uucuccugucucagcuuc

SEQ ID NO: 8814 - RNA, 18 nt, Artificial Sequence
  Description of Artificial Sequence: Synthetic oligonucleotide
agugauucuccugucuca

SEQ ID NO: 8815 - RNA, 18 nt, Artificial Sequence
  Description of Artificial Sequence: Synthetic oligonucleotide
guucaagugauucuccug

SEQ ID NO: 8816 - RNA, 18 nt, Artificial Sequence
  Description of Artificial Sequence: Synthetic oligonucleotide
ccuggguucaagugauuc

SEQ ID NO: 8817 - RNA, 18 nt, Artificial Sequence
  Description of Artificial Sequence: Synthetic oligonucleotide
ugccuccuggguucaagu

SEQ ID NO: 8818 - RNA, 18 nt, Artificial Sequence
  Description of Artificial Sequence: Synthetic oligonucleotide
accucugccuccuggguu

SEQ ID NO: 8819 - RNA, 18 nt, Artificial Sequence
  Description of Artificial Sequence: Synthetic oligonucleotide
cugcaaccucugccuccu

SEQ ID NO: 8820 - RNA, 18 nt, Artificial Sequence
  Description of Artificial Sequence: Synthetic oligonucleotide
guucacugcaaccucugc

SEQ ID NO: 8821 - RNA, 18 nt, Artificial Sequence
  Description of Artificial Sequence: Synthetic oligonucleotide
ucucaguucacugcaacc

SEQ ID NO: 8822 - RNA, 18 nt, Artificial Sequence
  Description of Artificial Sequence: Synthetic oligonucleotide
cgcaaucucaguucacug

SEQ ID NO: 8823 - RNA, 18 nt, Artificial Sequence
  Description of Artificial Sequence: Synthetic oligonucleotide
aguggcgcaaucucaguu

SEQ ID NO: 8824 - RNA, 18 nt, Artificial Sequence
  Description of Artificial Sequence: Synthetic oligonucleotide
agugcaguggcgcaaucu

SEQ ID NO: 8825 - RNA, 18 nt, Artificial Sequence
  Description of Artificial Sequence: Synthetic oligonucleotide
uuugucccuagaccuaua

SEQ ID NO: 8826 - RNA, 18 nt, Artificial Sequence
  Description of Artificial Sequence: Synthetic oligonucleotide
cugcuuuugucccuagac

SEQ ID NO: 8827 - RNA, 18 nt, Artificial Sequence
  Description of Artificial Sequence: Synthetic oligonucleotide
guggccugcuuuuguccc

SEQ ID NO: 8828 - RNA, 18 nt, Artificial Sequence
  Description of Artificial Sequence: Synthetic oligonucleotide
uaucaguggccugcuuuu

SEQ ID NO: 8829 - RNA, 18 nt, Artificial Sequence
  Description of Artificial Sequence: Synthetic oligonucleotide
ccacuuaucaguggccug

SEQ ID NO: 8830 - RNA, 18 nt, Artificial Sequence
  Description of Artificial Sequence: Synthetic oligonucleotide
aucugccacuuaucagug

SEQ ID NO: 8831 - RNA, 18 nt, Artificial Sequence
  Description of Artificial Sequence: Synthetic oligonucleotide
caggcaucugccacuuau

SEQ ID NO: 8832 - RNA, 18 nt, Artificial Sequence
  Description of Artificial Sequence: Synthetic oligonucleotide
gggaucaggcaucugcca

SEQ ID NO: 8833 - RNA, 18 nt, Artificial Sequence
  Description of Artificial Sequence: Synthetic oligonucleotide
acuccccacuaccuaggg

SEQ ID NO: 8834 - RNA, 18 nt, Artificial Sequence
  Description of Artificial Sequence: Synthetic oligonucleotide
ucacacuccccacuaccu

SEQ ID NO: 8835 - RNA, 18 nt, Artificial Sequence
  Description of Artificial Sequence: Synthetic oligonucleotide
cagucucacacuccccac

SEQ ID NO: 8836 - RNA, 18 nt, Artificial Sequence
  Description of Artificial Sequence: Synthetic oligonucleotide
uaacccagucucacacuc

SEQ ID NO: 8837 - RNA, 18 nt, Artificial Sequence
  Description of Artificial Sequence: Synthetic oligonucleotide
ucuuauaacccagucuca

SEQ ID NO: 8838 - RNA, 18 nt, Artificial Sequence
  Description of Artificial Sequence: Synthetic oligonucleotide
aggcuucuuauaacccag

SEQ ID NO: 8839 - RNA, 18 nt, Artificial Sequence
  Description of Artificial Sequence: Synthetic oligonucleotide
agugaaggcuucuuauaa

SEQ ID NO: 8840 - RNA, 18 nt, Artificial Sequence
  Description of Artificial Sequence: Synthetic oligonucleotide
aagauagugaaggcuucu

SEQ ID NO: 8841 - RNA, 18 nt, Artificial Sequence
  Description of Artificial Sequence: Synthetic oligonucleotide
ccuaaaagauagugaagg

SEQ ID NO: 8842 - RNA, 18 nt, Artificial Sequence
  Description of Artificial Sequence: Synthetic oligonucleotide
aggguccuaaaagauagu

SEQ ID NO: 8843 - RNA, 18 nt, Artificial Sequence
  Description of Artificial Sequence: Synthetic oligonucleotide
aagggaggguccuaaaag

SEQ ID NO: 8844 - RNA, 18 nt, Artificial Sequence
  Description of Artificial Sequence: Synthetic oligonucleotide
uccucaagggaggguccu

SEQ ID NO: 8845 - RNA, 18 nt, Artificial Sequence
  Description of Artificial Sequence: Synthetic oligonucleotide
uggccuccucaagggagg

SEQ ID NO: 8846 - RNA, 18 nt, Artificial Sequence
  Description of Artificial Sequence: Synthetic oligonucleotide
uagacuggccuccucaag

SEQ ID NO: 8847 - RNA, 18 nt, Artificial Sequence
  Description of Artificial Sequence: Synthetic oligonucleotide
ugugguagacuggccucc

SEQ ID NO: 8848 - RNA, 18 nt, Artificial Sequence
  Description of Artificial Sequence: Synthetic oligonucleotide
gcaauugugguagacugg

SEQ ID NO: 8849 - RNA, 18 nt, Artificial Sequence
  Description of Artificial Sequence: Synthetic oligonucleotide
cuaaagcaauugugguag

SEQ ID NO: 8850 - RNA, 18 nt, Artificial Sequence
  Description of Artificial Sequence: Synthetic oligonucleotide
ucauucuaaagcaauugu

SEQ ID NO: 8851 - RNA, 18 nt, Artificial Sequence
  Description of Artificial Sequence: Synthetic oligonucleotide
gaccuucauucuaaagca

SEQ ID NO: 8852 - RNA, 18 nt, Artificial Sequence
  Description of Artificial Sequence: Synthetic oligonucleotide
caaaagaccuucauucua

SEQ ID NO: 8853 - RNA, 18 nt, Artificial Sequence
  Description of Artificial Sequence: Synthetic oligonucleotide
gcaaccaaaagaccuuca

SEQ ID NO: 8854 - RNA, 18 nt, Artificial Sequence
  Description of Artificial Sequence: Synthetic oligonucleotide
ugugagcaaccaaaagac

SEQ ID NO: 8855 - RNA, 18 nt, Artificial Sequence
  Description of Artificial Sequence: Synthetic oligonucleotide
agucuugugagcaaccaa

SEQ ID NO: 8856 - RNA, 18 nt, Artificial Sequence
  Description of Artificial Sequence: Synthetic oligonucleotide
auuauagucuugugagca

SEQ ID NO: 8857 - RNA, 18 nt, Artificial Sequence
  Description of Artificial Sequence: Synthetic oligonucleotide
uuaccauuauagucuugu

SEQ ID NO: 8858 - RNA, 18 nt, Artificial Sequence
  Description of Artificial Sequence: Synthetic oligonucleotide
aaaaauuaccauuauagu

SEQ ID NO: 8859 - RNA, 18 nt, Artificial Sequence
  Description of Artificial Sequence: Synthetic oligonucleotide
gagccaaaaauuaccauu

SEQ ID NO: 8860 - RNA, 18 nt, Artificial Sequence
  Description of Artificial Sequence: Synthetic oligonucleotide
augaugagccaaaaauua

SEQ ID NO: 8861 - RNA, 18 nt, Artificial Sequence
  Description of Artificial Sequence: Synthetic oligonucleotide
caaaaaugaugagccaaa

SEQ ID NO: 8862 - RNA, 18 nt, Artificial Sequence
  Description of Artificial Sequence: Synthetic oligonucleotide
acacacaaaaaugaugag

SEQ ID NO: 8863 - RNA, 18 nt, Artificial Sequence
  Description of Artificial Sequence: Synthetic oligonucleotide
cccacacacacaaaaaug

SEQ ID NO: 8864 - RNA, 18 nt, Artificial Sequence
  Description of Artificial Sequence: Synthetic oligonucleotide
uaaaacccacacacacaa

SEQ ID NO: 8865 - RNA, 18 nt, Artificial Sequence
  Description of Artificial Sequence: Synthetic oligonucleotide
uaagauaaaacccacaca

SEQ ID NO: 8866 - RNA, 18 nt, Artificial Sequence
  Description of Artificial Sequence: Synthetic oligonucleotide
ugaauuaagauaaaaccc

SEQ ID NO: 8867 - RNA, 18 nt, Artificial Sequence
  Description of Artificial Sequence: Synthetic oligonucleotide
aacaaugaauuaagauaa

SEQ ID NO: 8868 - RNA, 18 nt, Artificial Sequence
  Description of Artificial Sequence: Synthetic oligonucleotide
ucuuuaacaaugaauuaa

SEQ ID NO: 8869 - RNA, 18 nt, Artificial Sequence
  Description of Artificial Sequence: Synthetic oligonucleotide
cuaucucuuuaacaauga

SEQ ID NO: 8870 - RNA, 18 nt, Artificial Sequence
  Description of Artificial Sequence: Synthetic oligonucleotide
acccacuaucucuuuaac

SEQ ID NO: 8871 - RNA, 18 nt, Artificial Sequence
  Description of Artificial Sequence: Synthetic oligonucleotide
gggaaacccacuaucucu

SEQ ID NO: 8872 - RNA, 18 nt, Artificial Sequence
  Description of Artificial Sequence: Synthetic oligonucleotide
uaggaaacuagcucaggg

SEQ ID NO: 8873 - RNA, 18 nt, Artificial Sequence
  Description of Artificial Sequence: Synthetic oligonucleotide
ugauaggaaacuagcuca

SEQ ID NO: 8874 - RNA, 18 nt, Artificial Sequence
  Description of Artificial Sequence: Synthetic oligonucleotide
acagaugauaggaaacua

SEQ ID NO: 8875 - RNA, 18 nt, Artificial Sequence
  Description of Artificial Sequence: Synthetic oligonucleotide
uaggcacagaugauagga

SEQ ID NO: 8876 - RNA, 18 nt, Artificial Sequence
  Description of Artificial Sequence: Synthetic oligonucleotide
aaacauaggcacagauga

SEQ ID NO: 8877 - RNA, 18 nt, Artificial Sequence
  Description of Artificial Sequence: Synthetic oligonucleotide
gaagcaaacauaggcaca

SEQ ID NO: 8878 - RNA, 18 nt, Artificial Sequence
  Description of Artificial Sequence: Synthetic oligonucleotide
ucagugaagcaaacauag

SEQ ID NO: 8879 - RNA, 18 nt, Artificial Sequence
  Description of Artificial Sequence: Synthetic oligonucleotide
auagcucagugaagcaaa

SEQ ID NO: 8880 - RNA, 18 nt, Artificial Sequence
  Description of Artificial Sequence: Synthetic oligonucleotide
uccccauagcucagugaa

SEQ ID NO: 8881 - RNA, 18 nt, Artificial Sequence
  Description of Artificial Sequence: Synthetic oligonucleotide
cucuuuccccauagcuca

SEQ ID NO: 8882 - RNA, 18 nt, Artificial Sequence
  Description of Artificial Sequence: Synthetic oligonucleotide
agugacucuuuccccaua

SEQ ID NO: 8883 - RNA, 18 nt, Artificial Sequence
  Description of Artificial Sequence: Synthetic oligonucleotide
cagccagugacucuuucc

SEQ ID NO: 8884 - RNA, 18 nt, Artificial Sequence
  Description of Artificial Sequence: Synthetic oligonucleotide
caaagcagccagugacuc

SEQ ID NO: 8885 - RNA, 18 nt, Artificial Sequence
  Description of Artificial Sequence: Synthetic oligonucleotide
guaaacaaagcagccagu

SEQ ID NO: 8886 - RNA, 18 nt, Artificial Sequence
  Description of Artificial Sequence: Synthetic oligonucleotide
uuuuuguaaacaaagcag

SEQ ID NO: 8887 - RNA, 18 nt, Artificial Sequence
  Description of Artificial Sequence: Synthetic oligonucleotide
cuuucuuuuuguaaacaa

SEQ ID NO: 8888 - RNA, 18 nt, Artificial Sequence
  Description of Artificial Sequence: Synthetic oligonucleotide
cuguccuuucuuuuugua

SEQ ID NO: 8889 - RNA, 18 nt, Artificial Sequence
  Description of Artificial Sequence: Synthetic oligonucleotide
ucagccuguccuuucuuu

SEQ ID NO: 8890 - RNA, 18 nt, Artificial Sequence
  Description of Artificial Sequence: Synthetic oligonucleotide
aaggcucagccuguccuu

SEQ ID NO: 8891 - RNA, 18 nt, Artificial Sequence
  Description of Artificial Sequence: Synthetic oligonucleotide
uccuuaaggcucagccug

SEQ ID NO: 8892 - RNA, 18 nt, Artificial Sequence
  Description of Artificial Sequence: Synthetic oligonucleotide
ccuacuccuuaaggcuca

SEQ ID NO: 8893 - RNA, 18 nt, Artificial Sequence
  Description of Artificial Sequence: Synthetic oligonucleotide
uccuuccuacuccuuaag

SEQ ID NO: 8894 - RNA, 18 nt, Artificial Sequence
  Description of Artificial Sequence: Synthetic oligonucleotide
ggaacuccuuccuacucc

SEQ ID NO: 8895 - RNA, 18 nt, Artificial Sequence
  Description of Artificial Sequence: Synthetic oligonucleotide
gccaaggaacuccuuccu

SEQ ID NO: 8896 - RNA, 18 nt, Artificial Sequence
  Description of Artificial Sequence: Synthetic oligonucleotide
gguaggccaaggaacucc

SEQ ID NO: 8897 - RNA, 18 nt, Artificial Sequence
  Description of Artificial Sequence: Synthetic oligonucleotide
ugaaggguaggccaagga

SEQ ID NO: 8898 - RNA, 18 nt, Artificial Sequence
  Description of Artificial Sequence: Synthetic oligonucleotide
ggagaugaaggguaggcc

SEQ ID NO: 8899 - RNA, 18 nt, Artificial Sequence
  Description of Artificial Sequence: Synthetic oligonucleotide
cuuguggagaugaagggu

SEQ ID NO: 8900 - RNA, 18 nt, Artificial Sequence
  Description of Artificial Sequence: Synthetic oligonucleotide
uuucacuuguggagauga

SEQ ID NO: 8901 - RNA, 18 nt, Artificial Sequence
  Description of Artificial Sequence: Synthetic oligonucleotide
gggcuuuucacuugugga

SEQ ID NO: 8902 - RNA, 18 nt, Artificial Sequence
  Description of Artificial Sequence: Synthetic oligonucleotide
uuucugcuacgcuaaggg

SEQ ID NO: 8903 - RNA, 18 nt, Artificial Sequence
  Description of Artificial Sequence: Synthetic oligonucleotide
auuuucugcuacgcuaag

SEQ ID NO: 8904 - RNA, 18 nt, Artificial Sequence
  Description of Artificial Sequence: Synthetic oligonucleotide
cuggaauuuucugcuacg

SEQ ID NO: 8905 - RNA, 18 nt, Artificial Sequence
  Description of Artificial Sequence: Synthetic oligonucleotide
ucaaccuggaauuuucug

SEQ ID NO: 8906 - RNA, 18 nt, Artificial Sequence
  Description of Artificial Sequence: Synthetic oligonucleotide
gaccuucaaccuggaauu

SEQ ID NO: 8907 - RNA, 18 nt, Artificial Sequence
  Description of Artificial Sequence: Synthetic oligonucleotide
aaagagaccuucaaccug

SEQ ID NO: 8908 - RNA, 18 nt, Artificial Sequence
  Description of Artificial Sequence: Synthetic oligonucleotide
ucuccaaagagaccuuca

SEQ ID NO: 8909 - RNA, 18 nt, Artificial Sequence
  Description of Artificial Sequence: Synthetic oligonucleotide
ugccuucuccaaagagac

SEQ ID NO: 8910 - RNA, 18 nt, Artificial Sequence
  Description of Artificial Sequence: Synthetic oligonucleotide
ccuucugccuucuccaaa

SEQ ID NO: 8911 - RNA, 18 nt, Artificial Sequence
  Description of Artificial Sequence: Synthetic oligonucleotide
ucacuccuucugccuucu

SEQ ID NO: 8912 - RNA, 18 nt, Artificial Sequence
  Description of Artificial Sequence: Synthetic oligonucleotide
cuaggucacuccuucugc

SEQ ID NO: 8913 - RNA, 18 nt, Artificial Sequence
  Description of Artificial Sequence: Synthetic oligonucleotide
ggagucuaggucacuccu

SEQ ID NO: 8914 - RNA, 18 nt, Artificial Sequence
  Description of Artificial Sequence: Synthetic oligonucleotide
gaacaggagucuagguca

SEQ ID NO: 8915 - RNA, 18 nt, Artificial Sequence
  Description of Artificial Sequence: Synthetic oligonucleotide
ugugugaacaggagucua

SEQ ID NO: 8916 - RNA, 18 nt, Artificial Sequence
  Description of Artificial Sequence: Synthetic oligonucleotide
uuagaugugugaacagga

SEQ ID NO: 8917 - RNA, 18 nt, Artificial Sequence
  Description of Artificial Sequence: Synthetic oligonucleotide
gacaaccuggaauuuaaa

SEQ ID NO: 8918 - RNA, 18 nt, Artificial Sequence
  Description of Artificial Sequence: Synthetic oligonucleotide
uugaugacaaccuggaau

SEQ ID NO: 8919 - RNA, 18 nt, Artificial Sequence
  Description of Artificial Sequence: Synthetic oligonucleotide
ggccauugaugacaaccu

SEQ ID NO: 8920 - RNA, 18 nt, Artificial Sequence
  Description of Artificial Sequence: Synthetic oligonucleotide
cucucggccauugaugac

SEQ ID NO: 8921 - RNA, 18 nt, Artificial Sequence
  Description of Artificial Sequence: Synthetic oligonucleotide
ggaaacucucggccauug

SEQ ID NO: 8922 - RNA, 18 nt, Artificial Sequence
  Description of Artificial Sequence: Synthetic oligonucleotide
gggaaacucucggccauu

SEQ ID NO: 8923 - RNA, 18 nt, Artificial Sequence
  Description of Artificial Sequence: Synthetic oligonucleotide
cuuccagcuucagcuggg

SEQ ID NO: 8924 - RNA, 18 nt, Artificial Sequence
  Description of Artificial Sequence: Synthetic oligonucleotide
ucuugcuuccagcuucag

SEQ ID NO: 8925 - RNA, 18 nt, Artificial Sequence
  Description of Artificial Sequence: Synthetic oligonucleotide
cacuuucuugcuuccagc

SEQ ID NO: 8926 - RNA, 18 nt, Artificial Sequence
  Description of Artificial Sequence: Synthetic oligonucleotide
uuggccacuuucuugcuu

SEQ ID NO: 8927 - RNA, 18 nt, Artificial Sequence
  Description of Artificial Sequence: Synthetic oligonucleotide
ccugcuuggccacuuucu

SEQ ID NO: 8928 - RNA, 18 nt, Artificial Sequence
  Description of Artificial Sequence: Synthetic oligonucleotide
ugcauccugcuuggccac

SEQ ID NO: 8929 - RNA, 18 nt, Artificial Sequence
  Description of Artificial Sequence: Synthetic oligonucleotide
auagcugcauccugcuug

SEQ ID NO: 8930 - RNA, 18 nt, Artificial Sequence
  Description of Artificial Sequence: Synthetic oligonucleotide
cuuucauagcugcauccu

SEQ ID NO: 8931 - RNA, 18 nt, Artificial Sequence
  Description of Artificial Sequence: Synthetic oligonucleotide
cauggcuuucauagcugc

SEQ ID NO: 8932 - RNA, 18 nt, Artificial Sequence
  Description of Artificial Sequence: Synthetic oligonucleotide
auugucauggcuuucaua

SEQ ID NO: 8933 - RNA, 18 nt, Artificial Sequence
  Description of Artificial Sequence: Synthetic oligonucleotide
gcagaauugucauggcuu

SEQ ID NO: 8934 - RNA, 18 nt, Artificial Sequence
  Description of Artificial Sequence: Synthetic oligonucleotide
cucuagcagaauugucau

SEQ ID NO: 8935 - RNA, 18 nt, Artificial Sequence
  Description of Artificial Sequence: Synthetic oligonucleotide
gcuuccucuagcagaauu

SEQ ID NO: 8936 - RNA, 18 nt, Artificial Sequence
  Description of Artificial Sequence: Synthetic oligonucleotide
cuuuggcuuccucuagca

SEQ ID NO: 8937 - RNA, 18 nt, Artificial Sequence
  Description of Artificial Sequence: Synthetic oligonucleotide
cuuggcuuuggcuuccuc

SEQ ID NO: 8938 - RNA, 18 nt, Artificial Sequence
  Description of Artificial Sequence: Synthetic oligonucleotide
cuguccuuggcuuuggcu

SEQ ID NO: 8939 - RNA, 18 nt, Artificial Sequence
  Description of Artificial Sequence: Synthetic oligonucleotide
uuccacuguccuuggcuu

SEQ ID NO: 8940 - RNA, 18 nt, Artificial Sequence
  Description of Artificial Sequence: Synthetic oligonucleotide
ugauuuuccacuguccuu

SEQ ID NO: 8941 - RNA, 18 nt, Artificial Sequence
  Description of Artificial Sequence: Synthetic oligonucleotide
ucuucugauuuuccacug

SEQ ID NO: 8942 - RNA, 18 nt, Artificial Sequence
  Description of Artificial Sequence: Synthetic oligonucleotide
augauucuucugauuuuc

SEQ ID NO: 8943 - RNA, 18 nt, Artificial Sequence
  Description of Artificial Sequence: Synthetic oligonucleotide
gugggaugauucuucuga

SEQ ID NO: 8944 - RNA, 18 nt, Artificial Sequence
  Description of Artificial Sequence: Synthetic oligonucleotide
gaauagugggaugauucu

SEQ ID NO: 8945 - RNA, 18 nt, Artificial Sequence
  Description of Artificial Sequence: Synthetic oligonucleotide
cuguggaauagugggaug

SEQ ID NO: 8946 - RNA, 18 nt, Artificial Sequence
  Description of Artificial Sequence: Synthetic oligonucleotide
uuucucuguggaauagug

SEQ ID NO: 8947 - RNA, 18 nt, Artificial Sequence
  Description of Artificial Sequence: Synthetic oligonucleotide
gauucuuucucuguggaa

SEQ ID NO: 8948 - RNA, 18 nt, Artificial Sequence
  Description of Artificial Sequence: Synthetic oligonucleotide
ucucugauucuuucucug

SEQ ID NO: 8949 - RNA, 18 nt, Artificial Sequence
  Description of Artificial Sequence: Synthetic oligonucleotide
ggcgcagaaccaccaggu

SEQ ID NO: 8950 - RNA, 18 nt, Artificial Sequence
  Description of Artificial Sequence: Synthetic oligonucleotide
gggaaggcgcagaaccac

SEQ ID NO: 8951 - RNA, 18 nt, Artificial Sequence
  Description of Artificial Sequence: Synthetic oligonucleotide
gaugaggaggcuguaggg

SEQ ID NO: 8952 - RNA, 18 nt, Artificial Sequence
  Description of Artificial Sequence: Synthetic oligonucleotide
agaugaggaggcuguagg

SEQ ID NO: 8953 - RNA, 18 nt, Artificial Sequence
  Description of Artificial Sequence: Synthetic oligonucleotide
gaugaagaugaggaggcu

SEQ ID NO: 8954 - RNA, 18 nt, Artificial Sequence
  Description of Artificial Sequence: Synthetic oligonucleotide
ucauagaugaagaugagg

SEQ ID NO: 8955 - RNA, 18 nt, Artificial Sequence
  Description of Artificial Sequence: Synthetic oligonucleotide
ccucaucauagaugaaga

SEQ ID NO: 8956 - RNA, 18 nt, Artificial Sequence
  Description of Artificial Sequence: Synthetic oligonucleotide
ucggaccucaucauagau

SEQ ID NO: 8957 - RNA, 18 nt, Artificial Sequence
  Description of Artificial Sequence: Synthetic oligonucleotide
agcuuucggaccucauca

SEQ ID NO: 8958 - RNA, 18 nt, Artificial Sequence
  Description of Artificial Sequence: Synthetic oligonucleotide
ggaugagcuuucggaccu

SEQ ID NO: 8959 - RNA, 18 nt, Artificial Sequence
  Description of Artificial Sequence: Synthetic oligonucleotide
ccgcaggaugagcuuucg

SEQ ID NO: 8960 - RNA, 18 nt, Artificial Sequence
  Description of Artificial Sequence: Synthetic oligonucleotide
uaccgccgcaggaugagc

SEQ ID NO: 8961 - RNA, 18 nt, Artificial Sequence
  Description of Artificial Sequence: Synthetic oligonucleotide
caggauaccgccgcagga

SEQ ID NO: 8962 - RNA, 18 nt, Artificial Sequence
  Description of Artificial Sequence: Synthetic oligonucleotide
ggcuugcacuuugcuggg

SEQ ID NO: 8963 - RNA, 18 nt, Artificial Sequence
  Description of Artificial Sequence: Synthetic oligonucleotide
gggcuugcacuuugcugg

SEQ ID NO: 8964 - RNA, 18 nt, Artificial Sequence
  Description of Artificial Sequence: Synthetic oligonucleotide
ggaggagcuggugguggg

SEQ ID NO: 8965 - RNA, 18 nt, Artificial Sequence
  Description of Artificial Sequence: Synthetic oligonucleotide
uggagggaggagcuggug

SEQ ID NO: 8966 - RNA, 18 nt, Artificial Sequence
  Description of Artificial Sequence: Synthetic oligonucleotide
gguccuggagggaggagc

SEQ ID NO: 8967 - RNA, 18 nt, Artificial Sequence
  Description of Artificial Sequence: Synthetic oligonucleotide
cgugugguccuggaggga

SEQ ID NO: 8968 - RNA, 18 nt, Artificial Sequence
  Description of Artificial Sequence: Synthetic oligonucleotide
gucugcgugugguccugg

SEQ ID NO: 8969 - RNA, 18 nt, Artificial Sequence
  Description of Artificial Sequence: Synthetic oligonucleotide
guggagucugcguguggu

SEQ ID NO: 8970 - RNA, 18 nt, Artificial Sequence
  Description of Artificial Sequence: Synthetic oligonucleotide
ugggaguggagucugcgu

SEQ ID NO: 8971 - RNA, 18 nt, Artificial Sequence
  Description of Artificial Sequence: Synthetic oligonucleotide
aguagugggaguggaguc

SEQ ID NO: 8972 - RNA, 18 nt, Artificial Sequence
  Description of Artificial Sequence: Synthetic oligonucleotide
gaaccaguagugggagug

SEQ ID NO: 8973 - RNA, 18 nt, Artificial Sequence
  Description of Artificial Sequence: Synthetic oligonucleotide
agcaggaaccaguagugg

SEQ ID NO: 8974 - RNA, 18 nt, Artificial Sequence
  Description of Artificial Sequence: Synthetic oligonucleotide
acagaagcaggaaccagu

SEQ ID NO: 8975 - RNA, 18 nt, Artificial Sequence
  Description of Artificial Sequence: Synthetic oligonucleotide
gaggaacagaagcaggaa

SEQ ID NO: 8976 - RNA, 18 nt, Artificial Sequence
  Description of Artificial Sequence: Synthetic oligonucleotide
guguugaggaacagaagc

SEQ ID NO: 8977 - RNA, 18 nt, Artificial Sequence
  Description of Artificial Sequence: Synthetic oligonucleotide
ugaggguguugaggaaca

SEQ ID NO: 8978 - RNA, 18 nt, Artificial Sequence
  Description of Artificial Sequence: Synthetic oligonucleotide
ggaucugaggguguugag

SEQ ID NO: 8979 - RNA, 18 nt, Artificial Sequence
  Description of Artificial Sequence: Synthetic oligonucleotide
ccccaggaucugagggug

SEQ ID NO: 8980 - RNA, 18 nt, Artificial Sequence
  Description of Artificial Sequence: Synthetic oligonucleotide
ugggaccccaggaucuga

SEQ ID NO: 8981 - RNA, 18 nt, Artificial Sequence
  Description of Artificial Sequence: Synthetic oligonucleotide
ggaccugggaccccagga

SEQ ID NO: 8982 - RNA, 18 nt, Artificial Sequence
  Description of Artificial Sequence: Synthetic oligonucleotide
uccugggaccugggaccc

SEQ ID NO: 8983 - RNA, 18 nt, Artificial Sequence
  Description of Artificial Sequence: Synthetic oligonucleotide
agggcuccugggaccugg

SEQ ID NO: 8984 - RNA, 18 nt, Artificial Sequence
  Description of Artificial Sequence: Synthetic oligonucleotide
gagucagggcuccuggga

SEQ ID NO: 8985 - RNA, 18 nt, Artificial Sequence
  Description of Artificial Sequence: Synthetic oligonucleotide
cgaaagagucagggcucc

SEQ ID NO: 8986 - RNA, 18 nt, Artificial Sequence
  Description of Artificial Sequence: Synthetic oligonucleotide
agguucgaaagagucagg

SEQ ID NO: 8987 - RNA, 18 nt, Artificial Sequence
  Description of Artificial Sequence: Synthetic oligonucleotide
acaacagguucgaaagag

SEQ ID NO: 8988 - RNA, 18 nt, Artificial Sequence
  Description of Artificial Sequence: Synthetic oligonucleotide
cagagacaacagguucga

SEQ ID NO: 8989 - RNA, 18 nt, Artificial Sequence
  Description of Artificial Sequence: Synthetic oligonucleotide
gagggcagagacaacagg

SEQ ID NO: 8990 - RNA, 18 nt, Artificial Sequence
  Description of Artificial Sequence: Synthetic oligonucleotide
gggaagagggcagagaca

SEQ ID NO: 8991 - RNA, 18 nt, Artificial Sequence
  Description of Artificial Sequence: Synthetic oligonucleotide
cugaugggaagagggcag

SEQ ID NO: 8992 - RNA, 18 nt, Artificial Sequence
  Description of Artificial Sequence: Synthetic oligonucleotide
agaaucugaugggaagag

SEQ ID NO: 8993 - RNA, 18 nt, Artificial Sequence
  Description of Artificial Sequence: Synthetic oligonucleotide
gguuuagaaucugauggg

SEQ ID NO: 8994 - RNA, 18 nt, Artificial Sequence
  Description of Artificial Sequence: Synthetic oligonucleotide
ggguuuagaaucugaugg

SEQ ID NO: 8995 - RNA, 18 nt, Artificial Sequence
  Description of Artificial Sequence: Synthetic oligonucleotide
aacugugaguuaggcggg

SEQ ID NO: 8996 - RNA, 18 nt, Artificial Sequence
  Description of Artificial Sequence: Synthetic oligonucleotide
agaccaacugugaguuag

SEQ ID NO: 8997 - RNA, 18 nt, Artificial Sequence
  Description of Artificial Sequence: Synthetic oligonucleotide
cucggagaccaacuguga

SEQ ID NO: 8998 - RNA, 18 nt, Artificial Sequence
  Description of Artificial Sequence: Synthetic oligonucleotide
agggccucggagaccaac

SEQ ID NO: 8999 - RNA, 18 nt, Artificial Sequence
  Description of Artificial Sequence: Synthetic oligonucleotide
gguggagggccucggaga

SEQ ID NO: 9000 - RNA, 18 nt, Artificial Sequence
  Description of Artificial Sequence: Synthetic oligonucleotide
uggaagguggagggccuc

SEQ ID NO: 9001 - RNA, 18 nt, Artificial Sequence
  Description of Artificial Sequence: Synthetic oligonucleotide
ucagguggaagguggagg

SEQ ID NO: 9002 - RNA, 18 nt, Artificial Sequence
  Description of Artificial Sequence: Synthetic oligonucleotide
ugguuucagguggaaggu

SEQ ID NO: 9003 - RNA, 18 nt, Artificial Sequence
  Description of Artificial Sequence: Synthetic oligonucleotide
uucugugguuucaggugg

SEQ ID NO: 9004 - RNA, 18 nt, Artificial Sequence
  Description of Artificial Sequence: Synthetic oligonucleotide
ugauguucugugguuuca

SEQ ID NO: 9005 - RNA, 18 nt, Artificial Sequence
  Description of Artificial Sequence: Synthetic oligonucleotide
aauucugauguucugugg

SEQ ID NO: 9006 - RNA, 18 nt, Artificial Sequence
  Description of Artificial Sequence: Synthetic oligonucleotide
cuucuaauucugauguuc

SEQ ID NO: 9007 - RNA, 18 nt, Artificial Sequence
  Description of Artificial Sequence: Synthetic oligonucleotide
aggcccuucuaauucuga

SEQ ID NO: 9008 - RNA, 18 nt, Artificial Sequence
  Description of Artificial Sequence: Synthetic oligonucleotide
uggaaaggcccuucuaau

SEQ ID NO: 9009 - RNA, 18 nt, Artificial Sequence
  Description of Artificial Sequence: Synthetic oligonucleotide
ugaccuggaaaggcccuu

SEQ ID NO: 9010 - RNA, 18 nt, Artificial Sequence
  Description of Artificial Sequence: Synthetic oligonucleotide
cuaggugaccuggaaagg

SEQ ID NO: 9011 - RNA, 18 nt, Artificial Sequence
  Description of Artificial Sequence: Synthetic oligonucleotide
ugggacuaggugaccugg

SEQ ID NO: 9012 - RNA, 18 nt, Artificial Sequence
  Description of Artificial Sequence: Synthetic oligonucleotide
ggacgugggacuagguga

SEQ ID NO: 9013 - RNA, 18 nt, Artificial Sequence
  Description of Artificial Sequence: Synthetic oligonucleotide
aauauggacgugggacua

SEQ ID NO: 9014 - RNA, 18 nt, Artificial Sequence
  Description of Artificial Sequence: Synthetic oligonucleotide
uguaaaauauggacgugg

SEQ ID NO: 9015 - RNA, 18 nt, Artificial Sequence
  Description of Artificial Sequence: Synthetic oligonucleotide
cuaucuguaaaauaugga

SEQ ID NO: 9016 - RNA, 18 nt, Artificial Sequence
  Description of Artificial Sequence: Synthetic oligonucleotide
cuccucuaucuguaaaau

SEQ ID NO: 9017 - RNA, 18 nt, Artificial Sequence
  Description of Artificial Sequence: Synthetic oligonucleotide
ugagccuccucuaucugu

SEQ ID NO: 9018 - RNA, 18 nt, Artificial Sequence
  Description of Artificial Sequence: Synthetic oligonucleotide
accucugagccuccucua

SEQ ID NO: 9019 - RNA, 18 nt, Artificial Sequence
  Description of Artificial Sequence: Synthetic oligonucleotide
gauucaccucugagccuc

SEQ ID NO: 9020 - RNA, 18 nt, Artificial Sequence
  Description of Artificial Sequence: Synthetic oligonucleotide
gaacagauucaccucuga

SEQ ID NO: 9021 - RNA, 18 nt, Artificial Sequence
  Description of Artificial Sequence: Synthetic oligonucleotide
acccugaacagauucacc

SEQ ID NO: 9022 - RNA, 18 nt, Artificial Sequence
  Description of Artificial Sequence: Synthetic oligonucleotide
uuacgacccugaacagau

SEQ ID NO: 9023 - RNA, 18 nt, Artificial Sequence
  Description of Artificial Sequence: Synthetic oligonucleotide
uugcuuuacgacccugaa

SEQ ID NO: 9024 - RNA, 18 nt, Artificial Sequence
  Description of Artificial Sequence: Synthetic oligonucleotide
auucuuugcuuuacgacc

SEQ ID NO: 9025 - RNA, 18 nt, Artificial Sequence
  Description of Artificial Sequence: Synthetic oligonucleotide
cugcuauucuuugcuuua

SEQ ID NO: 9026 - RNA, 18 nt, Artificial Sequence
  Description of Artificial Sequence: Synthetic oligonucleotide
caguccugcuauucuuug

SEQ ID NO: 9027 - RNA, 18 nt, Artificial Sequence
  Description of Artificial Sequence: Synthetic oligonucleotide
aguaccaguccugcuauu

SEQ ID NO: 9028 - RNA, 18 nt, Artificial Sequence
  Description of Artificial Sequence: Synthetic oligonucleotide
guucuaguaccaguccug

SEQ ID NO: 9029 - RNA, 18 nt, Artificial Sequence
  Description of Artificial Sequence: Synthetic oligonucleotide
ccuggguucuaguaccag

SEQ ID NO: 9030 - RNA, 18 nt, Artificial Sequence
  Description of Artificial Sequence: Synthetic oligonucleotide
ggaggccuggguucuagu

SEQ ID NO: 9031 - RNA, 18 nt, Artificial Sequence
  Description of Artificial Sequence: Synthetic oligonucleotide
gaucaggaggccuggguu

SEQ ID NO: 9032 - RNA, 18 nt, Artificial Sequence
  Description of Artificial Sequence: Synthetic oligonucleotide
gggaucaggaggccuggg

SEQ ID NO: 9033 - RNA, 18 nt, Artificial Sequence
  Description of Artificial Sequence: Synthetic oligonucleotide
ugucgguugaugaguggg

SEQ ID NO: 9034 - RNA, 18 nt, Artificial Sequence
  Description of Artificial Sequence: Synthetic oligonucleotide
uaacuugucgguugauga

SEQ ID NO: 9035 - RNA, 18 nt, Artificial Sequence
  Description of Artificial Sequence: Synthetic oligonucleotide
aacaauaacuugucgguu

SEQ ID NO: 9036 - RNA, 18 nt, Artificial Sequence
  Description of Artificial Sequence: Synthetic oligonucleotide
ggaaaaacaauaacuugu

SEQ ID NO: 9037 - RNA, 18 nt, Artificial Sequence
  Description of Artificial Sequence: Synthetic oligonucleotide
uuguaggaaaaacaauaa

SEQ ID NO: 9038 - RNA, 18 nt, Artificial Sequence
  Description of Artificial Sequence: Synthetic oligonucleotide
aacgcuuguaggaaaaac

SEQ ID NO: 9039 - RNA, 18 nt, Artificial Sequence
  Description of Artificial Sequence: Synthetic oligonucleotide
uaaaaaacgcuuguagga

SEQ ID NO: 9040 - RNA, 18 nt, Artificial Sequence
  Description of Artificial Sequence: Synthetic oligonucleotide
gugauuaaaaaacgcuug

SEQ ID NO: 9041 - RNA, 18 nt, Artificial Sequence
  Description of Artificial Sequence: Synthetic oligonucleotide
acuaagugauuaaaaaac

SEQ ID NO: 9042 - RNA, 18 nt, Artificial Sequence
  Description of Artificial Sequence: Synthetic oligonucleotide
ccucuacuaagugauuaa

SEQ ID NO: 9043 - RNA, 18 nt, Artificial Sequence
  Description of Artificial Sequence: Synthetic oligonucleotide
uuuaaccucuacuaagug

SEQ ID NO: 9044 - RNA, 18 nt, Artificial Sequence
  Description of Artificial Sequence: Synthetic oligonucleotide
cauauuuuaaccucuacu

SEQ ID NO: 9045 - RNA, 18 nt, Artificial Sequence
  Description of Artificial Sequence: Synthetic oligonucleotide
gccaucauauuuuaaccu

SEQ ID NO: 9046 - RNA, 18 nt, Artificial Sequence
  Description of Artificial Sequence: Synthetic oligonucleotide
uguaagccaucauauuuu

SEQ ID NO: 9047 - RNA, 18 nt, Artificial Sequence
  Description of Artificial Sequence: Synthetic oligonucleotide
ugguuuguaagccaucau

SEQ ID NO: 9048 - RNA, 18 nt, Artificial Sequence
  Description of Artificial Sequence: Synthetic oligonucleotide
guauuugguuuguaagcc

SEQ ID NO: 9049 - RNA, 18 nt, Artificial Sequence
  Description of Artificial Sequence: Synthetic oligonucleotide
ggacaguauuugguuugu

SEQ ID NO: 9050 - RNA, 18 nt, Artificial Sequence
  Description of Artificial Sequence: Synthetic oligonucleotide
uuccuggacaguauuugg

SEQ ID NO: 9051 - RNA, 18 nt, Artificial Sequence
  Description of Artificial Sequence: Synthetic oligonucleotide
caguauuccuggacagua

SEQ ID NO: 9052 - RNA, 18 nt, Artificial Sequence
  Description of Artificial Sequence: Synthetic oligonucleotide
ccaaacaguauuccugga

SEQ ID NO: 9053 - RNA, 18 nt, Artificial Sequence
  Description of Artificial Sequence: Synthetic oligonucleotide
ucaaaccaaacaguauuc

SEQ ID NO: 9054 - RNA, 18 nt, Artificial Sequence
  Description of Artificial Sequence: Synthetic oligonucleotide
ggaagggagggugaaccu

SEQ ID NO: 9055 - RNA, 18 nt, Artificial Sequence
  Description of Artificial Sequence: Synthetic oligonucleotide
uuaaaggaagggagggug

SEQ ID NO: 9056 - RNA, 18 nt, Artificial Sequence
  Description of Artificial Sequence: Synthetic oligonucleotide
auagguuaaaggaaggga

SEQ ID NO: 9057 - RNA, 18 nt, Artificial Sequence
  Description of Artificial Sequence: Synthetic oligonucleotide
gggccauagguuaaagga

SEQ ID NO: 9058 - RNA, 18 nt, Artificial Sequence
  Description of Artificial Sequence: Synthetic oligonucleotide
gagguccagugagcuggg

SEQ ID NO: 9059 - RNA, 18 nt, Artificial Sequence
  Description of Artificial Sequence: Synthetic oligonucleotide
aggagguccagugagcug

SEQ ID NO: 9060 - RNA, 18 nt, Artificial Sequence
  Description of Artificial Sequence: Synthetic oligonucleotide
ggagaaggagguccagug

SEQ ID NO: 9061 - RNA, 18 nt, Artificial Sequence
  Description of Artificial Sequence: Synthetic oligonucleotide
agggaggagaaggagguc

SEQ ID NO: 9062 - RNA, 18 nt, Artificial Sequence
  Description of Artificial Sequence: Synthetic oligonucleotide
gugaaagggaggagaagg

SEQ ID NO: 9063 - RNA, 18 nt, Artificial Sequence
  Description of Artificial Sequence: Synthetic oligonucleotide
agaaggugaaagggagga

SEQ ID NO: 9064 - RNA, 18 nt, Artificial Sequence
  Description of Artificial Sequence: Synthetic oligonucleotide
aaaaaagaaggugaaagg

SEQ ID NO: 9065 - RNA, 18 nt, Artificial Sequence
  Description of Artificial Sequence: Synthetic oligonucleotide
aaaaaaaaaaagaaggug

SEQ ID NO: 9066 - RNA, 18 nt, Artificial Sequence
  Description of Artificial Sequence: Synthetic oligonucleotide
aaaaaaaaaaaaaaaaga

SEQ ID NO: 9067 - RNA, 18 nt, Artificial Sequence
  Description of Artificial Sequence: Synthetic oligonucleotide
aaaaaaaaaaaaaaaaaa

SEQ ID NO: 9068 - RNA, 18 nt, Artificial Sequence
  Description of Artificial Sequence: Synthetic oligonucleotide
aaaaaaaaaaaaaaaaaa

SEQ ID NO: 9069 - RNA, 18 nt, Artificial Sequence
  Description of Artificial Sequence: Synthetic oligonucleotide
ucaaaaaaaaaaaaaaaa

SEQ ID NO: 9070 - RNA, 18 nt, Artificial Sequence
  Description of Artificial Sequence: Synthetic oligonucleotide
ccgucucaaaaaaaaaaa

SEQ ID NO: 9071 - RNA, 18 nt, Artificial Sequence
  Description of Artificial Sequence: Synthetic oligonucleotide
agacuccgucucaaaaaa

SEQ ID NO: 9072 - RNA, 18 nt, Artificial Sequence
  Description of Artificial Sequence: Synthetic oligonucleotide
gagcgagacuccgucuca

SEQ ID NO: 9073 - RNA, 18 nt, Artificial Sequence
  Description of Artificial Sequence: Synthetic oligonucleotide
cgacagagcgagacuccg

SEQ ID NO: 9074 - RNA, 18 nt, Artificial Sequence
  Description of Artificial Sequence: Synthetic oligonucleotide
uugggcgacagagcgaga

SEQ ID NO: 9075 - RNA, 18 nt, Artificial Sequence
  Description of Artificial Sequence: Synthetic oligonucleotide
ccugguugggcgacagag

SEQ ID NO: 9076 - RNA, 18 nt, Artificial Sequence
  Description of Artificial Sequence: Synthetic oligonucleotide
gcacuccugguugggcga

SEQ ID NO: 9077 - RNA, 18 nt, Artificial Sequence
  Description of Artificial Sequence: Synthetic oligonucleotide
gcacugcacuccugguug

SEQ ID NO: 9078 - RNA, 18 nt, Artificial Sequence
  Description of Artificial Sequence: Synthetic oligonucleotide
ccacugcacugcacuccu

SEQ ID NO: 9079 - RNA, 18 nt, Artificial Sequence
  Description of Artificial Sequence: Synthetic oligonucleotide
ucgugccacugcacugca

SEQ ID NO: 9080 - RNA, 18 nt, Artificial Sequence
  Description of Artificial Sequence: Synthetic oligonucleotide
cgagaucgugccacugca

SEQ ID NO: 9081 - RNA, 18 nt, Artificial Sequence
  Description of Artificial Sequence: Synthetic oligonucleotide
ugagccgagaucgugcca

SEQ ID NO: 9082 - RNA, 18 nt, Artificial Sequence
  Description of Artificial Sequence: Synthetic oligonucleotide
ugcagugagccgagaucg

SEQ ID NO: 9083 - RNA, 18 nt, Artificial Sequence
  Description of Artificial Sequence: Synthetic oligonucleotide
gagcuugcagugagccga

SEQ ID NO: 9084 - RNA, 18 nt, Artificial Sequence
  Description of Artificial Sequence: Synthetic oligonucleotide
aggcggagcuugcaguga

SEQ ID NO: 9085 - RNA, 18 nt, Artificial Sequence
  Description of Artificial Sequence: Synthetic oligonucleotide
ccaggaggcggagcuugc

SEQ ID NO: 9086 - RNA, 18 nt, Artificial Sequence
  Description of Artificial Sequence: Synthetic oligonucleotide
ugaacccaggaggcggag

SEQ ID NO: 9087 - RNA, 18 nt, Artificial Sequence
  Description of Artificial Sequence: Synthetic oligonucleotide
uugcuugaacccaggagg

SEQ ID NO: 9088 - RNA, 18 nt, Artificial Sequence
  Description of Artificial Sequence: Synthetic oligonucleotide
gagaauugcuugaaccca

SEQ ID NO: 9089 - RNA, 18 nt, Artificial Sequence
  Description of Artificial Sequence: Synthetic oligonucleotide
ggcaagagaauugcuuga

SEQ ID NO: 9090 - RNA, 18 nt, Artificial Sequence
  Description of Artificial Sequence: Synthetic oligonucleotide
gcugaggcaagagaauug

SEQ ID NO: 9091 - RNA, 18 nt, Artificial Sequence
  Description of Artificial Sequence: Synthetic oligonucleotide
uggaggcugaggcaagag

SEQ ID NO: 9092 - RNA, 18 nt, Artificial Sequence
  Description of Artificial Sequence: Synthetic oligonucleotide
uacucuggaggcugaggc

SEQ ID NO: 9093 - RNA, 18 nt, Artificial Sequence
  Description of Artificial Sequence: Synthetic oligonucleotide
ccagcuacucuggaggcu

SEQ ID NO: 9094 - RNA, 18 nt, Artificial Sequence
  Description of Artificial Sequence: Synthetic oligonucleotide
caaucccagcuacucugg

SEQ ID NO: 9095 - RNA, 18 nt, Artificial Sequence
  Description of Artificial Sequence: Synthetic oligonucleotide
gccugcaaucccagcuac

SEQ ID NO: 9096 - RNA, 18 nt, Artificial Sequence
  Description of Artificial Sequence: Synthetic oligonucleotide
caugcgccugcaauccca

SEQ ID NO: 9097 - RNA, 18 nt, Artificial Sequence
  Description of Artificial Sequence: Synthetic oligonucleotide
aguggcaugcgccugcaa

SEQ ID NO: 9098 - RNA, 18 nt, Artificial Sequence
  Description of Artificial Sequence: Synthetic oligonucleotide
ggcauaguggcaugcgcc

SEQ ID NO: 9099 - RNA, 18 nt, Artificial Sequence
  Description of Artificial Sequence: Synthetic oligonucleotide
agucgggcauaguggcau

SEQ ID NO: 9100 - RNA, 18 nt, Artificial Sequence
  Description of Artificial Sequence: Synthetic oligonucleotide
aaauuagucgggcauagu

SEQ ID NO: 9101 - RNA, 18 nt, Artificial Sequence
  Description of Artificial Sequence: Synthetic oligonucleotide
acaaaaaauuagucgggc

SEQ ID NO: 9102 - RNA, 18 nt, Artificial Sequence
  Description of Artificial Sequence: Synthetic oligonucleotide
aaaauacaaaaaauuagu

SEQ ID NO: 9103 - RNA, 18 nt, Artificial Sequence
  Description of Artificial Sequence: Synthetic oligonucleotide
uacuaaaaauacaaaaaa

SEQ ID NO: 9104 - RNA, 18 nt, Artificial Sequence
  Description of Artificial Sequence: Synthetic oligonucleotide
gucuguacuaaaaauaca

SEQ ID NO: 9105 - RNA, 18 nt, Artificial Sequence
  Description of Artificial Sequence: Synthetic oligonucleotide
acccugucuguacuaaaa

SEQ ID NO: 9106 - RNA, 18 nt, Artificial Sequence
  Description of Artificial Sequence: Synthetic oligonucleotide
gugaaacccugucuguac

SEQ ID NO: 9107 - RNA, 18 nt, Artificial Sequence
  Description of Artificial Sequence: Synthetic oligonucleotide
acccagugaaacccuguc

SEQ ID NO: 9108 - RNA, 18 nt, Artificial Sequence
  Description of Artificial Sequence: Synthetic oligonucleotide
ggcuaacccagugaaacc

SEQ ID NO: 9109 - RNA, 18 nt, Artificial Sequence
  Description of Artificial Sequence: Synthetic oligonucleotide
cuccuggcuaacccagug

SEQ ID NO: 9110 - RNA, 18 nt, Artificial Sequence
  Description of Artificial Sequence: Synthetic oligonucleotide
caagacuccuggcuaacc

SEQ ID NO: 9111 - RNA, 18 nt, Artificial Sequence
  Description of Artificial Sequence: Synthetic oligonucleotide
gagaucaagacuccuggc

SEQ ID NO: 9112 - RNA, 18 nt, Artificial Sequence
  Description of Artificial Sequence: Synthetic oligonucleotide
aggcggagaucaagacuc

SEQ ID NO: 9113 - RNA, 18 nt, Artificial Sequence
  Description of Artificial Sequence: Synthetic oligonucleotide
gaggcaggcggagaucaa

SEQ ID NO: 9114 - RNA, 18 nt, Artificial Sequence
  Description of Artificial Sequence: Synthetic oligonucleotide
aggcugaggcaggcggag

SEQ ID NO: 9115 - RNA, 18 nt, Artificial Sequence
  Description of Artificial Sequence: Synthetic oligonucleotide
cugggaggcugaggcagg

SEQ ID NO: 9116 - RNA, 18 nt, Artificial Sequence
  Description of Artificial Sequence: Synthetic oligonucleotide
gcauacugggaggcugag

SEQ ID NO: 9117 - RNA, 18 nt, Artificial Sequence
  Description of Artificial Sequence: Synthetic oligonucleotide
ucccagcauacugggagg

SEQ ID NO: 9118 - RNA, 18 nt, Artificial Sequence
  Description of Artificial Sequence: Synthetic oligonucleotide
uguaaucccagcauacug

SEQ ID NO: 9119 - RNA, 18 nt, Artificial Sequence
  Description of Artificial Sequence: Synthetic oligonucleotide
augccuguaaucccagca

SEQ ID NO: 9120 - RNA, 18 nt, Artificial Sequence
  Description of Artificial Sequence: Synthetic oligonucleotide
ggcucaugccuguaaucc

SEQ ID NO: 9121 - RNA, 18 nt, Artificial Sequence
  Description of Artificial Sequence: Synthetic oligonucleotide
gcaguggcucaugccugu

SEQ ID NO: 9122 - RNA, 18 nt, Artificial Sequence
  Description of Artificial Sequence: Synthetic oligonucleotide
ugggugcaguggcucaug

SEQ ID NO: 9123 - RNA, 18 nt, Artificial Sequence
  Description of Artificial Sequence: Synthetic oligonucleotide
gaggcugggugcaguggc

SEQ ID NO: 9124 - RNA, 18 nt, Artificial Sequence
  Description of Artificial Sequence: Synthetic oligonucleotide
ggaaggaggcugggugca

SEQ ID NO: 9125 - RNA, 18 nt, Artificial Sequence
  Description of Artificial Sequence: Synthetic oligonucleotide
aagguggaaggaggcugg

SEQ ID NO: 9126 - RNA, 18 nt, Artificial Sequence
  Description of Artificial Sequence: Synthetic oligonucleotide
uuaggaagguggaaggag

SEQ ID NO: 9127 - RNA, 18 nt, Artificial Sequence
  Description of Artificial Sequence: Synthetic oligonucleotide
guggcuuaggaaggugga

SEQ ID NO: 9128 - RNA, 18 nt, Artificial Sequence
  Description of Artificial Sequence: Synthetic oligonucleotide
gggaaguggcuuaggaag

SEQ ID NO: 9129 - RNA, 18 nt, Artificial Sequence
  Description of Artificial Sequence: Synthetic oligonucleotide
cuggugaagggcacuggg

SEQ ID NO: 9130 - RNA, 18 nt, Artificial Sequence
  Description of Artificial Sequence: Synthetic oligonucleotide
ccuggugaagggcacugg

SEQ ID NO: 9131 - RNA, 18 nt, Artificial Sequence
  Description of Artificial Sequence: Synthetic oligonucleotide
agaagccuggugaagggc

SEQ ID NO: 9132 - RNA, 18 nt, Artificial Sequence
  Description of Artificial Sequence: Synthetic oligonucleotide
gaaggagaagccugguga

SEQ ID NO: 9133 - RNA, 18 nt, Artificial Sequence
  Description of Artificial Sequence: Synthetic oligonucleotide
agguggaaggagaagccu

SEQ ID NO: 9134 - RNA, 18 nt, Artificial Sequence
  Description of Artificial Sequence: Synthetic oligonucleotide
aagccagguggaaggaga

SEQ ID NO: 9135 - RNA, 18 nt, Artificial Sequence
  Description of Artificial Sequence: Synthetic oligonucleotide
cgcugaagccagguggaa

SEQ ID NO: 9136 - RNA, 18 nt, Artificial Sequence
  Description of Artificial Sequence: Synthetic oligonucleotide
ugggucgcugaagccagg

SEQ ID NO: 9137 - RNA, 18 nt, Artificial Sequence
  Description of Artificial Sequence: Synthetic oligonucleotide
gggcuugggucgcugaag

SEQ ID NO: 9138 - RNA, 18 nt, Artificial Sequence
  Description of Artificial Sequence: Synthetic oligonucleotide
gagaucaauuuccuaggg

SEQ ID NO: 9139 - RNA, 18 nt, Artificial Sequence
  Description of Artificial Sequence: Synthetic oligonucleotide
aagagaucaauuuccuag

SEQ ID NO: 9140 - RNA, 18 nt, Artificial Sequence
  Description of Artificial Sequence: Synthetic oligonucleotide
gaggcaagagaucaauuu

SEQ ID NO: 9141 - RNA, 18 nt, Artificial Sequence
  Description of Artificial Sequence: Synthetic oligonucleotide
aaaaggaggcaagagauc

SEQ ID NO: 9142 - RNA, 18 nt, Artificial Sequence
  Description of Artificial Sequence: Synthetic oligonucleotide
agcuuaaaaggaggcaag

SEQ ID NO: 9143 - RNA, 18 nt, Artificial Sequence
  Description of Artificial Sequence: Synthetic oligonucleotide
gcaugagcuuaaaaggag

SEQ ID NO: 9144 - RNA, 18 nt, Artificial Sequence
  Description of Artificial Sequence: Synthetic oligonucleotide
uugcagcaugagcuuaaa

SEQ ID NO: 9145 - RNA, 18 nt, Artificial Sequence
  Description of Artificial Sequence: Synthetic oligonucleotide
ggagauugcagcaugagc

SEQ ID NO: 9146 - RNA, 18 nt, Artificial Sequence
  Description of Artificial Sequence: Synthetic oligonucleotide
ggaguggagauugcagca

SEQ ID NO: 9147 - RNA, 18 nt, Artificial Sequence
  Description of Artificial Sequence: Synthetic oligonucleotide
gucuccuucuccacccag

SEQ ID NO: 9148 - RNA, 18 nt, Artificial Sequence
  Description of Artificial Sequence: Synthetic oligonucleotide
aguaugucuccuucucca

SEQ ID NO: 9149 - RNA, 18 nt, Artificial Sequence
  Description of Artificial Sequence: Synthetic oligonucleotide
ucaguaguaugucuccuu

SEQ ID NO: 9150 - RNA, 18 nt, Artificial Sequence
  Description of Artificial Sequence: Synthetic oligonucleotide
gggucaguaguaugucuc

SEQ ID NO: 9151 - RNA, 18 nt, Artificial Sequence
  Description of Artificial Sequence: Synthetic oligonucleotide
gguucuucuuccaauggg

SEQ ID NO: 9152 - RNA, 18 nt, Artificial Sequence
  Description of Artificial Sequence: Synthetic oligonucleotide
ugccugguucuucuucca

SEQ ID NO: 9153 - RNA, 18 nt, Artificial Sequence
  Description of Artificial Sequence: Synthetic oligonucleotide
uuccaugccugguucuuc

SEQ ID NO: 9154 - RNA, 18 nt, Artificial Sequence
  Description of Artificial Sequence: Synthetic oligonucleotide
caucuuuccaugccuggu

SEQ ID NO: 9155 - RNA, 18 nt, Artificial Sequence
  Description of Artificial Sequence: Synthetic oligonucleotide
cuccccaucuuuccaugc

SEQ ID NO: 9156 - RNA, 18 nt, Artificial Sequence
  Description of Artificial Sequence: Synthetic oligonucleotide
cagagcuccccaucuuuc

SEQ ID NO: 9157 - RNA, 18 nt, Artificial Sequence
  Description of Artificial Sequence: Synthetic oligonucleotide
accuccagagcuccccau

SEQ ID NO: 9158 - RNA, 18 nt, Artificial Sequence
  Description of Artificial Sequence: Synthetic oligonucleotide
acaacaccuccagagcuc

SEQ ID NO: 9159 - RNA, 18 nt, Artificial Sequence
  Description of Artificial Sequence: Synthetic oligonucleotide
uccccacaacaccuccag

SEQ ID NO: 9160 - RNA, 18 nt, Artificial Sequence
  Description of Artificial Sequence: Synthetic oligonucleotide
caccauccccacaacacc

SEQ ID NO: 9161 - RNA, 18 nt, Artificial Sequence
  Description of Artificial Sequence: Synthetic oligonucleotide
uccaucaccauccccaca

SEQ ID NO: 9162 - RNA, 18 nt, Artificial Sequence
  Description of Artificial Sequence: Synthetic oligonucleotide
cccucuccaucaccaucc

SEQ ID NO: 9163 - RNA, 18 nt, Artificial Sequence
  Description of Artificial Sequence: Synthetic oligonucleotide
uccaucccucuccaucac

SEQ ID NO: 9164 - RNA, 18 nt, Artificial Sequence
  Description of Artificial Sequence: Synthetic oligonucleotide
uuauuuccaucccucucc

SEQ ID NO: 9165 - RNA, 18 nt, Artificial Sequence
  Description of Artificial Sequence: Synthetic oligonucleotide
acccguuauuuccauccc

SEQ ID NO: 9166 - RNA, 18 nt, Artificial Sequence
  Description of Artificial Sequence: Synthetic oligonucleotide
augccacccguuauuucc

SEQ ID NO: 9167 - RNA, 18 nt, Artificial Sequence
  Description of Artificial Sequence: Synthetic oligonucleotide
acccaaugccacccguua

SEQ ID NO: 9168 - RNA, 18 nt, Artificial Sequence
  Description of Artificial Sequence: Synthetic oligonucleotide
uugccacccaaugccacc

SEQ ID NO: 9169 - RNA, 18 nt, Artificial Sequence
  Description of Artificial Sequence: Synthetic oligonucleotide
aaauguugccacccaaug

SEQ ID NO: 9170 - RNA, 18 nt, Artificial Sequence
  Description of Artificial Sequence: Synthetic oligonucleotide
uccccaaauguugccacc

SEQ ID NO: 9171 - RNA, 18 nt, Artificial Sequence
  Description of Artificial Sequence: Synthetic oligonucleotide
aucucuccccaaauguug

SEQ ID NO: 9172 - RNA, 18 nt, Artificial Sequence
  Description of Artificial Sequence: Synthetic oligonucleotide
ucauuaucucuccccaaa

SEQ ID NO: 9173 - RNA, 18 nt, Artificial Sequence
  Description of Artificial Sequence: Synthetic oligonucleotide
uugccucauuaucucucc

SEQ ID NO: 9174 - RNA, 18 nt, Artificial Sequence
  Description of Artificial Sequence: Synthetic oligonucleotide
cugaguugccucauuauc

SEQ ID NO: 9175 - RNA, 18 nt, Artificial Sequence
  Description of Artificial Sequence: Synthetic oligonucleotide
gccugcugaguugccuca

SEQ ID NO: 9176 - RNA, 18 nt, Artificial Sequence
  Description of Artificial Sequence: Synthetic oligonucleotide
acuuagccugcugaguug

SEQ ID NO: 9177 - RNA, 18 nt, Artificial Sequence
  Description of Artificial Sequence: Synthetic oligonucleotide
ccgcaacuuagccugcug

SEQ ID NO: 9178 - RNA, 18 nt, Artificial Sequence
  Description of Artificial Sequence: Synthetic oligonucleotide
auaccccgcaacuuagcc

SEQ ID NO: 9179 - RNA, 18 nt, Artificial Sequence
  Description of Artificial Sequence: Synthetic oligonucleotide
uuuauauaccccgcaacu

SEQ ID NO: 9180 - RNA, 18 nt, Artificial Sequence
  Description of Artificial Sequence: Synthetic oligonucleotide
cccaauuuauauaccccg

SEQ ID NO: 9181 - RNA, 18 nt, Artificial Sequence
  Description of Artificial Sequence: Synthetic oligonucleotide
aucaccccaauuuauaua

SEQ ID NO: 9182 - RNA, 18 nt, Artificial Sequence
  Description of Artificial Sequence: Synthetic oligonucleotide
gggucaucaccccaauuu

SEQ ID NO: 9183 - RNA, 18 nt, Artificial Sequence
  Description of Artificial Sequence: Synthetic oligonucleotide
uguucacaguuaggucua

SEQ ID NO: 9184 - RNA, 18 nt, Artificial Sequence
  Description of Artificial Sequence: Synthetic oligonucleotide
cugauuguucacaguuag

SEQ ID NO: 9185 - RNA, 18 nt, Artificial Sequence
  Description of Artificial Sequence: Synthetic oligonucleotide
cuaaucugauuguucaca

SEQ ID NO: 9186 - RNA, 18 nt, Artificial Sequence
  Description of Artificial Sequence: Synthetic oligonucleotide
agugucuaaucugauugu

SEQ ID NO: 9187 - RNA, 18 nt, Artificial Sequence
  Description of Artificial Sequence: Synthetic oligonucleotide
cacauagugucuaaucug

SEQ ID NO: 9188 - RNA, 18 nt, Artificial Sequence
  Description of Artificial Sequence: Synthetic oligonucleotide
ucuaacacauagugucua

SEQ ID NO: 9189 - RNA, 18 nt, Artificial Sequence
  Description of Artificial Sequence: Synthetic oligonucleotide
gggacucuaacacauagu

SEQ ID NO: 9190 - RNA, 18 nt, Artificial Sequence
  Description of Artificial Sequence: Synthetic oligonucleotide
uggaaaaggaucuggucg

SEQ ID NO: 9191 - RNA, 18 nt, Artificial Sequence
  Description of Artificial Sequence: Synthetic oligonucleotide
ugggauggaaaaggaucu

SEQ ID NO: 9192 - RNA, 18 nt, Artificial Sequence
  Description of Artificial Sequence: Synthetic oligonucleotide
uggagugggauggaaaag

SEQ ID NO: 9193 - RNA, 18 nt, Artificial Sequence
  Description of Artificial Sequence: Synthetic oligonucleotide
cauaguggagugggaugg

SEQ ID NO: 9194 - RNA, 18 nt, Artificial Sequence
  Description of Artificial Sequence: Synthetic oligonucleotide
gacaacauaguggagugg

SEQ ID NO: 9195 - RNA, 18 nt, Artificial Sequence
  Description of Artificial Sequence: Synthetic oligonucleotide
aaauagacaacauagugg

SEQ ID NO: 9196 - RNA, 18 nt, Artificial Sequence
  Description of Artificial Sequence: Synthetic oligonucleotide
agaaaaaauagacaacau

SEQ ID NO: 9197 - RNA, 18 nt, Artificial Sequence
  Description of Artificial Sequence: Synthetic oligonucleotide
uccucagaaaaaauagac

SEQ ID NO: 9198 - RNA, 18 nt, Artificial Sequence
  Description of Artificial Sequence: Synthetic oligonucleotide
uuaauuccucagaaaaaa

SEQ ID NO: 9199 - RNA, 18 nt, Artificial Sequence
  Description of Artificial Sequence: Synthetic oligonucleotide
aacccuuaauuccucaga

SEQ ID NO: 9200 - RNA, 18 nt, Artificial Sequence
  Description of Artificial Sequence: Synthetic oligonucleotide
ggguaacccuuaauuccu

SEQ ID NO: 9201 - RNA, 18 nt, Artificial Sequence
  Description of Artificial Sequence: Synthetic oligonucleotide
gggagugggcaggguggg

SEQ ID NO: 9202 - RNA, 18 nt, Artificial Sequence
  Description of Artificial Sequence: Synthetic oligonucleotide
gggaugggagugggcagg

SEQ ID NO: 9203 - RNA, 18 nt, Artificial Sequence
  Description of Artificial Sequence: Synthetic oligonucleotide
uugaagggaugggagugg

SEQ ID NO: 9204 - RNA, 18 nt, Artificial Sequence
  Description of Artificial Sequence: Synthetic oligonucleotide
ggguugaagggaugggag

SEQ ID NO: 9205 - RNA, 18 nt, Artificial Sequence
  Description of Artificial Sequence: Synthetic oligonucleotide
auuacaguaggaaguggg

SEQ ID NO: 9206 - RNA, 18 nt, Artificial Sequence
  Description of Artificial Sequence: Synthetic oligonucleotide
gaucuauuacaguaggaa

SEQ ID NO: 9207 - RNA, 18 nt, Artificial Sequence
  Description of Artificial Sequence: Synthetic oligonucleotide
augcugaucuauuacagu

SEQ ID NO: 9208 - RNA, 18 nt, Artificial Sequence
  Description of Artificial Sequence: Synthetic oligonucleotide
uuuggaugcugaucuauu

SEQ ID NO: 9209 - RNA, 18 nt, Artificial Sequence
  Description of Artificial Sequence: Synthetic oligonucleotide
cugcuuuuggaugcugau

SEQ ID NO: 9210 - RNA, 18 nt, Artificial Sequence
  Description of Artificial Sequence: Synthetic oligonucleotide
gguuccugcuuuuggaug

SEQ ID NO: 9211 - RNA, 18 nt, Artificial Sequence
  Description of Artificial Sequence: Synthetic oligonucleotide
agauggguuccugcuuuu

SEQ ID NO: 9212 - RNA, 18 nt, Artificial Sequence
  Description of Artificial Sequence: Synthetic oligonucleotide
gguuuagauggguuccug

SEQ ID NO: 9213 - RNA, 18 nt, Artificial Sequence
  Description of Artificial Sequence: Synthetic oligonucleotide
cuucugguuuagaugggu

SEQ ID NO: 9214 - RNA, 18 nt, Artificial Sequence
  Description of Artificial Sequence: Synthetic oligonucleotide
gcuuccuucugguuuaga

SEQ ID NO: 9215 - RNA, 18 nt, Artificial Sequence
  Description of Artificial Sequence: Synthetic oligonucleotide
agagggcuuccuucuggu

SEQ ID NO: 9216 - RNA, 18 nt, Artificial Sequence
  Description of Artificial Sequence: Synthetic oligonucleotide
aucugagagggcuuccuu

SEQ ID NO: 9217 - RNA, 18 nt, Artificial Sequence
  Description of Artificial Sequence: Synthetic oligonucleotide
gggugaucugagagggcu

SEQ ID NO: 9218 - RNA, 18 nt, Artificial Sequence
  Description of Artificial Sequence: Synthetic oligonucleotide
ugggaaauggagugaggc

SEQ ID NO: 9219 - RNA, 18 nt, Artificial Sequence
  Description of Artificial Sequence: Synthetic oligonucleotide
ggaagugggaaauggagu

SEQ ID NO: 9220 - RNA, 18 nt, Artificial Sequence
  Description of Artificial Sequence: Synthetic oligonucleotide
ggguggaagugggaaaug

SEQ ID NO: 9221 - RNA, 18 nt, Artificial Sequence
  Description of Artificial Sequence: Synthetic oligonucleotide
cugcaggaagcuaacggg

SEQ ID NO: 9222 - RNA, 18 nt, Artificial Sequence
  Description of Artificial Sequence: Synthetic oligonucleotide
gaguccugcaggaagcua

SEQ ID NO: 9223 - RNA, 18 nt, Artificial Sequence
  Description of Artificial Sequence: Synthetic oligonucleotide
ggauagaguccugcagga

SEQ ID NO: 9224 - RNA, 18 nt, Artificial Sequence
  Description of Artificial Sequence: Synthetic oligonucleotide
gccagggauagaguccug

SEQ ID NO: 9225 - RNA, 18 nt, Artificial Sequence
  Description of Artificial Sequence: Synthetic oligonucleotide
gggaagccagggauagag

SEQ ID NO: 9226 - RNA, 18 nt, Artificial Sequence
  Description of Artificial Sequence: Synthetic oligonucleotide
ugugauugcaaggucuga

SEQ ID NO: 9227 - RNA, 18 nt, Artificial Sequence
  Description of Artificial Sequence: Synthetic oligonucleotide
ccuuuugugauugcaagg

SEQ ID NO: 9228 - RNA, 18 nt, Artificial Sequence
  Description of Artificial Sequence: Synthetic oligonucleotide
aagaaccuuuugugauug

SEQ ID NO: 9229 - RNA, 18 nt, Artificial Sequence
  Description of Artificial Sequence: Synthetic oligonucleotide
accagaagaaccuuuugu

SEQ ID NO: 9230 - RNA, 18 nt, Artificial Sequence
  Description of Artificial Sequence: Synthetic oligonucleotide
cacucaccagaagaaccu

SEQ ID NO: 9231 - RNA, 18 nt, Artificial Sequence
  Description of Artificial Sequence: Synthetic oligonucleotide
ucuugcacucaccagaag

SEQ ID NO: 9232 - RNA, 18 nt, Artificial Sequence
  Description of Artificial Sequence: Synthetic oligonucleotide
caggcucuugcacucacc

SEQ ID NO: 9233 - RNA, 18 nt, Artificial Sequence
  Description of Artificial Sequence: Synthetic oligonucleotide
agucucaggcucuugcac

SEQ ID NO: 9234 - RNA, 18 nt, Artificial Sequence
  Description of Artificial Sequence: Synthetic oligonucleotide
uuuccagucucaggcucu

SEQ ID NO: 9235 - RNA, 18 nt, Artificial Sequence
  Description of Artificial Sequence: Synthetic oligonucleotide
caccuuuuccagucucag

SEQ ID NO: 9236 - RNA, 18 nt, Artificial Sequence
  Description of Artificial Sequence: Synthetic oligonucleotide
aaguccaccuuuuccagu

SEQ ID NO: 9237 - RNA, 18 nt, Artificial Sequence
  Description of Artificial Sequence: Synthetic oligonucleotide
gagacaaguccaccuuuu

SEQ ID NO: 9238 - RNA, 18 nt, Artificial Sequence
  Description of Artificial Sequence: Synthetic oligonucleotide
acugggagacaaguccac

SEQ ID NO: 9239 - RNA, 18 nt, Artificial Sequence
  Description of Artificial Sequence: Synthetic oligonucleotide
ccucgacugggagacaag

SEQ ID NO: 9240 - RNA, 18 nt, Artificial Sequence
  Description of Artificial Sequence: Synthetic oligonucleotide
accagccucgacugggag

SEQ ID NO: 9241 - RNA, 18 nt, Artificial Sequence
  Description of Artificial Sequence: Synthetic oligonucleotide
cccuuaccagccucgacu

SEQ ID NO: 9242 - RNA, 18 nt, Artificial Sequence
  Description of Artificial Sequence: Synthetic oligonucleotide
aaggucccuuaccagccu

SEQ ID NO: 9243 - RNA, 18 nt, Artificial Sequence
  Description of Artificial Sequence: Synthetic oligonucleotide
cccugaaggucccuuacc

SEQ ID NO: 9244 - RNA, 18 nt, Artificial Sequence
  Description of Artificial Sequence: Synthetic oligonucleotide
gcucucccugaagguccc

SEQ ID NO: 9245 - RNA, 18 nt, Artificial Sequence
  Description of Artificial Sequence: Synthetic oligonucleotide
gcccagcucucccugaag

SEQ ID NO: 9246 - RNA, 18 nt, Artificial Sequence
  Description of Artificial Sequence: Synthetic oligonucleotide
ugucugcccagcucuccc

SEQ ID NO: 9247 - RNA, 18 nt, Artificial Sequence
  Description of Artificial Sequence: Synthetic oligonucleotide
ccaccugucugcccagcu

SEQ ID NO: 9248 - RNA, 18 nt, Artificial Sequence
  Description of Artificial Sequence: Synthetic oligonucleotide
aucucccaccugucugcc

SEQ ID NO: 9249 - RNA, 18 nt, Artificial Sequence
  Description of Artificial Sequence: Synthetic oligonucleotide
ccuccaucucccaccugu

SEQ ID NO: 9250 - RNA, 18 nt, Artificial Sequence
  Description of Artificial Sequence: Synthetic oligonucleotide
cccuaccuccaucuccca

SEQ ID NO: 9251 - RNA, 18 nt, Artificial Sequence
  Description of Artificial Sequence: Synthetic oligonucleotide
gccagcccuaccuccauc

SEQ ID NO: 9252 - RNA, 18 nt, Artificial Sequence
  Description of Artificial Sequence: Synthetic oligonucleotide
cuccagccagcccuaccu

SEQ ID NO: 9253 - RNA, 18 nt, Artificial Sequence
  Description of Artificial Sequence: Synthetic oligonucleotide
ccuuccuccagccagccc

SEQ ID NO: 9254 - RNA, 18 nt, Artificial Sequence
  Description of Artificial Sequence: Synthetic oligonucleotide
uguuuccuuccuccagcc

SEQ ID NO: 9255 - RNA, 18 nt, Artificial Sequence
  Description of Artificial Sequence: Synthetic oligonucleotide
uuuguuguuuccuuccuc

SEQ ID NO: 9256 - RNA, 18 nt, Artificial Sequence
  Description of Artificial Sequence: Synthetic oligonucleotide
cuuccuuuguuguuuccu

SEQ ID NO: 9257 - RNA, 18 nt, Artificial Sequence
  Description of Artificial Sequence: Synthetic oligonucleotide
ccucacuuccuuuguugu

SEQ ID NO: 9258 - RNA, 18 nt, Artificial Sequence
  Description of Artificial Sequence: Synthetic oligonucleotide
cacuaccucacuuccuuu

SEQ ID NO: 9259 - RNA, 18 nt, Artificial Sequence
  Description of Artificial Sequence: Synthetic oligonucleotide
auuggcacuaccucacuu

SEQ ID NO: 9260 - RNA, 18 nt, Artificial Sequence
  Description of Artificial Sequence: Synthetic oligonucleotide
cugucauuggcacuaccu

SEQ ID NO: 9261 - RNA, 18 nt, Artificial Sequence
  Description of Artificial Sequence: Synthetic oligonucleotide
auguccugucauuggcac

SEQ ID NO: 9262 - RNA, 18 nt, Artificial Sequence
  Description of Artificial Sequence: Synthetic oligonucleotide
gucaaauguccugucauu

SEQ ID NO: 9263 - RNA, 18 nt, Artificial Sequence
  Description of Artificial Sequence: Synthetic oligonucleotide
cucaugucaaauguccug

SEQ ID NO: 9264 - RNA, 18 nt, Artificial Sequence
  Description of Artificial Sequence: Synthetic oligonucleotide
ggagacucaugucaaaug

SEQ ID NO: 9265 - RNA, 18 nt, Artificial Sequence
  Description of Artificial Sequence: Synthetic oligonucleotide
uaucuggagacucauguc

SEQ ID NO: 9266 - RNA, 18 nt, Artificial Sequence
  Description of Artificial Sequence: Synthetic oligonucleotide
acaucuaucuggagacuc

SEQ ID NO: 9267 - RNA, 18 nt, Artificial Sequence
  Description of Artificial Sequence: Synthetic oligonucleotide
ccacgacaucuaucugga

SEQ ID NO: 9268 - RNA, 18 nt, Artificial Sequence
  Description of Artificial Sequence: Synthetic oligonucleotide
ggaguccacgacaucuau

SEQ ID NO: 9269 - RNA, 18 nt, Artificial Sequence
  Description of Artificial Sequence: Synthetic oligonucleotide
gagcuggaguccacgaca

SEQ ID NO: 9270 - RNA, 18 nt, Artificial Sequence
  Description of Artificial Sequence: Synthetic oligonucleotide
acguagagcuggagucca

SEQ ID NO: 9271 - RNA, 18 nt, Artificial Sequence
  Description of Artificial Sequence: Synthetic oligonucleotide
gugggacguagagcugga

SEQ ID NO: 9272 - RNA, 18 nt, Artificial Sequence
  Description of Artificial Sequence: Synthetic oligonucleotide
aaaaugugggacguagag

SEQ ID NO: 9273 - RNA, 18 nt, Artificial Sequence
  Description of Artificial Sequence: Synthetic oligonucleotide
auucuaaaaugugggacg

SEQ ID NO: 9274 - RNA, 18 nt, Artificial Sequence
  Description of Artificial Sequence: Synthetic oligonucleotide
ggguauucuaaaaugugg

SEQ ID NO: 9275 - RNA, 18 nt, Artificial Sequence
  Description of Artificial Sequence: Synthetic oligonucleotide
guuuguucugcugguggg

SEQ ID NO: 9276 - RNA, 18 nt, Artificial Sequence
  Description of Artificial Sequence: Synthetic oligonucleotide
ucugaguuuguucugcug

SEQ ID NO: 9277 - RNA, 18 nt, Artificial Sequence
  Description of Artificial Sequence: Synthetic oligonucleotide
ugagaucugaguuuguuc

SEQ ID NO: 9278 - RNA, 18 nt, Artificial Sequence
  Description of Artificial Sequence: Synthetic oligonucleotide
ccugaugagaucugaguu

SEQ ID NO: 9279 - RNA, 18 nt, Artificial Sequence
  Description of Artificial Sequence: Synthetic oligonucleotide
gcuacccugaugagaucu

SEQ ID NO: 9280 - RNA, 18 nt, Artificial Sequence
  Description of Artificial Sequence: Synthetic oligonucleotide
cugcugcuacccugauga

SEQ ID NO: 9281 - RNA, 18 nt, Artificial Sequence
  Description of Artificial Sequence: Synthetic oligonucleotide
ugccucugcugcuacccu

SEQ ID NO: 9282 - RNA, 18 nt, Artificial Sequence
  Description of Artificial Sequence: Synthetic oligonucleotide
gguccugccucugcugcu

SEQ ID NO: 9283 - RNA, 18 nt, Artificial Sequence
  Description of Artificial Sequence: Synthetic oligonucleotide
cuucugguccugccucug

SEQ ID NO: 9284 - RNA, 18 nt, Artificial Sequence
  Description of Artificial Sequence: Synthetic oligonucleotide
auugccuucugguccugc

SEQ ID NO: 9285 - RNA, 18 nt, Artificial Sequence
  Description of Artificial Sequence: Synthetic oligonucleotide
ucuugauugccuucuggu

SEQ ID NO: 9286 - RNA, 18 nt, Artificial Sequence
  Description of Artificial Sequence: Synthetic oligonucleotide
gaagcucuugauugccuu

SEQ ID NO: 9287 - RNA, 18 nt, Artificial Sequence
  Description of Artificial Sequence: Synthetic oligonucleotide
uucuggaagcucuugauu

SEQ ID NO: 9288 - RNA, 18 nt, Artificial Sequence
  Description of Artificial Sequence: Synthetic oligonucleotide
ggcauuucuggaagcucu

SEQ ID NO: 9289 - RNA, 18 nt, Artificial Sequence
  Description of Artificial Sequence: Synthetic oligonucleotide
aguguggcauuucuggaa

SEQ ID NO: 9290 - RNA, 18 nt, Artificial Sequence
  Description of Artificial Sequence: Synthetic oligonucleotide
acacaaguguggcauuuc

SEQ ID NO: 9291 - RNA, 18 nt, Artificial Sequence
  Description of Artificial Sequence: Synthetic oligonucleotide
guggcacacaaguguggc

SEQ ID NO: 9292 - RNA, 18 nt, Artificial Sequence
  Description of Artificial Sequence: Synthetic oligonucleotide
acucuguggcacacaagu

SEQ ID NO: 9293 - RNA, 18 nt, Artificial Sequence
  Description of Artificial Sequence: Synthetic oligonucleotide
gggaacucuguggcacac

SEQ ID NO: 9294 - RNA, 18 nt, Artificial Sequence
  Description of Artificial Sequence: Synthetic oligonucleotide
uaaccaagggucagcggg

SEQ ID NO: 9295 - RNA, 18 nt, Artificial Sequence
  Description of Artificial Sequence: Synthetic oligonucleotide
accccuaaccaaggguca

SEQ ID NO: 9296 - RNA, 18 nt, Artificial Sequence
  Description of Artificial Sequence: Synthetic oligonucleotide
agaggaccccuaaccaag

SEQ ID NO: 9297 - RNA, 18 nt, Artificial Sequence
  Description of Artificial Sequence: Synthetic oligonucleotide
gacuaagaggaccccuaa

SEQ ID NO: 9298 - RNA, 18 nt, Artificial Sequence
  Description of Artificial Sequence: Synthetic oligonucleotide
uuguggacuaagaggacc

SEQ ID NO: 9299 - RNA, 18 nt, Artificial Sequence
  Description of Artificial Sequence: Synthetic oligonucleotide
ggaccuuguggacuaaga

SEQ ID NO: 9300 - RNA, 18 nt, Artificial Sequence
  Description of Artificial Sequence: Synthetic oligonucleotide
cauccggaccuuguggac

SEQ ID NO: 9301 - RNA, 18 nt, Artificial Sequence
  Description of Artificial Sequence: Synthetic oligonucleotide
agugacauccggaccuug

SEQ ID NO: 9302 - RNA, 18 nt, Artificial Sequence
  Description of Artificial Sequence: Synthetic oligonucleotide
acaugagugacauccgga

SEQ ID NO: 9303 - RNA, 18 nt, Artificial Sequence
  Description of Artificial Sequence: Synthetic oligonucleotide
uaaguacaugagugacau

SEQ ID NO: 9304 - RNA, 18 nt, Artificial Sequence
  Description of Artificial Sequence: Synthetic oligonucleotide
guuauuaaguacaugagu

SEQ ID NO: 9305 - RNA, 18 nt, Artificial Sequence
  Description of Artificial Sequence: Synthetic oligonucleotide
gaaguguuauuaaguaca

SEQ ID NO: 9306 - RNA, 18 nt, Artificial Sequence
  Description of Artificial Sequence: Synthetic oligonucleotide
aaggugaaguguuauuaa

SEQ ID NO: 9307 - RNA, 18 nt, Artificial Sequence
  Description of Artificial Sequence: Synthetic oligonucleotide
uacagaaggugaaguguu

SEQ ID NO: 9308 - RNA, 18 nt, Artificial Sequence
  Description of Artificial Sequence: Synthetic oligonucleotide
aguauuacagaaggugaa

SEQ ID NO: 9309 - RNA, 18 nt, Artificial Sequence
  Description of Artificial Sequence: Synthetic oligonucleotide
gacuuaguauuacagaag

SEQ ID NO: 9310 - RNA, 18 nt, Artificial Sequence
  Description of Artificial Sequence: Synthetic oligonucleotide
cugaggacuuaguauuac

SEQ ID NO: 9311 - RNA, 18 nt, Artificial Sequence
  Description of Artificial Sequence: Synthetic oligonucleotide
gagcucugaggacuuagu

SEQ ID NO: 9312 - RNA, 18 nt, Artificial Sequence
  Description of Artificial Sequence: Synthetic oligonucleotide
gcauggagcucugaggac

SEQ ID NO: 9313 - RNA, 18 nt, Artificial Sequence
  Description of Artificial Sequence: Synthetic oligonucleotide
gaacagcauggagcucug

SEQ ID NO: 9314 - RNA, 18 nt, Artificial Sequence
  Description of Artificial Sequence: Synthetic oligonucleotide
uuucagaacagcauggag

SEQ ID NO: 9315 - RNA, 18 nt, Artificial Sequence
  Description of Artificial Sequence: Synthetic oligonucleotide
aucccuuucagaacagca

SEQ ID NO: 9316 - RNA, 18 nt, Artificial Sequence
  Description of Artificial Sequence: Synthetic oligonucleotide
uggccaucccuuucagaa

SEQ ID NO: 9317 - RNA, 18 nt, Artificial Sequence
  Description of Artificial Sequence: Synthetic oligonucleotide
acuuguggccaucccuuu

SEQ ID NO: 9318 - RNA, 18 nt, Artificial Sequence
  Description of Artificial Sequence: Synthetic oligonucleotide
aaagaacuuguggccauc

SEQ ID NO: 9319 - RNA, 18 nt, Artificial Sequence
  Description of Artificial Sequence: Synthetic oligonucleotide
cugggaaagaacuugugg

SEQ ID NO: 9320 - RNA, 18 nt, Artificial Sequence
  Description of Artificial Sequence: Synthetic oligonucleotide
agaggcugggaaagaacu

SEQ ID NO: 9321 - RNA, 18 nt, Artificial Sequence
  Description of Artificial Sequence: Synthetic oligonucleotide
auggaagaggcugggaaa

SEQ ID NO: 9322 - RNA, 18 nt, Artificial Sequence
  Description of Artificial Sequence: Synthetic oligonucleotide
agggaauggaagaggcug

SEQ ID NO: 9323 - RNA, 18 nt, Artificial Sequence
  Description of Artificial Sequence: Synthetic oligonucleotide
aagaaagggaauggaaga

SEQ ID NO: 9324 - RNA, 18 nt, Artificial Sequence
  Description of Artificial Sequence: Synthetic oligonucleotide
augaaaagaaagggaaug

SEQ ID NO: 9325 - RNA, 18 nt, Artificial Sequence
  Description of Artificial Sequence: Synthetic oligonucleotide
ugggcaugaaaagaaagg

SEQ ID NO: 9326 - RNA, 18 nt, Artificial Sequence
  Description of Artificial Sequence: Synthetic oligonucleotide
cgggaugggcaugaaaag

SEQ ID NO: 9327 - RNA, 18 nt, Artificial Sequence
  Description of Artificial Sequence: Synthetic oligonucleotide
uucaucgggaugggcaug

SEQ ID NO: 9328 - RNA, 18 nt, Artificial Sequence
  Description of Artificial Sequence: Synthetic oligonucleotide
gcagguucaucgggaugg

SEQ ID NO: 9329 - RNA, 18 nt, Artificial Sequence
  Description of Artificial Sequence: Synthetic oligonucleotide
augaugcagguucaucgg

SEQ ID NO: 9330 - RNA, 18 nt, Artificial Sequence
  Description of Artificial Sequence: Synthetic oligonucleotide
gggaaugaugcagguuca

SEQ ID NO: 9331 - RNA, 18 nt, Artificial Sequence
  Description of Artificial Sequence: Synthetic oligonucleotide
uggcuuggcagugucggg

SEQ ID NO: 9332 - RNA, 18 nt, Artificial Sequence
  Description of Artificial Sequence: Synthetic oligonucleotide
aggguuggcuuggcagug

SEQ ID NO: 9333 - RNA, 18 nt, Artificial Sequence
  Description of Artificial Sequence: Synthetic oligonucleotide
uuuccaggguuggcuugg

SEQ ID NO: 9334 - RNA, 18 nt, Artificial Sequence
  Description of Artificial Sequence: Synthetic oligonucleotide
cuccuuuuccaggguugg

SEQ ID NO: 9335 - RNA, 18 nt, Artificial Sequence
  Description of Artificial Sequence: Synthetic oligonucleotide
gcgaacuccuuuuccagg

SEQ ID NO: 9336 - RNA, 18 nt, Artificial Sequence
  Description of Artificial Sequence: Synthetic oligonucleotide
ggccagcgaacuccuuuu

SEQ ID NO: 9337 - RNA, 18 nt, Artificial Sequence
  Description of Artificial Sequence: Synthetic oligonucleotide
ccaauggccagcgaacuc

SEQ ID NO: 9338 - RNA, 18 nt, Artificial Sequence
  Description of Artificial Sequence: Synthetic oligonucleotide
ucuagccaauggccagcg

SEQ ID NO: 9339 - RNA, 18 nt, Artificial Sequence
  Description of Artificial Sequence: Synthetic oligonucleotide
cugauucuagccaauggc

SEQ ID NO: 9340 - RNA, 18 nt, Artificial Sequence
  Description of Artificial Sequence: Synthetic oligonucleotide
ccacccugauucuagcca

SEQ ID NO: 9341 - RNA, 18 nt, Artificial Sequence
  Description of Artificial Sequence: Synthetic oligonucleotide
cuucuccacccugauucu

SEQ ID NO: 9342 - RNA, 18 nt, Artificial Sequence
  Description of Artificial Sequence: Synthetic oligonucleotide
gggaacuucuccacccug

SEQ ID NO: 9343 - RNA, 18 nt, Artificial Sequence
  Description of Artificial Sequence: Synthetic oligonucleotide
guucagggaacuucucca

SEQ ID NO: 9344 - RNA, 18 nt, Artificial Sequence
  Description of Artificial Sequence: Synthetic oligonucleotide
ggaagguucagggaacuu

SEQ ID NO: 9345 - RNA, 18 nt, Artificial Sequence
  Description of Artificial Sequence: Synthetic oligonucleotide
agacaggaagguucaggg

SEQ ID NO: 9346 - RNA, 18 nt, Artificial Sequence
  Description of Artificial Sequence: Synthetic oligonucleotide
cugggagacaggaagguu

SEQ ID NO: 9347 - RNA, 18 nt, Artificial Sequence
  Description of Artificial Sequence: Synthetic oligonucleotide
ugucccugggagacagga

SEQ ID NO: 9348 - RNA, 18 nt, Artificial Sequence
  Description of Artificial Sequence: Synthetic oligonucleotide
auacaugucccugggaga

SEQ ID NO: 9349 - RNA, 18 nt, Artificial Sequence
  Description of Artificial Sequence: Synthetic oligonucleotide
gaagcauacaugucccug

SEQ ID NO: 9350 - RNA, 18 nt, Artificial Sequence
  Description of Artificial Sequence: Synthetic oligonucleotide
cccuggaagcauacaugu

SEQ ID NO: 9351 - RNA, 18 nt, Artificial Sequence
  Description of Artificial Sequence: Synthetic oligonucleotide
cuugucccuggaagcaua

SEQ ID NO: 9352 - RNA, 18 nt, Artificial Sequence
  Description of Artificial Sequence: Synthetic oligonucleotide
cuaagcuugucccuggaa

SEQ ID NO: 9353 - RNA, 18 nt, Artificial Sequence
  Description of Artificial Sequence: Synthetic oligonucleotide
augaccuaagcuuguccc

SEQ ID NO: 9354 - RNA, 18 nt, Artificial Sequence
  Description of Artificial Sequence: Synthetic oligonucleotide
uguucaugaccuaagcuu

SEQ ID NO: 9355 - RNA, 18 nt, Artificial Sequence
  Description of Artificial Sequence: Synthetic oligonucleotide
gaccauguucaugaccua

SEQ ID NO: 9356 - RNA, 18 nt, Artificial Sequence
  Description of Artificial Sequence: Synthetic oligonucleotide
guucugaccauguucaug

SEQ ID NO: 9357 - RNA, 18 nt, Artificial Sequence
  Description of Artificial Sequence: Synthetic oligonucleotide
caaagguucugaccaugu

SEQ ID NO: 9358 - RNA, 18 nt, Artificial Sequence
  Description of Artificial Sequence: Synthetic oligonucleotide
uuguccaaagguucugac

SEQ ID NO: 9359 - RNA, 18 nt, Artificial Sequence
  Description of Artificial Sequence: Synthetic oligonucleotide
uccucuuguccaaagguu

SEQ ID NO: 9360 - RNA, 18 nt, Artificial Sequence
  Description of Artificial Sequence: Synthetic oligonucleotide
auuuuuccucuuguccaa

SEQ ID NO: 9361 - RNA, 18 nt, Artificial Sequence
  Description of Artificial Sequence: Synthetic oligonucleotide
uuaguauuuuuccucuug

SEQ ID NO: 9362 - RNA, 18 nt, Artificial Sequence
  Description of Artificial Sequence: Synthetic oligonucleotide
aucucuuaguauuuuucc

SEQ ID NO: 9363 - RNA, 18 nt, Artificial Sequence
  Description of Artificial Sequence: Synthetic oligonucleotide
agcaaaucucuuaguauu

SEQ ID NO: 9364 - RNA, 18 nt, Artificial Sequence
  Description of Artificial Sequence: Synthetic oligonucleotide
gaaaaagcaaaucucuua

SEQ ID NO: 9365 - RNA, 18 nt, Artificial Sequence
  Description of Artificial Sequence: Synthetic oligonucleotide
acccagaaaaagcaaauc

SEQ ID NO: 9366 - RNA, 18 nt, Artificial Sequence
  Description of Artificial Sequence: Synthetic oligonucleotide
accgcacccagaaaaagc

SEQ ID NO: 9367 - RNA, 18 nt, Artificial Sequence
  Description of Artificial Sequence: Synthetic oligonucleotide
gagccaccgcacccagaa

SEQ ID NO: 9368 - RNA, 18 nt, Artificial Sequence
  Description of Artificial Sequence: Synthetic oligonucleotide
ggcaugagccaccgcacc

SEQ ID NO: 9369 - RNA, 18 nt, Artificial Sequence
  Description of Artificial Sequence: Synthetic oligonucleotide
uuacaggcaugagccacc

SEQ ID NO: 9370 - RNA, 18 nt, Artificial Sequence
  Description of Artificial Sequence: Synthetic oligonucleotide
ugggauuacaggcaugag

SEQ ID NO: 9371 - RNA, 18 nt, Artificial Sequence
  Description of Artificial Sequence: Synthetic oligonucleotide
agugcugggauuacaggc

SEQ ID NO: 9372 - RNA, 18 nt, Artificial Sequence
  Description of Artificial Sequence: Synthetic oligonucleotide
cccaaagugcugggauua

SEQ ID NO: 9373 - RNA, 18 nt, Artificial Sequence
  Description of Artificial Sequence: Synthetic oligonucleotide
ggccucccaaagugcugg

SEQ ID NO: 9374 - RNA, 18 nt, Artificial Sequence
  Description of Artificial Sequence: Synthetic oligonucleotide
gccucggccucccaaagu

SEQ ID NO: 9375 - RNA, 18 nt, Artificial Sequence
  Description of Artificial Sequence: Synthetic oligonucleotide
caccugccucggccuccc

SEQ ID NO: 9376 - RNA, 18 nt, Artificial Sequence
  Description of Artificial Sequence: Synthetic oligonucleotide
ugauccaccugccucggc

SEQ ID NO: 9377 - RNA, 18 nt, Artificial Sequence
  Description of Artificial Sequence: Synthetic oligonucleotide
ccucaugauccaccugcc

SEQ ID NO: 9378 - RNA, 18 nt, Artificial Sequence
  Description of Artificial Sequence: Synthetic oligonucleotide
ccugaccucaugauccac

SEQ ID NO: 9379 - RNA, 18 nt, Artificial Sequence
  Description of Artificial Sequence: Synthetic oligonucleotide
gaacuccugaccucauga

SEQ ID NO: 9380 - RNA, 18 nt, Artificial Sequence
  Description of Artificial Sequence: Synthetic oligonucleotide
gccucgaacuccugaccu

SEQ ID NO: 9381 - RNA, 18 nt, Artificial Sequence
  Description of Artificial Sequence: Synthetic oligonucleotide
ggcucgccucgaacuccu

SEQ ID NO: 9382 - RNA, 18 nt, Artificial Sequence
  Description of Artificial Sequence: Synthetic oligonucleotide
ggccaggcucgccucgaa

SEQ ID NO: 9383 - RNA, 18 nt, Artificial Sequence
  Description of Artificial Sequence: Synthetic oligonucleotide
auguuggccaggcucgcc

SEQ ID NO: 9384 - RNA, 18 nt, Artificial Sequence
  Description of Artificial Sequence: Synthetic oligonucleotide
ucaccauguuggccaggc

SEQ ID NO: 9385 - RNA, 18 nt, Artificial Sequence
  Description of Artificial Sequence: Synthetic oligonucleotide
ggguuucaccauguuggc

SEQ ID NO: 9386 - RNA, 18 nt, Artificial Sequence
  Description of Artificial Sequence: Synthetic oligonucleotide
agacaggguuucaccaug

SEQ ID NO: 9387 - RNA, 18 nt, Artificial Sequence
  Description of Artificial Sequence: Synthetic oligonucleotide
aguagagacaggguuuca

SEQ ID NO: 9388 - RNA, 18 nt, Artificial Sequence
  Description of Artificial Sequence: Synthetic oligonucleotide
cuuuuaguagagacaggg

SEQ ID NO: 9389 - RNA, 18 nt, Artificial Sequence
  Description of Artificial Sequence: Synthetic oligonucleotide
uuguacuuuuaguagaga

SEQ ID NO: 9390 - RNA, 18 nt, Artificial Sequence
  Description of Artificial Sequence: Synthetic oligonucleotide
auuuuuuguacuuuuagu

SEQ ID NO: 9391 - RNA, 18 nt, Artificial Sequence
  Description of Artificial Sequence: Synthetic oligonucleotide
ggcuaauuuuuuguacuu

SEQ ID NO: 9392 - RNA, 18 nt, Artificial Sequence
  Description of Artificial Sequence: Synthetic oligonucleotide
ugacuggcuaauuuuuug

SEQ ID NO: 9393 - RNA, 18 nt, Artificial Sequence
  Description of Artificial Sequence: Synthetic oligonucleotide
caccaugacuggcuaauu

SEQ ID NO: 9394 - RNA, 18 nt, Artificial Sequence
  Description of Artificial Sequence: Synthetic oligonucleotide
ugugccaccaugacuggc

SEQ ID NO: 9395 - RNA, 18 nt, Artificial Sequence
  Description of Artificial Sequence: Synthetic oligonucleotide
aggcgugugccaccauga

SEQ ID NO: 9396 - RNA, 18 nt, Artificial Sequence
  Description of Artificial Sequence: Synthetic oligonucleotide
auuacaggcgugugccac

SEQ ID NO: 9397 - RNA, 18 nt, Artificial Sequence
  Description of Artificial Sequence: Synthetic oligonucleotide
cugagauuacaggcgugu

SEQ ID NO: 9398 - RNA, 18 nt, Artificial Sequence
  Description of Artificial Sequence: Synthetic oligonucleotide
aguagcugagauuacagg

SEQ ID NO: 9399 - RNA, 18 nt, Artificial Sequence
  Description of Artificial Sequence: Synthetic oligonucleotide
uccugaguagcugagauu

SEQ ID NO: 9400 - RNA, 18 nt, Artificial Sequence
  Description of Artificial Sequence: Synthetic oligonucleotide
cagccuccugaguagcug

SEQ ID NO: 9401 - RNA, 18 nt, Artificial Sequence
  Description of Artificial Sequence: Synthetic oligonucleotide
ugccucagccuccugagu

SEQ ID NO: 9402 - RNA, 18 nt, Artificial Sequence
  Description of Artificial Sequence: Synthetic oligonucleotide
ucuccugccucagccucc

SEQ ID NO: 9403 - RNA, 18 nt, Artificial Sequence
  Description of Artificial Sequence: Synthetic oligonucleotide
gcaauucuccugccucag

SEQ ID NO: 9404 - RNA, 18 nt, Artificial Sequence
  Description of Artificial Sequence: Synthetic oligonucleotide
uucaagcaauucuccugc

SEQ ID NO: 9405 - RNA, 18 nt, Artificial Sequence
  Description of Artificial Sequence: Synthetic oligonucleotide
acagguucaagcaauucu

SEQ ID NO: 9406 - RNA, 18 nt, Artificial Sequence
  Description of Artificial Sequence: Synthetic oligonucleotide
uccucacagguucaagca

SEQ ID NO: 9407 - RNA, 18 nt, Artificial Sequence
  Description of Artificial Sequence: Synthetic oligonucleotide
ccucuuccucacagguuc

SEQ ID NO: 9408 - RNA, 18 nt, Artificial Sequence
  Description of Artificial Sequence: Synthetic oligonucleotide
ugcaaccucuuccucaca

SEQ ID NO: 9409 - RNA, 18 nt, Artificial Sequence
  Description of Artificial Sequence: Synthetic oligonucleotide
cucacugcaaccucuucc

SEQ ID NO: 9410 - RNA, 18 nt, Artificial Sequence
  Description of Artificial Sequence: Synthetic oligonucleotide
cucagcucacugcaaccu

SEQ ID NO: 9411 - RNA, 18 nt, Artificial Sequence
  Description of Artificial Sequence: Synthetic oligonucleotide
acgaucucagcucacugc

SEQ ID NO: 9412 - RNA, 18 nt, Artificial Sequence
  Description of Artificial Sequence: Synthetic oligonucleotide
auggcacgaucucagcuc

SEQ ID NO: 9413 - RNA, 18 nt, Artificial Sequence
  Description of Artificial Sequence: Synthetic oligonucleotide
guguaauggcacgaucuc

SEQ ID NO: 9414 - RNA, 18 nt, Artificial Sequence
  Description of Artificial Sequence: Synthetic oligonucleotide
cuggaguguaauggcacg

SEQ ID NO: 9415 - RNA, 18 nt, Artificial Sequence
  Description of Artificial Sequence: Synthetic oligonucleotide
ccaggcuggaguguaaug

SEQ ID NO: 9416 - RNA, 18 nt, Artificial Sequence
  Description of Artificial Sequence: Synthetic oligonucleotide
uucgcccaggcuggagug

SEQ ID NO: 9417 - RNA, 18 nt, Artificial Sequence
  Description of Artificial Sequence: Synthetic oligonucleotide
acccuuucgcccaggcug

SEQ ID NO: 9418 - RNA, 18 nt, Artificial Sequence
  Description of Artificial Sequence: Synthetic oligonucleotide
gucucacccuuucgccca

SEQ ID NO: 9419 - RNA, 18 nt, Artificial Sequence
  Description of Artificial Sequence: Synthetic oligonucleotide
auggagucucacccuuuc

SEQ ID NO: 9420 - RNA, 18 nt, Artificial Sequence
  Description of Artificial Sequence: Synthetic oligonucleotide
uugagauggagucucacc

SEQ ID NO: 9421 - RNA, 18 nt, Artificial Sequence
  Description of Artificial Sequence: Synthetic oligonucleotide
uuuuuuugagauggaguc

SEQ ID NO: 9422 - RNA, 18 nt, Artificial Sequence
  Description of Artificial Sequence: Synthetic oligonucleotide
uuuuuuuuuuuugagaug

SEQ ID NO: 9423 - RNA, 18 nt, Artificial Sequence
  Description of Artificial Sequence: Synthetic oligonucleotide
ucauuuuuuuuuuuuuug

SEQ ID NO: 9424 - RNA, 18 nt, Artificial Sequence
  Description of Artificial Sequence: Synthetic oligonucleotide
gcaaaucauuuuuuuuuu

SEQ ID NO: 9425 - RNA, 18 nt, Artificial Sequence
  Description of Artificial Sequence: Synthetic oligonucleotide
caaaagcaaaucauuuuu

SEQ ID NO: 9426 - RNA, 18 nt, Artificial Sequence
  Description of Artificial Sequence: Synthetic oligonucleotide
gacgucaaaagcaaauca

SEQ ID NO: 9427 - RNA, 18 nt, Artificial Sequence
  Description of Artificial Sequence: Synthetic oligonucleotide
ccuaagacgucaaaagca

SEQ ID NO: 9428 - RNA, 18 nt, Artificial Sequence
  Description of Artificial Sequence: Synthetic oligonucleotide
ugccaccuaagacgucaa

SEQ ID NO: 9429 - RNA, 18 nt, Artificial Sequence
  Description of Artificial Sequence: Synthetic oligonucleotide
agcccugccaccuaagac

SEQ ID NO: 9430 - RNA, 18 nt, Artificial Sequence
  Description of Artificial Sequence: Synthetic oligonucleotide
ggaacagcccugccaccu

SEQ ID NO: 9431 - RNA, 18 nt, Artificial Sequence
  Description of Artificial Sequence: Synthetic oligonucleotide
uggagggaacagcccugc

SEQ ID NO: 9432 - RNA, 18 nt, Artificial Sequence
  Description of Artificial Sequence: Synthetic oligonucleotide
uugccuggagggaacagc

SEQ ID NO: 9433 - RNA, 18 nt, Artificial Sequence
  Description of Artificial Sequence: Synthetic oligonucleotide
ggcauuugccuggaggga

SEQ ID NO: 9434 - RNA, 18 nt, Artificial Sequence
  Description of Artificial Sequence: Synthetic oligonucleotide
ugaagggcauuugccugg

SEQ ID NO: 9435 - RNA, 18 nt, Artificial Sequence
  Description of Artificial Sequence: Synthetic oligonucleotide
cgguuugaagggcauuug

SEQ ID NO: 9436 - RNA, 18 nt, Artificial Sequence
  Description of Artificial Sequence: Synthetic oligonucleotide
aucgucgguuugaagggc

SEQ ID NO: 9437 - RNA, 18 nt, Artificial Sequence
  Description of Artificial Sequence: Synthetic oligonucleotide
caaugaucgucgguuuga

SEQ ID NO: 9438 - RNA, 18 nt, Artificial Sequence
  Description of Artificial Sequence: Synthetic oligonucleotide
gggcacaaugaucgucgg

SEQ ID NO: 9439 - RNA, 18 nt, Artificial Sequence
  Description of Artificial Sequence: Synthetic oligonucleotide
uaagugggcacaaugauc

SEQ ID NO: 9440 - RNA, 18 nt, Artificial Sequence
  Description of Artificial Sequence: Synthetic oligonucleotide
caggguaagugggcacaa

SEQ ID NO: 9441 - RNA, 18 nt, Artificial Sequence
  Description of Artificial Sequence: Synthetic oligonucleotide
cagcccaggguaaguggg

SEQ ID NO: 9442 - RNA, 18 nt, Artificial Sequence
  Description of Artificial Sequence: Synthetic oligonucleotide
cucuccagcccaggguaa

SEQ ID NO: 9443 - RNA, 18 nt, Artificial Sequence
  Description of Artificial Sequence: Synthetic oligonucleotide
accaacucuccagcccag

SEQ ID NO: 9444 - RNA, 18 nt, Artificial Sequence
  Description of Artificial Sequence: Synthetic oligonucleotide
cugaaaccaacucuccag

SEQ ID NO: 9445 - RNA, 18 nt, Artificial Sequence
  Description of Artificial Sequence: Synthetic oligonucleotide
ggaaccugaaaccaacuc

SEQ ID NO: 9446 - RNA, 18 nt, Artificial Sequence
  Description of Artificial Sequence: Synthetic oligonucleotide
cuguaggaaccugaaacc

SEQ ID NO: 9447 - RNA, 18 nt, Artificial Sequence
  Description of Artificial Sequence: Synthetic oligonucleotide
aucuccuguaggaaccug

SEQ ID NO: 9448 - RNA, 18 nt, Artificial Sequence
  Description of Artificial Sequence: Synthetic oligonucleotide
aagcuaucuccuguagga

SEQ ID NO: 9449 - RNA, 18 nt, Artificial Sequence
  Description of Artificial Sequence: Synthetic oligonucleotide
aaagaaagcuaucuccug

SEQ ID NO: 9450 - RNA, 18 nt, Artificial Sequence
  Description of Artificial Sequence: Synthetic oligonucleotide
aagggaaagaaagcuauc

SEQ ID NO: 9451 - RNA, 18 nt, Artificial Sequence
  Description of Artificial Sequence: Synthetic oligonucleotide
ggaguaagggaaagaaag

SEQ ID NO: 9452 - RNA, 18 nt, Artificial Sequence
  Description of Artificial Sequence: Synthetic oligonucleotide
gauagggaguaagggaaa

SEQ ID NO: 9453 - RNA, 18 nt, Artificial Sequence
  Description of Artificial Sequence: Synthetic oligonucleotide
uguuagauagggaguaag

SEQ ID NO: 9454 - RNA, 18 nt, Artificial Sequence
  Description of Artificial Sequence: Synthetic oligonucleotide
aaaaguguuagauaggga

SEQ ID NO: 9455 - RNA, 18 nt, Artificial Sequence
  Description of Artificial Sequence: Synthetic oligonucleotide
agagcaaaaguguuagau

SEQ ID NO: 9456 - RNA, 18 nt, Artificial Sequence
  Description of Artificial Sequence: Synthetic oligonucleotide
ccugcagagcaaaagugu

SEQ ID NO: 9457 - RNA, 18 nt, Artificial Sequence
  Description of Artificial Sequence: Synthetic oligonucleotide
ggcugccugcagagcaaa

SEQ ID NO: 9458 - RNA, 18 nt, Artificial Sequence
  Description of Artificial Sequence: Synthetic oligonucleotide
ggcaaggcugccugcaga

SEQ ID NO: 9459 - RNA, 18 nt, Artificial Sequence
  Description of Artificial Sequence: Synthetic oligonucleotide
gaaugggcaaggcugccu

SEQ ID NO: 9460 - RNA, 18 nt, Artificial Sequence
  Description of Artificial Sequence: Synthetic oligonucleotide
uuagagaaugggcaaggc

SEQ ID NO: 9461 - RNA, 18 nt, Artificial Sequence
  Description of Artificial Sequence: Synthetic oligonucleotide
caggcuuagagaaugggc

SEQ ID NO: 9462 - RNA, 18 nt, Artificial Sequence
  Description of Artificial Sequence: Synthetic oligonucleotide
uaagccaggcuuagagaa

SEQ ID NO: 9463 - RNA, 18 nt, Artificial Sequence
  Description of Artificial Sequence: Synthetic oligonucleotide
ccuucuaagccaggcuua

SEQ ID NO: 9464 - RNA, 18 nt, Artificial Sequence
  Description of Artificial Sequence: Synthetic oligonucleotide
cagugccuucuaagccag

SEQ ID NO: 9465 - RNA, 18 nt, Artificial Sequence
  Description of Artificial Sequence: Synthetic oligonucleotide
auucccagugccuucuaa

SEQ ID NO: 9466 - RNA, 18 nt, Artificial Sequence
  Description of Artificial Sequence: Synthetic oligonucleotide
aggacauucccagugccu

SEQ ID NO: 9467 - RNA, 18 nt, Artificial Sequence
  Description of Artificial Sequence: Synthetic oligonucleotide
ucuacaggacauucccag

SEQ ID NO: 9468 - RNA, 18 nt, Artificial Sequence
  Description of Artificial Sequence: Synthetic oligonucleotide
cucucucuacaggacauu

SEQ ID NO: 9469 - RNA, 18 nt, Artificial Sequence
  Description of Artificial Sequence: Synthetic oligonucleotide
uaggucucucucuacagg

SEQ ID NO: 9470 - RNA, 18 nt, Artificial Sequence
  Description of Artificial Sequence: Synthetic oligonucleotide
cuaucuaggucucucucu

SEQ ID NO: 9471 - RNA, 18 nt, Artificial Sequence
  Description of Artificial Sequence: Synthetic oligonucleotide
augaccuaucuaggucuc

SEQ ID NO: 9472 - RNA, 18 nt, Artificial Sequence
  Description of Artificial Sequence: Synthetic oligonucleotide
cuugcaugaccuaucuag

SEQ ID NO: 9473 - RNA, 18 nt, Artificial Sequence
  Description of Artificial Sequence: Synthetic oligonucleotide
ucucacuugcaugaccua

SEQ ID NO: 9474 - RNA, 18 nt, Artificial Sequence
  Description of Artificial Sequence: Synthetic oligonucleotide
gucuuucucacuugcaug

SEQ ID NO: 9475 - RNA, 18 nt, Artificial Sequence
  Description of Artificial Sequence: Synthetic oligonucleotide
cagaugucuuucucacuu

SEQ ID NO: 9476 - RNA, 18 nt, Artificial Sequence
  Description of Artificial Sequence: Synthetic oligonucleotide
uuccucagaugucuuucu

SEQ ID NO: 9477 - RNA, 18 nt, Artificial Sequence
  Description of Artificial Sequence: Synthetic oligonucleotide
ccauuuuccucagauguc

SEQ ID NO: 9478 - RNA, 18 nt, Artificial Sequence
  Description of Artificial Sequence: Synthetic oligonucleotide
gucuuccauuuuccucag

SEQ ID NO: 9479 - RNA, 18 nt, Artificial Sequence
  Description of Artificial Sequence: Synthetic oligonucleotide
cuuaggucuuccauuuuc

SEQ ID NO: 9480 - RNA, 18 nt, Artificial Sequence
  Description of Artificial Sequence: Synthetic oligonucleotide
ucugccuuaggucuucca

SEQ ID NO: 9481 - RNA, 18 nt, Artificial Sequence
  Description of Artificial Sequence: Synthetic oligonucleotide
uccugucugccuuagguc

SEQ ID NO: 9482 - RNA, 18 nt, Artificial Sequence
  Description of Artificial Sequence: Synthetic oligonucleotide
uuccuuccugucugccuu

SEQ ID NO: 9483 - RNA, 18 nt, Artificial Sequence
  Description of Artificial Sequence: Synthetic oligonucleotide
ugugcuuccuuccugucu

SEQ ID NO: 9484 - RNA, 18 nt, Artificial Sequence
  Description of Artificial Sequence: Synthetic oligonucleotide
ucuuuugugcuuccuucc

SEQ ID NO: 9485 - RNA, 18 nt, Artificial Sequence
  Description of Artificial Sequence: Synthetic oligonucleotide
gcuugucuuuugugcuuc

SEQ ID NO: 9486 - RNA, 18 nt, Artificial Sequence
  Description of Artificial Sequence: Synthetic oligonucleotide
ccaaugcuugucuuuugu

SEQ ID NO: 9487 - RNA, 18 nt, Artificial Sequence
  Description of Artificial Sequence: Synthetic oligonucleotide
cugacccaaugcuugucu

SEQ ID NO: 9488 - RNA, 18 nt, Artificial Sequence
  Description of Artificial Sequence: Synthetic oligonucleotide
ugggucugacccaaugcu

SEQ ID NO: 9489 - RNA, 18 nt, Artificial Sequence
  Description of Artificial Sequence: Synthetic oligonucleotide
guuuaugggucugaccca

SEQ ID NO: 9490 - RNA, 18 nt, Artificial Sequence
  Description of Artificial Sequence: Synthetic oligonucleotide
aggugguuuaugggucug

SEQ ID NO: 9491 - RNA, 18 nt, Artificial Sequence
  Description of Artificial Sequence: Synthetic oligonucleotide
uugggaggugguuuaugg

SEQ ID NO: 9492 - RNA, 18 nt, Artificial Sequence
  Description of Artificial Sequence: Synthetic oligonucleotide
agccuuugggaggugguu

SEQ ID NO: 9493 - RNA, 18 nt, Artificial Sequence
  Description of Artificial Sequence: Synthetic oligonucleotide
augacagccuuugggagg

SEQ ID NO: 9494 - RNA, 18 nt, Artificial Sequence
  Description of Artificial Sequence: Synthetic oligonucleotide
augaaaugacagccuuug

SEQ ID NO: 9495 - RNA, 18 nt, Artificial Sequence
  Description of Artificial Sequence: Synthetic oligonucleotide
gugcaaugaaaugacagc

SEQ ID NO: 9496 - RNA, 18 nt, Artificial Sequence
  Description of Artificial Sequence: Synthetic oligonucleotide
uuccagugcaaugaaaug

SEQ ID NO: 9497 - RNA, 18 nt, Artificial Sequence
  Description of Artificial Sequence: Synthetic oligonucleotide
caaaauuccagugcaaug

SEQ ID NO: 9498 - RNA, 18 nt, Artificial Sequence
  Description of Artificial Sequence: Synthetic oligonucleotide
uaaagcaaaauuccagug

SEQ ID NO: 9499 - RNA, 18 nt, Artificial Sequence
  Description of Artificial Sequence: Synthetic oligonucleotide
ucugauaaagcaaaauuc

SEQ ID NO: 9500 - RNA, 18 nt, Artificial Sequence
  Description of Artificial Sequence: Synthetic oligonucleotide
uugcuucugauaaagcaa

SEQ ID NO: 9501 - RNA, 18 nt, Artificial Sequence
  Description of Artificial Sequence: Synthetic oligonucleotide
cuuccuugcuucugauaa

SEQ ID NO: 9502 - RNA, 18 nt, Artificial Sequence
  Description of Artificial Sequence: Synthetic oligonucleotide
ccuuacuuccuugcuucu

SEQ ID NO: 9503 - RNA, 18 nt, Artificial Sequence
  Description of Artificial Sequence: Synthetic oligonucleotide
gacucccuuacuuccuug

SEQ ID NO: 9504 - RNA, 18 nt, Artificial Sequence
  Description of Artificial Sequence: Synthetic oligonucleotide
gcaaugacucccuuacuu

SEQ ID NO: 9505 - RNA, 18 nt, Artificial Sequence
  Description of Artificial Sequence: Synthetic oligonucleotide
ccaaggcaaugacucccu

SEQ ID NO: 9506 - RNA, 18 nt, Artificial Sequence
  Description of Artificial Sequence: Synthetic oligonucleotide
caggcccaaggcaaugac

SEQ ID NO: 9507 - RNA, 18 nt, Artificial Sequence
  Description of Artificial Sequence: Synthetic oligonucleotide
auucccaggcccaaggca

SEQ ID NO: 9508 - RNA, 18 nt, Artificial Sequence
  Description of Artificial Sequence: Synthetic oligonucleotide
cuuagauucccaggccca

SEQ ID NO: 9509 - RNA, 18 nt, Artificial Sequence
  Description of Artificial Sequence: Synthetic oligonucleotide
ucccacuuagauucccag

SEQ ID NO: 9510 - RNA, 18 nt, Artificial Sequence
  Description of Artificial Sequence: Synthetic oligonucleotide
uugucucccacuuagauu

SEQ ID NO: 9511 - RNA, 18 nt, Artificial Sequence
  Description of Artificial Sequence: Synthetic oligonucleotide
uaauauugucucccacuu

SEQ ID NO: 9512 - RNA, 18 nt, Artificial Sequence
  Description of Artificial Sequence: Synthetic oligonucleotide
caaauuaauauugucucc

SEQ ID NO: 9513 - RNA, 18 nt, Artificial Sequence
  Description of Artificial Sequence: Synthetic oligonucleotide
ggauccaaauuaauauug

SEQ ID NO: 9514 - RNA, 18 nt, Artificial Sequence
  Description of Artificial Sequence: Synthetic oligonucleotide
uaaucggauccaaauuaa

SEQ ID NO: 9515 - RNA, 18 nt, Artificial Sequence
  Description of Artificial Sequence: Synthetic oligonucleotide
ccaauuaaucggauccaa

SEQ ID NO: 9516 - RNA, 18 nt, Artificial Sequence
  Description of Artificial Sequence: Synthetic oligonucleotide
aaucuccaauuaaucgga

SEQ ID NO: 9517 - RNA, 18 nt, Artificial Sequence
  Description of Artificial Sequence: Synthetic oligonucleotide
uuaguaaucuccaauuaa

SEQ ID NO: 9518 - RNA, 18 nt, Artificial Sequence
  Description of Artificial Sequence: Synthetic oligonucleotide
cacaguuaguaaucucca

SEQ ID NO: 9519 - RNA, 18 nt, Artificial Sequence
  Description of Artificial Sequence: Synthetic oligonucleotide
uuguccacaguuaguaau

SEQ ID NO: 9520 - RNA, 18 nt, Artificial Sequence
  Description of Artificial Sequence: Synthetic oligonucleotide
aacuuuuguccacaguua

SEQ ID NO: 9521 - RNA, 18 nt, Artificial Sequence
  Description of Artificial Sequence: Synthetic oligonucleotide
agauaaacuuuuguccac

SEQ ID NO: 9522 - RNA, 18 nt, Artificial Sequence
  Description of Artificial Sequence: Synthetic oligonucleotide
ugcaaagauaaacuuuug

SEQ ID NO: 9523 - RNA, 18 nt, Artificial Sequence
  Description of Artificial Sequence: Synthetic oligonucleotide
gauugugcaaagauaaac

SEQ ID NO: 9524 - RNA, 18 nt, Artificial Sequence
  Description of Artificial Sequence: Synthetic oligonucleotide
uuauugauugugcaaaga

SEQ ID NO: 9525 - RNA, 18 nt, Artificial Sequence
  Description of Artificial Sequence: Synthetic oligonucleotide
cauuuuuauugauugugc

SEQ ID NO: 9526 - RNA, 18 nt, Artificial Sequence
  Description of Artificial Sequence: Synthetic oligonucleotide
aaugccauuuuuauugau

SEQ ID NO: 9527 - RNA, 18 nt, Artificial Sequence
  Description of Artificial Sequence: Synthetic oligonucleotide
aaaaaaaugccauuuuua

SEQ ID NO: 9528 - RNA, 18 nt, Artificial Sequence
  Description of Artificial Sequence: Synthetic oligonucleotide
uuacuaaaaaaaugccau

SEQ ID NO: 9529 - RNA, 18 nt, Artificial Sequence
  Description of Artificial Sequence: Synthetic oligonucleotide
uuaauuuacuaaaaaaau

SEQ ID NO: 9530 - RNA, 18 nt, Artificial Sequence
  Description of Artificial Sequence: Synthetic oligonucleotide
ugcucuuaauuuacuaaa

SEQ ID NO: 9531 - RNA, 18 nt, Artificial Sequence
  Description of Artificial Sequence: Synthetic oligonucleotide
guuuaugcucuuaauuua

SEQ ID NO: 9532 - RNA, 18 nt, Artificial Sequence
  Description of Artificial Sequence: Synthetic oligonucleotide
auauuguuuaugcucuua

SEQ ID NO: 9533 - RNA, 18 nt, Artificial Sequence
  Description of Artificial Sequence: Synthetic oligonucleotide
uagcaauauuguuuaugc

SEQ ID NO: 9534 - RNA, 18 nt, Artificial Sequence
  Description of Artificial Sequence: Synthetic oligonucleotide
accucuagcaauauuguu

SEQ ID NO: 9535 - RNA, 18 nt, Artificial Sequence
  Description of Artificial Sequence: Synthetic oligonucleotide
augccaccucuagcaaua

SEQ ID NO: 9536 - RNA, 18 nt, Artificial Sequence
  Description of Artificial Sequence: Synthetic oligonucleotide
uaaacaugccaccucuag

SEQ ID NO: 9537 - RNA, 18 nt, Artificial Sequence
  Description of Artificial Sequence: Synthetic oligonucleotide
uagacuaaacaugccacc

SEQ ID NO: 9538 - RNA, 18 nt, Artificial Sequence
  Description of Artificial Sequence: Synthetic oligonucleotide
uuugguagacuaaacaug

SEQ ID NO: 9539 - RNA, 18 nt, Artificial Sequence
  Description of Artificial Sequence: Synthetic oligonucleotide
uuguuuuugguagacuaa

SEQ ID NO: 9540 - RNA, 18 nt, Artificial Sequence
  Description of Artificial Sequence: Synthetic oligonucleotide
aaguauuguuuuugguag

SEQ ID NO: 9541 - RNA, 18 nt, Artificial Sequence
  Description of Artificial Sequence: Synthetic oligonucleotide
cugaaaaguauuguuuuu

SEQ ID NO: 9542 - RNA, 18 nt, Artificial Sequence
  Description of Artificial Sequence: Synthetic oligonucleotide
agugccugaaaaguauug

SEQ ID NO: 9543 - RNA, 18 nt, Artificial Sequence
  Description of Artificial Sequence: Synthetic oligonucleotide
ucuaaagugccugaaaag

SEQ ID NO: 9544 - RNA, 18 nt, Artificial Sequence
  Description of Artificial Sequence: Synthetic oligonucleotide
auauuucuaaagugccug

SEQ ID NO: 9545 - RNA, 18 nt, Artificial Sequence
  Description of Artificial Sequence: Synthetic oligonucleotide
aaaggauauuucuaaagu

SEQ ID NO: 9546 - RNA, 18 nt, Artificial Sequence
  Description of Artificial Sequence: Synthetic oligonucleotide
uucuaaaaggauauuucu

SEQ ID NO: 9547 - RNA, 18 nt, Artificial Sequence
  Description of Artificial Sequence: Synthetic oligonucleotide
gcugcuucuaaaaggaua

SEQ ID NO: 9548 - RNA, 18 nt, Artificial Sequence
  Description of Artificial Sequence: Synthetic oligonucleotide
cacucgcugcuucuaaaa

SEQ ID NO: 9549 - RNA, 18 nt, Artificial Sequence
  Description of Artificial Sequence: Synthetic oligonucleotide
ccaugcacucgcugcuuc

SEQ ID NO: 9550 - RNA, 18 nt, Artificial Sequence
  Description of Artificial Sequence: Synthetic oligonucleotide
uuagcccaugcacucgcu

SEQ ID NO: 9551 - RNA, 18 nt, Artificial Sequence
  Description of Artificial Sequence: Synthetic oligonucleotide
gauaauuagcccaugcac

SEQ ID NO: 9552 - RNA, 18 nt, Artificial Sequence
  Description of Artificial Sequence: Synthetic oligonucleotide
uugaugauaauuagccca

SEQ ID NO: 9553 - RNA, 18 nt, Artificial Sequence
  Description of Artificial Sequence: Synthetic oligonucleotide
aaagauugaugauaauua

SEQ ID NO: 9554 - RNA, 18 nt, Artificial Sequence
  Description of Artificial Sequence: Synthetic oligonucleotide
uacauaaagauugaugau

SEQ ID NO: 9555 - RNA, 18 nt, Artificial Sequence
  Description of Artificial Sequence: Synthetic oligonucleotide
acaaauacauaaagauug

SEQ ID NO: 9556 - RNA, 18 nt, Artificial Sequence
  Description of Artificial Sequence: Synthetic oligonucleotide
cuuuaacaaauacauaaa

SEQ ID NO: 9557 - RNA, 18 nt, Artificial Sequence
  Description of Artificial Sequence: Synthetic oligonucleotide
uguuucuuuaacaaauac

SEQ ID NO: 9558 - RNA, 18 nt, Artificial Sequence
  Description of Artificial Sequence: Synthetic oligonucleotide
guagauguuucuuuaaca

SEQ ID NO: 9559 - RNA, 18 nt, Artificial Sequence
  Description of Artificial Sequence: Synthetic oligonucleotide
auccuguagauguuucuu

SEQ ID NO: 9560 - RNA, 18 nt, Artificial Sequence
  Description of Artificial Sequence: Synthetic oligonucleotide
uaaagauccuguagaugu

SEQ ID NO: 9561 - RNA, 18 nt, Artificial Sequence
  Description of Artificial Sequence: Synthetic oligonucleotide
accaauaaagauccugua

SEQ ID NO: 9562 - RNA, 18 nt, Artificial Sequence
  Description of Artificial Sequence: Synthetic oligonucleotide
aggucaccaauaaagauc

SEQ ID NO: 9563 - RNA, 18 nt, Artificial Sequence
  Description of Artificial Sequence: Synthetic oligonucleotide
acaaaaggucaccaauaa

SEQ ID NO: 9564 - RNA, 18 nt, Artificial Sequence
  Description of Artificial Sequence: Synthetic oligonucleotide
gucuuacaaaaggucacc

SEQ ID NO: 9565 - RNA, 18 nt, Artificial Sequence
  Description of Artificial Sequence: Synthetic oligonucleotide
cuaaugucuuacaaaagg

SEQ ID NO: 9566 - RNA, 18 nt, Artificial Sequence
  Description of Artificial Sequence: Synthetic oligonucleotide
ucaaacuaaugucuuaca

SEQ ID NO: 9567 - RNA, 18 nt, Artificial Sequence
  Description of Artificial Sequence: Synthetic oligonucleotide
guaccucaaacuaauguc

SEQ ID NO: 9568 - RNA, 18 nt, Artificial Sequence
  Description of Artificial Sequence: Synthetic oligonucleotide
agguaguaccucaaacua

SEQ ID NO: 9569 - RNA, 18 nt, Artificial Sequence
  Description of Artificial Sequence: Synthetic oligonucleotide
uacauagguaguaccuca

SEQ ID NO: 9570 - RNA, 18 nt, Artificial Sequence
  Description of Artificial Sequence: Synthetic oligonucleotide
ucaaguacauagguagua

SEQ ID NO: 9571 - RNA, 18 nt, Artificial Sequence
  Description of Artificial Sequence: Synthetic oligonucleotide
uauuuucaaguacauagg

SEQ ID NO: 9572 - RNA, 18 nt, Artificial Sequence
  Description of Artificial Sequence: Synthetic oligonucleotide
uuuauuauuuucaaguac

SEQ ID NO: 9573 - RNA, 18 nt, Artificial Sequence
  Description of Artificial Sequence: Synthetic oligonucleotide
gccacuuuauuauuuuca

SEQ ID NO: 9574 - RNA, 18 nt, Artificial Sequence
  Description of Artificial Sequence: Synthetic oligonucleotide
gaaaugccacuuuauuau

SEQ ID NO: 9575 - RNA, 18 nt, Artificial Sequence
  Description of Artificial Sequence: Synthetic oligonucleotide
auaaagaaaugccacuuu

SEQ ID NO: 9576 - RNA, 18 nt, Artificial Sequence
  Description of Artificial Sequence: Synthetic oligonucleotide
agggaguugcaauaucga

SEQ ID NO: 9577 - RNA, 18 nt, Artificial Sequence
  Description of Artificial Sequence: Synthetic oligonucleotide
cauccagggaguugcaau

SEQ ID NO: 9578 - RNA, 18 nt, Artificial Sequence
  Description of Artificial Sequence: Synthetic oligonucleotide
uuccucauccagggaguu

SEQ ID NO: 9579 - RNA, 18 nt, Artificial Sequence
  Description of Artificial Sequence: Synthetic oligonucleotide
uucucuuccucauccagg

SEQ ID NO: 9580 - RNA, 18 nt, Artificial Sequence
  Description of Artificial Sequence: Synthetic oligonucleotide
cccucuucucuuccucau

SEQ ID NO: 9581 - RNA, 18 nt, Artificial Sequence
  Description of Artificial Sequence: Synthetic oligonucleotide
cagcucccucuucucuuc

SEQ ID NO: 9582 - RNA, 18 nt, Artificial Sequence
  Description of Artificial Sequence: Synthetic oligonucleotide
agcuucagcucccucuuc

SEQ ID NO: 9583 - RNA, 18 nt, Artificial Sequence
  Description of Artificial Sequence: Synthetic oligonucleotide
ugaaaagcuucagcuccc

SEQ ID NO: 9584 - RNA, 18 nt, Artificial Sequence
  Description of Artificial Sequence: Synthetic oligonucleotide
gcugcugaaaagcuucag

SEQ ID NO: 9585 - RNA, 18 nt, Artificial Sequence
  Description of Artificial Sequence: Synthetic oligonucleotide
cucuggcugcugaaaagc

SEQ ID NO: 9586 - RNA, 18 nt, Artificial Sequence
  Description of Artificial Sequence: Synthetic oligonucleotide
guuuccucuggcugcuga

SEQ ID NO: 9587 - RNA, 18 nt, Artificial Sequence
  Description of Artificial Sequence: Synthetic oligonucleotide
uucgcguuuccucuggcu

SEQ ID NO: 9588 - RNA, 18 nt, Artificial Sequence
  Description of Artificial Sequence: Synthetic oligonucleotide
aaguuuucgcguuuccuc

SEQ ID NO: 9589 - RNA, 18 nt, Artificial Sequence
  Description of Artificial Sequence: Synthetic oligonucleotide
ggcccaaguuuucgcguu

SEQ ID NO: 9590 - RNA, 18 nt, Artificial Sequence
  Description of Artificial Sequence: Synthetic oligonucleotide
cccgcggcccaaguuuuc

SEQ ID NO: 9591 - RNA, 18 nt, Artificial Sequence
  Description of Artificial Sequence: Synthetic oligonucleotide
acauucccgcggcccaag

SEQ ID NO: 9592 - RNA, 18 nt, Artificial Sequence
  Description of Artificial Sequence: Synthetic oligonucleotide
gccugacauucccgcggc

SEQ ID NO: 9593 - RNA, 18 nt, Artificial Sequence
  Description of Artificial Sequence: Synthetic oligonucleotide
gaaaggccugacauuccc

SEQ ID NO: 9594 - RNA, 18 nt, Artificial Sequence
  Description of Artificial Sequence: Synthetic oligonucleotide
acugggaaaggccugaca

SEQ ID NO: 9595 - RNA, 18 nt, Artificial Sequence
  Description of Artificial Sequence: Synthetic oligonucleotide
uggugacugggaaaggcc

SEQ ID NO: 9596 - RNA, 18 nt, Artificial Sequence
  Description of Artificial Sequence: Synthetic oligonucleotide
ugucauggugacugggaa

SEQ ID NO: 9597 - RNA, 18 nt, Artificial Sequence
  Description of Artificial Sequence: Synthetic oligonucleotide
gcuccugucauggugacu

SEQ ID NO: 9598 - RNA, 18 nt, Artificial Sequence
  Description of Artificial Sequence: Synthetic oligonucleotide
aaauagcuccugucaugg

SEQ ID NO: 9599 - RNA, 18 nt, Artificial Sequence
  Description of Artificial Sequence: Synthetic oligonucleotide
uucacaaauagcuccugu

SEQ ID NO: 9600 - RNA, 18 nt, Artificial Sequence
  Description of Artificial Sequence: Synthetic oligonucleotide
cacuccccugaauccaug

SEQ ID NO: 9601 - RNA, 18 nt, Artificial Sequence
  Description of Artificial Sequence: Synthetic oligonucleotide
cucuucacuccccugaau

SEQ ID NO: 9602 - RNA, 18 nt, Artificial Sequence
  Description of Artificial Sequence: Synthetic oligonucleotide
aaugccucuucacucccc

SEQ ID NO: 9603 - RNA, 18 nt, Artificial Sequence
  Description of Artificial Sequence: Synthetic oligonucleotide
agaacaaugccucuucac

SEQ ID NO: 9604 - RNA, 18 nt, Artificial Sequence
  Description of Artificial Sequence: Synthetic oligonucleotide
augccagaacaaugccuc

SEQ ID NO: 9605 - RNA, 18 nt, Artificial Sequence
  Description of Artificial Sequence: Synthetic oligonucleotide
aaaagaugccagaacaau

SEQ ID NO: 9606 - RNA, 18 nt, Artificial Sequence
  Description of Artificial Sequence: Synthetic oligonucleotide
gggugaaaagaugccaga

SEQ ID NO: 9607 - RNA, 18 nt, Artificial Sequence
  Description of Artificial Sequence: Synthetic oligonucleotide
ugaaugggugaaaagaug

SEQ ID NO: 9608 - RNA, 18 nt, Artificial Sequence
  Description of Artificial Sequence: Synthetic oligonucleotide
augaaugaaugggugaaa

SEQ ID NO: 9609 - RNA, 18 nt, Artificial Sequence
  Description of Artificial Sequence: Synthetic oligonucleotide
guuggaugaaugaauggg

SEQ ID NO: 9610 - RNA, 18 nt, Artificial Sequence
  Description of Artificial Sequence: Synthetic oligonucleotide
caauuguuggaugaauga

SEQ ID NO: 9611 - RNA, 18 nt, Artificial Sequence
  Description of Artificial Sequence: Synthetic oligonucleotide
uaaaacaauuguuggaug

SEQ ID NO: 9612 - RNA, 18 nt, Artificial Sequence
  Description of Artificial Sequence: Synthetic oligonucleotide
cucaguaaaacaauuguu

SEQ ID NO: 9613 - RNA, 18 nt, Artificial Sequence
  Description of Artificial Sequence: Synthetic oligonucleotide
aggcacucaguaaaacaa

SEQ ID NO: 9614 - RNA, 18 nt, Artificial Sequence
  Description of Artificial Sequence: Synthetic oligonucleotide
auaguaggcacucaguaa

SEQ ID NO: 9615 - RNA, 18 nt, Artificial Sequence
  Description of Artificial Sequence: Synthetic oligonucleotide
ggcacauaguaggcacuc

SEQ ID NO: 9616 - RNA, 18 nt, Artificial Sequence
  Description of Artificial Sequence: Synthetic oligonucleotide
ucucaggcacauaguagg

SEQ ID NO: 9617 - RNA, 18 nt, Artificial Sequence
  Description of Artificial Sequence: Synthetic oligonucleotide
cuguaucucaggcacaua

SEQ ID NO: 9618 - RNA, 18 nt, Artificial Sequence
  Description of Artificial Sequence: Synthetic oligonucleotide
cacuacuguaucucaggc

SEQ ID NO: 9619 - RNA, 18 nt, Artificial Sequence
  Description of Artificial Sequence: Synthetic oligonucleotide
uuguucacuacuguaucu

SEQ ID NO: 9620 - RNA, 18 nt, Artificial Sequence
  Description of Artificial Sequence: Synthetic oligonucleotide
gucuuuuguucacuacug

SEQ ID NO: 9621 - RNA, 18 nt, Artificial Sequence
  Description of Artificial Sequence: Synthetic oligonucleotide
uucccgucuuuuguucac

SEQ ID NO: 9622 - RNA, 18 nt, Artificial Sequence
  Description of Artificial Sequence: Synthetic oligonucleotide
aaacuuucccgucuuuug

SEQ ID NO: 9623 - RNA, 18 nt, Artificial Sequence
  Description of Artificial Sequence: Synthetic oligonucleotide
agaugaaacuuucccguc

SEQ ID NO: 9624 - RNA, 18 nt, Artificial Sequence
  Description of Artificial Sequence: Synthetic oligonucleotide
gggcaagaugaaacuuuc

SEQ ID NO: 9625 - RNA, 18 nt, Artificial Sequence
  Description of Artificial Sequence: Synthetic oligonucleotide
uagaagggcaagaugaaa

SEQ ID NO: 9626 - RNA, 18 nt, Artificial Sequence
  Description of Artificial Sequence: Synthetic oligonucleotide
cuccuuagaagggcaaga

SEQ ID NO: 9627 - RNA, 18 nt, Artificial Sequence
  Description of Artificial Sequence: Synthetic oligonucleotide
uccaacuccuuagaaggg

SEQ ID NO: 9628 - RNA, 18 nt, Artificial Sequence
  Description of Artificial Sequence: Synthetic oligonucleotide
uagaauccaacuccuuag

SEQ ID NO: 9629 - RNA, 18 nt, Artificial Sequence
  Description of Artificial Sequence: Synthetic oligonucleotide
uccccuagaauccaacuc

SEQ ID NO: 9630 - RNA, 18 nt, Artificial Sequence
  Description of Artificial Sequence: Synthetic oligonucleotide
cuuccuccccuagaaucc

SEQ ID NO: 9631 - RNA, 18 nt, Artificial Sequence
  Description of Artificial Sequence: Synthetic oligonucleotide
ucugacuuccuccccuag

SEQ ID NO: 9632 - RNA, 18 nt, Artificial Sequence
  Description of Artificial Sequence: Synthetic oligonucleotide
uauugucugacuuccucc

SEQ ID NO: 9633 - RNA, 18 nt, Artificial Sequence
  Description of Artificial Sequence: Synthetic oligonucleotide
acauauauugucugacuu

SEQ ID NO: 9634 - RNA, 18 nt, Artificial Sequence
  Description of Artificial Sequence: Synthetic oligonucleotide
ugauuacauauauugucu

SEQ ID NO: 9635 - RNA, 18 nt, Artificial Sequence
  Description of Artificial Sequence: Synthetic oligonucleotide
uuuguugauuacauauau

SEQ ID NO: 9636 - RNA, 18 nt, Artificial Sequence
  Description of Artificial Sequence: Synthetic oligonucleotide
ucuauuuuguugauuaca

SEQ ID NO: 9637 - RNA, 18 nt, Artificial Sequence
  Description of Artificial Sequence: Synthetic oligonucleotide
cuuuuucuauuuuguuga

SEQ ID NO: 9638 - RNA, 18 nt, Artificial Sequence
  Description of Artificial Sequence: Synthetic oligonucleotide
uguaucuuuuucuauuuu

SEQ ID NO: 9639 - RNA, 18 nt, Artificial Sequence
  Description of Artificial Sequence: Synthetic oligonucleotide
cuugcuguaucuuuuucu

SEQ ID NO: 9640 - RNA, 18 nt, Artificial Sequence
  Description of Artificial Sequence: Synthetic oligonucleotide
ccuuccuugcuguaucuu

SEQ ID NO: 9641 - RNA, 18 nt, Artificial Sequence
  Description of Artificial Sequence: Synthetic oligonucleotide
agucuccuuccuugcugu

SEQ ID NO: 9642 - RNA, 18 nt, Artificial Sequence
  Description of Artificial Sequence: Synthetic oligonucleotide
auucaagucuccuuccuu

SEQ ID NO: 9643 - RNA, 18 nt, Artificial Sequence
  Description of Artificial Sequence: Synthetic oligonucleotide
aguacauucaagucuccu

SEQ ID NO: 9644 - RNA, 18 nt, Artificial Sequence
  Description of Artificial Sequence: Synthetic oligonucleotide
cuuccaguacauucaagu

SEQ ID NO: 9645 - RNA, 18 nt, Artificial Sequence
  Description of Artificial Sequence: Synthetic oligonucleotide
ccacacuuccaguacauu

SEQ ID NO: 9646 - RNA, 18 nt, Artificial Sequence
  Description of Artificial Sequence: Synthetic oligonucleotide
ccuccccacacuuccagu

SEQ ID NO: 9647 - RNA, 18 nt, Artificial Sequence
  Description of Artificial Sequence: Synthetic oligonucleotide
ugcagccuccccacacuu

SEQ ID NO: 9648 - RNA, 18 nt, Artificial Sequence
  Description of Artificial Sequence: Synthetic oligonucleotide
aaaacugcagccucccca

SEQ ID NO: 9649 - RNA, 18 nt, Artificial Sequence
  Description of Artificial Sequence: Synthetic oligonucleotide
uccuuaaaacugcagccu

SEQ ID NO: 9650 - RNA, 18 nt, Artificial Sequence
  Description of Artificial Sequence: Synthetic oligonucleotide
aaccuuccuuaaaacugc

SEQ ID NO: 9651 - RNA, 18 nt, Artificial Sequence
  Description of Artificial Sequence: Synthetic oligonucleotide
ccaucaaccuuccuuaaa

SEQ ID NO: 9652 - RNA, 18 nt, Artificial Sequence
  Description of Artificial Sequence: Synthetic oligonucleotide
cuuccccaucaaccuucc

SEQ ID NO: 9653 - RNA, 18 nt, Artificial Sequence
  Description of Artificial Sequence: Synthetic oligonucleotide
gggucuuccccaucaacc

SEQ ID NO: 9654 - RNA, 18 nt, Artificial Sequence
  Description of Artificial Sequence: Synthetic oligonucleotide
ucagaucuucuaaguggg

SEQ ID NO: 9655 - RNA, 18 nt, Artificial Sequence
  Description of Artificial Sequence: Synthetic oligonucleotide
uuugcucagaucuucuaa

SEQ ID NO: 9656 - RNA, 18 nt, Artificial Sequence
  Description of Artificial Sequence: Synthetic oligonucleotide
acaucuuugcucagaucu

SEQ ID NO: 9657 - RNA, 18 nt, Artificial Sequence
  Description of Artificial Sequence: Synthetic oligonucleotide
ugugcacaucuuugcuca

SEQ ID NO: 9658 - RNA, 18 nt, Artificial Sequence
  Description of Artificial Sequence: Synthetic oligonucleotide
acaucugugcacaucuuu

SEQ ID NO: 9659 - RNA, 18 nt, Artificial Sequence
  Description of Artificial Sequence: Synthetic oligonucleotide
cuugcacaucugugcaca

SEQ ID NO: 9660 - RNA, 18 nt, Artificial Sequence
  Description of Artificial Sequence: Synthetic oligonucleotide
ucccucuugcacaucugu

SEQ ID NO: 9661 - RNA, 18 nt, Artificial Sequence
  Description of Artificial Sequence: Synthetic oligonucleotide
cucucucccucuugcaca

SEQ ID NO: 9662 - RNA, 18 nt, Artificial Sequence
  Description of Artificial Sequence: Synthetic oligonucleotide
caagacucucucccucuu

SEQ ID NO: 9663 - RNA, 18 nt, Artificial Sequence
  Description of Artificial Sequence: Synthetic oligonucleotide
aucugcaagacucucucc

SEQ ID NO: 9664 - RNA, 18 nt, Artificial Sequence
  Description of Artificial Sequence: Synthetic oligonucleotide
cuaaaaucugcaagacuc

SEQ ID NO: 9665 - RNA, 18 nt, Artificial Sequence
  Description of Artificial Sequence: Synthetic oligonucleotide
cugcccuaaaaucugcaa

SEQ ID NO: 9666 - RNA, 18 nt, Artificial Sequence
  Description of Artificial Sequence: Synthetic oligonucleotide
ucccucugcccuaaaauc

SEQ ID NO: 9667 - RNA, 18 nt, Artificial Sequence
  Description of Artificial Sequence: Synthetic oligonucleotide
agcauucccucugcccua

SEQ ID NO: 9668 - RNA, 18 nt, Artificial Sequence
  Description of Artificial Sequence: Synthetic oligonucleotide
gccuuagcauucccucug

SEQ ID NO: 9669 - RNA, 18 nt, Artificial Sequence
  Description of Artificial Sequence: Synthetic oligonucleotide
cuucugccuuagcauucc

SEQ ID NO: 9670 - RNA, 18 nt, Artificial Sequence
  Description of Artificial Sequence: Synthetic oligonucleotide
cauuccuucugccuuagc

SEQ ID NO: 9671 - RNA, 18 nt, Artificial Sequence
  Description of Artificial Sequence: Synthetic oligonucleotide
ccggucauuccuucugcc

SEQ ID NO: 9672 - RNA, 18 nt, Artificial Sequence
  Description of Artificial Sequence: Synthetic oligonucleotide
cuaagccggucauuccuu

SEQ ID NO: 9673 - RNA, 18 nt, Artificial Sequence
  Description of Artificial Sequence: Synthetic oligonucleotide
ggccucuaagccggucau

SEQ ID NO: 9674 - RNA, 18 nt, Artificial Sequence
  Description of Artificial Sequence: Synthetic oligonucleotide
cucagggccucuaagccg

SEQ ID NO: 9675 - RNA, 18 nt, Artificial Sequence
  Description of Artificial Sequence: Synthetic oligonucleotide
ccugucucagggccucua

SEQ ID NO: 9676 - RNA, 18 nt, Artificial Sequence
  Description of Artificial Sequence: Synthetic oligonucleotide
acccuccugucucagggc

SEQ ID NO: 9677 - RNA, 18 nt, Artificial Sequence
  Description of Artificial Sequence: Synthetic oligonucleotide
uagacacccuccugucuc

SEQ ID NO: 9678 - RNA, 18 nt, Artificial Sequence
  Description of Artificial Sequence: Synthetic oligonucleotide
cauaauagacacccuccu

SEQ ID NO: 9679 - RNA, 18 nt, Artificial Sequence
  Description of Artificial Sequence: Synthetic oligonucleotide
uugaacauaauagacacc

SEQ ID NO: 9680 - RNA, 18 nt, Artificial Sequence
  Description of Artificial Sequence: Synthetic oligonucleotide
cacuguugaacauaauag

SEQ ID NO: 9681 - RNA, 18 nt, Artificial Sequence
  Description of Artificial Sequence: Synthetic oligonucleotide
caacucacuguugaacau

SEQ ID NO: 9682 - RNA, 18 nt, Artificial Sequence
  Description of Artificial Sequence: Synthetic oligonucleotide
uuggccaacucacuguug

SEQ ID NO: 9683 - RNA, 18 nt, Artificial Sequence
  Description of Artificial Sequence: Synthetic oligonucleotide
gcccauuggccaacucac

SEQ ID NO: 9684 - RNA, 18 nt, Artificial Sequence
  Description of Artificial Sequence: Synthetic oligonucleotide
ccccagcccauuggccaa

SEQ ID NO: 9685 - RNA, 18 nt, Artificial Sequence
  Description of Artificial Sequence: Synthetic oligonucleotide
cucugccccagcccauug

SEQ ID NO: 9686 - RNA, 18 nt, Artificial Sequence
  Description of Artificial Sequence: Synthetic oligonucleotide
acucccucugccccagcc

SEQ ID NO: 9687 - RNA, 18 nt, Artificial Sequence
  Description of Artificial Sequence: Synthetic oligonucleotide
ccuucacucccucugccc

SEQ ID NO: 9688 - RNA, 18 nt, Artificial Sequence
  Description of Artificial Sequence: Synthetic oligonucleotide
aucucccuucacucccuc

SEQ ID NO: 9689 - RNA, 18 nt, Artificial Sequence
  Description of Artificial Sequence: Synthetic oligonucleotide
gaauuaucucccuucacu

SEQ ID NO: 9690 - RNA, 18 nt, Artificial Sequence
  Description of Artificial Sequence: Synthetic oligonucleotide
uaucugaauuaucucccu

SEQ ID NO: 9691 - RNA, 18 nt, Artificial Sequence
  Description of Artificial Sequence: Synthetic oligonucleotide
gacuuuaucugaauuauc

SEQ ID NO: 9692 - RNA, 18 nt, Artificial Sequence
  Description of Artificial Sequence: Synthetic oligonucleotide
acucugacuuuaucugaa

SEQ ID NO: 9693 - RNA, 18 nt, Artificial Sequence
  Description of Artificial Sequence: Synthetic oligonucleotide
ccagaacucugacuuuau

SEQ ID NO: 9694 - RNA, 18 nt, Artificial Sequence
  Description of Artificial Sequence: Synthetic oligonucleotide
cucacccagaacucugac

SEQ ID NO: 9695 - RNA, 18 nt, Artificial Sequence
  Description of Artificial Sequence: Synthetic oligonucleotide
aauggcucacccagaacu

SEQ ID NO: 9696 - RNA, 18 nt, Artificial Sequence
  Description of Artificial Sequence: Synthetic oligonucleotide
cuuccaauggcucaccca

SEQ ID NO: 9697 - RNA, 18 nt, Artificial Sequence
  Description of Artificial Sequence: Synthetic oligonucleotide
ucucugugugccuuucag

SEQ ID NO: 9698 - RNA, 18 nt, Artificial Sequence
  Description of Artificial Sequence: Synthetic oligonucleotide
uaccuucucugugugccu

SEQ ID NO: 9699 - RNA, 18 nt, Artificial Sequence
  Description of Artificial Sequence: Synthetic oligonucleotide
uuaacuaccuucucugug

SEQ ID NO: 9700 - RNA, 18 nt, Artificial Sequence
  Description of Artificial Sequence: Synthetic oligonucleotide
caccuuuaacuaccuucu

SEQ ID NO: 9701 - RNA, 18 nt, Artificial Sequence
  Description of Artificial Sequence: Synthetic oligonucleotide
acgcucaccuuuaacuac

SEQ ID NO: 9702 - RNA, 18 nt, Artificial Sequence
  Description of Artificial Sequence: Synthetic oligonucleotide
acagcacgcucaccuuua

SEQ ID NO: 9703 - RNA, 18 nt, Artificial Sequence
  Description of Artificial Sequence: Synthetic oligonucleotide
acauaacagcacgcucac

SEQ ID NO: 9704 - RNA, 18 nt, Artificial Sequence
  Description of Artificial Sequence: Synthetic oligonucleotide
uggauacauaacagcacg

SEQ ID NO: 9705 - RNA, 18 nt, Artificial Sequence
  Description of Artificial Sequence: Synthetic oligonucleotide
gaggguggauacauaaca

SEQ ID NO: 9706 - RNA, 18 nt, Artificial Sequence
  Description of Artificial Sequence: Synthetic oligonucleotide
ggagggaggguggauaca

SEQ ID NO: 9707 - RNA, 18 nt, Artificial Sequence
  Description of Artificial Sequence: Synthetic oligonucleotide
auaugggagggagggugg

SEQ ID NO: 9708 - RNA, 18 nt, Artificial Sequence
  Description of Artificial Sequence: Synthetic oligonucleotide
cuuuuauaugggagggag

SEQ ID NO: 9709 - RNA, 18 nt, Artificial Sequence
  Description of Artificial Sequence: Synthetic oligonucleotide
cuauacuuuuauauggga

SEQ ID NO: 9710 - RNA, 18 nt, Artificial Sequence
  Description of Artificial Sequence: Synthetic oligonucleotide
gggaccuauacuuuuaua

SEQ ID NO: 9711 - RNA, 18 nt, Artificial Sequence
  Description of Artificial Sequence: Synthetic oligonucleotide
gaggugggaccuauacuu

SEQ ID NO: 9712 - RNA, 18 nt, Artificial Sequence
  Description of Artificial Sequence: Synthetic oligonucleotide
uggaggaggugggaccua

SEQ ID NO: 9713 - RNA, 18 nt, Artificial Sequence
  Description of Artificial Sequence: Synthetic oligonucleotide
gggcuuggaggagguggg

SEQ ID NO: 9714 - RNA, 18 nt, Artificial Sequence
  Description of Artificial Sequence: Synthetic oligonucleotide
ggugggugggaggacggg

SEQ ID NO: 9715 - RNA, 18 nt, Artificial Sequence
  Description of Artificial Sequence: Synthetic oligonucleotide
gggaggugggugggagga

SEQ ID NO: 9716 - RNA, 18 nt, Artificial Sequence
  Description of Artificial Sequence: Synthetic oligonucleotide
ccaccaggaguggcuggg

SEQ ID NO: 9717 - RNA, 18 nt, Artificial Sequence
  Description of Artificial Sequence: Synthetic oligonucleotide
uaacaccaccaggagugg

SEQ ID NO: 9718 - RNA, 18 nt, Artificial Sequence
  Description of Artificial Sequence: Synthetic oligonucleotide
agguuuaacaccaccagg

SEQ ID NO: 9719 - RNA, 18 nt, Artificial Sequence
  Description of Artificial Sequence: Synthetic oligonucleotide
cagccagguuuaacacca

SEQ ID NO: 9720 - RNA, 18 nt, Artificial Sequence
  Description of Artificial Sequence: Synthetic oligonucleotide
agacacagccagguuuaa

SEQ ID NO: 9721 - RNA, 18 nt, Artificial Sequence
  Description of Artificial Sequence: Synthetic oligonucleotide
ugcagagacacagccagg

SEQ ID NO: 9722 - RNA, 18 nt, Artificial Sequence
  Description of Artificial Sequence: Synthetic oligonucleotide
cuccaugcagagacacag

SEQ ID NO: 9723 - RNA, 18 nt, Artificial Sequence
  Description of Artificial Sequence: Synthetic oligonucleotide
uuaaacuccaugcagaga

SEQ ID NO: 9724 - RNA, 18 nt, Artificial Sequence
  Description of Artificial Sequence: Synthetic oligonucleotide
auacuuuaaacuccaugc

SEQ ID NO: 9725 - RNA, 18 nt, Artificial Sequence
  Description of Artificial Sequence: Synthetic oligonucleotide
uuuagauacuuuaaacuc

SEQ ID NO: 9726 - RNA, 18 nt, Artificial Sequence
  Description of Artificial Sequence: Synthetic oligonucleotide
uaucuuuuagauacuuua

SEQ ID NO: 9727 - RNA, 18 nt, Artificial Sequence
  Description of Artificial Sequence: Synthetic oligonucleotide
cucauuaucuuuuagaua

SEQ ID NO: 9728 - RNA, 18 nt, Artificial Sequence
  Description of Artificial Sequence: Synthetic oligonucleotide
aaagccucauuaucuuuu

SEQ ID NO: 9729 - RNA, 18 nt, Artificial Sequence
  Description of Artificial Sequence: Synthetic oligonucleotide
agaggaaagccucauuau

SEQ ID NO: 9730 - RNA, 18 nt, Artificial Sequence
  Description of Artificial Sequence: Synthetic oligonucleotide
ggcacagaggaaagccuc

SEQ ID NO: 9731 - RNA, 18 nt, Artificial Sequence
  Description of Artificial Sequence: Synthetic oligonucleotide
aaacuggcacagaggaaa

SEQ ID NO: 9732 - RNA, 18 nt, Artificial Sequence
  Description of Artificial Sequence: Synthetic oligonucleotide
gaggcaaacuggcacaga

SEQ ID NO: 9733 - RNA, 18 nt, Artificial Sequence
  Description of Artificial Sequence: Synthetic oligonucleotide
ggcaggaggcaaacuggc

SEQ ID NO: 9734 - RNA, 18 nt, Artificial Sequence
  Description of Artificial Sequence: Synthetic oligonucleotide
cugcaggcaggaggcaaa

SEQ ID NO: 9735 - RNA, 18 nt, Artificial Sequence
  Description of Artificial Sequence: Synthetic oligonucleotide
gggcucugcaggcaggag

SEQ ID NO: 9736 - RNA, 18 nt, Artificial Sequence
  Description of Artificial Sequence: Synthetic oligonucleotide
gcacaauaacguacaggg

SEQ ID NO: 9737 - RNA, 18 nt, Artificial Sequence
  Description of Artificial Sequence: Synthetic oligonucleotide
uagcacaauaacguacag

SEQ ID NO: 9738 - RNA, 18 nt, Artificial Sequence
  Description of Artificial Sequence: Synthetic oligonucleotide
ucuuuuagcacaauaacg

SEQ ID NO: 9739 - RNA, 18 nt, Artificial Sequence
  Description of Artificial Sequence: Synthetic oligonucleotide
aaagcucuuuuagcacaa

SEQ ID NO: 9740 - RNA, 18 nt, Artificial Sequence
  Description of Artificial Sequence: Synthetic oligonucleotide
aaagaaaagcucuuuuag

SEQ ID NO: 9741 - RNA, 18 nt, Artificial Sequence
  Description of Artificial Sequence: Synthetic oligonucleotide
gaaagaaagaaaagcucu

SEQ ID NO: 9742 - RNA, 18 nt, Artificial Sequence
  Description of Artificial Sequence: Synthetic oligonucleotide
ggugggaaagaaagaaaa

SEQ ID NO: 9743 - RNA, 18 nt, Artificial Sequence
  Description of Artificial Sequence: Synthetic oligonucleotide
acaaaggugggaaagaaa

SEQ ID NO: 9744 - RNA, 18 nt, Artificial Sequence
  Description of Artificial Sequence: Synthetic oligonucleotide
gaaucacaaaggugggaa

SEQ ID NO: 9745 - RNA, 18 nt, Artificial Sequence
  Description of Artificial Sequence: Synthetic oligonucleotide
augaggaaucacaaaggu

SEQ ID NO: 9746 - RNA, 18 nt, Artificial Sequence
  Description of Artificial Sequence: Synthetic oligonucleotide
ggagaaugaggaaucaca

SEQ ID NO: 9747 - RNA, 18 nt, Artificial Sequence
  Description of Artificial Sequence: Synthetic oligonucleotide
cauugggagaaugaggaa

SEQ ID NO: 9748 - RNA, 18 nt, Artificial Sequence
  Description of Artificial Sequence: Synthetic oligonucleotide
aaagucauugggagaaug

SEQ ID NO: 9749 - RNA, 18 nt, Artificial Sequence
  Description of Artificial Sequence: Synthetic oligonucleotide
gagagaaagucauuggga

SEQ ID NO: 9750 - RNA, 18 nt, Artificial Sequence
  Description of Artificial Sequence: Synthetic oligonucleotide
auguagagagaaagucau

SEQ ID NO: 9751 - RNA, 18 nt, Artificial Sequence
  Description of Artificial Sequence: Synthetic oligonucleotide
aaauaauguagagagaaa

SEQ ID NO: 9752 - RNA, 18 nt, Artificial Sequence
  Description of Artificial Sequence: Synthetic oligonucleotide
cuuacaaauaauguagag

SEQ ID NO: 9753 - RNA, 18 nt, Artificial Sequence
  Description of Artificial Sequence: Synthetic oligonucleotide
uaaggcuuacaaauaaug

SEQ ID NO: 9754 - RNA, 18 nt, Artificial Sequence
  Description of Artificial Sequence: Synthetic oligonucleotide
uuuccuaaggcuuacaaa

SEQ ID NO: 9755 - RNA, 18 nt, Artificial Sequence
  Description of Artificial Sequence: Synthetic oligonucleotide
ucuccuuuccuaaggcuu

SEQ ID NO: 9756 - RNA, 18 nt, Artificial Sequence
  Description of Artificial Sequence: Synthetic oligonucleotide
ugaacucuccuuuccuaa

SEQ ID NO: 9757 - RNA, 18 nt, Artificial Sequence
  Description of Artificial Sequence: Synthetic oligonucleotide
cucccugaacucuccuuu

SEQ ID NO: 9758 - RNA, 18 nt, Artificial Sequence
  Description of Artificial Sequence: Synthetic oligonucleotide
uuguccucccugaacucu

SEQ ID NO: 9759 - RNA, 18 nt, Artificial Sequence
  Description of Artificial Sequence: Synthetic oligonucleotide
uuuucuuguccucccuga

SEQ ID NO: 9760 - RNA, 18 nt, Artificial Sequence
  Description of Artificial Sequence: Synthetic oligonucleotide
cagguuuuucuuguccuc

SEQ ID NO: 9761 - RNA, 18 nt, Artificial Sequence
  Description of Artificial Sequence: Synthetic oligonucleotide
cagggcagguuuuucuug

SEQ ID NO: 9762 - RNA, 18 nt, Artificial Sequence
  Description of Artificial Sequence: Synthetic oligonucleotide
ggcagcagggcagguuuu

SEQ ID NO: 9763 - RNA, 18 nt, Artificial Sequence
  Description of Artificial Sequence: Synthetic oligonucleotide
acacaggcagcagggcag

SEQ ID NO: 9764 - RNA, 18 nt, Artificial Sequence
  Description of Artificial Sequence: Synthetic oligonucleotide
gcuuuacacaggcagcag

SEQ ID NO: 9765 - RNA, 18 nt, Artificial Sequence
  Description of Artificial Sequence: Synthetic oligonucleotide
uuccugcuuuacacaggc

SEQ ID NO: 9766 - RNA, 18 nt, Artificial Sequence
  Description of Artificial Sequence: Synthetic oligonucleotide
uaugcuuccugcuuuaca

SEQ ID NO: 9767 - RNA, 18 nt, Artificial Sequence
  Description of Artificial Sequence: Synthetic oligonucleotide
gucacuaugcuuccugcu

SEQ ID NO: 9768 - RNA, 18 nt, Artificial Sequence
  Description of Artificial Sequence: Synthetic oligonucleotide
aagcagucacuaugcuuc

SEQ ID NO: 9769 - RNA, 18 nt, Artificial Sequence
  Description of Artificial Sequence: Synthetic oligonucleotide
guucaaagcagucacuau

SEQ ID NO: 9770 - RNA, 18 nt, Artificial Sequence
  Description of Artificial Sequence: Synthetic oligonucleotide
cuuauguucaaagcaguc

SEQ ID NO: 9771 - RNA, 18 nt, Artificial Sequence
  Description of Artificial Sequence: Synthetic oligonucleotide
gagugcuuauguucaaag

SEQ ID NO: 9772 - RNA, 18 nt, Artificial Sequence
  Description of Artificial Sequence: Synthetic oligonucleotide
cuacugagugcuuauguu

SEQ ID NO: 9773 - RNA, 18 nt, Artificial Sequence
  Description of Artificial Sequence: Synthetic oligonucleotide
gcuggcuacugagugcuu

SEQ ID NO: 9774 - RNA, 18 nt, Artificial Sequence
  Description of Artificial Sequence: Synthetic oligonucleotide
cauuagcuggcuacugag

SEQ ID NO: 9775 - RNA, 18 nt, Artificial Sequence
  Description of Artificial Sequence: Synthetic oligonucleotide
accaccauuagcuggcua

SEQ ID NO: 9776 - RNA, 18 nt, Artificial Sequence
  Description of Artificial Sequence: Synthetic oligonucleotide
ggacaaccaccauuagcu

SEQ ID NO: 9777 - RNA, 18 nt, Artificial Sequence
  Description of Artificial Sequence: Synthetic oligonucleotide
auaaaggacaaccaccau

SEQ ID NO: 9778 - RNA, 18 nt, Artificial Sequence
  Description of Artificial Sequence: Synthetic oligonucleotide
aaaugauaaaggacaacc

SEQ ID NO: 9779 - RNA, 18 nt, Artificial Sequence
  Description of Artificial Sequence: Synthetic oligonucleotide
ugcauaaaugauaaagga

SEQ ID NO: 9780 - RNA, 18 nt, Artificial Sequence
  Description of Artificial Sequence: Synthetic oligonucleotide
ugcugugcauaaaugaua

SEQ ID NO: 9781 - RNA, 18 nt, Artificial Sequence
  Description of Artificial Sequence: Synthetic oligonucleotide
cccagugcugugcauaaa

SEQ ID NO: 9782 - RNA, 18 nt, Artificial Sequence
  Description of Artificial Sequence: Synthetic oligonucleotide
caucucccagugcugugc

SEQ ID NO: 9783 - RNA, 18 nt, Artificial Sequence
  Description of Artificial Sequence: Synthetic oligonucleotide
gcccccaucucccagugc

SEQ ID NO: 9784 - RNA, 18 nt, Artificial Sequence
  Description of Artificial Sequence: Synthetic oligonucleotide
cacuagcccccaucuccc

SEQ ID NO: 9785 - RNA, 18 nt, Artificial Sequence
  Description of Artificial Sequence: Synthetic oligonucleotide
agucacacuagcccccau

SEQ ID NO: 9786 - RNA, 18 nt, Artificial Sequence
  Description of Artificial Sequence: Synthetic oligonucleotide
ucaguagucacacuagcc

SEQ ID NO: 9787 - RNA, 18 nt, Artificial Sequence
  Description of Artificial Sequence: Synthetic oligonucleotide
aaacaucaguagucacac

SEQ ID NO: 9788 - RNA, 18 nt, Artificial Sequence
  Description of Artificial Sequence: Synthetic oligonucleotide
cauugaucuggccuccgc

SEQ ID NO: 9789 - RNA, 18 nt, Artificial Sequence
  Description of Artificial Sequence: Synthetic oligonucleotide
uccaccauugaucuggcc

SEQ ID NO: 9790 - RNA, 18 nt, Artificial Sequence
  Description of Artificial Sequence: Synthetic oligonucleotide
augucuccaccauugauc

SEQ ID NO: 9791 - RNA, 18 nt, Artificial Sequence
  Description of Artificial Sequence: Synthetic oligonucleotide
cagcgaugucuccaccau

SEQ ID NO: 9792 - RNA, 18 nt, Artificial Sequence
  Description of Artificial Sequence: Synthetic oligonucleotide
aaacacagcgaugucucc

SEQ ID NO: 9793 - RNA, 18 nt, Artificial Sequence
  Description of Artificial Sequence: Synthetic oligonucleotide
gacgcaaacacagcgaug

SEQ ID NO: 9794 - RNA, 18 nt, Artificial Sequence
  Description of Artificial Sequence: Synthetic oligonucleotide
cgcgugacgcaaacacag

SEQ ID NO: 9795 - RNA, 18 nt, Artificial Sequence
  Description of Artificial Sequence: Synthetic oligonucleotide
gccagcgcgugacgcaaa

SEQ ID NO: 9796 - RNA, 18 nt, Artificial Sequence
  Description of Artificial Sequence: Synthetic oligonucleotide
ccguggccagcgcgugac

SEQ ID NO: 9797 - RNA, 18 nt, Artificial Sequence
  Description of Artificial Sequence: Synthetic oligonucleotide
aaacgccguggccagcgc

SEQ ID NO: 9798 - RNA, 18 nt, Artificial Sequence
  Description of Artificial Sequence: Synthetic oligonucleotide
ccagcaaacgccguggcc

SEQ ID NO: 9799 - RNA, 18 nt, Artificial Sequence
  Description of Artificial Sequence: Synthetic oligonucleotide
gggugccagcaaacgccg

SEQ ID NO: 9800 - RNA, 18 nt, Artificial Sequence
  Description of Artificial Sequence: Synthetic oligonucleotide
acggcgggugccagcaaa

SEQ ID NO: 9801 - RNA, 18 nt, Artificial Sequence
  Description of Artificial Sequence: Synthetic oligonucleotide
gaagcacggcgggugcca

SEQ ID NO: 9802 - RNA, 18 nt, Artificial Sequence
  Description of Artificial Sequence: Synthetic oligonucleotide
cauacgaagcacggcggg

SEQ ID NO: 9803 - RNA, 18 nt, Artificial Sequence
  Description of Artificial Sequence: Synthetic oligonucleotide
cagugcauacgaagcacg

SEQ ID NO: 9804 - RNA, 18 nt, Artificial Sequence
  Description of Artificial Sequence: Synthetic oligonucleotide
gcagacagugcauacgaa

SEQ ID NO: 9805 - RNA, 18 nt, Artificial Sequence
  Description of Artificial Sequence: Synthetic oligonucleotide
ucauugcagacagugcau

SEQ ID NO: 9806 - RNA, 18 nt, Artificial Sequence
  Description of Artificial Sequence: Synthetic oligonucleotide
ggagcucauugcagacag

SEQ ID NO: 9807 - RNA, 18 nt, Artificial Sequence
  Description of Artificial Sequence: Synthetic oligonucleotide
caccaggagcucauugca

SEQ ID NO: 9808 - RNA, 18 nt, Artificial Sequence
  Description of Artificial Sequence: Synthetic oligonucleotide
agauccaccaggagcuca

SEQ ID NO: 9809 - RNA, 18 nt, Artificial Sequence
  Description of Artificial Sequence: Synthetic oligonucleotide
agaucagauccaccagga

SEQ ID NO: 9810 - RNA, 18 nt, Artificial Sequence
  Description of Artificial Sequence: Synthetic oligonucleotide
aaaguagaucagauccac

SEQ ID NO: 9811 - RNA, 18 nt, Artificial Sequence
  Description of Artificial Sequence: Synthetic oligonucleotide
ugguaaaaguagaucaga

SEQ ID NO: 9812 - RNA, 18 nt, Artificial Sequence
  Description of Artificial Sequence: Synthetic oligonucleotide
caucuugguaaaaguaga

SEQ ID NO: 9813 - RNA, 18 nt, Artificial Sequence
  Description of Artificial Sequence: Synthetic oligonucleotide
cuucccaucuugguaaaa

SEQ ID NO: 9814 - RNA, 18 nt, Artificial Sequence
  Description of Artificial Sequence: Synthetic oligonucleotide
uauaucuucccaucuugg

SEQ ID NO: 9815 - RNA, 18 nt, Artificial Sequence
  Description of Artificial Sequence: Synthetic oligonucleotide
cacaguauaucuucccau

SEQ ID NO: 9816 - RNA, 18 nt, Artificial Sequence
  Description of Artificial Sequence: Synthetic oligonucleotide
ccugccacaguauaucuu

SEQ ID NO: 9817 - RNA, 18 nt, Artificial Sequence
  Description of Artificial Sequence: Synthetic oligonucleotide
uggugccugccacaguau

SEQ ID NO: 9818 - RNA, 18 nt, Artificial Sequence
  Description of Artificial Sequence: Synthetic oligonucleotide
cagcauggugccugccac

SEQ ID NO: 9819 - RNA, 18 nt, Artificial Sequence
  Description of Artificial Sequence: Synthetic oligonucleotide
gcacucagcauggugccu

SEQ ID NO: 9820 - RNA, 18 nt, Artificial Sequence
  Description of Artificial Sequence: Synthetic oligonucleotide
uucaggcacucagcaugg

SEQ ID NO: 9821 - RNA, 18 nt, Artificial Sequence
  Description of Artificial Sequence: Synthetic oligonucleotide
gcggcuucaggcacucag

SEQ ID NO: 9822 - RNA, 18 nt, Artificial Sequence
  Description of Artificial Sequence: Synthetic oligonucleotide
acagcgcggcuucaggca

SEQ ID NO: 9823 - RNA, 18 nt, Artificial Sequence
  Description of Artificial Sequence: Synthetic oligonucleotide
gcagcacagcgcggcuuc

SEQ ID NO: 9824 - RNA, 18 nt, Artificial Sequence
  Description of Artificial Sequence: Synthetic oligonucleotide
cgcaggcagcacagcgcg

SEQ ID NO: 9825 - RNA, 18 nt, Artificial Sequence
  Description of Artificial Sequence: Synthetic oligonucleotide
cucaucgcaggcagcaca

SEQ ID NO: 9826 - RNA, 18 nt, Artificial Sequence
  Description of Artificial Sequence: Synthetic oligonucleotide
gccuccacagauucaggg

SEQ ID NO: 9827 - RNA, 18 nt, Artificial Sequence
  Description of Artificial Sequence: Synthetic oligonucleotide
gacuagccuccacagauu

SEQ ID NO: 9828 - RNA, 18 nt, Artificial Sequence
  Description of Artificial Sequence: Synthetic oligonucleotide
ugcuggacuagccuccac

SEQ ID NO: 9829 - RNA, 18 nt, Artificial Sequence
  Description of Artificial Sequence: Synthetic oligonucleotide
uuaacugcuggacuagcc

SEQ ID NO: 9830 - RNA, 18 nt, Artificial Sequence
  Description of Artificial Sequence: Synthetic oligonucleotide
ucucauuaacugcuggac

SEQ ID NO: 9831 - RNA, 18 nt, Artificial Sequence
  Description of Artificial Sequence: Synthetic oligonucleotide
gcucuucucauuaacugc

SEQ ID NO: 9832 - RNA, 18 nt, Artificial Sequence
  Description of Artificial Sequence: Synthetic oligonucleotide
uacacgcucuucucauua

SEQ ID NO: 9833 - RNA, 18 nt, Artificial Sequence
  Description of Artificial Sequence: Synthetic oligonucleotide
uggaauacacgcucuucu

SEQ ID NO: 9834 - RNA, 18 nt, Artificial Sequence
  Description of Artificial Sequence: Synthetic oligonucleotide
augaguggaauacacgcu

SEQ ID NO: 9835 - RNA, 18 nt, Artificial Sequence
  Description of Artificial Sequence: Synthetic oligonucleotide
uaauuaugaguggaauac

SEQ ID NO: 9836 - RNA, 18 nt, Artificial Sequence
  Description of Artificial Sequence: Synthetic oligonucleotide
ucccauaauuaugagugg

SEQ ID NO: 9837 - RNA, 18 nt, Artificial Sequence
  Description of Artificial Sequence: Synthetic oligonucleotide
aguggucccauaauuaug

SEQ ID NO: 9838 - RNA, 18 nt, Artificial Sequence
  Description of Artificial Sequence: Synthetic oligonucleotide
cucugaguggucccauaa

SEQ ID NO: 9839 - RNA, 18 nt, Artificial Sequence
  Description of Artificial Sequence: Synthetic oligonucleotide
caugccucugaguggucc

SEQ ID NO: 9840 - RNA, 18 nt, Artificial Sequence
  Description of Artificial Sequence: Synthetic oligonucleotide
acacccaugccucugagu

SEQ ID NO: 9841 - RNA, 18 nt, Artificial Sequence
  Description of Artificial Sequence: Synthetic oligonucleotide
ccucgacacccaugccuc

SEQ ID NO: 9842 - RNA, 18 nt, Artificial Sequence
  Description of Artificial Sequence: Synthetic oligonucleotide
gcaguccucgacacccau

SEQ ID NO: 9843 - RNA, 18 nt, Artificial Sequence
  Description of Artificial Sequence: Synthetic oligonucleotide
auaaggcaguccucgaca

SEQ ID NO: 9844 - RNA, 18 nt, Artificial Sequence
  Description of Artificial Sequence: Synthetic oligonucleotide
gagagaaacaaaugcaua

SEQ ID NO: 9845 - RNA, 18 nt, Artificial Sequence
  Description of Artificial Sequence: Synthetic oligonucleotide
uucuggagagaaacaaau

SEQ ID NO: 9846 - RNA, 18 nt, Artificial Sequence
  Description of Artificial Sequence: Synthetic oligonucleotide
cacuguucuggagagaaa

SEQ ID NO: 9847 - RNA, 18 nt, Artificial Sequence
  Description of Artificial Sequence: Synthetic oligonucleotide
aagaucacuguucuggag

SEQ ID NO: 9848 - RNA, 18 nt, Artificial Sequence
  Description of Artificial Sequence: Synthetic oligonucleotide
ccaggaagaucacuguuc

SEQ ID NO: 9849 - RNA, 18 nt, Artificial Sequence
  Description of Artificial Sequence: Synthetic oligonucleotide
acacuccaggaagaucac

SEQ ID NO: 9850 - RNA, 18 nt, Artificial Sequence
  Description of Artificial Sequence: Synthetic oligonucleotide
ggauuacacuccaggaag

SEQ ID NO: 9851 - RNA, 18 nt, Artificial Sequence
  Description of Artificial Sequence: Synthetic oligonucleotide
agaauggauuacacucca

SEQ ID NO: 9852 - RNA, 18 nt, Artificial Sequence
  Description of Artificial Sequence: Synthetic oligonucleotide
guauaagaauggauuaca

SEQ ID NO: 9853 - RNA, 18 nt, Artificial Sequence
  Description of Artificial Sequence: Synthetic oligonucleotide
acaauguauaagaaugga

SEQ ID NO: 9854 - RNA, 18 nt, Artificial Sequence
  Description of Artificial Sequence: Synthetic oligonucleotide
aagucacaauguauaaga

SEQ ID NO: 9855 - RNA, 18 nt, Artificial Sequence
  Description of Artificial Sequence: Synthetic oligonucleotide
caagaaagucacaaugua

SEQ ID NO: 9856 - RNA, 18 nt, Artificial Sequence
  Description of Artificial Sequence: Synthetic oligonucleotide
cauuucaagaaagucaca

SEQ ID NO: 9857 - RNA, 18 nt, Artificial Sequence
  Description of Artificial Sequence: Synthetic oligonucleotide
auaaacauuucaagaaag

SEQ ID NO: 9858 - RNA, 18 nt, Artificial Sequence
  Description of Artificial Sequence: Synthetic oligonucleotide
ugcauauaaacauuucaa

SEQ ID NO: 9859 - RNA, 18 nt, Artificial Sequence
  Description of Artificial Sequence: Synthetic oligonucleotide
caugcugcauauaaacau

SEQ ID NO: 9860 - RNA, 18 nt, Artificial Sequence
  Description of Artificial Sequence: Synthetic oligonucleotide
uucgucaugcugcauaua

SEQ ID NO: 9861 - RNA, 18 nt, Artificial Sequence
  Description of Artificial Sequence: Synthetic oligonucleotide
gcaacuucgucaugcugc

SEQ ID NO: 9862 - RNA, 18 nt, Artificial Sequence
  Description of Artificial Sequence: Synthetic oligonucleotide
gggcaacuucgucaugcu

SEQ ID NO: 9863 - RNA, 18 nt, Artificial Sequence
  Description of Artificial Sequence: Synthetic oligonucleotide
cagggaagugcaaaaggg

SEQ ID NO: 9864 - RNA, 18 nt, Artificial Sequence
  Description of Artificial Sequence: Synthetic oligonucleotide
ggagucagggaagugcaa

SEQ ID NO: 9865 - RNA, 18 nt, Artificial Sequence
  Description of Artificial Sequence: Synthetic oligonucleotide
ccgcuggagucagggaag

SEQ ID NO: 9866 - RNA, 18 nt, Artificial Sequence
  Description of Artificial Sequence: Synthetic oligonucleotide
gacguccgcuggagucag

SEQ ID NO: 9867 - RNA, 18 nt, Artificial Sequence
  Description of Artificial Sequence: Synthetic oligonucleotide
ggcuagacguccgcugga

SEQ ID NO: 9868 - RNA, 18 nt, Artificial Sequence
  Description of Artificial Sequence: Synthetic oligonucleotide
ugcagggcuagacguccg

SEQ ID NO: 9869 - RNA, 18 nt, Artificial Sequence
  Description of Artificial Sequence: Synthetic oligonucleotide
aaugaugcagggcuagac

SEQ ID NO: 9870 - RNA, 18 nt, Artificial Sequence
  Description of Artificial Sequence: Synthetic oligonucleotide
agaacaaugaugcagggc

SEQ ID NO: 9871 - RNA, 18 nt, Artificial Sequence
  Description of Artificial Sequence: Synthetic oligonucleotide
aaacaagaacaaugaugc

SEQ ID NO: 9872 - RNA, 18 nt, Artificial Sequence
  Description of Artificial Sequence: Synthetic oligonucleotide
cauaaaaacaagaacaau

SEQ ID NO: 9873 - RNA, 18 nt, Artificial Sequence
  Description of Artificial Sequence: Synthetic oligonucleotide
ugggacauaaaaacaaga

SEQ ID NO: 9874 - RNA, 18 nt, Artificial Sequence
  Description of Artificial Sequence: Synthetic oligonucleotide
ucaacugggacauaaaaa

SEQ ID NO: 9875 - RNA, 18 nt, Artificial Sequence
  Description of Artificial Sequence: Synthetic oligonucleotide
caaggucaacugggacau

SEQ ID NO: 9876 - RNA, 18 nt, Artificial Sequence
  Description of Artificial Sequence: Synthetic oligonucleotide
aaugccaaggucaacugg

SEQ ID NO: 9877 - RNA, 18 nt, Artificial Sequence
  Description of Artificial Sequence: Synthetic oligonucleotide
aacaaaaugccaagguca

SEQ ID NO: 9878 - RNA, 18 nt, Artificial Sequence
  Description of Artificial Sequence: Synthetic oligonucleotide
gauaaaacaaaaugccaa

SEQ ID NO: 9879 - RNA, 18 nt, Artificial Sequence
  Description of Artificial Sequence: Synthetic oligonucleotide
aaagugauaaaacaaaau

SEQ ID NO: 9880 - RNA, 18 nt, Artificial Sequence
  Description of Artificial Sequence: Synthetic oligonucleotide
ccaggaaagugauaaaac

SEQ ID NO: 9881 - RNA, 18 nt, Artificial Sequence
  Description of Artificial Sequence: Synthetic oligonucleotide
uucaaccaggaaagugau

SEQ ID NO: 9882 - RNA, 18 nt, Artificial Sequence
  Description of Artificial Sequence: Synthetic oligonucleotide
uuggcuucaaccaggaaa

SEQ ID NO: 9883 - RNA, 18 nt, Artificial Sequence
  Description of Artificial Sequence: Synthetic oligonucleotide
caacugggacauaaaaac

SEQ ID NO: 9884 - RNA, 18 nt, Artificial Sequence
  Description of Artificial Sequence: Synthetic oligonucleotide
aaggucaacugggacaua

SEQ ID NO: 9885 - RNA, 18 nt, Artificial Sequence
  Description of Artificial Sequence: Synthetic oligonucleotide
augccaaggucaacuggg

SEQ ID NO: 9886 - RNA, 18 nt, Artificial Sequence
  Description of Artificial Sequence: Synthetic oligonucleotide
acaaaaugccaaggucaa

SEQ ID NO: 9887 - RNA, 18 nt, Artificial Sequence
  Description of Artificial Sequence: Synthetic oligonucleotide
auaaaacaaaaugccaag

SEQ ID NO: 9888 - RNA, 18 nt, Artificial Sequence
  Description of Artificial Sequence: Synthetic oligonucleotide
aagugauaaaacaaaaug

SEQ ID NO: 9889 - RNA, 18 nt, Artificial Sequence
  Description of Artificial Sequence: Synthetic oligonucleotide
caggaaagugauaaaaca

SEQ ID NO: 9890 - RNA, 18 nt, Artificial Sequence
  Description of Artificial Sequence: Synthetic oligonucleotide
ucaaccaggaaagugaua

SEQ ID NO: 9891 - RNA, 18 nt, Artificial Sequence
  Description of Artificial Sequence: Synthetic oligonucleotide
uggcuucaaccaggaaag

SEQ ID NO: 9892 - RNA, 18 nt, Artificial Sequence
  Description of Artificial Sequence: Synthetic oligonucleotide
uuuuuuggcuucaaccag

SEQ ID NO: 9893 - RNA, 18 nt, Artificial Sequence
  Description of Artificial Sequence: Synthetic oligonucleotide
cuuuguuuuuuggcuuca

SEQ ID NO: 9894 - RNA, 18 nt, Artificial Sequence
  Description of Artificial Sequence: Synthetic oligonucleotide
guacccuuuguuuuuugg

SEQ ID NO: 9895 - RNA, 18 nt, Artificial Sequence
  Description of Artificial Sequence: Synthetic oligonucleotide
aaguaguacccuuuguuu

SEQ ID NO: 9896 - RNA, 18 nt, Artificial Sequence
  Description of Artificial Sequence: Synthetic oligonucleotide
gaagaaaguaguacccuu

SEQ ID NO: 9897 - RNA, 18 nt, Artificial Sequence
  Description of Artificial Sequence: Synthetic oligonucleotide
agaaagaagaaaguagua

SEQ ID NO: 9898 - RNA, 18 nt, Artificial Sequence
  Description of Artificial Sequence: Synthetic oligonucleotide
uggaaagaaagaagaaag

SEQ ID NO: 9899 - RNA, 18 nt, Artificial Sequence
  Description of Artificial Sequence: Synthetic oligonucleotide
acauauggaaagaaagaa

SEQ ID NO: 9900 - RNA, 18 nt, Artificial Sequence
  Description of Artificial Sequence: Synthetic oligonucleotide
augguacauauggaaaga

SEQ ID NO: 9901 - RNA, 18 nt, Artificial Sequence
  Description of Artificial Sequence: Synthetic oligonucleotide
aaaguaugguacauaugg

SEQ ID NO: 9902 - RNA, 18 nt, Artificial Sequence
  Description of Artificial Sequence: Synthetic oligonucleotide
ccccuaaaguaugguaca

SEQ ID NO: 9903 - RNA, 18 nt, Artificial Sequence
  Description of Artificial Sequence: Synthetic oligonucleotide
ucucuccccuaaaguaug

SEQ ID NO: 9904 - RNA, 18 nt, Artificial Sequence
  Description of Artificial Sequence: Synthetic oligonucleotide
gccccucucuccccuaaa

SEQ ID NO: 9905 - RNA, 18 nt, Artificial Sequence
  Description of Artificial Sequence: Synthetic oligonucleotide
cacuggccccucucuccc

SEQ ID NO: 9906 - RNA, 18 nt, Artificial Sequence
  Description of Artificial Sequence: Synthetic oligonucleotide
ccaaacacuggccccucu

SEQ ID NO: 9907 - RNA, 18 nt, Artificial Sequence
  Description of Artificial Sequence: Synthetic oligonucleotide
aguguccaaacacuggcc

SEQ ID NO: 9908 - RNA, 18 nt, Artificial Sequence
  Description of Artificial Sequence: Synthetic oligonucleotide
ucaacaguguccaaacac

SEQ ID NO: 9909 - RNA, 18 nt, Artificial Sequence
  Description of Artificial Sequence: Synthetic oligonucleotide
uuaaaucaacagugucca

SEQ ID NO: 9910 - RNA, 18 nt, Artificial Sequence
  Description of Artificial Sequence: Synthetic oligonucleotide
auuuuuuaaaucaacagu

SEQ ID NO: 9911 - RNA, 18 nt, Artificial Sequence
  Description of Artificial Sequence: Synthetic oligonucleotide
auaagauuuuuuaaauca

SEQ ID NO: 9912 - RNA, 18 nt, Artificial Sequence
  Description of Artificial Sequence: Synthetic oligonucleotide
ugaaaauaagauuuuuua

SEQ ID NO: 9913 - RNA, 18 nt, Artificial Sequence
  Description of Artificial Sequence: Synthetic oligonucleotide
gauccugaaaauaagauu

SEQ ID NO: 9914 - RNA, 18 nt, Artificial Sequence
  Description of Artificial Sequence: Synthetic oligonucleotide
auuaugauccugaaaaua

SEQ ID NO: 9915 - RNA, 18 nt, Artificial Sequence
  Description of Artificial Sequence: Synthetic oligonucleotide
ccguaauuaugauccuga

SEQ ID NO: 9916 - RNA, 18 nt, Artificial Sequence
  Description of Artificial Sequence: Synthetic oligonucleotide
gggcuccguaauuaugau

SEQ ID NO: 9917 - RNA, 18 nt, Artificial Sequence
  Description of Artificial Sequence: Synthetic oligonucleotide
ggugucggaggaggaggg

SEQ ID NO: 9918 - RNA, 18 nt, Artificial Sequence
  Description of Artificial Sequence: Synthetic oligonucleotide
gaggugucggaggaggag

SEQ ID NO: 9919 - RNA, 18 nt, Artificial Sequence
  Description of Artificial Sequence: Synthetic oligonucleotide
agcaggaggugucggagg

SEQ ID NO: 9920 - RNA, 18 nt, Artificial Sequence
  Description of Artificial Sequence: Synthetic oligonucleotide
cagaacgagggaugaucg

SEQ ID NO: 9921 - RNA, 18 nt, Artificial Sequence
  Description of Artificial Sequence: Synthetic oligonucleotide
caggucagaacgagggau

SEQ ID NO: 9922 - RNA, 18 nt, Artificial Sequence
  Description of Artificial Sequence: Synthetic oligonucleotide
ccauucaggucagaacga

SEQ ID NO: 9923 - RNA, 18 nt, Artificial Sequence
  Description of Artificial Sequence: Synthetic oligonucleotide
gcaggccauucaggucag

SEQ ID NO: 9924 - RNA, 18 nt, Artificial Sequence
  Description of Artificial Sequence: Synthetic oligonucleotide
cgacggcaggccauucag

SEQ ID NO: 9925 - RNA, 18 nt, Artificial Sequence
  Description of Artificial Sequence: Synthetic oligonucleotide
acaggcgacggcaggcca

SEQ ID NO: 9926 - RNA, 18 nt, Artificial Sequence
  Description of Artificial Sequence: Synthetic oligonucleotide
ccucuacaggcgacggca

SEQ ID NO: 9927 - RNA, 18 nt, Artificial Sequence
  Description of Artificial Sequence: Synthetic oligonucleotide
gcguuccucuacaggcga

SEQ ID NO: 9928 - RNA, 18 nt, Artificial Sequence
  Description of Artificial Sequence: Synthetic oligonucleotide
ccacagcguuccucuaca

SEQ ID NO: 9929 - RNA, 18 nt, Artificial Sequence
  Description of Artificial Sequence: Synthetic oligonucleotide
ugucuccacagcguuccu

SEQ ID NO: 9930 - RNA, 18 nt, Artificial Sequence
  Description of Artificial Sequence: Synthetic oligonucleotide
cgggcugucuccacagcg

SEQ ID NO: 9931 - RNA, 18 nt, Artificial Sequence
  Description of Artificial Sequence: Synthetic oligonucleotide
gaguucgggcugucucca

SEQ ID NO: 9932 - RNA, 18 nt, Artificial Sequence
  Description of Artificial Sequence: Synthetic oligonucleotide
cuucagaguucgggcugu

SEQ ID NO: 9933 - RNA, 18 nt, Artificial Sequence
  Description of Artificial Sequence: Synthetic oligonucleotide
uucuccuucagaguucgg

SEQ ID NO: 9934 - RNA, 18 nt, Artificial Sequence
  Description of Artificial Sequence: Synthetic oligonucleotide
acaguuucuccuucagag

SEQ ID NO: 9935 - RNA, 18 nt, Artificial Sequence
  Description of Artificial Sequence: Synthetic oligonucleotide
uagguacaguuucuccuu

SEQ ID NO: 9936 - RNA, 18 nt, Artificial Sequence
  Description of Artificial Sequence: Synthetic oligonucleotide
ccagguagguacaguuuc

SEQ ID NO: 9937 - RNA, 18 nt, Artificial Sequence
  Description of Artificial Sequence: Synthetic oligonucleotide
ggacaccagguagguaca

SEQ ID NO: 9938 - RNA, 18 nt, Artificial Sequence
  Description of Artificial Sequence: Synthetic oligonucleotide
cacaaggacaccagguag

SEQ ID NO: 9939 - RNA, 18 nt, Artificial Sequence
  Description of Artificial Sequence: Synthetic oligonucleotide
aagaccacaaggacacca

SEQ ID NO: 9940 - RNA, 18 nt, Artificial Sequence
  Description of Artificial Sequence: Synthetic oligonucleotide
ugagaaagaccacaagga

SEQ ID NO: 9941 - RNA, 18 nt, Artificial Sequence
  Description of Artificial Sequence: Synthetic oligonucleotide
cauccugagaaagaccac

SEQ ID NO: 9942 - RNA, 18 nt, Artificial Sequence
  Description of Artificial Sequence: Synthetic oligonucleotide
gaagccauccugagaaag

SEQ ID NO: 9943 - RNA, 18 nt, Artificial Sequence
  Description of Artificial Sequence: Synthetic oligonucleotide
agaaggaagccauccuga

SEQ ID NO: 9944 - RNA, 18 nt, Artificial Sequence
  Description of Artificial Sequence: Synthetic oligonucleotide
aguugagaaggaagccau

SEQ ID NO: 9945 - RNA, 18 nt, Artificial Sequence
  Description of Artificial Sequence: Synthetic oligonucleotide
gucacaguugagaaggaa

SEQ ID NO: 9946 - RNA, 18 nt, Artificial Sequence
  Description of Artificial Sequence: Synthetic oligonucleotide
cacuugucacaguugaga

SEQ ID NO: 9947 - RNA, 18 nt, Artificial Sequence
  Description of Artificial Sequence: Synthetic oligonucleotide
gccuccacagauucaggg

SEQ ID NO: 9948 - RNA, 18 nt, Artificial Sequence
  Description of Artificial Sequence: Synthetic oligonucleotide
gacuagccuccacagauu

SEQ ID NO: 9949 - RNA, 18 nt, Artificial Sequence
  Description of Artificial Sequence: Synthetic oligonucleotide
ugcuggacuagccuccac

SEQ ID NO: 9950 - RNA, 18 nt, Artificial Sequence
  Description of Artificial Sequence: Synthetic oligonucleotide
uuaacugcuggacuagcc

SEQ ID NO: 9951 - RNA, 18 nt, Artificial Sequence
  Description of Artificial Sequence: Synthetic oligonucleotide
ucucauuaacugcuggac

SEQ ID NO: 9952 - RNA, 18 nt, Artificial Sequence
  Description of Artificial Sequence: Synthetic oligonucleotide
gcucuucucauuaacugc

SEQ ID NO: 9953 - RNA, 18 nt, Artificial Sequence
  Description of Artificial Sequence: Synthetic oligonucleotide
uacacgcucuucucauua

SEQ ID NO: 9954 - RNA, 18 nt, Artificial Sequence
  Description of Artificial Sequence: Synthetic oligonucleotide
uggaauacacgcucuucu

SEQ ID NO: 9955 - RNA, 18 nt, Artificial Sequence
  Description of Artificial Sequence: Synthetic oligonucleotide
augaguggaauacacgcu

SEQ ID NO: 9956 - RNA, 18 nt, Artificial Sequence
  Description of Artificial Sequence: Synthetic oligonucleotide
uaauuaugaguggaauac

SEQ ID NO: 9957 - RNA, 18 nt, Artificial Sequence
  Description of Artificial Sequence: Synthetic oligonucleotide
ucccauaauuaugagugg

SEQ ID NO: 9958 - RNA, 18 nt, Artificial Sequence
  Description of Artificial Sequence: Synthetic oligonucleotide
aguggucccauaauuaug

SEQ ID NO: 9959 - RNA, 18 nt, Artificial Sequence
  Description of Artificial Sequence: Synthetic oligonucleotide
cucugaguggucccauaa

SEQ ID NO: 9960 - RNA, 18 nt, Artificial Sequence
  Description of Artificial Sequence: Synthetic oligonucleotide
caugccucugaguggucc

SEQ ID NO: 9961 - RNA, 18 nt, Artificial Sequence
  Description of Artificial Sequence: Synthetic oligonucleotide
acacccaugccucugagu

SEQ ID NO: 9962 - RNA, 18 nt, Artificial Sequence
  Description of Artificial Sequence: Synthetic oligonucleotide
ccucgacacccaugccuc

SEQ ID NO: 9963 - RNA, 18 nt, Artificial Sequence
  Description of Artificial Sequence: Synthetic oligonucleotide
gcaguccucgacacccau

SEQ ID NO: 9964 - RNA, 18 nt, Artificial Sequence
  Description of Artificial Sequence: Synthetic oligonucleotide
auaaggcaguccucgaca

SEQ ID NO: 9965 - RNA, 18 nt, Artificial Sequence
  Description of Artificial Sequence: Synthetic oligonucleotide
gagagaaacaaaugcaua

SEQ ID NO: 9966 - RNA, 18 nt, Artificial Sequence
  Description of Artificial Sequence: Synthetic oligonucleotide
uucuggagagaaacaaau

SEQ ID NO: 9967 - RNA, 18 nt, Artificial Sequence
  Description of Artificial Sequence: Synthetic oligonucleotide
cacuguucuggagagaaa

SEQ ID NO: 9968 - RNA, 18 nt, Artificial Sequence
  Description of Artificial Sequence: Synthetic oligonucleotide
aagaucacuguucuggag

SEQ ID NO: 9969 - RNA, 18 nt, Artificial Sequence
  Description of Artificial Sequence: Synthetic oligonucleotide
ccaggaagaucacuguuc

SEQ ID NO: 9970 - RNA, 18 nt, Artificial Sequence
  Description of Artificial Sequence: Synthetic oligonucleotide
acacuccaggaagaucac

SEQ ID NO: 9971 - RNA, 18 nt, Artificial Sequence
  Description of Artificial Sequence: Synthetic oligonucleotide
ggauuacacuccaggaag

SEQ ID NO: 9972 - RNA, 18 nt, Artificial Sequence
  Description of Artificial Sequence: Synthetic oligonucleotide
agaauggauuacacucca

SEQ ID NO: 9973 - RNA, 18 nt, Artificial Sequence
  Description of Artificial Sequence: Synthetic oligonucleotide
guauaagaauggauuaca

SEQ ID NO: 9974 - RNA, 18 nt, Artificial Sequence
  Description of Artificial Sequence: Synthetic oligonucleotide
acaauguauaagaaugga

SEQ ID NO: 9975 - RNA, 18 nt, Artificial Sequence
  Description of Artificial Sequence: Synthetic oligonucleotide
aagucacaauguauaaga

SEQ ID NO: 9976 - RNA, 18 nt, Artificial Sequence
  Description of Artificial Sequence: Synthetic oligonucleotide
caagaaagucacaaugua

SEQ ID NO: 9977 - RNA, 18 nt, Artificial Sequence
  Description of Artificial Sequence: Synthetic oligonucleotide
cauuucaagaaagucaca

SEQ ID NO: 9978 - RNA, 18 nt, Artificial Sequence
  Description of Artificial Sequence: Synthetic oligonucleotide
auaaacauuucaagaaag

SEQ ID NO: 9979 - RNA, 18 nt, Artificial Sequence
  Description of Artificial Sequence: Synthetic oligonucleotide
ugcauauaaacauuucaa

SEQ ID NO: 9980 - RNA, 18 nt, Artificial Sequence
  Description of Artificial Sequence: Synthetic oligonucleotide
caugcugcauauaaacau

SEQ ID NO: 9981 - RNA, 18 nt, Artificial Sequence
  Description of Artificial Sequence: Synthetic oligonucleotide
uucgucaugcugcauaua

SEQ ID NO: 9982 - RNA, 18 nt, Artificial Sequence
  Description of Artificial Sequence: Synthetic oligonucleotide
gcaacuucgucaugcugc

SEQ ID NO: 9983 - RNA, 18 nt, Artificial Sequence
  Description of Artificial Sequence: Synthetic oligonucleotide
gggcaacuucgucaugcu

SEQ ID NO: 9984 - RNA, 18 nt, Artificial Sequence
  Description of Artificial Sequence: Synthetic oligonucleotide
cagggaagugcaaaaggg

SEQ ID NO: 9985 - RNA, 18 nt, Artificial Sequence
  Description of Artificial Sequence: Synthetic oligonucleotide
ggagucagggaagugcaa

SEQ ID NO: 9986 - RNA, 18 nt, Artificial Sequence
  Description of Artificial Sequence: Synthetic oligonucleotide
ccgcuggagucagggaag

SEQ ID NO: 9987 - RNA, 18 nt, Artificial Sequence
  Description of Artificial Sequence: Synthetic oligonucleotide
gacguccgcuggagucag

SEQ ID NO: 9988 - RNA, 18 nt, Artificial Sequence
  Description of Artificial Sequence: Synthetic oligonucleotide
ggcuagacguccgcugga

SEQ ID NO: 9989 - RNA, 18 nt, Artificial Sequence
  Description of Artificial Sequence: Synthetic oligonucleotide
ugcagggcuagacguccg

SEQ ID NO: 9990 - RNA, 18 nt, Artificial Sequence
  Description of Artificial Sequence: Synthetic oligonucleotide
aaugaugcagggcuagac

SEQ ID NO: 9991 - RNA, 18 nt, Artificial Sequence
  Description of Artificial Sequence: Synthetic oligonucleotide
agaacaaugaugcagggc

SEQ ID NO: 9992 - RNA, 18 nt, Artificial Sequence
  Description of Artificial Sequence: Synthetic oligonucleotide
aaacaagaacaaugaugc

SEQ ID NO: 9993 - RNA, 18 nt, Artificial Sequence
  Description of Artificial Sequence: Synthetic oligonucleotide
cauaaaaacaagaacaau

SEQ ID NO: 9994 - RNA, 18 nt, Artificial Sequence
  Description of Artificial Sequence: Synthetic oligonucleotide
ugggacauaaaaacaaga

SEQ ID NO: 9995 - RNA, 18 nt, Artificial Sequence
  Description of Artificial Sequence: Synthetic oligonucleotide
ucaacugggacauaaaaa

SEQ ID NO: 9996 - RNA, 18 nt, Artificial Sequence
  Description of Artificial Sequence: Synthetic oligonucleotide
caaggucaacugggacau

SEQ ID NO: 9997 - RNA, 18 nt, Artificial Sequence
  Description of Artificial Sequence: Synthetic oligonucleotide
aaugccaaggucaacugg

SEQ ID NO: 9998 - RNA, 18 nt, Artificial Sequence
  Description of Artificial Sequence: Synthetic oligonucleotide
aacaaaaugccaagguca

SEQ ID NO: 9999 - RNA, 18 nt, Artificial Sequence
  Description of Artificial Sequence: Synthetic oligonucleotide
gauaaaacaaaaugccaa

SEQ ID NO: 10000 - RNA, 18 nt, Artificial Sequence
  Description of Artificial Sequence: Synthetic oligonucleotide
aaagugauaaaacaaaau

SEQ ID NO: 10001 - RNA, 18 nt, Artificial Sequence
  Description of Artificial Sequence: Synthetic oligonucleotide
ccaggaaagugauaaaac

SEQ ID NO: 10002 - RNA, 18 nt, Artificial Sequence
  Description of Artificial Sequence: Synthetic oligonucleotide
uucaaccaggaaagugau

SEQ ID NO: 10003 - RNA, 18 nt, Artificial Sequence
  Description of Artificial Sequence: Synthetic oligonucleotide
uuggcuucaaccaggaaa

SEQ ID NO: 10004 - RNA, 18 nt, Artificial Sequence
  Description of Artificial Sequence: Synthetic oligonucleotide
caacugggacauaaaaac

SEQ ID NO: 10005 - RNA, 18 nt, Artificial Sequence
  Description of Artificial Sequence: Synthetic oligonucleotide
aaggucaacugggacaua

SEQ ID NO: 10006 - RNA, 18 nt, Artificial Sequence
  Description of Artificial Sequence: Synthetic oligonucleotide
augccaaggucaacuggg

SEQ ID NO: 10007 - RNA, 18 nt, Artificial Sequence
  Description of Artificial Sequence: Synthetic oligonucleotide
acaaaaugccaaggucaa

SEQ ID NO: 10008 - RNA, 18 nt, Artificial Sequence
  Description of Artificial Sequence: Synthetic oligonucleotide
auaaaacaaaaugccaag

SEQ ID NO: 10009 - RNA, 18 nt, Artificial Sequence
  Description of Artificial Sequence: Synthetic oligonucleotide
aagugauaaaacaaaaug

SEQ ID NO: 10010 - RNA, 18 nt, Artificial Sequence
  Description of Artificial Sequence: Synthetic oligonucleotide
caggaaagugauaaaaca

SEQ ID NO: 10011 - RNA, 18 nt, Artificial Sequence
  Description of Artificial Sequence: Synthetic oligonucleotide
ucaaccaggaaagugaua

SEQ ID NO: 10012 - RNA, 18 nt, Artificial Sequence
  Description of Artificial Sequence: Synthetic oligonucleotide
uggcuucaaccaggaaag

SEQ ID NO: 10013 - RNA, 18 nt, Artificial Sequence
  Description of Artificial Sequence: Synthetic oligonucleotide
uuuuuuggcuucaaccag

SEQ ID NO: 10014 - RNA, 18 nt, Artificial Sequence
  Description of Artificial Sequence: Synthetic oligonucleotide
cuuuguuuuuuggcuuca

SEQ ID NO: 10015 - RNA, 18 nt, Artificial Sequence
  Description of Artificial Sequence: Synthetic oligonucleotide
guacccuuuguuuuuugg

SEQ ID NO: 10016 - RNA, 18 nt, Artificial Sequence
  Description of Artificial Sequence: Synthetic oligonucleotide
aaguaguacccuuuguuu

SEQ ID NO: 10017 - RNA, 18 nt, Artificial Sequence
  Description of Artificial Sequence: Synthetic oligonucleotide
gaagaaaguaguacccuu

SEQ ID NO: 10018 - RNA, 18 nt, Artificial Sequence
  Description of Artificial Sequence: Synthetic oligonucleotide
agaaagaagaaaguagua

SEQ ID NO: 10019 - RNA, 18 nt, Artificial Sequence
  Description of Artificial Sequence: Synthetic oligonucleotide
uggaaagaaagaagaaag

SEQ ID NO: 10020 - RNA, 18 nt, Artificial Sequence
  Description of Artificial Sequence: Synthetic oligonucleotide
acauauggaaagaaagaa

SEQ ID NO: 10021 - RNA, 18 nt, Artificial Sequence
  Description of Artificial Sequence: Synthetic oligonucleotide
augguacauauggaaaga

SEQ ID NO: 10022 - RNA, 18 nt, Artificial Sequence
  Description of Artificial Sequence: Synthetic oligonucleotide
aaaguaugguacauaugg

SEQ ID NO: 10023 - RNA, 18 nt, Artificial Sequence
  Description of Artificial Sequence: Synthetic oligonucleotide
ccccuaaaguaugguaca

SEQ ID NO: 10024 - RNA, 18 nt, Artificial Sequence
  Description of Artificial Sequence: Synthetic oligonucleotide
ucucuccccuaaaguaug

SEQ ID NO: 10025 - RNA, 18 nt, Artificial Sequence
  Description of Artificial Sequence: Synthetic oligonucleotide
gccccucucuccccuaaa

SEQ ID NO: 10026 - RNA, 18 nt, Artificial Sequence
  Description of Artificial Sequence: Synthetic oligonucleotide
cacuggccccucucuccc

SEQ ID NO: 10027 - RNA, 18 nt, Artificial Sequence
  Description of Artificial Sequence: Synthetic oligonucleotide
ccaaacacuggccccucu

SEQ ID NO: 10028 - RNA, 18 nt, Artificial Sequence
  Description of Artificial Sequence: Synthetic oligonucleotide
aguguccaaacacuggcc

SEQ ID NO: 10029 - RNA, 18 nt, Artificial Sequence
  Description of Artificial Sequence: Synthetic oligonucleotide
ucaacaguguccaaacac

SEQ ID NO: 10030 - RNA, 18 nt, Artificial Sequence
  Description of Artificial Sequence: Synthetic oligonucleotide
uuaaaucaacagugucca

SEQ ID NO: 10031 - RNA, 18 nt, Artificial Sequence
  Description of Artificial Sequence: Synthetic oligonucleotide
auuuuuuaaaucaacagu

SEQ ID NO: 10032 - RNA, 18 nt, Artificial Sequence
  Description of Artificial Sequence: Synthetic oligonucleotide
auaagauuuuuuaaauca

SEQ ID NO: 10033 - RNA, 18 nt, Artificial Sequence
  Description of Artificial Sequence: Synthetic oligonucleotide
ugaaaauaagauuuuuua

SEQ ID NO: 10034 - RNA, 18 nt, Artificial Sequence
  Description of Artificial Sequence: Synthetic oligonucleotide
gauccugaaaauaagauu

SEQ ID NO: 10035 - RNA, 18 nt, Artificial Sequence
  Description of Artificial Sequence: Synthetic oligonucleotide
auuaugauccugaaaaua

SEQ ID NO: 10036 - RNA, 18 nt, Artificial Sequence
  Description of Artificial Sequence: Synthetic oligonucleotide
ccguaauuaugauccuga

SEQ ID NO: 10037 - RNA, 18 nt, Artificial Sequence
  Description of Artificial Sequence: Synthetic oligonucleotide
gggcuccguaauuaugau

SEQ ID NO: 10038 - RNA, 18 nt, Artificial Sequence
  Description of Artificial Sequence: Synthetic oligonucleotide
ggugucggaggaggaggg

SEQ ID NO: 10039 - RNA, 18 nt, Artificial Sequence
  Description of Artificial Sequence: Synthetic oligonucleotide
gaggugucggaggaggag

SEQ ID NO: 10040 - RNA, 18 nt, Artificial Sequence
  Description of Artificial Sequence: Synthetic oligonucleotide
agcaggaggugucggagg

SEQ ID NO: 10041 - RNA, 18 nt, Artificial Sequence
  Description of Artificial Sequence: Synthetic oligonucleotide
cagaacgagggaugaucg

SEQ ID NO: 10042 - RNA, 18 nt, Artificial Sequence
  Description of Artificial Sequence: Synthetic oligonucleotide
caggucagaacgagggau

SEQ ID NO: 10043 - RNA, 18 nt, Artificial Sequence
  Description of Artificial Sequence: Synthetic oligonucleotide
ccauucaggucagaacga

SEQ ID NO: 10044 - RNA, 18 nt, Artificial Sequence
  Description of Artificial Sequence: Synthetic oligonucleotide
gcaggccauucaggucag

SEQ ID NO: 10045 - RNA, 18 nt, Artificial Sequence
  Description of Artificial Sequence: Synthetic oligonucleotide
cgacggcaggccauucag

SEQ ID NO: 10046 - RNA, 18 nt, Artificial Sequence
  Description of Artificial Sequence: Synthetic oligonucleotide
acaggcgacggcaggcca

SEQ ID NO: 10047 - RNA, 18 nt, Artificial Sequence
  Description of Artificial Sequence: Synthetic oligonucleotide
ccucuacaggcgacggca

SEQ ID NO: 10048 - RNA, 18 nt, Artificial Sequence
  Description of Artificial Sequence: Synthetic oligonucleotide
gcguuccucuacaggcga

SEQ ID NO: 10049 - RNA, 18 nt, Artificial Sequence
  Description of Artificial Sequence: Synthetic oligonucleotide
ccacagcguuccucuaca

SEQ ID NO: 10050 - RNA, 18 nt, Artificial Sequence
  Description of Artificial Sequence: Synthetic oligonucleotide
ugucuccacagcguuccu

SEQ ID NO: 10051 - RNA, 18 nt, Artificial Sequence
  Description of Artificial Sequence: Synthetic oligonucleotide
cgggcugucuccacagcg

SEQ ID NO: 10052 - RNA, 18 nt, Artificial Sequence
  Description of Artificial Sequence: Synthetic oligonucleotide
gaguucgggcugucucca

SEQ ID NO: 10053 - RNA, 18 nt, Artificial Sequence
  Description of Artificial Sequence: Synthetic oligonucleotide
cuucagaguucgggcugu

SEQ ID NO: 10054 - RNA, 18 nt, Artificial Sequence
  Description of Artificial Sequence: Synthetic oligonucleotide
uucuccuucagaguucgg

SEQ ID NO: 10055 - RNA, 18 nt, Artificial Sequence
  Description of Artificial Sequence: Synthetic oligonucleotide
acaguuucuccuucagag

SEQ ID NO: 10056 - RNA, 18 nt, Artificial Sequence
  Description of Artificial Sequence: Synthetic oligonucleotide
uagguacaguuucuccuu

SEQ ID NO: 10057 - RNA, 18 nt, Artificial Sequence
  Description of Artificial Sequence: Synthetic oligonucleotide
ccagguagguacaguuuc

SEQ ID NO: 10058 - RNA, 18 nt, Artificial Sequence
  Description of Artificial Sequence: Synthetic oligonucleotide
ggacaccagguagguaca

SEQ ID NO: 10059 - RNA, 18 nt, Artificial Sequence
  Description of Artificial Sequence: Synthetic oligonucleotide
cacaaggacaccagguag

SEQ ID NO: 10060 - RNA, 18 nt, Artificial Sequence
  Description of Artificial Sequence: Synthetic oligonucleotide
aagaccacaaggacacca

SEQ ID NO: 10061 - RNA, 18 nt, Artificial Sequence
  Description of Artificial Sequence: Synthetic oligonucleotide
ugagaaagaccacaagga

SEQ ID NO: 10062 - RNA, 18 nt, Artificial Sequence
  Description of Artificial Sequence: Synthetic oligonucleotide
cauccugagaaagaccac

SEQ ID NO: 10063 - RNA, 18 nt, Artificial Sequence
  Description of Artificial Sequence: Synthetic oligonucleotide
gaagccauccugagaaag

SEQ ID NO: 10064 - RNA, 18 nt, Artificial Sequence
  Description of Artificial Sequence: Synthetic oligonucleotide
agaaggaagccauccuga

SEQ ID NO: 10065 - RNA, 18 nt, Artificial Sequence
  Description of Artificial Sequence: Synthetic oligonucleotide
aguugagaaggaagccau

SEQ ID NO: 10066 - RNA, 18 nt, Artificial Sequence
  Description of Artificial Sequence: Synthetic oligonucleotide
gucacaguugagaaggaa

SEQ ID NO: 10067 - RNA, 18 nt, Artificial Sequence
  Description of Artificial Sequence: Synthetic oligonucleotide
cacuugucacaguugaga

SEQ ID NO: 10068 - RNA, 18 nt, Artificial Sequence
  Description of Artificial Sequence: Synthetic oligonucleotide
aaacuucauucuggaaca

SEQ ID NO: 10069 - RNA, 18 nt, Artificial Sequence
  Description of Artificial Sequence: Synthetic oligonucleotide
uccuaaaacuucauucug

SEQ ID NO: 10070 - RNA, 18 nt, Artificial Sequence
  Description of Artificial Sequence: Synthetic oligonucleotide
aguguuccuaaaacuuca

SEQ ID NO: 10071 - RNA, 18 nt, Artificial Sequence
  Description of Artificial Sequence: Synthetic oligonucleotide
gcuguaguguuccuaaaa

SEQ ID NO: 10072 - RNA, 18 nt, Artificial Sequence
  Description of Artificial Sequence: Synthetic oligonucleotide
gccccgcuguaguguucc

SEQ ID NO: 10073 - RNA, 18 nt, Artificial Sequence
  Description of Artificial Sequence: Synthetic oligonucleotide
ucuuugccccgcuguagu

SEQ ID NO: 10074 - RNA, 18 nt, Artificial Sequence
  Description of Artificial Sequence: Synthetic oligonucleotide
ucuccucuuugccccgcu

SEQ ID NO: 10075 - RNA, 18 nt, Artificial Sequence
  Description of Artificial Sequence: Synthetic oligonucleotide
aauguucuccucuuugcc

SEQ ID NO: 10076 - RNA, 18 nt, Artificial Sequence
  Description of Artificial Sequence: Synthetic oligonucleotide
caagaaauguucuccucu

SEQ ID NO: 10077 - RNA, 18 nt, Artificial Sequence
  Description of Artificial Sequence: Synthetic oligonucleotide
ugucacaagaaauguucu

SEQ ID NO: 10078 - RNA, 18 nt, Artificial Sequence
  Description of Artificial Sequence: Synthetic oligonucleotide
gagauugucacaagaaau

SEQ ID NO: 10079 - RNA, 18 nt, Artificial Sequence
  Description of Artificial Sequence: Synthetic oligonucleotide
aggacgagauugucacaa

SEQ ID NO: 10080 - RNA, 18 nt, Artificial Sequence
  Description of Artificial Sequence: Synthetic oligonucleotide
uuuccaggacgagauugu

SEQ ID NO: 10081 - RNA, 18 nt, Artificial Sequence
  Description of Artificial Sequence: Synthetic oligonucleotide
guugauuuccaggacgag

SEQ ID NO: 10082 - RNA, 18 nt, Artificial Sequence
  Description of Artificial Sequence: Synthetic oligonucleotide
agagaguugauuuccagg

SEQ ID NO: 10083 - RNA, 18 nt, Artificial Sequence
  Description of Artificial Sequence: Synthetic oligonucleotide
accccgaggagaacaggg

SEQ ID NO: 10084 - RNA, 18 nt, Artificial Sequence
  Description of Artificial Sequence: Synthetic oligonucleotide
ggaucaccccgaggagaa

SEQ ID NO: 10085 - RNA, 18 nt, Artificial Sequence
  Description of Artificial Sequence: Synthetic oligonucleotide
ucccgggaucaccccgag

SEQ ID NO: 10086 - RNA, 18 nt, Artificial Sequence
  Description of Artificial Sequence: Synthetic oligonucleotide
uaccuucccgggaucacc

SEQ ID NO: 10087 - RNA, 18 nt, Artificial Sequence
  Description of Artificial Sequence: Synthetic oligonucleotide
gccucuaccuucccggga

SEQ ID NO: 10088 - RNA, 18 nt, Artificial Sequence
  Description of Artificial Sequence: Synthetic oligonucleotide
agaaagccucuaccuucc

SEQ ID NO: 10089 - RNA, 18 nt, Artificial Sequence
  Description of Artificial Sequence: Synthetic oligonucleotide
uuacgagaaagccucuac

SEQ ID NO: 10090 - RNA, 18 nt, Artificial Sequence
  Description of Artificial Sequence: Synthetic oligonucleotide
aacacuuacgagaaagcc

SEQ ID NO: 10091 - RNA, 18 nt, Artificial Sequence
  Description of Artificial Sequence: Synthetic oligonucleotide
gacaaaacacuuacgaga

SEQ ID NO: 10092 - RNA, 18 nt, Artificial Sequence
  Description of Artificial Sequence: Synthetic oligonucleotide
uuggagacaaaacacuua

SEQ ID NO: 10093 - RNA, 18 nt, Artificial Sequence
  Description of Artificial Sequence: Synthetic oligonucleotide
ccuauuuggagacaaaac

SEQ ID NO: 10094 - RNA, 18 nt, Artificial Sequence
  Description of Artificial Sequence: Synthetic oligonucleotide
agguuccuauuuggagac

SEQ ID NO: 10095 - RNA, 18 nt, Artificial Sequence
  Description of Artificial Sequence: Synthetic oligonucleotide
ggaauagguuccuauuug

SEQ ID NO: 10096 - RNA, 18 nt, Artificial Sequence
  Description of Artificial Sequence: Synthetic oligonucleotide
ucgaaggaauagguuccu

SEQ ID NO: 10097 - RNA, 18 nt, Artificial Sequence
  Description of Artificial Sequence: Synthetic oligonucleotide
ggaugucgaaggaauagg

SEQ ID NO: 10098 - RNA, 18 nt, Artificial Sequence
  Description of Artificial Sequence: Synthetic oligonucleotide
auuugggaugucgaagga

SEQ ID NO: 10099 - RNA, 18 nt, Artificial Sequence
  Description of Artificial Sequence: Synthetic oligonucleotide
uuuccauuugggaugucg

SEQ ID NO: 10100 - RNA, 18 nt, Artificial Sequence
  Description of Artificial Sequence: Synthetic oligonucleotide
uggucuuuccauuuggga

SEQ ID NO: 10101 - RNA, 18 nt, Artificial Sequence
  Description of Artificial Sequence: Synthetic oligonucleotide
acuacuggucuuuccauu

SEQ ID NO: 10102 - RNA, 18 nt, Artificial Sequence
  Description of Artificial Sequence: Synthetic oligonucleotide
caaauacuacuggucuuu

SEQ ID NO: 10103 - RNA, 18 nt, Artificial Sequence
  Description of Artificial Sequence: Synthetic oligonucleotide
ugcuccaaauacuacugg

SEQ ID NO: 10104 - RNA, 18 nt, Artificial Sequence
  Description of Artificial Sequence: Synthetic oligonucleotide
cuccuugcuccaaauacu

SEQ ID NO: 10105 - RNA, 18 nt, Artificial Sequence
  Description of Artificial Sequence: Synthetic oligonucleotide
augcucuccuugcuccaa

SEQ ID NO: 10106 - RNA, 18 nt, Artificial Sequence
  Description of Artificial Sequence: Synthetic oligonucleotide
uaauaaugcucuccuugc

SEQ ID NO: 10107 - RNA, 18 nt, Artificial Sequence
  Description of Artificial Sequence: Synthetic oligonucleotide
gaacuuaauaaugcucuc

SEQ ID NO: 10108 - RNA, 18 nt, Artificial Sequence
  Description of Artificial Sequence: Synthetic oligonucleotide
ggcuagaacuuaauaaug

SEQ ID NO: 10109 - RNA, 18 nt, Artificial Sequence
  Description of Artificial Sequence: Synthetic oligonucleotide
gcugaggcuagaacuuaa

SEQ ID NO: 10110 - RNA, 18 nt, Artificial Sequence
  Description of Artificial Sequence: Synthetic oligonucleotide
ucuaugcugaggcuagaa

SEQ ID NO: 10111 - RNA, 18 nt, Artificial Sequence
  Description of Artificial Sequence: Synthetic oligonucleotide
gaaagucuaugcugaggc

SEQ ID NO: 10112 - RNA, 18 nt, Artificial Sequence
  Description of Artificial Sequence: Synthetic oligonucleotide
aaggagaaagucuaugcu

SEQ ID NO: 10113 - RNA, 18 nt, Artificial Sequence
  Description of Artificial Sequence: Synthetic oligonucleotide
ccuugcuccaaauacuac

SEQ ID NO: 10114 - RNA, 18 nt, Artificial Sequence
  Description of Artificial Sequence: Synthetic oligonucleotide
gcucuccuugcuccaaau

SEQ ID NO: 10115 - RNA, 18 nt, Artificial Sequence
  Description of Artificial Sequence: Synthetic oligonucleotide
auaaugcucuccuugcuc

SEQ ID NO: 10116 - RNA, 18 nt, Artificial Sequence
  Description of Artificial Sequence: Synthetic oligonucleotide
acuuaauaaugcucuccu

SEQ ID NO: 10117 - RNA, 18 nt, Artificial Sequence
  Description of Artificial Sequence: Synthetic oligonucleotide
cuagaacuuaauaaugcu

SEQ ID NO: 10118 - RNA, 18 nt, Artificial Sequence
  Description of Artificial Sequence: Synthetic oligonucleotide
ugaggcuagaacuuaaua

SEQ ID NO: 10119 - RNA, 18 nt, Artificial Sequence
  Description of Artificial Sequence: Synthetic oligonucleotide
uaugcugaggcuagaacu

SEQ ID NO: 10120 - RNA, 18 nt, Artificial Sequence
  Description of Artificial Sequence: Synthetic oligonucleotide
aagucuaugcugaggcua

SEQ ID NO: 10121 - RNA, 18 nt, Artificial Sequence
  Description of Artificial Sequence: Synthetic oligonucleotide
ggagaaagucuaugcuga

SEQ ID NO: 10122 - RNA, 18 nt, Artificial Sequence
  Description of Artificial Sequence: Synthetic oligonucleotide
aggaaggagaaagucuau

SEQ ID NO: 10123 - RNA, 18 nt, Artificial Sequence
  Description of Artificial Sequence: Synthetic oligonucleotide
gguuuaggaaggagaaag

SEQ ID NO: 10124 - RNA, 18 nt, Artificial Sequence
  Description of Artificial Sequence: Synthetic oligonucleotide
gggaggguuuaggaagga

SEQ ID NO: 10125 - RNA, 18 nt, Artificial Sequence
  Description of Artificial Sequence: Synthetic oligonucleotide
uggaacaauauggaaggg

SEQ ID NO: 10126 - RNA, 18 nt, Artificial Sequence
  Description of Artificial Sequence: Synthetic oligonucleotide
gauggaacaauauggaag

SEQ ID NO: 10127 - RNA, 18 nt, Artificial Sequence
  Description of Artificial Sequence: Synthetic oligonucleotide
aucuggauggaacaauau

SEQ ID NO: 10128 - RNA, 18 nt, Artificial Sequence
  Description of Artificial Sequence: Synthetic oligonucleotide
gaggaaucuggauggaac

SEQ ID NO: 10129 - RNA, 18 nt, Artificial Sequence
  Description of Artificial Sequence: Synthetic oligonucleotide
uuggagaggaaucuggau

SEQ ID NO: 10130 - RNA, 18 nt, Artificial Sequence
  Description of Artificial Sequence: Synthetic oligonucleotide
agacauuggagaggaauc

SEQ ID NO: 10131 - RNA, 18 nt, Artificial Sequence
  Description of Artificial Sequence: Synthetic oligonucleotide
uugauagacauuggagag

SEQ ID NO: 10132 - RNA, 18 nt, Artificial Sequence
  Description of Artificial Sequence: Synthetic oligonucleotide
ugacuuugauagacauug

SEQ ID NO: 10133 - RNA, 18 nt, Artificial Sequence
  Description of Artificial Sequence: Synthetic oligonucleotide
aacuaugacuuugauaga

SEQ ID NO: 10134 - RNA, 18 nt, Artificial Sequence
  Description of Artificial Sequence: Synthetic oligonucleotide
cuuagaacuaugacuuug

SEQ ID NO: 10135 - RNA, 18 nt, Artificial Sequence
  Description of Artificial Sequence: Synthetic oligonucleotide
gcaggcuuagaacuauga

SEQ ID NO: 10136 - RNA, 18 nt, Artificial Sequence
  Description of Artificial Sequence: Synthetic oligonucleotide
uuucagcaggcuuagaac

SEQ ID NO: 10137 - RNA, 18 nt, Artificial Sequence
  Description of Artificial Sequence: Synthetic oligonucleotide
uggccuuucagcaggcuu

SEQ ID NO: 10138 - RNA, 18 nt, Artificial Sequence
  Description of Artificial Sequence: Synthetic oligonucleotide
uucacuggccuuucagca

SEQ ID NO: 10139 - RNA, 18 nt, Artificial Sequence
  Description of Artificial Sequence: Synthetic oligonucleotide
gggccuucacuggccuuu

SEQ ID NO: 10140 - RNA, 18 nt, Artificial Sequence
  Description of Artificial Sequence: Synthetic oligonucleotide
caccagggccuucacugg

SEQ ID NO: 10141 - RNA, 18 nt, Artificial Sequence
  Description of Artificial Sequence: Synthetic oligonucleotide
ggugacaccagggccuuc

SEQ ID NO: 10142 - RNA, 18 nt, Artificial Sequence
  Description of Artificial Sequence: Synthetic oligonucleotide
acuuauguuauaggcaua

SEQ ID NO: 10143 - RNA, 18 nt, Artificial Sequence
  Description of Artificial Sequence: Synthetic oligonucleotide
uuuagacuuauguuauag

SEQ ID NO: 10144 - RNA, 18 nt, Artificial Sequence
  Description of Artificial Sequence: Synthetic oligonucleotide
ccuccuuuagacuuaugu

SEQ ID NO: 10145 - RNA, 18 nt, Artificial Sequence
  Description of Artificial Sequence: Synthetic oligonucleotide
caucaccuccuuuagacu

SEQ ID NO: 10146 - RNA, 18 nt, Artificial Sequence
  Description of Artificial Sequence: Synthetic oligonucleotide
accugcaucaccuccuuu

SEQ ID NO: 10147 - RNA, 18 nt, Artificial Sequence
  Description of Artificial Sequence: Synthetic oligonucleotide
ucaguaccugcaucaccu

SEQ ID NO: 10148 - RNA, 18 nt, Artificial Sequence
  Description of Artificial Sequence: Synthetic oligonucleotide
guggcucaguaccugcau

SEQ ID NO: 10149 - RNA, 18 nt, Artificial Sequence
  Description of Artificial Sequence: Synthetic oligonucleotide
accacguggcucaguacc

SEQ ID NO: 10150 - RNA, 18 nt, Artificial Sequence
  Description of Artificial Sequence: Synthetic oligonucleotide
ccaggaccacguggcuca

SEQ ID NO: 10151 - RNA, 18 nt, Artificial Sequence
  Description of Artificial Sequence: Synthetic oligonucleotide
gaacuccaggaccacgug

SEQ ID NO: 10152 - RNA, 18 nt, Artificial Sequence
  Description of Artificial Sequence: Synthetic oligonucleotide
gggaacuccaggaccacg

SEQ ID NO: 10153 - RNA, 18 nt, Artificial Sequence
  Description of Artificial Sequence: Synthetic oligonucleotide
aauccaucuguugcaggg

SEQ ID NO: 10154 - RNA, 18 nt, Artificial Sequence
  Description of Artificial Sequence: Synthetic oligonucleotide
gggaauccaucuguugca

SEQ ID NO: 10155 - RNA, 18 nt, Artificial Sequence
  Description of Artificial Sequence: Synthetic oligonucleotide
cggcuugagucaagcggg

SEQ ID NO: 10156 - RNA, 18 nt, Artificial Sequence
  Description of Artificial Sequence: Synthetic oligonucleotide
aguagcggcuugagucaa

SEQ ID NO: 10157 - RNA, 18 nt, Artificial Sequence
  Description of Artificial Sequence: Synthetic oligonucleotide
ggcacaguagcggcuuga

SEQ ID NO: 10158 - RNA, 18 nt, Artificial Sequence
  Description of Artificial Sequence: Synthetic oligonucleotide
agcagggcacaguagcgg

SEQ ID NO: 10159 - RNA, 18 nt, Artificial Sequence
  Description of Artificial Sequence: Synthetic oligonucleotide
gaagcagcagggcacagu

SEQ ID NO: 10160 - RNA, 18 nt, Artificial Sequence
  Description of Artificial Sequence: Synthetic oligonucleotide
agacuuauguuauaggca

SEQ ID NO: 10161 - RNA, 18 nt, Artificial Sequence
  Description of Artificial Sequence: Synthetic oligonucleotide
ccuuuagacuuauguuau

SEQ ID NO: 10162 - RNA, 18 nt, Artificial Sequence
  Description of Artificial Sequence: Synthetic oligonucleotide
caccuccuuuagacuuau

SEQ ID NO: 10163 - RNA, 18 nt, Artificial Sequence
  Description of Artificial Sequence: Synthetic oligonucleotide
ugcaucaccuccuuuaga

SEQ ID NO: 10164 - RNA, 18 nt, Artificial Sequence
  Description of Artificial Sequence: Synthetic oligonucleotide
guaccugcaucaccuccu

SEQ ID NO: 10165 - RNA, 18 nt, Artificial Sequence
  Description of Artificial Sequence: Synthetic oligonucleotide
gcucaguaccugcaucac

SEQ ID NO: 10166 - RNA, 18 nt, Artificial Sequence
  Description of Artificial Sequence: Synthetic oligonucleotide
acguggcucaguaccugc

SEQ ID NO: 10167 - RNA, 18 nt, Artificial Sequence
  Description of Artificial Sequence: Synthetic oligonucleotide
ggaccacguggcucagua

SEQ ID NO: 10168 - RNA, 18 nt, Artificial Sequence
  Description of Artificial Sequence: Synthetic oligonucleotide
cuccaggaccacguggcu

SEQ ID NO: 10169 - RNA, 18 nt, Artificial Sequence
  Description of Artificial Sequence: Synthetic oligonucleotide
gggaacuccaggaccacg

SEQ ID NO: 10170 - RNA, 18 nt, Artificial Sequence
  Description of Artificial Sequence: Synthetic oligonucleotide
aauccaucuguugcaggg

SEQ ID NO: 10171 - RNA, 18 nt, Artificial Sequence
  Description of Artificial Sequence: Synthetic oligonucleotide
gggaauccaucuguugca

SEQ ID NO: 10172 - RNA, 18 nt, Artificial Sequence
  Description of Artificial Sequence: Synthetic oligonucleotide
cggcuugagucaagcggg

SEQ ID NO: 10173 - RNA, 18 nt, Artificial Sequence
  Description of Artificial Sequence: Synthetic oligonucleotide
guagcggcuugagucaag

SEQ ID NO: 10174 - RNA, 18 nt, Artificial Sequence
  Description of Artificial Sequence: Synthetic oligonucleotide
gcacaguagcggcuugag

SEQ ID NO: 10175 - RNA, 18 nt, Artificial Sequence
  Description of Artificial Sequence: Synthetic oligonucleotide
gcagggcacaguagcggc

SEQ ID NO: 10176 - RNA, 18 nt, Artificial Sequence
  Description of Artificial Sequence: Synthetic oligonucleotide
aagcagcagggcacagua

SEQ ID NO: 10177 - RNA, 18 nt, Artificial Sequence
  Description of Artificial Sequence: Synthetic oligonucleotide
acucagcuccaaucuuug

SEQ ID NO: 10178 - RNA, 18 nt, Artificial Sequence
  Description of Artificial Sequence: Synthetic oligonucleotide
cuuguacucagcuccaau

SEQ ID NO: 10179 - RNA, 18 nt, Artificial Sequence
  Description of Artificial Sequence: Synthetic oligonucleotide
aaucccuuguacucagcu

SEQ ID NO: 10180 - RNA, 18 nt, Artificial Sequence
  Description of Artificial Sequence: Synthetic oligonucleotide
uacccaaucccuuguacu

SEQ ID NO: 10181 - RNA, 18 nt, Artificial Sequence
  Description of Artificial Sequence: Synthetic oligonucleotide
gccuguacccaaucccuu

SEQ ID NO: 10182 - RNA, 18 nt, Artificial Sequence
  Description of Artificial Sequence: Synthetic oligonucleotide
ccuuugccuguacccaau

SEQ ID NO: 10183 - RNA, 18 nt, Artificial Sequence
  Description of Artificial Sequence: Synthetic oligonucleotide
gauuuccuuugccuguac

SEQ ID NO: 10184 - RNA, 18 nt, Artificial Sequence
  Description of Artificial Sequence: Synthetic oligonucleotide
cuccugauuuccuuugcc

SEQ ID NO: 10185 - RNA, 18 nt, Artificial Sequence
  Description of Artificial Sequence: Synthetic oligonucleotide
gucuacuccugauuuccu

SEQ ID NO: 10186 - RNA, 18 nt, Artificial Sequence
  Description of Artificial Sequence: Synthetic oligonucleotide
agacagucuacuccugau

SEQ ID NO: 10187 - RNA, 18 nt, Artificial Sequence
  Description of Artificial Sequence: Synthetic oligonucleotide
uaacaagacagucuacuc

SEQ ID NO: 10188 - RNA, 18 nt, Artificial Sequence
  Description of Artificial Sequence: Synthetic oligonucleotide
caauauaacaagacaguc

SEQ ID NO: 10189 - RNA, 18 nt, Artificial Sequence
  Description of Artificial Sequence: Synthetic oligonucleotide
acacccaauauaacaaga

SEQ ID NO: 10190 - RNA, 18 nt, Artificial Sequence
  Description of Artificial Sequence: Synthetic oligonucleotide
gacauacacccaauauaa

SEQ ID NO: 10191 - RNA, 18 nt, Artificial Sequence
  Description of Artificial Sequence: Synthetic oligonucleotide
gaagugacauacacccaa

SEQ ID NO: 10192 - RNA, 18 nt, Artificial Sequence
  Description of Artificial Sequence: Synthetic oligonucleotide
aaccagaagugacauaca

SEQ ID NO: 10193 - RNA, 18 nt, Artificial Sequence
  Description of Artificial Sequence: Synthetic oligonucleotide
aaaggaaccagaagugac

SEQ ID NO: 10194 - RNA, 18 nt, Artificial Sequence
  Description of Artificial Sequence: Synthetic oligonucleotide
aggaaaaaggaaccagaa

SEQ ID NO: 10195 - RNA, 18 nt, Artificial Sequence
  Description of Artificial Sequence: Synthetic oligonucleotide
aggcaaggaaaaaggaac

SEQ ID NO: 10196 - RNA, 18 nt, Artificial Sequence
  Description of Artificial Sequence: Synthetic oligonucleotide
uccagaggcaaggaaaaa

SEQ ID NO: 10197 - RNA, 18 nt, Artificial Sequence
  Description of Artificial Sequence: Synthetic oligonucleotide
cagcuuccagaggcaagg

SEQ ID NO: 10198 - RNA, 18 nt, Artificial Sequence
  Description of Artificial Sequence: Synthetic oligonucleotide
ccaaccagcuuccagagg

SEQ ID NO: 10199 - RNA, 18 nt, Artificial Sequence
  Description of Artificial Sequence: Synthetic oligonucleotide
agagcccaaccagcuucc

SEQ ID NO: 10200 - RNA, 18 nt, Artificial Sequence
  Description of Artificial Sequence: Synthetic oligonucleotide
gcucuagagcccaaccag

SEQ ID NO: 10201 - RNA, 18 nt, Artificial Sequence
  Description of Artificial Sequence: Synthetic oligonucleotide
aggcugcucuagagccca

SEQ ID NO: 10202 - RNA, 18 nt, Artificial Sequence
  Description of Artificial Sequence: Synthetic oligonucleotide
agccaaggcugcucuaga

SEQ ID NO: 10203 - RNA, 18 nt, Artificial Sequence
  Description of Artificial Sequence: Synthetic oligonucleotide
gaaccagccaaggcugcu

SEQ ID NO: 10204 - RNA, 18 nt, Artificial Sequence
  Description of Artificial Sequence: Synthetic oligonucleotide
ccucugaaccagccaagg

SEQ ID NO: 10205 - RNA, 18 nt, Artificial Sequence
  Description of Artificial Sequence: Synthetic oligonucleotide
ugaccccucugaaccagc

SEQ ID NO: 10206 - RNA, 18 nt, Artificial Sequence
  Description of Artificial Sequence: Synthetic oligonucleotide
caaucugaccccucugaa

SEQ ID NO: 10207 - RNA, 18 nt, Artificial Sequence
  Description of Artificial Sequence: Synthetic oligonucleotide
gaacucaaucugaccccu

SEQ ID NO: 10208 - RNA, 18 nt, Artificial Sequence
  Description of Artificial Sequence: Synthetic oligonucleotide
guauugaacucaaucuga

SEQ ID NO: 10209 - RNA, 18 nt, Artificial Sequence
  Description of Artificial Sequence: Synthetic oligonucleotide
agucaguauugaacucaa

SEQ ID NO: 10210 - RNA, 18 nt, Artificial Sequence
  Description of Artificial Sequence: Synthetic oligonucleotide
aggccagucaguauugaa

SEQ ID NO: 10211 - RNA, 18 nt, Artificial Sequence
  Description of Artificial Sequence: Synthetic oligonucleotide
cucaaaggccagucagua

SEQ ID NO: 10212 - RNA, 18 nt, Artificial Sequence
  Description of Artificial Sequence: Synthetic oligonucleotide
ggagucucaaaggccagu

SEQ ID NO: 10213 - RNA, 18 nt, Artificial Sequence
  Description of Artificial Sequence: Synthetic oligonucleotide
auccuggagucucaaagg

SEQ ID NO: 10214 - RNA, 18 nt, Artificial Sequence
  Description of Artificial Sequence: Synthetic oligonucleotide
augaaauccuggagucuc

SEQ ID NO: 10215 - RNA, 18 nt, Artificial Sequence
  Description of Artificial Sequence: Synthetic oligonucleotide
augguaugaaauccugga

SEQ ID NO: 10216 - RNA, 18 nt, Artificial Sequence
  Description of Artificial Sequence: Synthetic oligonucleotide
cuaggaugguaugaaauc

SEQ ID NO: 10217 - RNA, 18 nt, Artificial Sequence
  Description of Artificial Sequence: Synthetic oligonucleotide
ugggccuaggaugguaug

SEQ ID NO: 10218 - RNA, 18 nt, Artificial Sequence
  Description of Artificial Sequence: Synthetic oligonucleotide
cuuugugggccuaggaug

SEQ ID NO: 10219 - RNA, 18 nt, Artificial Sequence
  Description of Artificial Sequence: Synthetic oligonucleotide
uauaccuuugugggccua

SEQ ID NO: 10220 - RNA, 18 nt, Artificial Sequence
  Description of Artificial Sequence: Synthetic oligonucleotide
cugaauauaccuuugugg

SEQ ID NO: 10221 - RNA, 18 nt, Artificial Sequence
  Description of Artificial Sequence: Synthetic oligonucleotide
ccauucugaauauaccuu

SEQ ID NO: 10222 - RNA, 18 nt, Artificial Sequence
  Description of Artificial Sequence: Synthetic oligonucleotide
cagguccauucugaauau

SEQ ID NO: 10223 - RNA, 18 nt, Artificial Sequence
  Description of Artificial Sequence: Synthetic oligonucleotide
auguccagguccauucug

SEQ ID NO: 10224 - RNA, 18 nt, Artificial Sequence
  Description of Artificial Sequence: Synthetic oligonucleotide
ucugaauguccaggucca

SEQ ID NO: 10225 - RNA, 18 nt, Artificial Sequence
  Description of Artificial Sequence: Synthetic oligonucleotide
uagagucugaauguccag

SEQ ID NO: 10226 - RNA, 18 nt, Artificial Sequence
  Description of Artificial Sequence: Synthetic oligonucleotide
ugccauagagucugaaug

SEQ ID NO: 10227 - RNA, 18 nt, Artificial Sequence
  Description of Artificial Sequence: Synthetic oligonucleotide
auugcugccauagagucu

SEQ ID NO: 10228 - RNA, 18 nt, Artificial Sequence
  Description of Artificial Sequence: Synthetic oligonucleotide
gucaaauugcugccauag

SEQ ID NO: 10229 - RNA, 18 nt, Artificial Sequence
  Description of Artificial Sequence: Synthetic oligonucleotide
guugggucaaauugcugc

SEQ ID NO: 10230 - RNA, 18 nt, Artificial Sequence
  Description of Artificial Sequence: Synthetic oligonucleotide
cuuguguugggucaaauu

SEQ ID NO: 10231 - RNA, 18 nt, Artificial Sequence
  Description of Artificial Sequence: Synthetic oligonucleotide
cugaucuuguguuggguc

SEQ ID NO: 10232 - RNA, 18 nt, Artificial Sequence
  Description of Artificial Sequence: Synthetic oligonucleotide
auguccagguccauucug

SEQ ID NO: 10233 - RNA, 18 nt, Artificial Sequence
  Description of Artificial Sequence: Synthetic oligonucleotide
ucugaauguccaggucca

SEQ ID NO: 10234 - RNA, 18 nt, Artificial Sequence
  Description of Artificial Sequence: Synthetic oligonucleotide
uagagucugaauguccag

SEQ ID NO: 10235 - RNA, 18 nt, Artificial Sequence
  Description of Artificial Sequence: Synthetic oligonucleotide
ugccauagagucugaaug

SEQ ID NO: 10236 - RNA, 18 nt, Artificial Sequence
  Description of Artificial Sequence: Synthetic oligonucleotide
auugcugccauagagucu

SEQ ID NO: 10237 - RNA, 18 nt, Artificial Sequence
  Description of Artificial Sequence: Synthetic oligonucleotide
gucaaauugcugccauag

SEQ ID NO: 10238 - RNA, 18 nt, Artificial Sequence
  Description of Artificial Sequence: Synthetic oligonucleotide
guugggucaaauugcugc

SEQ ID NO: 10239 - RNA, 18 nt, Artificial Sequence
  Description of Artificial Sequence: Synthetic oligonucleotide
cuuguguugggucaaauu

SEQ ID NO: 10240 - RNA, 18 nt, Artificial Sequence
  Description of Artificial Sequence: Synthetic oligonucleotide
cugaucuuguguuggguc

SEQ ID NO: 10241 - RNA, 18 nt, Artificial Sequence
  Description of Artificial Sequence: Synthetic oligonucleotide
agaggcugaucuuguguu

SEQ ID NO: 10242 - RNA, 18 nt, Artificial Sequence
  Description of Artificial Sequence: Synthetic oligonucleotide
accccagaggcugaucuu

SEQ ID NO: 10243 - RNA, 18 nt, Artificial Sequence
  Description of Artificial Sequence: Synthetic oligonucleotide
uucccaccccagaggcug

SEQ ID NO: 10244 - RNA, 18 nt, Artificial Sequence
  Description of Artificial Sequence: Synthetic oligonucleotide
accuauucccaccccaga

SEQ ID NO: 10245 - RNA, 18 nt, Artificial Sequence
  Description of Artificial Sequence: Synthetic oligonucleotide
aaaauaccuauucccacc

SEQ ID NO: 10246 - RNA, 18 nt, Artificial Sequence
  Description of Artificial Sequence: Synthetic oligonucleotide
gccucaaaauaccuauuc

SEQ ID NO: 10247 - RNA, 18 nt, Artificial Sequence
  Description of Artificial Sequence: Synthetic oligonucleotide
aggcugccucaaaauacc

SEQ ID NO: 10248 - RNA, 18 nt, Artificial Sequence
  Description of Artificial Sequence: Synthetic oligonucleotide
gcuauaggcugccucaaa

SEQ ID NO: 10249 - RNA, 18 nt, Artificial Sequence
  Description of Artificial Sequence: Synthetic oligonucleotide
cagaugcuauaggcugcc

SEQ ID NO: 10250 - RNA, 18 nt, Artificial Sequence
  Description of Artificial Sequence: Synthetic oligonucleotide
gggaucagaugcuauagg

SEQ ID NO: 10251 - RNA, 18 nt, Artificial Sequence
  Description of Artificial Sequence: Synthetic oligonucleotide
uuagggaaggugaaaggg

SEQ ID NO: 10252 - RNA, 18 nt, Artificial Sequence
  Description of Artificial Sequence: Synthetic oligonucleotide
uuccuuagggaaggugaa

SEQ ID NO: 10253 - RNA, 18 nt, Artificial Sequence
  Description of Artificial Sequence: Synthetic oligonucleotide
agagauuccuuagggaag

SEQ ID NO: 10254 - RNA, 18 nt, Artificial Sequence
  Description of Artificial Sequence: Synthetic oligonucleotide
gaaaaagagauuccuuag

SEQ ID NO: 10255 - RNA, 18 nt, Artificial Sequence
  Description of Artificial Sequence: Synthetic oligonucleotide
uuugggaaaaagagauuc

SEQ ID NO: 10256 - RNA, 18 nt, Artificial Sequence
  Description of Artificial Sequence: Synthetic oligonucleotide
caggguuugggaaaaaga

SEQ ID NO: 10257 - RNA, 18 nt, Artificial Sequence
  Description of Artificial Sequence: Synthetic oligonucleotide
guugacaggguuugggaa

SEQ ID NO: 10258 - RNA, 18 nt, Artificial Sequence
  Description of Artificial Sequence: Synthetic oligonucleotide
gaguuguugacaggguuu

SEQ ID NO: 10259 - RNA, 18 nt, Artificial Sequence
  Description of Artificial Sequence: Synthetic oligonucleotide
cuugggaguuguugacag

SEQ ID NO: 10260 - RNA, 18 nt, Artificial Sequence
  Description of Artificial Sequence: Synthetic oligonucleotide
agggacuugggaguuguu

SEQ ID NO: 10261 - RNA, 18 nt, Artificial Sequence
  Description of Artificial Sequence: Synthetic oligonucleotide
gucagagggacuugggag

SEQ ID NO: 10262 - RNA, 18 nt, Artificial Sequence
  Description of Artificial Sequence: Synthetic oligonucleotide
auuaugucagagggacuu

SEQ ID NO: 10263 - RNA, 18 nt, Artificial Sequence
  Description of Artificial Sequence: Synthetic oligonucleotide
guggaauuaugucagagg

SEQ ID NO: 10264 - RNA, 18 nt, Artificial Sequence
  Description of Artificial Sequence: Synthetic oligonucleotide
guucuguggaauuauguc

SEQ ID NO: 10265 - RNA, 18 nt, Artificial Sequence
  Description of Artificial Sequence: Synthetic oligonucleotide
uacagguucuguggaauu

SEQ ID NO: 10266 - RNA, 18 nt, Artificial Sequence
  Description of Artificial Sequence: Synthetic oligonucleotide
gaugauacagguucugug

SEQ ID NO: 10267 - RNA, 18 nt, Artificial Sequence
  Description of Artificial Sequence: Synthetic oligonucleotide
agggagaugauacagguu

SEQ ID NO: 10268 - RNA, 18 nt, Artificial Sequence
  Description of Artificial Sequence: Synthetic oligonucleotide
acaaaagggagaugauac

SEQ ID NO: 10269 - RNA, 18 nt, Artificial Sequence
  Description of Artificial Sequence: Synthetic oligonucleotide
gguggacaaaagggagau

SEQ ID NO: 10270 - RNA, 18 nt, Artificial Sequence
  Description of Artificial Sequence: Synthetic oligonucleotide
acauggguggacaaaagg

SEQ ID NO: 10271 - RNA, 18 nt, Artificial Sequence
  Description of Artificial Sequence: Synthetic oligonucleotide
ugaugacauggguggaca

SEQ ID NO: 10272 - RNA, 18 nt, Artificial Sequence
  Description of Artificial Sequence: Synthetic oligonucleotide
cauacugaugacaugggu

SEQ ID NO: 10273 - RNA, 18 nt, Artificial Sequence
  Description of Artificial Sequence: Synthetic oligonucleotide
aaauccauacugaugaca

SEQ ID NO: 10274 - RNA, 18 nt, Artificial Sequence
  Description of Artificial Sequence: Synthetic oligonucleotide
caagcaaauccauacuga

SEQ ID NO: 10275 - RNA, 18 nt, Artificial Sequence
  Description of Artificial Sequence: Synthetic oligonucleotide
acauccaagcaaauccau

SEQ ID NO: 10276 - RNA, 18 nt, Artificial Sequence
  Description of Artificial Sequence: Synthetic oligonucleotide
ccuggacauccaagcaaa

SEQ ID NO: 10277 - RNA, 18 nt, Artificial Sequence
  Description of Artificial Sequence: Synthetic oligonucleotide
cuauaccuggacauccaa

SEQ ID NO: 10278 - RNA, 18 nt, Artificial Sequence
  Description of Artificial Sequence: Synthetic oligonucleotide
uucaccuauaccuggaca

SEQ ID NO: 10279 - RNA, 18 nt, Artificial Sequence
  Description of Artificial Sequence: Synthetic oligonucleotide
aagcauucaccuauaccu

SEQ ID NO: 10280 - RNA, 18 nt, Artificial Sequence
  Description of Artificial Sequence: Synthetic oligonucleotide
uuccuaagcauucaccua

SEQ ID NO: 10281 - RNA, 18 nt, Artificial Sequence
  Description of Artificial Sequence: Synthetic oligonucleotide
guauauuccuaagcauuc

SEQ ID NO: 10282 - RNA, 18 nt, Artificial Sequence
  Description of Artificial Sequence: Synthetic oligonucleotide
cugcaguauauuccuaag

SEQ ID NO: 10283 - RNA, 18 nt, Artificial Sequence
  Description of Artificial Sequence: Synthetic oligonucleotide
gggagcugcaguauauuc

SEQ ID NO: 10284 - RNA, 18 nt, Artificial Sequence
  Description of Artificial Sequence: Synthetic oligonucleotide
ggcuccaggccuuuagca

SEQ ID NO: 10285 - RNA, 18 nt, Artificial Sequence
  Description of Artificial Sequence: Synthetic oligonucleotide
aacagggcuccaggccuu

SEQ ID NO: 10286 - RNA, 18 nt, Artificial Sequence
  Description of Artificial Sequence: Synthetic oligonucleotide
cuaaaaacagggcuccag

SEQ ID NO: 10287 - RNA, 18 nt, Artificial Sequence
  Description of Artificial Sequence: Synthetic oligonucleotide
aguuccuaaaaacagggc

SEQ ID NO: 10288 - RNA, 18 nt, Artificial Sequence
  Description of Artificial Sequence: Synthetic oligonucleotide
uauguaguuccuaaaaac

SEQ ID NO: 10289 - RNA, 18 nt, Artificial Sequence
  Description of Artificial Sequence: Synthetic oligonucleotide
cgcuuuauguaguuccua

SEQ ID NO: 10290 - RNA, 18 nt, Artificial Sequence
  Description of Artificial Sequence: Synthetic oligonucleotide
cugcgcgcuuuauguagu

SEQ ID NO: 10291 - RNA, 18 nt, Artificial Sequence
  Description of Artificial Sequence: Synthetic oligonucleotide
gucggcugcgcgcuuuau

SEQ ID NO: 10292 - RNA, 18 nt, Artificial Sequence
  Description of Artificial Sequence: Synthetic oligonucleotide
aaauggucggcugcgcgc

SEQ ID NO: 10293 - RNA, 18 nt, Artificial Sequence
  Description of Artificial Sequence: Synthetic oligonucleotide
cuuccaaauggucggcug

SEQ ID NO: 10294 - RNA, 18 nt, Artificial Sequence
  Description of Artificial Sequence: Synthetic oligonucleotide
uaacgcuuccaaaugguc

SEQ ID NO: 10295 - RNA, 18 nt, Artificial Sequence
  Description of Artificial Sequence: Synthetic oligonucleotide
gcugcuaacgcuuccaaa

SEQ ID NO: 10296 - RNA, 18 nt, Artificial Sequence
  Description of Artificial Sequence: Synthetic oligonucleotide
caauggcugcuaacgcuu

SEQ ID NO: 10297 - RNA, 18 nt, Artificial Sequence
  Description of Artificial Sequence: Synthetic oligonucleotide
guccucaauggcugcuaa

SEQ ID NO: 10298 - RNA, 18 nt, Artificial Sequence
  Description of Artificial Sequence: Synthetic oligonucleotide
aagaaguccucaauggcu

SEQ ID NO: 10299 - RNA, 18 nt, Artificial Sequence
  Description of Artificial Sequence: Synthetic oligonucleotide
cuaggaagaaguccucaa

SEQ ID NO: 10300 - RNA, 18 nt, Artificial Sequence
  Description of Artificial Sequence: Synthetic oligonucleotide
augcucuaggaagaaguc

SEQ ID NO: 10301 - RNA, 18 nt, Artificial Sequence
  Description of Artificial Sequence: Synthetic oligonucleotide
gcuucaugcucuaggaag

SEQ ID NO: 10302 - RNA, 18 nt, Artificial Sequence
  Description of Artificial Sequence: Synthetic oligonucleotide
caagagcuucaugcucua

SEQ ID NO: 10303 - RNA, 18 nt, Artificial Sequence
  Description of Artificial Sequence: Synthetic oligonucleotide
aauaccaagagcuucaug

SEQ ID NO: 10304 - RNA, 18 nt, Artificial Sequence
  Description of Artificial Sequence: Synthetic oligonucleotide
auggaaauaccaagagcu

SEQ ID NO: 10305 - RNA, 18 nt, Artificial Sequence
  Description of Artificial Sequence: Synthetic oligonucleotide
uggccauggaaauaccaa

SEQ ID NO: 10306 - RNA, 18 nt, Artificial Sequence
  Description of Artificial Sequence: Synthetic oligonucleotide
cgccuaaggaauucacuc

SEQ ID NO: 10307 - RNA, 18 nt, Artificial Sequence
  Description of Artificial Sequence: Synthetic oligonucleotide
ggauacgccuaaggaauu

SEQ ID NO: 10308 - RNA, 18 nt, Artificial Sequence
  Description of Artificial Sequence: Synthetic oligonucleotide
aaggaggauacgccuaag

SEQ ID NO: 10309 - RNA, 18 nt, Artificial Sequence
  Description of Artificial Sequence: Synthetic oligonucleotide
gcuccaaggaggauacgc

SEQ ID NO: 10310 - RNA, 18 nt, Artificial Sequence
  Description of Artificial Sequence: Synthetic oligonucleotide
gaugugcuccaaggagga

SEQ ID NO: 10311 - RNA, 18 nt, Artificial Sequence
  Description of Artificial Sequence: Synthetic oligonucleotide
ugagugaugugcuccaag

SEQ ID NO: 10312 - RNA, 18 nt, Artificial Sequence
  Description of Artificial Sequence: Synthetic oligonucleotide
ggcugugagugaugugcu

SEQ ID NO: 10313 - RNA, 18 nt, Artificial Sequence
  Description of Artificial Sequence: Synthetic oligonucleotide
caggaggcugugagugau

SEQ ID NO: 10314 - RNA, 18 nt, Artificial Sequence
  Description of Artificial Sequence: Synthetic oligonucleotide
cgucccaggaggcuguga

SEQ ID NO: 10315 - RNA, 18 nt, Artificial Sequence
  Description of Artificial Sequence: Synthetic oligonucleotide
aagggcgucccaggaggc

SEQ ID NO: 10316 - RNA, 18 nt, Artificial Sequence
  Description of Artificial Sequence: Synthetic oligonucleotide
agacaaagggcgucccag

SEQ ID NO: 10317 - RNA, 18 nt, Artificial Sequence
  Description of Artificial Sequence: Synthetic oligonucleotide
ugccgagacaaagggcgu

SEQ ID NO: 10318 - RNA, 18 nt, Artificial Sequence
  Description of Artificial Sequence: Synthetic oligonucleotide
ucagcugccgagacaaag

SEQ ID NO: 10319 - RNA, 18 nt, Artificial Sequence
  Description of Artificial Sequence: Synthetic oligonucleotide
agacaucagcugccgaga

SEQ ID NO: 10320 - RNA, 18 nt, Artificial Sequence
  Description of Artificial Sequence: Synthetic oligonucleotide
acaagagacaucagcugc

SEQ ID NO: 10321 - RNA, 18 nt, Artificial Sequence
  Description of Artificial Sequence: Synthetic oligonucleotide
cugcaacaagagacauca

SEQ ID NO: 10322 - RNA, 18 nt, Artificial Sequence
  Description of Artificial Sequence: Synthetic oligonucleotide
aaguccugcaacaagaga

SEQ ID NO: 10323 - RNA, 18 nt, Artificial Sequence
  Description of Artificial Sequence: Synthetic oligonucleotide
uuccuaaguccugcaaca

SEQ ID NO: 10324 - RNA, 18 nt, Artificial Sequence
  Description of Artificial Sequence: Synthetic oligonucleotide
cuccauuccuaaguccug

SEQ ID NO: 10325 - RNA, 18 nt, Artificial Sequence
  Description of Artificial Sequence: Synthetic oligonucleotide
aagagcuccauuccuaag

SEQ ID NO: 10326 - RNA, 18 nt, Artificial Sequence
  Description of Artificial Sequence: Synthetic oligonucleotide
aguaaaagagcuccauuc

SEQ ID NO: 10327 - RNA, 18 nt, Artificial Sequence
  Description of Artificial Sequence: Synthetic oligonucleotide
cugugaguaaaagagcuc

SEQ ID NO: 10328 - RNA, 18 nt, Artificial Sequence
  Description of Artificial Sequence: Synthetic oligonucleotide
uccuccugugaguaaaag

SEQ ID NO: 10329 - RNA, 18 nt, Artificial Sequence
  Description of Artificial Sequence: Synthetic oligonucleotide
augaacacaccuuaacca

SEQ ID NO: 10330 - RNA, 18 nt, Artificial Sequence
  Description of Artificial Sequence: Synthetic oligonucleotide
gaaaaaugaacacaccuu

SEQ ID NO: 10331 - RNA, 18 nt, Artificial Sequence
  Description of Artificial Sequence: Synthetic oligonucleotide
uuacagaaaaaugaacac

SEQ ID NO: 10332 - RNA, 18 nt, Artificial Sequence
  Description of Artificial Sequence: Synthetic oligonucleotide
aaauguuacagaaaaaug

SEQ ID NO: 10333 - RNA, 18 nt, Artificial Sequence
  Description of Artificial Sequence: Synthetic oligonucleotide
uuauuaaauguuacagaa

SEQ ID NO: 10334 - RNA, 18 nt, Artificial Sequence
  Description of Artificial Sequence: Synthetic oligonucleotide
aaaaguuauuaaauguua

SEQ ID NO: 10335 - RNA, 18 nt, Artificial Sequence
  Description of Artificial Sequence: Synthetic oligonucleotide
aaaugaaaaguuauuaaa

SEQ ID NO: 10336 - RNA, 18 nt, Artificial Sequence
  Description of Artificial Sequence: Synthetic oligonucleotide
aagauaaaugaaaaguua

SEQ ID NO: 10337 - RNA, 18 nt, Artificial Sequence
  Description of Artificial Sequence: Synthetic oligonucleotide
aaagaaagauaaaugaaa

SEQ ID NO: 10338 - RNA, 18 nt, Artificial Sequence
  Description of Artificial Sequence: Synthetic oligonucleotide
aacccaaagaaagauaaa

SEQ ID NO: 10339 - RNA, 18 nt, Artificial Sequence
  Description of Artificial Sequence: Synthetic oligonucleotide
gucaaaacccaaagaaag

SEQ ID NO: 10340 - RNA, 18 nt, Artificial Sequence
  Description of Artificial Sequence: Synthetic oligonucleotide
agauggucaaaacccaaa

SEQ ID NO: 10341 - RNA, 18 nt, Artificial Sequence
  Description of Artificial Sequence: Synthetic oligonucleotide
auaauagauggucaaaac

SEQ ID NO: 10342 - RNA, 18 nt, Artificial Sequence
  Description of Artificial Sequence: Synthetic oligonucleotide
ccuauauaauagaugguc

SEQ ID NO: 10343 - RNA, 18 nt, Artificial Sequence
  Description of Artificial Sequence: Synthetic oligonucleotide
cccacccuauauaauaga

SEQ ID NO: 10344 - RNA, 18 nt, Artificial Sequence
  Description of Artificial Sequence: Synthetic oligonucleotide
caaaacccacccuauaua

SEQ ID NO: 10345 - RNA, 18 nt, Artificial Sequence
  Description of Artificial Sequence: Synthetic oligonucleotide
auggucaaaacccacccu

SEQ ID NO: 10346 - RNA, 18 nt, Artificial Sequence
  Description of Artificial Sequence: Synthetic oligonucleotide
aauagauggucaaaaccc

SEQ ID NO: 10347 - RNA, 18 nt, Artificial Sequence
  Description of Artificial Sequence: Synthetic oligonucleotide
uauauaauagauggucaa

SEQ ID NO: 10348 - RNA, 18 nt, Artificial Sequence
  Description of Artificial Sequence: Synthetic oligonucleotide
aacccuauauaauagaug

SEQ ID NO: 10349 - RNA, 18 nt, Artificial Sequence
  Description of Artificial Sequence: Synthetic oligonucleotide
guauaaacccuauauaau

SEQ ID NO: 10350 - RNA, 18 nt, Artificial Sequence
  Description of Artificial Sequence: Synthetic oligonucleotide
augucguauaaacccuau

SEQ ID NO: 10351 - RNA, 18 nt, Artificial Sequence
  Description of Artificial Sequence: Synthetic oligonucleotide
uccauaugucguauaaac

SEQ ID NO: 10352 - RNA, 18 nt, Artificial Sequence
  Description of Artificial Sequence: Synthetic oligonucleotide
ugcuuuccauaugucgua

SEQ ID NO: 10353 - RNA, 18 nt, Artificial Sequence
  Description of Artificial Sequence: Synthetic oligonucleotide
augaaugcuuuccauaug

SEQ ID NO: 10354 - RNA, 18 nt, Artificial Sequence
  Description of Artificial Sequence: Synthetic oligonucleotide
aauaaaugaaugcuuucc

SEQ ID NO: 10355 - RNA, 18 nt, Artificial Sequence
  Description of Artificial Sequence: Synthetic oligonucleotide
uagugaauaaaugaaugc

SEQ ID NO: 10356 - RNA, 18 nt, Artificial Sequence
  Description of Artificial Sequence: Synthetic oligonucleotide
aauauuagugaauaaaug

SEQ ID NO: 10357 - RNA, 18 nt, Artificial Sequence
  Description of Artificial Sequence: Synthetic oligonucleotide
acagaaauauuagugaau

SEQ ID NO: 10358 - RNA, 18 nt, Artificial Sequence
  Description of Artificial Sequence: Synthetic oligonucleotide
gacacacagaaauauuag

SEQ ID NO: 10359 - RNA, 18 nt, Artificial Sequence
  Description of Artificial Sequence: Synthetic oligonucleotide
aagcagacacacagaaau

SEQ ID NO: 10360 - RNA, 18 nt, Artificial Sequence
  Description of Artificial Sequence: Synthetic oligonucleotide
ccuaaaagcagacacaca

SEQ ID NO: 10361 - RNA, 18 nt, Artificial Sequence
  Description of Artificial Sequence: Synthetic oligonucleotide
caacaccuaaaagcagac

SEQ ID NO: 10362 - RNA, 18 nt, Artificial Sequence
  Description of Artificial Sequence: Synthetic oligonucleotide
ucccccaacaccuaaaag

SEQ ID NO: 10363 - RNA, 18 nt, Artificial Sequence
  Description of Artificial Sequence: Synthetic oligonucleotide
aucacucccccaacaccu

SEQ ID NO: 10364 - RNA, 18 nt, Artificial Sequence
  Description of Artificial Sequence: Synthetic oligonucleotide
ucgucaucacucccccaa

SEQ ID NO: 10365 - RNA, 18 nt, Artificial Sequence
  Description of Artificial Sequence: Synthetic oligonucleotide
cuuauucgucaucacucc

SEQ ID NO: 10366 - RNA, 18 nt, Artificial Sequence
  Description of Artificial Sequence: Synthetic oligonucleotide
ucagucuuauucgucauc

SEQ ID NO: 10367 - RNA, 18 nt, Artificial Sequence
  Description of Artificial Sequence: Synthetic oligonucleotide
gaacaucagucuuauucg

SEQ ID NO: 10368 - RNA, 18 nt, Artificial Sequence
  Description of Artificial Sequence: Synthetic oligonucleotide
auggagaacaucagucuu

SEQ ID NO: 10369 - RNA, 18 nt, Artificial Sequence
  Description of Artificial Sequence: Synthetic oligonucleotide
agggcauggagaacauca

SEQ ID NO: 10370 - RNA, 18 nt, Artificial Sequence
  Description of Artificial Sequence: Synthetic oligonucleotide
gaaaaagggcauggagaa

SEQ ID NO: 10371 - RNA, 18 nt, Artificial Sequence
  Description of Artificial Sequence: Synthetic oligonucleotide
acacagaaaaagggcaug

SEQ ID NO: 10372 - RNA, 18 nt, Artificial Sequence
  Description of Artificial Sequence: Synthetic oligonucleotide
aacugacacagaaaaagg

SEQ ID NO: 10373 - RNA, 18 nt, Artificial Sequence
  Description of Artificial Sequence: Synthetic oligonucleotide
guaucaacugacacagaa

SEQ ID NO: 10374 - RNA, 18 nt, Artificial Sequence
  Description of Artificial Sequence: Synthetic oligonucleotide
uaauuguaucaacugaca

SEQ ID NO: 10375 - RNA, 18 nt, Artificial Sequence
  Description of Artificial Sequence: Synthetic oligonucleotide
ccauauaauuguaucaac

SEQ ID NO: 10376 - RNA, 18 nt, Artificial Sequence
  Description of Artificial Sequence: Synthetic oligonucleotide
aaaaaccauauaauugua

SEQ ID NO: 10377 - RNA, 18 nt, Artificial Sequence
  Description of Artificial Sequence: Synthetic oligonucleotide
aaaagaaaaaccauauaa

SEQ ID NO: 10378 - RNA, 18 nt, Artificial Sequence
  Description of Artificial Sequence: Synthetic oligonucleotide
ccuaaaaaagaaaaacca

SEQ ID NO: 10379 - RNA, 18 nt, Artificial Sequence
  Description of Artificial Sequence: Synthetic oligonucleotide
aauagccuaaaaaagaaa

SEQ ID NO: 10380 - RNA, 18 nt, Artificial Sequence
  Description of Artificial Sequence: Synthetic oligonucleotide
caccuaauagccuaaaaa

SEQ ID NO: 10381 - RNA, 18 nt, Artificial Sequence
  Description of Artificial Sequence: Synthetic oligonucleotide
aucaacaccuaauagccu

SEQ ID NO: 10382 - RNA, 18 nt, Artificial Sequence
  Description of Artificial Sequence: Synthetic oligonucleotide
acccuaucaacaccuaau

SEQ ID NO: 10383 - RNA, 18 nt, Artificial Sequence
  Description of Artificial Sequence: Synthetic oligonucleotide
acucaacccuaucaacac

SEQ ID NO: 10384 - RNA, 18 nt, Artificial Sequence
  Description of Artificial Sequence: Synthetic oligonucleotide
aaguuacucaacccuauc

SEQ ID NO: 10385 - RNA, 18 nt, Artificial Sequence
  Description of Artificial Sequence: Synthetic oligonucleotide
uuuguaaguuacucaacc

SEQ ID NO: 10386 - RNA, 18 nt, Artificial Sequence
  Description of Artificial Sequence: Synthetic oligonucleotide
caacauuuguaaguuacu

SEQ ID NO: 10387 - RNA, 18 nt, Artificial Sequence
  Description of Artificial Sequence: Synthetic oligonucleotide
ugguucaacauuuguaag

SEQ ID NO: 10388 - RNA, 18 nt, Artificial Sequence
  Description of Artificial Sequence: Synthetic oligonucleotide
aaggcugguucaacauuu

SEQ ID NO: 10389 - RNA, 18 nt, Artificial Sequence
  Description of Artificial Sequence: Synthetic oligonucleotide
uaugcaaggcugguucaa

SEQ ID NO: 10390 - RNA, 18 nt, Artificial Sequence
  Description of Artificial Sequence: Synthetic oligonucleotide
acagguaugcaaggcugg

SEQ ID NO: 10391 - RNA, 18 nt, Artificial Sequence
  Description of Artificial Sequence: Synthetic oligonucleotide
uuaucacagguaugcaag

SEQ ID NO: 10392 - RNA, 18 nt, Artificial Sequence
  Description of Artificial Sequence: Synthetic oligonucleotide
gguauuuaucacagguau

SEQ ID NO: 10393 - RNA, 18 nt, Artificial Sequence
  Description of Artificial Sequence: Synthetic oligonucleotide
uacgugguauuuaucaca

SEQ ID NO: 10394 - RNA, 18 nt, Artificial Sequence
  Description of Artificial Sequence: Synthetic oligonucleotide
acaacuacgugguauuua

SEQ ID NO: 10395 - RNA, 18 nt, Artificial Sequence
  Description of Artificial Sequence: Synthetic oligonucleotide
acaccacaacuacguggu

SEQ ID NO: 10396 - RNA, 18 nt, Artificial Sequence
  Description of Artificial Sequence: Synthetic oligonucleotide
cugguucaacauuuguaa

SEQ ID NO: 10397 - RNA, 18 nt, Artificial Sequence
  Description of Artificial Sequence: Synthetic oligonucleotide
caaggcugguucaacauu

SEQ ID NO: 10398 - RNA, 18 nt, Artificial Sequence
  Description of Artificial Sequence: Synthetic oligonucleotide
guaugcaaggcugguuca

SEQ ID NO: 10399 - RNA, 18 nt, Artificial Sequence
  Description of Artificial Sequence: Synthetic oligonucleotide
cacagguaugcaaggcug

SEQ ID NO: 10400 - RNA, 18 nt, Artificial Sequence
  Description of Artificial Sequence: Synthetic oligonucleotide
uuuaucacagguaugcaa

SEQ ID NO: 10401 - RNA, 18 nt, Artificial Sequence
  Description of Artificial Sequence: Synthetic oligonucleotide
ugguauuuaucacaggua

SEQ ID NO: 10402 - RNA, 18 nt, Artificial Sequence
  Description of Artificial Sequence: Synthetic oligonucleotide
cuacgugguauuuaucac

SEQ ID NO: 10403 - RNA, 18 nt, Artificial Sequence
  Description of Artificial Sequence: Synthetic oligonucleotide
cacaacuacgugguauuu

SEQ ID NO: 10404 - RNA, 18 nt, Artificial Sequence
  Description of Artificial Sequence: Synthetic oligonucleotide
uacaccacaacuacgugg

SEQ ID NO: 10405 - RNA, 18 nt, Artificial Sequence
  Description of Artificial Sequence: Synthetic oligonucleotide
aaugauacaccacaacua

SEQ ID NO: 10406 - RNA, 18 nt, Artificial Sequence
  Description of Artificial Sequence: Synthetic oligonucleotide
gaaagaaugauacaccac

SEQ ID NO: 10407 - RNA, 18 nt, Artificial Sequence
  Description of Artificial Sequence: Synthetic oligonucleotide
auguagaaagaaugauac

SEQ ID NO: 10408 - RNA, 18 nt, Artificial Sequence
  Description of Artificial Sequence: Synthetic oligonucleotide
cagcaauguagaaagaau

SEQ ID NO: 10409 - RNA, 18 nt, Artificial Sequence
  Description of Artificial Sequence: Synthetic oligonucleotide
aaacucagcaauguagaa

SEQ ID NO: 10410 - RNA, 18 nt, Artificial Sequence
  Description of Artificial Sequence: Synthetic oligonucleotide
agauaaaacucagcaaug

SEQ ID NO: 10411 - RNA, 18 nt, Artificial Sequence
  Description of Artificial Sequence: Synthetic oligonucleotide
uuagcagauaaaacucag

SEQ ID NO: 10412 - RNA, 18 nt, Artificial Sequence
  Description of Artificial Sequence: Synthetic oligonucleotide
gaacauuagcagauaaaa

SEQ ID NO: 10413 - RNA, 18 nt, Artificial Sequence
  Description of Artificial Sequence: Synthetic oligonucleotide
caacagaacauuagcaga

SEQ ID NO: 10414 - RNA, 18 nt, Artificial Sequence
  Description of Artificial Sequence: Synthetic oligonucleotide
aagcucaacagaacauua

SEQ ID NO: 10415 - RNA, 18 nt, Artificial Sequence
  Description of Artificial Sequence: Synthetic oligonucleotide
gacaaaagcucaacagaa

SEQ ID NO: 10416 - RNA, 18 nt, Artificial Sequence
  Description of Artificial Sequence: Synthetic oligonucleotide
aaauggacaaaagcucaa

SEQ ID NO: 10417 - RNA, 18 nt, Artificial Sequence
  Description of Artificial Sequence: Synthetic oligonucleotide
aacuuaaauggacaaaag

SEQ ID NO: 10418 - RNA, 18 nt, Artificial Sequence
  Description of Artificial Sequence: Synthetic oligonucleotide
uuucaaacuuaaauggac

SEQ ID NO: 10419 - RNA, 18 nt, Artificial Sequence
  Description of Artificial Sequence: Synthetic oligonucleotide
aucacuuucaaacuuaaa

SEQ ID NO: 10420 - RNA, 18 nt, Artificial Sequence
  Description of Artificial Sequence: Synthetic oligonucleotide
aacuaaucacuuucaaac

SEQ ID NO: 10421 - RNA, 18 nt, Artificial Sequence
  Description of Artificial Sequence: Synthetic oligonucleotide
cugcaaacuaaucacuuu

SEQ ID NO: 10422 - RNA, 18 nt, Artificial Sequence
  Description of Artificial Sequence: Synthetic oligonucleotide
gaaaacugcaaacuaauc

SEQ ID NO: 10423 - RNA, 18 nt, Artificial Sequence
  Description of Artificial Sequence: Synthetic oligonucleotide
aaacagaaaacugcaaac

SEQ ID NO: 10424 - RNA, 18 nt, Artificial Sequence
  Description of Artificial Sequence: Synthetic oligonucleotide
cacaaaaacagaaaacug

SEQ ID NO: 10425 - RNA, 18 nt, Artificial Sequence
  Description of Artificial Sequence: Synthetic oligonucleotide
gacaacacaaaaacagaa

SEQ ID NO: 10426 - RNA, 18 nt, Artificial Sequence
  Description of Artificial Sequence: Synthetic oligonucleotide
acaaagacaacacaaaaa

SEQ ID NO: 10427 - RNA, 18 nt, Artificial Sequence
  Description of Artificial Sequence: Synthetic oligonucleotide
accagacaaagacaacac

SEQ ID NO: 10428 - RNA, 18 nt, Artificial Sequence
  Description of Artificial Sequence: Synthetic oligonucleotide
gcaaaaccagacaaagac

SEQ ID NO: 10429 - RNA, 18 nt, Artificial Sequence
  Description of Artificial Sequence: Synthetic oligonucleotide
ggauagcaaaaccagaca

SEQ ID NO: 10430 - RNA, 18 nt, Artificial Sequence
  Description of Artificial Sequence: Synthetic oligonucleotide
uacacggauagcaaaacc

SEQ ID NO: 10431 - RNA, 18 nt, Artificial Sequence
  Description of Artificial Sequence: Synthetic oligonucleotide
agauuuacacggauagca

SEQ ID NO: 10432 - RNA, 18 nt, Artificial Sequence
  Description of Artificial Sequence: Synthetic oligonucleotide
aggccagauuuacacgga

SEQ ID NO: 10433 - RNA, 18 nt, Artificial Sequence
  Description of Artificial Sequence: Synthetic oligonucleotide
uuaugaggccagauuuac

SEQ ID NO: 10434 - RNA, 18 nt, Artificial Sequence
  Description of Artificial Sequence: Synthetic oligonucleotide
ucauuuuaugaggccaga

SEQ ID NO: 10435 - RNA, 18 nt, Artificial Sequence
  Description of Artificial Sequence: Synthetic oligonucleotide
ccaucucauuuuaugagg

SEQ ID NO: 10436 - RNA, 18 nt, Artificial Sequence
  Description of Artificial Sequence: Synthetic oligonucleotide
acuucccaucucauuuua

SEQ ID NO: 10437 - RNA, 18 nt, Artificial Sequence
  Description of Artificial Sequence: Synthetic oligonucleotide
agaauacuucccaucuca

SEQ ID NO: 10438 - RNA, 18 nt, Artificial Sequence
  Description of Artificial Sequence: Synthetic oligonucleotide
aggagagaauacuuccca

SEQ ID NO: 10439 - RNA, 18 nt, Artificial Sequence
  Description of Artificial Sequence: Synthetic oligonucleotide
agaagaggagagaauacu

SEQ ID NO: 10440 - RNA, 18 nt, Artificial Sequence
  Description of Artificial Sequence: Synthetic oligonucleotide
acaaaagaagaggagaga

SEQ ID NO: 10441 - RNA, 18 nt, Artificial Sequence
  Description of Artificial Sequence: Synthetic oligonucleotide
aaaaaacaaaagaagagg

SEQ ID NO: 10442 - RNA, 18 nt, Artificial Sequence
  Description of Artificial Sequence: Synthetic oligonucleotide
uuccaaaaaaacaaaaga

SEQ ID NO: 10443 - RNA, 18 nt, Artificial Sequence
  Description of Artificial Sequence: Synthetic oligonucleotide
accucuuccaaaaaaaca

SEQ ID NO: 10444 - RNA, 18 nt, Artificial Sequence
  Description of Artificial Sequence: Synthetic oligonucleotide
auacaaccucuuccaaaa

SEQ ID NO: 10445 - RNA, 18 nt, Artificial Sequence
  Description of Artificial Sequence: Synthetic oligonucleotide
auuuuauacaaccucuuc

SEQ ID NO: 10446 - RNA, 18 nt, Artificial Sequence
  Description of Artificial Sequence: Synthetic oligonucleotide
ccucaauuuuauacaacc

SEQ ID NO: 10447 - RNA, 18 nt, Artificial Sequence
  Description of Artificial Sequence: Synthetic oligonucleotide
uucagccucaauuuuaua

SEQ ID NO: 10448 - RNA, 18 nt, Artificial Sequence
  Description of Artificial Sequence: Synthetic oligonucleotide
caagauucagccucaauu

SEQ ID NO: 10449 - RNA, 18 nt, Artificial Sequence
  Description of Artificial Sequence: Synthetic oligonucleotide
accaccaagauucagccu

SEQ ID NO: 10450 - RNA, 18 nt, Artificial Sequence
  Description of Artificial Sequence: Synthetic oligonucleotide
uggcaaccaccaagauuc

SEQ ID NO: 10451 - RNA, 18 nt, Artificial Sequence
  Description of Artificial Sequence: Synthetic oligonucleotide
cauuguggcaaccaccaa

SEQ ID NO: 10452 - RNA, 18 nt, Artificial Sequence
  Description of Artificial Sequence: Synthetic oligonucleotide
ccugucauuguggcaacc

SEQ ID NO: 10453 - RNA, 18 nt, Artificial Sequence
  Description of Artificial Sequence: Synthetic oligonucleotide
uaguuccugucauugugg

SEQ ID NO: 10454 - RNA, 18 nt, Artificial Sequence
  Description of Artificial Sequence: Synthetic oligonucleotide
agaaauaguuccugucau

SEQ ID NO: 10455 - RNA, 18 nt, Artificial Sequence
  Description of Artificial Sequence: Synthetic oligonucleotide
gucacagaaauaguuccu

SEQ ID NO: 10456 - RNA, 18 nt, Artificial Sequence
  Description of Artificial Sequence: Synthetic oligonucleotide
auucagucacagaaauag

SEQ ID NO: 10457 - RNA, 18 nt, Artificial Sequence
  Description of Artificial Sequence: Synthetic oligonucleotide
aauauauucagucacaga

SEQ ID NO: 10458 - RNA, 18 nt, Artificial Sequence
  Description of Artificial Sequence: Synthetic oligonucleotide
uucccaauauauucaguc

SEQ ID NO: 10459 - RNA, 18 nt, Artificial Sequence
  Description of Artificial Sequence: Synthetic oligonucleotide
aggaauucccaauauauu

SEQ ID NO: 10460 - RNA, 18 nt, Artificial Sequence
  Description of Artificial Sequence: Synthetic oligonucleotide
uuuauaggaauucccaau

SEQ ID NO: 10461 - RNA, 18 nt, Artificial Sequence
  Description of Artificial Sequence: Synthetic oligonucleotide
aaguugauuuuccacuuc

SEQ ID NO: 10462 - RNA, 18 nt, Artificial Sequence
  Description of Artificial Sequence: Synthetic oligonucleotide
ggcuaaaguugauuuucc

SEQ ID NO: 10463 - RNA, 18 nt, Artificial Sequence
  Description of Artificial Sequence: Synthetic oligonucleotide
gcuuuggcuaaaguugau

SEQ ID NO: 10464 - RNA, 18 nt, Artificial Sequence
  Description of Artificial Sequence: Synthetic oligonucleotide
agauugcuuuggcuaaag

SEQ ID NO: 10465 - RNA, 18 nt, Artificial Sequence
  Description of Artificial Sequence: Synthetic oligonucleotide
uuuacagauugcuuuggc

SEQ ID NO: 10466 - RNA, 18 nt, Artificial Sequence
  Description of Artificial Sequence: Synthetic oligonucleotide
gcuucuuuacagauugcu

SEQ ID NO: 10467 - RNA, 18 nt, Artificial Sequence
  Description of Artificial Sequence: Synthetic oligonucleotide
caaaugcuucuuuacaga

SEQ ID NO: 10468 - RNA, 18 nt, Artificial Sequence
  Description of Artificial Sequence: Synthetic oligonucleotide
uuugucaaaugcuucuuu

SEQ ID NO: 10469 - RNA, 18 nt, Artificial Sequence
  Description of Artificial Sequence: Synthetic oligonucleotide
uccaguuugucaaaugcu

SEQ ID NO: 10470 - RNA, 18 nt, Artificial Sequence
  Description of Artificial Sequence: Synthetic oligonucleotide
gggcauccaguuugucaa

SEQ ID NO: 10471 - RNA, 18 nt, Artificial Sequence
  Description of Artificial Sequence: Synthetic oligonucleotide
cacaugggcauccaguuu

SEQ ID NO: 10472 - RNA, 18 nt, Artificial Sequence
  Description of Artificial Sequence: Synthetic oligonucleotide
cucuccacaugggcaucc

SEQ ID NO: 10473 - RNA, 18 nt, Artificial Sequence
  Description of Artificial Sequence: Synthetic oligonucleotide
caacucucuccacauggg

SEQ ID NO: 10474 - RNA, 18 nt, Artificial Sequence
  Description of Artificial Sequence: Synthetic oligonucleotide
acagucaacucucuccac

SEQ ID NO: 10475 - RNA, 18 nt, Artificial Sequence
  Description of Artificial Sequence: Synthetic oligonucleotide
gcuuuacagucaacucuc

SEQ ID NO: 10476 - RNA, 18 nt, Artificial Sequence
  Description of Artificial Sequence: Synthetic oligonucleotide
guaaagcuuuacagucaa

SEQ ID NO: 10477 - RNA, 18 nt, Artificial Sequence
  Description of Artificial Sequence: Synthetic oligonucleotide
uagcagccaauacauaaa

SEQ ID NO: 10478 - RNA, 18 nt, Artificial Sequence
  Description of Artificial Sequence: Synthetic oligonucleotide
acuaguagcagccaauac

SEQ ID NO: 10479 - RNA, 18 nt, Artificial Sequence
  Description of Artificial Sequence: Synthetic oligonucleotide
gggcgacuaguagcagcc

SEQ ID NO: 10480 - RNA, 18 nt, Artificial Sequence
  Description of Artificial Sequence: Synthetic oligonucleotide
agucagggcgacuaguag

SEQ ID NO: 10481 - RNA, 18 nt, Artificial Sequence
  Description of Artificial Sequence: Synthetic oligonucleotide
aaucaagucagggcgacu

SEQ ID NO: 10482 - RNA, 18 nt, Artificial Sequence
  Description of Artificial Sequence: Synthetic oligonucleotide
gggucaaucaagucaggg

SEQ ID NO: 10483 - RNA, 18 nt, Artificial Sequence
  Description of Artificial Sequence: Synthetic oligonucleotide
gggcagggucaaucaagu

SEQ ID NO: 10484 - RNA, 18 nt, Artificial Sequence
  Description of Artificial Sequence: Synthetic oligonucleotide
aagcagggcagggucaau

SEQ ID NO: 10485 - RNA, 18 nt, Artificial Sequence
  Description of Artificial Sequence: Synthetic oligonucleotide
ggccuaagcagggcaggg

SEQ ID NO: 10486 - RNA, 18 nt, Artificial Sequence
  Description of Artificial Sequence: Synthetic oligonucleotide
gaccaggccuaagcaggg

SEQ ID NO: 10487 - RNA, 18 nt, Artificial Sequence
  Description of Artificial Sequence: Synthetic oligonucleotide
uagucgaccaggccuaag

SEQ ID NO: 10488 - RNA, 18 nt, Artificial Sequence
  Description of Artificial Sequence: Synthetic oligonucleotide
uuaucuagucgaccaggc

SEQ ID NO: 10489 - RNA, 18 nt, Artificial Sequence
  Description of Artificial Sequence: Synthetic oligonucleotide
cacauuuaucuagucgac

SEQ ID NO: 10490 - RNA, 18 nt, Artificial Sequence
  Description of Artificial Sequence: Synthetic oligonucleotide
guauacacauuuaucuag

SEQ ID NO: 10491 - RNA, 18 nt, Artificial Sequence
  Description of Artificial Sequence: Synthetic oligonucleotide
ggacaguauacacauuua

SEQ ID NO: 10492 - RNA, 18 nt, Artificial Sequence
  Description of Artificial Sequence: Synthetic oligonucleotide
gaggaggacaguauacac

SEQ ID NO: 10493 - RNA, 18 nt, Artificial Sequence
  Description of Artificial Sequence: Synthetic oligonucleotide
aucaggaggaggacagua

SEQ ID NO: 10494 - RNA, 18 nt, Artificial Sequence
  Description of Artificial Sequence: Synthetic oligonucleotide
gacucuaaauaugaaauu

SEQ ID NO: 10495 - RNA, 18 nt, Artificial Sequence
  Description of Artificial Sequence: Synthetic oligonucleotide
uuuuggacucuaaauaug

SEQ ID NO: 10496 - RNA, 18 nt, Artificial Sequence
  Description of Artificial Sequence: Synthetic oligonucleotide
uuggguuuuggacucuaa

SEQ ID NO: 10497 - RNA, 18 nt, Artificial Sequence
  Description of Artificial Sequence: Synthetic oligonucleotide
auuuguuggguuuuggac

SEQ ID NO: 10498 - RNA, 18 nt, Artificial Sequence
  Description of Artificial Sequence: Synthetic oligonucleotide
guagcauuuguuggguuu

SEQ ID NO: 10499 - RNA, 18 nt, Artificial Sequence
  Description of Artificial Sequence: Synthetic oligonucleotide
agaguguagcauuuguug

SEQ ID NO: 10500 - RNA, 18 nt, Artificial Sequence
  Description of Artificial Sequence: Synthetic oligonucleotide
aggaaagaguguagcauu

SEQ ID NO: 10501 - RNA, 18 nt, Artificial Sequence
  Description of Artificial Sequence: Synthetic oligonucleotide
ucacaaggaaagagugua

SEQ ID NO: 10502 - RNA, 18 nt, Artificial Sequence
  Description of Artificial Sequence: Synthetic oligonucleotide
aaagcucacaaggaaaga

SEQ ID NO: 10503 - RNA, 18 nt, Artificial Sequence
  Description of Artificial Sequence: Synthetic oligonucleotide
gaaguaaagcucacaagg

SEQ ID NO: 10504 - RNA, 18 nt, Artificial Sequence
  Description of Artificial Sequence: Synthetic oligonucleotide
uggcagaaguaaagcuca

SEQ ID NO: 10505 - RNA, 18 nt, Artificial Sequence
  Description of Artificial Sequence: Synthetic oligonucleotide
uuaccuggcagaaguaaa

SEQ ID NO: 10506 - RNA, 18 nt, Artificial Sequence
  Description of Artificial Sequence: Synthetic oligonucleotide
ugccauuaccuggcagaa

SEQ ID NO: 10507 - RNA, 18 nt, Artificial Sequence
  Description of Artificial Sequence: Synthetic oligonucleotide
acaauugccauuaccugg

SEQ ID NO: 10508 - RNA, 18 nt, Artificial Sequence
  Description of Artificial Sequence: Synthetic oligonucleotide
uaaggacaauugccauua

SEQ ID NO: 10509 - RNA, 18 nt, Artificial Sequence
  Description of Artificial Sequence: Synthetic oligonucleotide
ucuucuaaggacaauugc

SEQ ID NO: 10510 - RNA, 18 nt, Artificial Sequence
  Description of Artificial Sequence: Synthetic oligonucleotide
gcuggucuucuaaggaca

SEQ ID NO: 10511 - RNA, 18 nt, Artificial Sequence
  Description of Artificial Sequence: Synthetic oligonucleotide
agaaagcuggucuucuaa

SEQ ID NO: 10512 - RNA, 18 nt, Artificial Sequence
  Description of Artificial Sequence: Synthetic oligonucleotide
cccuaagaaagcuggucu

SEQ ID NO: 10513 - RNA, 18 nt, Artificial Sequence
  Description of Artificial Sequence: Synthetic oligonucleotide
cuuuucccuaagaaagcu

SEQ ID NO: 10514 - RNA, 18 nt, Artificial Sequence
  Description of Artificial Sequence: Synthetic oligonucleotide
uaaagcuuuucccuaaga

SEQ ID NO: 10515 - RNA, 18 nt, Artificial Sequence
  Description of Artificial Sequence: Synthetic oligonucleotide
guggcuaaagcuuuuccc

SEQ ID NO: 10516 - RNA, 18 nt, Artificial Sequence
  Description of Artificial Sequence: Synthetic oligonucleotide
aaacaguggcuaaagcuu

SEQ ID NO: 10517 - RNA, 18 nt, Artificial Sequence
  Description of Artificial Sequence: Synthetic oligonucleotide
ugagcaaacaguggcuaa

SEQ ID NO: 10518 - RNA, 18 nt, Artificial Sequence
  Description of Artificial Sequence: Synthetic oligonucleotide
ugcuuugagcaaacagug

SEQ ID NO: 10519 - RNA, 18 nt, Artificial Sequence
  Description of Artificial Sequence: Synthetic oligonucleotide
uuuuaugcuuugagcaaa

SEQ ID NO: 10520 - RNA, 18 nt, Artificial Sequence
  Description of Artificial Sequence: Synthetic oligonucleotide
aaucuuuuuaugcuuuga

SEQ ID NO: 10521 - RNA, 18 nt, Artificial Sequence
  Description of Artificial Sequence: Synthetic oligonucleotide
uucagaaucuuuuuaugc

SEQ ID NO: 10522 - RNA, 18 nt, Artificial Sequence
  Description of Artificial Sequence: Synthetic oligonucleotide
ucuaauucagaaucuuuu

SEQ ID NO: 10523 - RNA, 18 nt, Artificial Sequence
  Description of Artificial Sequence: Synthetic oligonucleotide
uugcaucuaauucagaau

SEQ ID NO: 10524 - RNA, 18 nt, Artificial Sequence
  Description of Artificial Sequence: Synthetic oligonucleotide
aggcuuugcaucuaauuc

SEQ ID NO: 10525 - RNA, 18 nt, Artificial Sequence
  Description of Artificial Sequence: Synthetic oligonucleotide
aaaaaaggcuuugcaucu

SEQ ID NO: 10526 - RNA, 18 nt, Artificial Sequence
  Description of Artificial Sequence: Synthetic oligonucleotide
ggccaaaaaaaggcuuug

SEQ ID NO: 10527 - RNA, 18 nt, Artificial Sequence
  Description of Artificial Sequence: Synthetic oligonucleotide
cacugggccaaaaaaagg

SEQ ID NO: 10528 - RNA, 18 nt, Artificial Sequence
  Description of Artificial Sequence: Synthetic oligonucleotide
acuugcacugggccaaaa

SEQ ID NO: 10529 - RNA, 18 nt, Artificial Sequence
  Description of Artificial Sequence: Synthetic oligonucleotide
uucagacuugcacugggc

SEQ ID NO: 10530 - RNA, 18 nt, Artificial Sequence
  Description of Artificial Sequence: Synthetic oligonucleotide
aaguuuucagacuugcac

SEQ ID NO: 10531 - RNA, 18 nt, Artificial Sequence
  Description of Artificial Sequence: Synthetic oligonucleotide
uuacaaaguuuucagacu

SEQ ID NO: 10532 - RNA, 18 nt, Artificial Sequence
  Description of Artificial Sequence: Synthetic oligonucleotide
aaggauuacaaaguuuuc

SEQ ID NO: 10533 - RNA, 18 nt, Artificial Sequence
  Description of Artificial Sequence: Synthetic oligonucleotide
cacagaaggauuacaaag

SEQ ID NO: 10534 - RNA, 18 nt, Artificial Sequence
  Description of Artificial Sequence: Synthetic oligonucleotide
gccaacacagaaggauua

SEQ ID NO: 10535 - RNA, 18 nt, Artificial Sequence
  Description of Artificial Sequence: Synthetic oligonucleotide
aaucagccaacacagaag

SEQ ID NO: 10536 - RNA, 18 nt, Artificial Sequence
  Description of Artificial Sequence: Synthetic oligonucleotide
uccccaaucagccaacac

SEQ ID NO: 10537 - RNA, 18 nt, Artificial Sequence
  Description of Artificial Sequence: Synthetic oligonucleotide
uuuuuuccccaaucagcc

SEQ ID NO: 10538 - RNA, 18 nt, Artificial Sequence
  Description of Artificial Sequence: Synthetic oligonucleotide
cauuuuuuuuuccccaau

SEQ ID NO: 10539 - RNA, 18 nt, Artificial Sequence
  Description of Artificial Sequence: Synthetic oligonucleotide
ucuugcauuuuuuuuucc

SEQ ID NO: 10540 - RNA, 18 nt, Artificial Sequence
  Description of Artificial Sequence: Synthetic oligonucleotide
agguuucuugcauuuuuu

SEQ ID NO: 10541 - RNA, 18 nt, Artificial Sequence
  Description of Artificial Sequence: Synthetic oligonucleotide
acauuagguuucuugcau

SEQ ID NO: 10542 - RNA, 18 nt, Artificial Sequence
  Description of Artificial Sequence: Synthetic oligonucleotide
auaauacauuagguuucu

SEQ ID NO: 10543 - RNA, 18 nt, Artificial Sequence
  Description of Artificial Sequence: Synthetic oligonucleotide
aaaauauaauacauuagg

SEQ ID NO: 10544 - RNA, 18 nt, Artificial Sequence
  Description of Artificial Sequence: Synthetic oligonucleotide
augugaaaauauaauaca

SEQ ID NO: 10545 - RNA, 18 nt, Artificial Sequence
  Description of Artificial Sequence: Synthetic oligonucleotide
agauaaugugaaaauaua

SEQ ID NO: 10546 - RNA, 18 nt, Artificial Sequence
  Description of Artificial Sequence: Synthetic oligonucleotide
acagaagauaaugugaaa

SEQ ID NO: 10547 - RNA, 18 nt, Artificial Sequence
  Description of Artificial Sequence: Synthetic oligonucleotide
uuugaacagaagauaaug

SEQ ID NO: 10548 - RNA, 18 nt, Artificial Sequence
  Description of Artificial Sequence: Synthetic oligonucleotide
uaaucuuugaacagaaga

SEQ ID NO: 10549 - RNA, 18 nt, Artificial Sequence
  Description of Artificial Sequence: Synthetic oligonucleotide
guauguaaucuuugaaca

SEQ ID NO: 10550 - RNA, 18 nt, Artificial Sequence
  Description of Artificial Sequence: Synthetic oligonucleotide
uggaaguauguaaucuuu

SEQ ID NO: 10551 - RNA, 18 nt, Artificial Sequence
  Description of Artificial Sequence: Synthetic oligonucleotide
gauaauggaaguauguaa

SEQ ID NO: 10552 - RNA, 18 nt, Artificial Sequence
  Description of Artificial Sequence: Synthetic oligonucleotide
gacaggauaauggaagua

SEQ ID NO: 10553 - RNA, 18 nt, Artificial Sequence
  Description of Artificial Sequence: Synthetic oligonucleotide
uuuuugacaggauaaugg

SEQ ID NO: 10554 - RNA, 18 nt, Artificial Sequence
  Description of Artificial Sequence: Synthetic oligonucleotide
uuuuuuuuuugacaggau

SEQ ID NO: 10555 - RNA, 18 nt, Artificial Sequence
  Description of Artificial Sequence: Synthetic oligonucleotide
cagaguuuuuuuuuugac

SEQ ID NO: 10556 - RNA, 18 nt, Artificial Sequence
  Description of Artificial Sequence: Synthetic oligonucleotide
uguaucagaguuuuuuuu

SEQ ID NO: 10557 - RNA, 18 nt, Artificial Sequence
  Description of Artificial Sequence: Synthetic oligonucleotide
gauucuguaucagaguuu

SEQ ID NO: 10558 - RNA, 18 nt, Artificial Sequence
  Description of Artificial Sequence: Synthetic oligonucleotide
ugcuugauucuguaucag

SEQ ID NO: 10559 - RNA, 18 nt, Artificial Sequence
  Description of Artificial Sequence: Synthetic oligonucleotide
ucacaugcuugauucugu

SEQ ID NO: 10560 - RNA, 18 nt, Artificial Sequence
  Description of Artificial Sequence: Synthetic oligonucleotide
acgauucacaugcuugau

SEQ ID NO: 10561 - RNA, 18 nt, Artificial Sequence
  Description of Artificial Sequence: Synthetic oligonucleotide
ugcuuacgauucacaugc

SEQ ID NO: 10562 - RNA, 18 nt, Artificial Sequence
  Description of Artificial Sequence: Synthetic oligonucleotide
uuacaugcuuacgauuca

SEQ ID NO: 10563 - RNA, 18 nt, Artificial Sequence
  Description of Artificial Sequence: Synthetic oligonucleotide
ccugcuuacaugcuuacg

SEQ ID NO: 10564 - RNA, 18 nt, Artificial Sequence
  Description of Artificial Sequence: Synthetic oligonucleotide
ugaaaccugcuuacaugc

SEQ ID NO: 10565 - RNA, 18 nt, Artificial Sequence
  Description of Artificial Sequence: Synthetic oligonucleotide
cucuaugaaaccugcuua

SEQ ID NO: 10566 - RNA, 18 nt, Artificial Sequence
  Description of Artificial Sequence: Synthetic oligonucleotide
auuaucucuaugaaaccu

SEQ ID NO: 10567 - RNA, 18 nt, Artificial Sequence
  Description of Artificial Sequence: Synthetic oligonucleotide
gaaaaauuaucucuauga

SEQ ID NO: 10568 - RNA, 18 nt, Artificial Sequence
  Description of Artificial Sequence: Synthetic oligonucleotide
gaguugaaaaauuaucuc

SEQ ID NO: 10569 - RNA, 18 nt, Artificial Sequence
  Description of Artificial Sequence: Synthetic oligonucleotide
aggaagaguugaaaaauu

SEQ ID NO: 10570 - RNA, 18 nt, Artificial Sequence
  Description of Artificial Sequence: Synthetic oligonucleotide
ggacaaggaagaguugaa

SEQ ID NO: 10571 - RNA, 18 nt, Artificial Sequence
  Description of Artificial Sequence: Synthetic oligonucleotide
acacaggacaaggaagag

SEQ ID NO: 10572 - RNA, 18 nt, Artificial Sequence
  Description of Artificial Sequence: Synthetic oligonucleotide
gaacaacacaggacaagg

SEQ ID NO: 10573 - RNA, 18 nt, Artificial Sequence
  Description of Artificial Sequence: Synthetic oligonucleotide
aguuggaacaacacagga

SEQ ID NO: 10574 - RNA, 18 nt, Artificial Sequence
  Description of Artificial Sequence: Synthetic oligonucleotide
auaagaguuggaacaaca

SEQ ID NO: 10575 - RNA, 18 nt, Artificial Sequence
  Description of Artificial Sequence: Synthetic oligonucleotide
ggagaauaagaguuggaa

SEQ ID NO: 10576 - RNA, 18 nt, Artificial Sequence
  Description of Artificial Sequence: Synthetic oligonucleotide
aaauuggagaauaagagu

SEQ ID NO: 10577 - RNA, 18 nt, Artificial Sequence
  Description of Artificial Sequence: Synthetic oligonucleotide
cuucuaaauuggagaaua

SEQ ID NO: 10578 - RNA, 18 nt, Artificial Sequence
  Description of Artificial Sequence: Synthetic oligonucleotide
guuugcuucuaaauugga

SEQ ID NO: 10579 - RNA, 18 nt, Artificial Sequence
  Description of Artificial Sequence: Synthetic oligonucleotide
uauuuguuugcuucuaaa

SEQ ID NO: 10580 - RNA, 18 nt, Artificial Sequence
  Description of Artificial Sequence: Synthetic oligonucleotide
ucauuuauuuguuugcuu

SEQ ID NO: 10581 - RNA, 18 nt, Artificial Sequence
  Description of Artificial Sequence: Synthetic oligonucleotide
uucauucauuuauuuguu

SEQ ID NO: 10582 - RNA, 18 nt, Artificial Sequence
  Description of Artificial Sequence: Synthetic oligonucleotide
guucuuucauucauuuau

SEQ ID NO: 10583 - RNA, 18 nt, Artificial Sequence
  Description of Artificial Sequence: Synthetic oligonucleotide
uaucuguucuuucauuca

SEQ ID NO: 10584 - RNA, 18 nt, Artificial Sequence
  Description of Artificial Sequence: Synthetic oligonucleotide
uugucuaucuguucuuuc

SEQ ID NO: 10585 - RNA, 18 nt, Artificial Sequence
  Description of Artificial Sequence: Synthetic oligonucleotide
uucauuugucuaucuguu

SEQ ID NO: 10586 - RNA, 18 nt, Artificial Sequence
  Description of Artificial Sequence: Synthetic oligonucleotide
gacuauucauuugucuau

SEQ ID NO: 10587 - RNA, 18 nt, Artificial Sequence
  Description of Artificial Sequence: Synthetic oligonucleotide
ccuuugacuauucauuug

SEQ ID NO: 10588 - RNA, 18 nt, Artificial Sequence
  Description of Artificial Sequence: Synthetic oligonucleotide
uuauaccuuugacuauuc

SEQ ID NO: 10589 - RNA, 18 nt, Artificial Sequence
  Description of Artificial Sequence: Synthetic oligonucleotide
auacuuuauaccuuugac

SEQ ID NO: 10590 - RNA, 18 nt, Artificial Sequence
  Description of Artificial Sequence: Synthetic oligonucleotide
uacagauacuuuauaccu

SEQ ID NO: 10591 - RNA, 18 nt, Artificial Sequence
  Description of Artificial Sequence: Synthetic oligonucleotide
auauauacagauacuuua

SEQ ID NO: 10592 - RNA, 18 nt, Artificial Sequence
  Description of Artificial Sequence: Synthetic oligonucleotide
guaacauauauacagaua

SEQ ID NO: 10593 - RNA, 18 nt, Artificial Sequence
  Description of Artificial Sequence: Synthetic oligonucleotide
ugagaccuugucugaaaa

SEQ ID NO: 10594 - RNA, 18 nt, Artificial Sequence
  Description of Artificial Sequence: Synthetic oligonucleotide
caaagugagaccuugucu

SEQ ID NO: 10595 - RNA, 18 nt, Artificial Sequence
  Description of Artificial Sequence: Synthetic oligonucleotide
ggugacaaagugagaccu

SEQ ID NO: 10596 - RNA, 18 nt, Artificial Sequence
  Description of Artificial Sequence: Synthetic oligonucleotide
gccugggugacaaaguga

SEQ ID NO: 10597 - RNA, 18 nt, Artificial Sequence
  Description of Artificial Sequence: Synthetic oligonucleotide
cuccagccugggugacaa

SEQ ID NO: 10598 - RNA, 18 nt, Artificial Sequence
  Description of Artificial Sequence: Synthetic oligonucleotide
guguacuccagccugggu

SEQ ID NO: 10599 - RNA, 18 nt, Artificial Sequence
  Description of Artificial Sequence: Synthetic oligonucleotide
uaccaguguacuccagcc

SEQ ID NO: 10600 - RNA, 18 nt, Artificial Sequence
  Description of Artificial Sequence: Synthetic oligonucleotide
gaucguaccaguguacuc

SEQ ID NO: 10601 - RNA, 18 nt, Artificial Sequence
  Description of Artificial Sequence: Synthetic oligonucleotide
guugugaucguaccagug

SEQ ID NO: 10602 - RNA, 18 nt, Artificial Sequence
  Description of Artificial Sequence: Synthetic oligonucleotide
agugaguugugaucguac

SEQ ID NO: 10603 - RNA, 18 nt, Artificial Sequence
  Description of Artificial Sequence: Synthetic oligonucleotide
gcugcagugaguugugau

SEQ ID NO: 10604 - RNA, 18 nt, Artificial Sequence
  Description of Artificial Sequence: Synthetic oligonucleotide
uagaggcugcagugaguu

SEQ ID NO: 10605 - RNA, 18 nt, Artificial Sequence
  Description of Artificial Sequence: Synthetic oligonucleotide
ggccauagaggcugcagu

SEQ ID NO: 10606 - RNA, 18 nt, Artificial Sequence
  Description of Artificial Sequence: Synthetic oligonucleotide
gccugggccauagaggcu

SEQ ID NO: 10607 - RNA, 18 nt, Artificial Sequence
  Description of Artificial Sequence: Synthetic oligonucleotide
cuugagccugggccauag

SEQ ID NO: 10608 - RNA, 18 nt, Artificial Sequence
  Description of Artificial Sequence: Synthetic oligonucleotide
gauugcuugagccugggc

SEQ ID NO: 10609 - RNA, 18 nt, Artificial Sequence
  Description of Artificial Sequence: Synthetic oligonucleotide
ucgggaggcugagguggg

SEQ ID NO: 10610 - RNA, 18 nt, Artificial Sequence
  Description of Artificial Sequence: Synthetic oligonucleotide
gcuacucgggaggcugag

SEQ ID NO: 10611 - RNA, 18 nt, Artificial Sequence
  Description of Artificial Sequence: Synthetic oligonucleotide
ucccagcuacucgggagg

SEQ ID NO: 10612 - RNA, 18 nt, Artificial Sequence
  Description of Artificial Sequence: Synthetic oligonucleotide
uguggucccagcuacucg

SEQ ID NO: 10613 - RNA, 18 nt, Artificial Sequence
  Description of Artificial Sequence: Synthetic oligonucleotide
gugccuguggucccagcu

SEQ ID NO: 10614 - RNA, 18 nt, Artificial Sequence
  Description of Artificial Sequence: Synthetic oligonucleotide
agcgugugccuguggucc

SEQ ID NO: 10615 - RNA, 18 nt, Artificial Sequence
  Description of Artificial Sequence: Synthetic oligonucleotide
augguagcgugugccugu

SEQ ID NO: 10616 - RNA, 18 nt, Artificial Sequence
  Description of Artificial Sequence: Synthetic oligonucleotide
ugggcaugguagcgugug

SEQ ID NO: 10617 - RNA, 18 nt, Artificial Sequence
  Description of Artificial Sequence: Synthetic oligonucleotide
uuaucugggcaugguagc

SEQ ID NO: 10618 - RNA, 18 nt, Artificial Sequence
  Description of Artificial Sequence: Synthetic oligonucleotide
uaaaauuaucugggcaug

SEQ ID NO: 10619 - RNA, 18 nt, Artificial Sequence
  Description of Artificial Sequence: Synthetic oligonucleotide
aauaauaaaauuaucugg

SEQ ID NO: 10620 - RNA, 18 nt, Artificial Sequence
  Description of Artificial Sequence: Synthetic oligonucleotide
aaauuaauaauaaaauua

SEQ ID NO: 10621 - RNA, 18 nt, Artificial Sequence
  Description of Artificial Sequence: Synthetic oligonucleotide
uacaaaaauuaauaauaa

SEQ ID NO: 10622 - RNA, 18 nt, Artificial Sequence
  Description of Artificial Sequence: Synthetic oligonucleotide
cucuauacaaaaauuaau

SEQ ID NO: 10623 - RNA, 18 nt, Artificial Sequence
  Description of Artificial Sequence: Synthetic oligonucleotide
cccaucucuauacaaaaa

SEQ ID NO: 10624 - RNA, 18 nt, Artificial Sequence
  Description of Artificial Sequence: Synthetic oligonucleotide
gagaccccaucucuauac

SEQ ID NO: 10625 - RNA, 18 nt, Artificial Sequence
  Description of Artificial Sequence: Synthetic oligonucleotide
acagggagaccccaucuc

SEQ ID NO: 10626 - RNA, 18 nt, Artificial Sequence
  Description of Artificial Sequence: Synthetic oligonucleotide
gcaacacagggagacccc

SEQ ID NO: 10627 - RNA, 18 nt, Artificial Sequence
  Description of Artificial Sequence: Synthetic oligonucleotide
ccugggcaacacagggag

SEQ ID NO: 10628 - RNA, 18 nt, Artificial Sequence
  Description of Artificial Sequence: Synthetic oligonucleotide
gaaagccugggcaacaca

SEQ ID NO: 10629 - RNA, 18 nt, Artificial Sequence
  Description of Artificial Sequence: Synthetic oligonucleotide
uucaagaaagccugggca

SEQ ID NO: 10630 - RNA, 18 nt, Artificial Sequence
  Description of Artificial Sequence: Synthetic oligonucleotide
uggaguucaagaaagccu

SEQ ID NO: 10631 - RNA, 18 nt, Artificial Sequence
  Description of Artificial Sequence: Synthetic oligonucleotide
agcccuggaguucaagaa

SEQ ID NO: 10632 - RNA, 18 nt, Artificial Sequence
  Description of Artificial Sequence: Synthetic oligonucleotide
acuugagcccuggaguuc

SEQ ID NO: 10633 - RNA, 18 nt, Artificial Sequence
  Description of Artificial Sequence: Synthetic oligonucleotide
ggaucacuugagcccugg

SEQ ID NO: 10634 - RNA, 18 nt, Artificial Sequence
  Description of Artificial Sequence: Synthetic oligonucleotide
ugggaggaucacuugagc

SEQ ID NO: 10635 - RNA, 18 nt, Artificial Sequence
  Description of Artificial Sequence: Synthetic oligonucleotide
ugaggugggaggaucacu

SEQ ID NO: 10636 - RNA, 18 nt, Artificial Sequence
  Description of Artificial Sequence: Synthetic oligonucleotide
gagguugaggugggagga

SEQ ID NO: 10637 - RNA, 18 nt, Artificial Sequence
  Description of Artificial Sequence: Synthetic oligonucleotide
uuugggagguugaggugg

SEQ ID NO: 10638 - RNA, 18 nt, Artificial Sequence
  Description of Artificial Sequence: Synthetic oligonucleotide
aacacuuugggagguuga

SEQ ID NO: 10639 - RNA, 18 nt, Artificial Sequence
  Description of Artificial Sequence: Synthetic oligonucleotide
aucccaacacuuugggag

SEQ ID NO: 10640 - RNA, 18 nt, Artificial Sequence
  Description of Artificial Sequence: Synthetic oligonucleotide
cuguaaucccaacacuuu

SEQ ID NO: 10641 - RNA, 18 nt, Artificial Sequence
  Description of Artificial Sequence: Synthetic oligonucleotide
cacgccuguaaucccaac

SEQ ID NO: 10642 - RNA, 18 nt, Artificial Sequence
  Description of Artificial Sequence: Synthetic oligonucleotide
uggcucacgccuguaauc

SEQ ID NO: 10643 - RNA, 18 nt, Artificial Sequence
  Description of Artificial Sequence: Synthetic oligonucleotide
caugguggcucacgccug

SEQ ID NO: 10644 - RNA, 18 nt, Artificial Sequence
  Description of Artificial Sequence: Synthetic oligonucleotide
cugggcaugguggcucac

SEQ ID NO: 10645 - RNA, 18 nt, Artificial Sequence
  Description of Artificial Sequence: Synthetic oligonucleotide
uaaggcugggcauggugg

SEQ ID NO: 10646 - RNA, 18 nt, Artificial Sequence
  Description of Artificial Sequence: Synthetic oligonucleotide
acucuuaaggcugggcau

SEQ ID NO: 10647 - RNA, 18 nt, Artificial Sequence
  Description of Artificial Sequence: Synthetic oligonucleotide
caaacacucuuaaggcug

SEQ ID NO: 10648 - RNA, 18 nt, Artificial Sequence
  Description of Artificial Sequence: Synthetic oligonucleotide
aaaaucaaacacucuuaa

SEQ ID NO: 10649 - RNA, 18 nt, Artificial Sequence
  Description of Artificial Sequence: Synthetic oligonucleotide
gaaugaaaaucaaacacu

SEQ ID NO: 10650 - RNA, 18 nt, Artificial Sequence
  Description of Artificial Sequence: Synthetic oligonucleotide
aaaaugaaugaaaaucaa

SEQ ID NO: 10651 - RNA, 18 nt, Artificial Sequence
  Description of Artificial Sequence: Synthetic oligonucleotide
auaggaaaaugaaugaaa

SEQ ID NO: 10652 - RNA, 18 nt, Artificial Sequence
  Description of Artificial Sequence: Synthetic oligonucleotide
uauauauaggaaaaugaa

SEQ ID NO: 10653 - RNA, 18 nt, Artificial Sequence
  Description of Artificial Sequence: Synthetic oligonucleotide
aauaauauauauaggaaa

SEQ ID NO: 10654 - RNA, 18 nt, Artificial Sequence
  Description of Artificial Sequence: Synthetic oligonucleotide
acagaaauaauauauaua

SEQ ID NO: 10655 - RNA, 18 nt, Artificial Sequence
  Description of Artificial Sequence: Synthetic oligonucleotide
ccccaacagaaauaauau

SEQ ID NO: 10656 - RNA, 18 nt, Artificial Sequence
  Description of Artificial Sequence: Synthetic oligonucleotide
uuuuuccccaacagaaau

SEQ ID NO: 10657 - RNA, 18 nt, Artificial Sequence
  Description of Artificial Sequence: Synthetic oligonucleotide
ggaauuuuuuccccaaca

SEQ ID NO: 10658 - RNA, 18 nt, Artificial Sequence
  Description of Artificial Sequence: Synthetic oligonucleotide
uccuuggaauuuuuuccc

SEQ ID NO: 10659 - RNA, 18 nt, Artificial Sequence
  Description of Artificial Sequence: Synthetic oligonucleotide
uaucuuccuuggaauuuu

SEQ ID NO: 10660 - RNA, 18 nt, Artificial Sequence
  Description of Artificial Sequence: Synthetic oligonucleotide
cuauuuaucuuccuugga

SEQ ID NO: 10661 - RNA, 18 nt, Artificial Sequence
  Description of Artificial Sequence: Synthetic oligonucleotide
gccuacuauuuaucuucc

SEQ ID NO: 10662 - RNA, 18 nt, Artificial Sequence
  Description of Artificial Sequence: Synthetic oligonucleotide
caacagccuacuauuuau

SEQ ID NO: 10663 - RNA, 18 nt, Artificial Sequence
  Description of Artificial Sequence: Synthetic oligonucleotide
uguaccaacagccuacua

SEQ ID NO: 10664 - RNA, 18 nt, Artificial Sequence
  Description of Artificial Sequence: Synthetic oligonucleotide
agaaauguaccaacagcc

SEQ ID NO: 10665 - RNA, 18 nt, Artificial Sequence
  Description of Artificial Sequence: Synthetic oligonucleotide
aguugagaaauguaccaa

SEQ ID NO: 10666 - RNA, 18 nt, Artificial Sequence
  Description of Artificial Sequence: Synthetic oligonucleotide
aaguaaguugagaaaugu

SEQ ID NO: 10667 - RNA, 18 nt, Artificial Sequence
  Description of Artificial Sequence: Synthetic oligonucleotide
uuuauaaguaaguugaga

SEQ ID NO: 10668 - RNA, 18 nt, Artificial Sequence
  Description of Artificial Sequence: Synthetic oligonucleotide
aaagcuuuauaaguaagu

SEQ ID NO: 10669 - RNA, 18 nt, Artificial Sequence
  Description of Artificial Sequence: Synthetic oligonucleotide
ucuaaaaagcuuuauaag

SEQ ID NO: 10670 - RNA, 18 nt, Artificial Sequence
  Description of Artificial Sequence: Synthetic oligonucleotide
auauaucuaaaaagcuuu

SEQ ID NO: 10671 - RNA, 18 nt, Artificial Sequence
  Description of Artificial Sequence: Synthetic oligonucleotide
accuuauauaucuaaaaa

SEQ ID NO: 10672 - RNA, 18 nt, Artificial Sequence
  Description of Artificial Sequence: Synthetic oligonucleotide
aauuaaccuuauauaucu

SEQ ID NO: 10673 - RNA, 18 nt, Artificial Sequence
  Description of Artificial Sequence: Synthetic oligonucleotide
ucauaaauuaaccuuaua

SEQ ID NO: 10674 - RNA, 18 nt, Artificial Sequence
  Description of Artificial Sequence: Synthetic oligonucleotide
uuucuucauaaauuaacc

SEQ ID NO: 10675 - RNA, 18 nt, Artificial Sequence
  Description of Artificial Sequence: Synthetic oligonucleotide
augauuuucuucauaaau

SEQ ID NO: 10676 - RNA, 18 nt, Artificial Sequence
  Description of Artificial Sequence: Synthetic oligonucleotide
aucuuaugauuuucuuca

SEQ ID NO: 10677 - RNA, 18 nt, Artificial Sequence
  Description of Artificial Sequence: Synthetic oligonucleotide
uguguaucuuaugauuuu

SEQ ID NO: 10678 - RNA, 18 nt, Artificial Sequence
  Description of Artificial Sequence: Synthetic oligonucleotide
uaaauuguguaucuuaug

SEQ ID NO: 10679 - RNA, 18 nt, Artificial Sequence
  Description of Artificial Sequence: Synthetic oligonucleotide
uaucuuaaauuguguauc

SEQ ID NO: 10680 - RNA, 18 nt, Artificial Sequence
  Description of Artificial Sequence: Synthetic oligonucleotide
aauauuaucuuaaauugu

SEQ ID NO: 10681 - RNA, 18 nt, Artificial Sequence
  Description of Artificial Sequence: Synthetic oligonucleotide
uuaaaaauauuaucuuaa

SEQ ID NO: 10682 - RNA, 18 nt, Artificial Sequence
  Description of Artificial Sequence: Synthetic oligonucleotide
uaaaauuaaaaauauuau

SEQ ID NO: 10683 - RNA, 18 nt, Artificial Sequence
  Description of Artificial Sequence: Synthetic oligonucleotide
aaaaauaaaauuaaaaau

SEQ ID NO: 10684 - RNA, 18 nt, Artificial Sequence
  Description of Artificial Sequence: Synthetic oligonucleotide
aaauaaaaaauaaaauua

SEQ ID NO: 10685 - RNA, 18 nt, Artificial Sequence
  Description of Artificial Sequence: Synthetic oligonucleotide
uuaacaaauaaaaaauaa

SEQ ID NO: 10686 - RNA, 18 nt, Artificial Sequence
  Description of Artificial Sequence: Synthetic oligonucleotide
uuuauuuaacaaauaaaa

SEQ ID NO: 10687 - RNA, 18 nt, Artificial Sequence
  Description of Artificial Sequence: Synthetic oligonucleotide
aaauuucaagacgugaca

SEQ ID NO: 10688 - RNA, 18 nt, Artificial Sequence
  Description of Artificial Sequence: Synthetic oligonucleotide
auuuaaaauuucaagacg

SEQ ID NO: 10689 - RNA, 18 nt, Artificial Sequence
  Description of Artificial Sequence: Synthetic oligonucleotide
aggacauuuaaaauuuca

SEQ ID NO: 10690 - RNA, 18 nt, Artificial Sequence
  Description of Artificial Sequence: Synthetic oligonucleotide
cacugaggacauuuaaaa

SEQ ID NO: 10691 - RNA, 18 nt, Artificial Sequence
  Description of Artificial Sequence: Synthetic oligonucleotide
agagucacugaggacauu

SEQ ID NO: 10692 - RNA, 18 nt, Artificial Sequence
  Description of Artificial Sequence: Synthetic oligonucleotide
gguagagagucacugagg

SEQ ID NO: 10693 - RNA, 18 nt, Artificial Sequence
  Description of Artificial Sequence: Synthetic oligonucleotide
ccagagguagagagucac

SEQ ID NO: 10694 - RNA, 18 nt, Artificial Sequence
  Description of Artificial Sequence: Synthetic oligonucleotide
aucugccagagguagaga

SEQ ID NO: 10695 - RNA, 18 nt, Artificial Sequence
  Description of Artificial Sequence: Synthetic oligonucleotide
acaucaucugccagaggu

SEQ ID NO: 10696 - RNA, 18 nt, Artificial Sequence
  Description of Artificial Sequence: Synthetic oligonucleotide
ggucaacaucaucugcca

SEQ ID NO: 10697 - RNA, 18 nt, Artificial Sequence
  Description of Artificial Sequence: Synthetic oligonucleotide
cugaaggucaacaucauc

SEQ ID NO: 10698 - RNA, 18 nt, Artificial Sequence
  Description of Artificial Sequence: Synthetic oligonucleotide
acaugcugaaggucaaca

SEQ ID NO: 10699 - RNA, 18 nt, Artificial Sequence
  Description of Artificial Sequence: Synthetic oligonucleotide
augcuacaugcugaaggu

SEQ ID NO: 10700 - RNA, 18 nt, Artificial Sequence
  Description of Artificial Sequence: Synthetic oligonucleotide
uacugaugcuacaugcug

SEQ ID NO: 10701 - RNA, 18 nt, Artificial Sequence
  Description of Artificial Sequence: Synthetic oligonucleotide
ucaguuacugaugcuaca

SEQ ID NO: 10702 - RNA, 18 nt, Artificial Sequence
  Description of Artificial Sequence: Synthetic oligonucleotide
aggagucaguuacugaug

SEQ ID NO: 10703 - RNA, 18 nt, Artificial Sequence
  Description of Artificial Sequence: Synthetic oligonucleotide
aguaaaggagucaguuac

SEQ ID NO: 10704 - RNA, 18 nt, Artificial Sequence
  Description of Artificial Sequence: Synthetic oligonucleotide
gcuccaguaaaggaguca

SEQ ID NO: 10705 - RNA, 18 nt, Artificial Sequence
  Description of Artificial Sequence: Synthetic oligonucleotide
gaucagcuccaguaaagg

SEQ ID NO: 10706 - RNA, 18 nt, Artificial Sequence
  Description of Artificial Sequence: Synthetic oligonucleotide
uuucagaucagcuccagu

SEQ ID NO: 10707 - RNA, 18 nt, Artificial Sequence
  Description of Artificial Sequence: Synthetic oligonucleotide
aaagcuuucagaucagcu

SEQ ID NO: 10708 - RNA, 18 nt, Artificial Sequence
  Description of Artificial Sequence: Synthetic oligonucleotide
aaaguaaagcuuucagau

SEQ ID NO: 10709 - RNA, 18 nt, Artificial Sequence
  Description of Artificial Sequence: Synthetic oligonucleotide
auuguaaaguaaagcuuu

SEQ ID NO: 10710 - RNA, 18 nt, Artificial Sequence
  Description of Artificial Sequence: Synthetic oligonucleotide
ugggcauuguaaaguaaa

SEQ ID NO: 10711 - RNA, 18 nt, Artificial Sequence
  Description of Artificial Sequence: Synthetic oligonucleotide
ccaauugggcauuguaaa

SEQ ID NO: 10712 - RNA, 18 nt, Artificial Sequence
  Description of Artificial Sequence: Synthetic oligonucleotide
ggccuccaauugggcauu

SEQ ID NO: 10713 - RNA, 18 nt, Artificial Sequence
  Description of Artificial Sequence: Synthetic oligonucleotide
uguaaggccuccaauugg

SEQ ID NO: 10714 - RNA, 18 nt, Artificial Sequence
  Description of Artificial Sequence: Synthetic oligonucleotide
uuccauguaaggccucca

SEQ ID NO: 10715 - RNA, 18 nt, Artificial Sequence
  Description of Artificial Sequence: Synthetic oligonucleotide
cagcauuccauguaaggc

SEQ ID NO: 10716 - RNA, 18 nt, Artificial Sequence
  Description of Artificial Sequence: Synthetic oligonucleotide
gagagcagcauuccaugu

SEQ ID NO: 10717 - RNA, 18 nt, Artificial Sequence
  Description of Artificial Sequence: Synthetic oligonucleotide
cacucgagagcagcauuc

SEQ ID NO: 10718 - RNA, 18 nt, Artificial Sequence
  Description of Artificial Sequence: Synthetic oligonucleotide
gaguccacucgagagcag

SEQ ID NO: 10719 - RNA, 18 nt, Artificial Sequence
  Description of Artificial Sequence: Synthetic oligonucleotide
agagcuggaacuuccauc

SEQ ID NO: 10720 - RNA, 18 nt, Artificial Sequence
  Description of Artificial Sequence: Synthetic oligonucleotide
cuaucagagcuggaacuu

SEQ ID NO: 10721 - RNA, 18 nt, Artificial Sequence
  Description of Artificial Sequence: Synthetic oligonucleotide
ggucacuaucagagcugg

SEQ ID NO: 10722 - RNA, 18 nt, Artificial Sequence
  Description of Artificial Sequence: Synthetic oligonucleotide
acuuaggucacuaucaga

SEQ ID NO: 10723 - RNA, 18 nt, Artificial Sequence
  Description of Artificial Sequence: Synthetic oligonucleotide
gacagacuuaggucacua

SEQ ID NO: 10724 - RNA, 18 nt, Artificial Sequence
  Description of Artificial Sequence: Synthetic oligonucleotide
uugaagacagacuuaggu

SEQ ID NO: 10725 - RNA, 18 nt, Artificial Sequence
  Description of Artificial Sequence: Synthetic oligonucleotide
gaccauugaagacagacu

SEQ ID NO: 10726 - RNA, 18 nt, Artificial Sequence
  Description of Artificial Sequence: Synthetic oligonucleotide
agaaagaccauugaagac

SEQ ID NO: 10727 - RNA, 18 nt, Artificial Sequence
  Description of Artificial Sequence: Synthetic oligonucleotide
gguuaagaaagaccauug

SEQ ID NO: 10728 - RNA, 18 nt, Artificial Sequence
  Description of Artificial Sequence: Synthetic oligonucleotide
gcuaugguuaagaaagac

SEQ ID NO: 10729 - RNA, 18 nt, Artificial Sequence
  Description of Artificial Sequence: Synthetic oligonucleotide
ccacugcuaugguuaaga

SEQ ID NO: 10730 - RNA, 18 nt, Artificial Sequence
  Description of Artificial Sequence: Synthetic oligonucleotide
cagagccacugcuauggu

SEQ ID NO: 10731 - RNA, 18 nt, Artificial Sequence
  Description of Artificial Sequence: Synthetic oligonucleotide
aucgucagagccacugcu

SEQ ID NO: 10732 - RNA, 18 nt, Artificial Sequence
  Description of Artificial Sequence: Synthetic oligonucleotide
gcugaaucgucagagcca

SEQ ID NO: 10733 - RNA, 18 nt, Artificial Sequence
  Description of Artificial Sequence: Synthetic oligonucleotide
cuccagcugaaucgucag

SEQ ID NO: 10734 - RNA, 18 nt, Artificial Sequence
  Description of Artificial Sequence: Synthetic oligonucleotide
uccaucuccagcugaauc

SEQ ID NO: 10735 - RNA, 18 nt, Artificial Sequence
  Description of Artificial Sequence: Synthetic oligonucleotide
cauucuccaucuccagcu

SEQ ID NO: 10736 - RNA, 18 nt, Artificial Sequence
  Description of Artificial Sequence: Synthetic oligonucleotide
agccacauucuccaucuc

SEQ ID NO: 10737 - RNA, 18 nt, Artificial Sequence
  Description of Artificial Sequence: Synthetic oligonucleotide
aucuaagccacauucucc

SEQ ID NO: 10738 - RNA, 18 nt, Artificial Sequence
  Description of Artificial Sequence: Synthetic oligonucleotide
gacugaucuaagccacau

SEQ ID NO: 10739 - RNA, 18 nt, Artificial Sequence
  Description of Artificial Sequence: Synthetic oligonucleotide
caagggacugaucuaagc

SEQ ID NO: 10740 - RNA, 18 nt, Artificial Sequence
  Description of Artificial Sequence: Synthetic oligonucleotide
agaaacaagggacugauc

SEQ ID NO: 10741 - RNA, 18 nt, Artificial Sequence
  Description of Artificial Sequence: Synthetic oligonucleotide
ucuaaagaaacaagggac

SEQ ID NO: 10742 - RNA, 18 nt, Artificial Sequence
  Description of Artificial Sequence: Synthetic oligonucleotide
acaucucuaaagaaacaa

SEQ ID NO: 10743 - RNA, 18 nt, Artificial Sequence
  Description of Artificial Sequence: Synthetic oligonucleotide
cucggacaucucuaaaga

SEQ ID NO: 10744 - RNA, 18 nt, Artificial Sequence
  Description of Artificial Sequence: Synthetic oligonucleotide
aggaucucggacaucucu

SEQ ID NO: 10745 - RNA, 18 nt, Artificial Sequence
  Description of Artificial Sequence: Synthetic oligonucleotide
cuggaaggaucucggaca

SEQ ID NO: 10746 - RNA, 18 nt, Artificial Sequence
  Description of Artificial Sequence: Synthetic oligonucleotide
uucaucuggaaggaucuc

SEQ ID NO: 10747 - RNA, 18 nt, Artificial Sequence
  Description of Artificial Sequence: Synthetic oligonucleotide
uuugauucaucuggaagg

SEQ ID NO: 10748 - RNA, 18 nt, Artificial Sequence
  Description of Artificial Sequence: Synthetic oligonucleotide
ugaauuuugauucaucug

SEQ ID NO: 10749 - RNA, 18 nt, Artificial Sequence
  Description of Artificial Sequence: Synthetic oligonucleotide
cauauugaauuuugauuc

SEQ ID NO: 10750 - RNA, 18 nt, Artificial Sequence
  Description of Artificial Sequence: Synthetic oligonucleotide
cgguacauauugaauuuu

SEQ ID NO: 10751 - RNA, 18 nt, Artificial Sequence
  Description of Artificial Sequence: Synthetic oligonucleotide
agagccgguacauauuga

SEQ ID NO: 10752 - RNA, 18 nt, Artificial Sequence
  Description of Artificial Sequence: Synthetic oligonucleotide
aaaguagagccgguacau

SEQ ID NO: 10753 - RNA, 18 nt, Artificial Sequence
  Description of Artificial Sequence: Synthetic oligonucleotide
cuuccaaaguagagccgg

SEQ ID NO: 10754 - RNA, 18 nt, Artificial Sequence
  Description of Artificial Sequence: Synthetic oligonucleotide
aagagcuuccaaaguaga

SEQ ID NO: 10755 - RNA, 18 nt, Artificial Sequence
  Description of Artificial Sequence: Synthetic oligonucleotide
uucauaagagcuuccaaa

SEQ ID NO: 10756 - RNA, 18 nt, Artificial Sequence
  Description of Artificial Sequence: Synthetic oligonucleotide
ucugauucauaagagcuu

SEQ ID NO: 10757 - RNA, 18 nt, Artificial Sequence
  Description of Artificial Sequence: Synthetic oligonucleotide
caaguucugauucauaag

SEQ ID NO: 10758 - RNA, 18 nt, Artificial Sequence
  Description of Artificial Sequence: Synthetic oligonucleotide
auuuccaaguucugauuc

SEQ ID NO: 10759 - RNA, 18 nt, Artificial Sequence
  Description of Artificial Sequence: Synthetic oligonucleotide
guuccauuuccaaguucu

SEQ ID NO: 10760 - RNA, 18 nt, Artificial Sequence
  Description of Artificial Sequence: Synthetic oligonucleotide
aagagguuccauuuccaa

SEQ ID NO: 10761 - RNA, 18 nt, Artificial Sequence
  Description of Artificial Sequence: Synthetic oligonucleotide
aucagaagagguuccauu

SEQ ID NO: 10762 - RNA, 18 nt, Artificial Sequence
  Description of Artificial Sequence: Synthetic oligonucleotide
auaaugaugacugcacaa

SEQ ID NO: 10763 - RNA, 18 nt, Artificial Sequence
  Description of Artificial Sequence: Synthetic oligonucleotide
acuguauaaugaugacug

SEQ ID NO: 10764 - RNA, 18 nt, Artificial Sequence
  Description of Artificial Sequence: Synthetic oligonucleotide
ucagaacuguauaaugau

SEQ ID NO: 10765 - RNA, 18 nt, Artificial Sequence
  Description of Artificial Sequence: Synthetic oligonucleotide
auauuucagaacuguaua

SEQ ID NO: 10766 - RNA, 18 nt, Artificial Sequence
  Description of Artificial Sequence: Synthetic oligonucleotide
gcuuuauauuucagaacu

SEQ ID NO: 10767 - RNA, 18 nt, Artificial Sequence
  Description of Artificial Sequence: Synthetic oligonucleotide
auauagcuuuauauuuca

SEQ ID NO: 10768 - RNA, 18 nt, Artificial Sequence
  Description of Artificial Sequence: Synthetic oligonucleotide
ccaacauauagcuuuaua

SEQ ID NO: 10769 - RNA, 18 nt, Artificial Sequence
  Description of Artificial Sequence: Synthetic oligonucleotide
uuacaccaacauauagcu

SEQ ID NO: 10770 - RNA, 18 nt, Artificial Sequence
  Description of Artificial Sequence: Synthetic oligonucleotide
caacuuuacaccaacaua

SEQ ID NO: 10771 - RNA, 18 nt, Artificial Sequence
  Description of Artificial Sequence: Synthetic oligonucleotide
cacugcaacuuuacacca

SEQ ID NO: 10772 - RNA, 18 nt, Artificial Sequence
  Description of Artificial Sequence: Synthetic oligonucleotide
gaaaucacugcaacuuua

SEQ ID NO: 10773 - RNA, 18 nt, Artificial Sequence
  Description of Artificial Sequence: Synthetic oligonucleotide
ggagagaaaucacugcaa

SEQ ID NO: 10774 - RNA, 18 nt, Artificial Sequence
  Description of Artificial Sequence: Synthetic oligonucleotide
gguuaggagagaaaucac

SEQ ID NO: 10775 - RNA, 18 nt, Artificial Sequence
  Description of Artificial Sequence: Synthetic oligonucleotide
gggcugguuaggagagaa

SEQ ID NO: 10776 - RNA, 18 nt, Artificial Sequence
  Description of Artificial Sequence: Synthetic oligonucleotide
ccaaccaggaagaauaug

SEQ ID NO: 10777 - RNA, 18 nt, Artificial Sequence
  Description of Artificial Sequence: Synthetic oligonucleotide
accaaccaaccaggaaga

SEQ ID NO: 10778 - RNA, 18 nt, Artificial Sequence
  Description of Artificial Sequence: Synthetic oligonucleotide
gaagaaccaaccaaccag

SEQ ID NO: 10779 - RNA, 18 nt, Artificial Sequence
  Description of Artificial Sequence: Synthetic oligonucleotide
uuacugaagaaccaacca

SEQ ID NO: 10780 - RNA, 18 nt, Artificial Sequence
  Description of Artificial Sequence: Synthetic oligonucleotide
cuauuuuacugaagaacc

SEQ ID NO: 10781 - RNA, 18 nt, Artificial Sequence
  Description of Artificial Sequence: Synthetic oligonucleotide
caagacuauuuuacugaa

SEQ ID NO: 10782 - RNA, 18 nt, Artificial Sequence
  Description of Artificial Sequence: Synthetic oligonucleotide
agaaacaagacuauuuua

SEQ ID NO: 10783 - RNA, 18 nt, Artificial Sequence
  Description of Artificial Sequence: Synthetic oligonucleotide
aagcaagaaacaagacua

SEQ ID NO: 10784 - RNA, 18 nt, Artificial Sequence
  Description of Artificial Sequence: Synthetic oligonucleotide
aguguaagcaagaaacaa

SEQ ID NO: 10785 - RNA, 18 nt, Artificial Sequence
  Description of Artificial Sequence: Synthetic oligonucleotide
caauuaguguaagcaaga

SEQ ID NO: 10786 - RNA, 18 nt, Artificial Sequence
  Description of Artificial Sequence: Synthetic oligonucleotide
auuaccaauuaguguaag

SEQ ID NO: 10787 - RNA, 18 nt, Artificial Sequence
  Description of Artificial Sequence: Synthetic oligonucleotide
ugcaaauuaccaauuagu

SEQ ID NO: 10788 - RNA, 18 nt, Artificial Sequence
  Description of Artificial Sequence: Synthetic oligonucleotide
aggaaugcaaauuaccaa

SEQ ID NO: 10789 - RNA, 18 nt, Artificial Sequence
  Description of Artificial Sequence: Synthetic oligonucleotide
uaacaaggaaugcaaauu

SEQ ID NO: 10790 - RNA, 18 nt, Artificial Sequence
  Description of Artificial Sequence: Synthetic oligonucleotide
aaucuuaacaaggaaugc

SEQ ID NO: 10791 - RNA, 18 nt, Artificial Sequence
  Description of Artificial Sequence: Synthetic oligonucleotide
uugaaaaucuuaacaagg

SEQ ID NO: 10792 - RNA, 18 nt, Artificial Sequence
  Description of Artificial Sequence: Synthetic oligonucleotide
cugucuugaaaaucuuaa

SEQ ID NO: 10793 - RNA, 18 nt, Artificial Sequence
  Description of Artificial Sequence: Synthetic oligonucleotide
cagcccugucuugaaaau

SEQ ID NO: 10794 - RNA, 18 nt, Artificial Sequence
  Description of Artificial Sequence: Synthetic oligonucleotide
gcucccagcccugucuug

SEQ ID NO: 10795 - RNA, 18 nt, Artificial Sequence
  Description of Artificial Sequence: Synthetic oligonucleotide
uccuugcucccagcccug

SEQ ID NO: 10796 - RNA, 18 nt, Artificial Sequence
  Description of Artificial Sequence: Synthetic oligonucleotide
uugguuccuugcucccag

SEQ ID NO: 10797 - RNA, 18 nt, Artificial Sequence
  Description of Artificial Sequence: Synthetic oligonucleotide
cuacuuugguuccuugcu

SEQ ID NO: 10798 - RNA, 18 nt, Artificial Sequence
  Description of Artificial Sequence: Synthetic oligonucleotide
acgcgcuacuuugguucc

SEQ ID NO: 10799 - RNA, 18 nt, Artificial Sequence
  Description of Artificial Sequence: Synthetic oligonucleotide
caaccacgcgcuacuuug

SEQ ID NO: 10800 - RNA, 18 nt, Artificial Sequence
  Description of Artificial Sequence: Synthetic oligonucleotide
aaucacaaccacgcgcua

SEQ ID NO: 10801 - RNA, 18 nt, Artificial Sequence
  Description of Artificial Sequence: Synthetic oligonucleotide
aagguaaucacaaccacg

SEQ ID NO: 10802 - RNA, 18 nt, Artificial Sequence
  Description of Artificial Sequence: Synthetic oligonucleotide
aaccaaagguaaucacaa

SEQ ID NO: 10803 - RNA, 18 nt, Artificial Sequence
  Description of Artificial Sequence: Synthetic oligonucleotide
aaagaaaccaaagguaau

SEQ ID NO: 10804 - RNA, 18 nt, Artificial Sequence
  Description of Artificial Sequence: Synthetic oligonucleotide
accucaaagaaaccaaag

SEQ ID NO: 10805 - RNA, 18 nt, Artificial Sequence
  Description of Artificial Sequence: Synthetic oligonucleotide
gagaaaccucaaagaaac

SEQ ID NO: 10806 - RNA, 18 nt, Artificial Sequence
  Description of Artificial Sequence: Synthetic oligonucleotide
gguaagagaaaccucaaa

SEQ ID NO: 10807 - RNA, 18 nt, Artificial Sequence
  Description of Artificial Sequence: Synthetic oligonucleotide
cacuagguaagagaaacc

SEQ ID NO: 10808 - RNA, 18 nt, Artificial Sequence
  Description of Artificial Sequence: Synthetic oligonucleotide
aaagccacuagguaagag

SEQ ID NO: 10809 - RNA, 18 nt, Artificial Sequence
  Description of Artificial Sequence: Synthetic oligonucleotide
guuuuaaagccacuaggu

SEQ ID NO: 10810 - RNA, 18 nt, Artificial Sequence
  Description of Artificial Sequence: Synthetic oligonucleotide
aagauguuuuaaagccac

SEQ ID NO: 10811 - RNA, 18 nt, Artificial Sequence
  Description of Artificial Sequence: Synthetic oligonucleotide
uccuaaagauguuuuaaa

SEQ ID NO: 10812 - RNA, 18 nt, Artificial Sequence
  Description of Artificial Sequence: Synthetic oligonucleotide
acugcuccuaaagauguu

SEQ ID NO: 10813 - RNA, 18 nt, Artificial Sequence
  Description of Artificial Sequence: Synthetic oligonucleotide
auggaacugcuccuaaag

SEQ ID NO: 10814 - RNA, 18 nt, Artificial Sequence
  Description of Artificial Sequence: Synthetic oligonucleotide
auaaaauggaacugcucc

SEQ ID NO: 10815 - RNA, 18 nt, Artificial Sequence
  Description of Artificial Sequence: Synthetic oligonucleotide
uuacuauaaaauggaacu

SEQ ID NO: 10816 - RNA, 18 nt, Artificial Sequence
  Description of Artificial Sequence: Synthetic oligonucleotide
uaaguuuacuauaaaaug

SEQ ID NO: 10817 - RNA, 18 nt, Artificial Sequence
  Description of Artificial Sequence: Synthetic oligonucleotide
gaauuuaaguuuacuaua

SEQ ID NO: 10818 - RNA, 18 nt, Artificial Sequence
  Description of Artificial Sequence: Synthetic oligonucleotide
uaacagaauuuaaguuua

SEQ ID NO: 10819 - RNA, 18 nt, Artificial Sequence
  Description of Artificial Sequence: Synthetic oligonucleotide
caugauaacagaauuuaa

SEQ ID NO: 10820 - RNA, 18 nt, Artificial Sequence
  Description of Artificial Sequence: Synthetic oligonucleotide
cuguucaugauaacagaa

SEQ ID NO: 10821 - RNA, 18 nt, Artificial Sequence
  Description of Artificial Sequence: Synthetic oligonucleotide
cucaacuguucaugauaa

SEQ ID NO: 10822 - RNA, 18 nt, Artificial Sequence
  Description of Artificial Sequence: Synthetic oligonucleotide
uuauccucaacuguucau

SEQ ID NO: 10823 - RNA, 18 nt, Artificial Sequence
  Description of Artificial Sequence: Synthetic oligonucleotide
auucauuauccucaacug

SEQ ID NO: 10824 - RNA, 18 nt, Artificial Sequence
  Description of Artificial Sequence: Synthetic oligonucleotide
aaauuauucauuauccuc

SEQ ID NO: 10825 - RNA, 18 nt, Artificial Sequence
  Description of Artificial Sequence: Synthetic oligonucleotide
guaucaaauuauucauua

SEQ ID NO: 10826 - RNA, 18 nt, Artificial Sequence
  Description of Artificial Sequence: Synthetic oligonucleotide
uuauuguaucaaauuauu

SEQ ID NO: 10827 - RNA, 18 nt, Artificial Sequence
  Description of Artificial Sequence: Synthetic oligonucleotide
uuacauuauuguaucaaa

SEQ ID NO: 10828 - RNA, 18 nt, Artificial Sequence
  Description of Artificial Sequence: Synthetic oligonucleotide
auuucuuacauuauugua

SEQ ID NO: 10829 - RNA, 18 nt, Artificial Sequence
  Description of Artificial Sequence: Synthetic oligonucleotide
caggaauuucuuacauua

SEQ ID NO: 10830 - RNA, 18 nt, Artificial Sequence
  Description of Artificial Sequence: Synthetic oligonucleotide
guuuucaggaauuucuua

SEQ ID NO: 10831 - RNA, 18 nt, Artificial Sequence
  Description of Artificial Sequence: Synthetic oligonucleotide
acuuuguuuucaggaauu

SEQ ID NO: 10832 - RNA, 18 nt, Artificial Sequence
  Description of Artificial Sequence: Synthetic oligonucleotide
auaacacuuuguuuucag

SEQ ID NO: 10833 - RNA, 18 nt, Artificial Sequence
  Description of Artificial Sequence: Synthetic oligonucleotide
cacagauaacacuuuguu

SEQ ID NO: 10834 - RNA, 18 nt, Artificial Sequence
  Description of Artificial Sequence: Synthetic oligonucleotide
aguaucacagauaacacu

SEQ ID NO: 10835 - RNA, 18 nt, Artificial Sequence
  Description of Artificial Sequence: Synthetic oligonucleotide
gcaaaaguaucacagaua

SEQ ID NO: 10836 - RNA, 18 nt, Artificial Sequence
  Description of Artificial Sequence: Synthetic oligonucleotide
augcagcaaaaguaucac

SEQ ID NO: 10837 - RNA, 18 nt, Artificial Sequence
  Description of Artificial Sequence: Synthetic oligonucleotide
uuacuaugcagcaaaagu

SEQ ID NO: 10838 - RNA, 18 nt, Artificial Sequence
  Description of Artificial Sequence: Synthetic oligonucleotide
ugugcuuacuaugcagca

SEQ ID NO: 10839 - RNA, 18 nt, Artificial Sequence
  Description of Artificial Sequence: Synthetic oligonucleotide
uucauugugcuuacuaug

SEQ ID NO: 10840 - RNA, 18 nt, Artificial Sequence
  Description of Artificial Sequence: Synthetic oligonucleotide
uacacuucauugugcuua

SEQ ID NO: 10841 - RNA, 18 nt, Artificial Sequence
  Description of Artificial Sequence: Synthetic oligonucleotide
aucaguacacuucauugu

SEQ ID NO: 10842 - RNA, 18 nt, Artificial Sequence
  Description of Artificial Sequence: Synthetic oligonucleotide
acauuaucaguacacuuc

SEQ ID NO: 10843 - RNA, 18 nt, Artificial Sequence
  Description of Artificial Sequence: Synthetic oligonucleotide
uugaaacauuaucaguac

SEQ ID NO: 10844 - RNA, 18 nt, Artificial Sequence
  Description of Artificial Sequence: Synthetic oligonucleotide
uccuguugaaacauuauc

SEQ ID NO: 10845 - RNA, 18 nt, Artificial Sequence
  Description of Artificial Sequence: Synthetic oligonucleotide
cacuuuccuguugaaaca

SEQ ID NO: 10846 - RNA, 18 nt, Artificial Sequence
  Description of Artificial Sequence: Synthetic oligonucleotide
caaaacacuuuccuguug

SEQ ID NO: 10847 - RNA, 18 nt, Artificial Sequence
  Description of Artificial Sequence: Synthetic oligonucleotide
uuaaucaaaacacuuucc

SEQ ID NO: 10848 - RNA, 18 nt, Artificial Sequence
  Description of Artificial Sequence: Synthetic oligonucleotide
cacauuuaaucaaaacac

SEQ ID NO: 10849 - RNA, 18 nt, Artificial Sequence
  Description of Artificial Sequence: Synthetic oligonucleotide
cugcccacauuuaaucaa

SEQ ID NO: 10850 - RNA, 18 nt, Artificial Sequence
  Description of Artificial Sequence: Synthetic oligonucleotide
ugauacugcccacauuua

SEQ ID NO: 10851 - RNA, 18 nt, Artificial Sequence
  Description of Artificial Sequence: Synthetic oligonucleotide
aacagugauacugcccac

SEQ ID NO: 10852 - RNA, 18 nt, Artificial Sequence
  Description of Artificial Sequence: Synthetic oligonucleotide
aguagaacagugauacug

SEQ ID NO: 10853 - RNA, 18 nt, Artificial Sequence
  Description of Artificial Sequence: Synthetic oligonucleotide
augcuaguagaacaguga

SEQ ID NO: 10854 - RNA, 18 nt, Artificial Sequence
  Description of Artificial Sequence: Synthetic oligonucleotide
guugaaugcuaguagaac

SEQ ID NO: 10855 - RNA, 18 nt, Artificial Sequence
  Description of Artificial Sequence: Synthetic oligonucleotide
gagauguugaaugcuagu

SEQ ID NO: 10856 - RNA, 18 nt, Artificial Sequence
  Description of Artificial Sequence: Synthetic oligonucleotide
uagaagagauguugaaug

SEQ ID NO: 10857 - RNA, 18 nt, Artificial Sequence
  Description of Artificial Sequence: Synthetic oligonucleotide
auuuuuagaagagauguu

SEQ ID NO: 10858 - RNA, 18 nt, Artificial Sequence
  Description of Artificial Sequence: Synthetic oligonucleotide
gcagauagcuugagccca

SEQ ID NO: 10859 - RNA, 18 nt, Artificial Sequence
  Description of Artificial Sequence: Synthetic oligonucleotide
ggcacgcagauagcuuga

SEQ ID NO: 10860 - RNA, 18 nt, Artificial Sequence
  Description of Artificial Sequence: Synthetic oligonucleotide
gucaaggcacgcagauag

SEQ ID NO: 10861 - RNA, 18 nt, Artificial Sequence
  Description of Artificial Sequence: Synthetic oligonucleotide
gggaggucaaggcacgca

SEQ ID NO: 10862 - RNA, 18 nt, Artificial Sequence
  Description of Artificial Sequence: Synthetic oligonucleotide
acuuugggaggucaaggc

SEQ ID NO: 10863 - RNA, 18 nt, Artificial Sequence
  Description of Artificial Sequence: Synthetic oligonucleotide
cuagcacuuugggagguc

SEQ ID NO: 10864 - RNA, 18 nt, Artificial Sequence
  Description of Artificial Sequence: Synthetic oligonucleotide
uaauccuagcacuuuggg

SEQ ID NO: 10865 - RNA, 18 nt, Artificial Sequence
  Description of Artificial Sequence: Synthetic oligonucleotide
accuguaauccuagcacu

SEQ ID NO: 10866 - RNA, 18 nt, Artificial Sequence
  Description of Artificial Sequence: Synthetic oligonucleotide
cucacaccuguaauccua

SEQ ID NO: 10867 - RNA, 18 nt, Artificial Sequence
  Description of Artificial Sequence: Synthetic oligonucleotide
aguggcucacaccuguaa

SEQ ID NO: 10868 - RNA, 18 nt, Artificial Sequence
  Description of Artificial Sequence: Synthetic oligonucleotide
ggcauaguggcucacacc

SEQ ID NO: 10869 - RNA, 18 nt, Artificial Sequence
  Description of Artificial Sequence: Synthetic oligonucleotide
ggcuaggcauaguggcuc

SEQ ID NO: 10870 - RNA, 18 nt, Artificial Sequence
  Description of Artificial Sequence: Synthetic oligonucleotide
aguuaggcuaggcauagu

SEQ ID NO: 10871 - RNA, 18 nt, Artificial Sequence
  Description of Artificial Sequence: Synthetic oligonucleotide
gucugaguuaggcuaggc

SEQ ID NO: 10872 - RNA, 18 nt, Artificial Sequence
  Description of Artificial Sequence: Synthetic oligonucleotide
uuaaagucugaguuaggc

SEQ ID NO: 10873 - RNA, 18 nt, Artificial Sequence
  Description of Artificial Sequence: Synthetic oligonucleotide
uauuuuuaaagucugagu

SEQ ID NO: 10874 - RNA, 18 nt, Artificial Sequence
  Description of Artificial Sequence: Synthetic oligonucleotide
uuuuauauuuuuaaaguc

SEQ ID NO: 10875 - RNA, 18 nt, Artificial Sequence
  Description of Artificial Sequence: Synthetic oligonucleotide
auugcuuuuauauuuuua

SEQ ID NO: 10876 - RNA, 18 nt, Artificial Sequence
  Description of Artificial Sequence: Synthetic oligonucleotide
aaugaauugcuuuuauau

SEQ ID NO: 10877 - RNA, 18 nt, Artificial Sequence
  Description of Artificial Sequence: Synthetic oligonucleotide
auaaaaaugaauugcuuu

SEQ ID NO: 10878 - RNA, 18 nt, Artificial Sequence
  Description of Artificial Sequence: Synthetic oligonucleotide
ugggaauaaaaaugaauu

SEQ ID NO: 10879 - RNA, 18 nt, Artificial Sequence
  Description of Artificial Sequence: Synthetic oligonucleotide
guucuugggaauaaaaau

SEQ ID NO: 10880 - RNA, 18 nt, Artificial Sequence
  Description of Artificial Sequence: Synthetic oligonucleotide
uuacuguucuugggaaua

SEQ ID NO: 10881 - RNA, 18 nt, Artificial Sequence
  Description of Artificial Sequence: Synthetic oligonucleotide
ccaccuuacuguucuugg

SEQ ID NO: 10882 - RNA, 18 nt, Artificial Sequence
  Description of Artificial Sequence: Synthetic oligonucleotide
aaccaccaccuuacuguu

SEQ ID NO: 10883 - RNA, 18 nt, Artificial Sequence
  Description of Artificial Sequence: Synthetic oligonucleotide
aauuaaaccaccaccuua

SEQ ID NO: 10884 - RNA, 18 nt, Artificial Sequence
  Description of Artificial Sequence: Synthetic oligonucleotide
acuaaaauuaaaccacca

SEQ ID NO: 10885 - RNA, 18 nt, Artificial Sequence
  Description of Artificial Sequence: Synthetic oligonucleotide
uaaagacuaaaauuaaac

SEQ ID NO: 10886 - RNA, 18 nt, Artificial Sequence
  Description of Artificial Sequence: Synthetic oligonucleotide
agaauuaaagacuaaaau

SEQ ID NO: 10887 - RNA, 18 nt, Artificial Sequence
  Description of Artificial Sequence: Synthetic oligonucleotide
aaaacagaauuaaagacu

SEQ ID NO: 10888 - RNA, 18 nt, Artificial Sequence
  Description of Artificial Sequence: Synthetic oligonucleotide
aauuaaaaacagaauuaa

SEQ ID NO: 10889 - RNA, 18 nt, Artificial Sequence
  Description of Artificial Sequence: Synthetic oligonucleotide
gaauaaauuaaaaacaga

SEQ ID NO: 10890 - RNA, 18 nt, Artificial Sequence
  Description of Artificial Sequence: Synthetic oligonucleotide
aaauagaauaaauuaaaa

SEQ ID NO: 10891 - RNA, 18 nt, Artificial Sequence
  Description of Artificial Sequence: Synthetic oligonucleotide
uuucuaaauagaauaaau

SEQ ID NO: 10892 - RNA, 18 nt, Artificial Sequence
  Description of Artificial Sequence: Synthetic oligonucleotide
ggacauuucuaaauagaa

SEQ ID NO: 10893 - RNA, 18 nt, Artificial Sequence
  Description of Artificial Sequence: Synthetic oligonucleotide
uucugggacauuucuaaa

SEQ ID NO: 10894 - RNA, 18 nt, Artificial Sequence
  Description of Artificial Sequence: Synthetic oligonucleotide
uaaguuucugggacauuu

SEQ ID NO: 10895 - RNA, 18 nt, Artificial Sequence
  Description of Artificial Sequence: Synthetic oligonucleotide
uauacuaaguuucuggga

SEQ ID NO: 10896 - RNA, 18 nt, Artificial Sequence
  Description of Artificial Sequence: Synthetic oligonucleotide
aaaguuauacuaaguuuc

SEQ ID NO: 10897 - RNA, 18 nt, Artificial Sequence
  Description of Artificial Sequence: Synthetic oligonucleotide
aaaguaaaguuauacuaa

SEQ ID NO: 10898 - RNA, 18 nt, Artificial Sequence
  Description of Artificial Sequence: Synthetic oligonucleotide
uucagaaaguaaaguuau

SEQ ID NO: 10899 - RNA, 18 nt, Artificial Sequence
  Description of Artificial Sequence: Synthetic oligonucleotide
ucauuuucagaaaguaaa

SEQ ID NO: 10900 - RNA, 18 nt, Artificial Sequence
  Description of Artificial Sequence: Synthetic oligonucleotide
uuucuucauuuucagaaa

SEQ ID NO: 10901 - RNA, 18 nt, Artificial Sequence
  Description of Artificial Sequence: Synthetic oligonucleotide
acagguuucuucauuuuc

SEQ ID NO: 10902 - RNA, 18 nt, Artificial Sequence
  Description of Artificial Sequence: Synthetic oligonucleotide
caaggacagguuucuuca

SEQ ID NO: 10903 - RNA, 18 nt, Artificial Sequence
  Description of Artificial Sequence: Synthetic oligonucleotide
augcccaaggacagguuu

SEQ ID NO: 10904 - RNA, 18 nt, Artificial Sequence
  Description of Artificial Sequence: Synthetic oligonucleotide
cacuaaugcccaaggaca

SEQ ID NO: 10905 - RNA, 18 nt, Artificial Sequence
  Description of Artificial Sequence: Synthetic oligonucleotide
caacacacuaaugcccaa

SEQ ID NO: 10906 - RNA, 18 nt, Artificial Sequence
  Description of Artificial Sequence: Synthetic oligonucleotide
aaauccaacacacuaaug

SEQ ID NO: 10907 - RNA, 18 nt, Artificial Sequence
  Description of Artificial Sequence: Synthetic oligonucleotide
ugcuuaaauccaacacac

SEQ ID NO: 10908 - RNA, 18 nt, Artificial Sequence
  Description of Artificial Sequence: Synthetic oligonucleotide
uuuguugcuuaaauccaa

SEQ ID NO: 10909 - RNA, 18 nt, Artificial Sequence
  Description of Artificial Sequence: Synthetic oligonucleotide
uuaacuuuguugcuuaaa

SEQ ID NO: 10910 - RNA, 18 nt, Artificial Sequence
  Description of Artificial Sequence: Synthetic oligonucleotide
uuuuuuuaacuuuguugc

SEQ ID NO: 10911 - RNA, 18 nt, Artificial Sequence
  Description of Artificial Sequence: Synthetic oligonucleotide
guagguuuuuuuaacuuu

SEQ ID NO: 10912 - RNA, 18 nt, Artificial Sequence
  Description of Artificial Sequence: Synthetic oligonucleotide
acaggguagguuuuuuua

SEQ ID NO: 10913 - RNA, 18 nt, Artificial Sequence
  Description of Artificial Sequence: Synthetic oligonucleotide
auaacacaggguagguuu

SEQ ID NO: 10914 - RNA, 18 nt, Artificial Sequence
  Description of Artificial Sequence: Synthetic oligonucleotide
uugccauaacacagggua

SEQ ID NO: 10915 - RNA, 18 nt, Artificial Sequence
  Description of Artificial Sequence: Synthetic oligonucleotide
gaaaauugccauaacaca

SEQ ID NO: 10916 - RNA, 18 nt, Artificial Sequence
  Description of Artificial Sequence: Synthetic oligonucleotide
caagugaaaauugccaua

SEQ ID NO: 10917 - RNA, 18 nt, Artificial Sequence
  Description of Artificial Sequence: Synthetic oligonucleotide
accaucaagugaaaauug

SEQ ID NO: 10918 - RNA, 18 nt, Artificial Sequence
  Description of Artificial Sequence: Synthetic oligonucleotide
gaaccaccaucaagugaa

SEQ ID NO: 10919 - RNA, 18 nt, Artificial Sequence
  Description of Artificial Sequence: Synthetic oligonucleotide
uuauagaaccaccaucaa

SEQ ID NO: 10920 - RNA, 18 nt, Artificial Sequence
  Description of Artificial Sequence: Synthetic oligonucleotide
cuguguuauagaaccacc

SEQ ID NO: 10921 - RNA, 18 nt, Artificial Sequence
  Description of Artificial Sequence: Synthetic oligonucleotide
gauaccuguguuauagaa

SEQ ID NO: 10922 - RNA, 18 nt, Artificial Sequence
  Description of Artificial Sequence: Synthetic oligonucleotide
ucacugauaccuguguua

SEQ ID NO: 10923 - RNA, 18 nt, Artificial Sequence
  Description of Artificial Sequence: Synthetic oligonucleotide
aagguucacugauaccug

SEQ ID NO: 10924 - RNA, 18 nt, Artificial Sequence
  Description of Artificial Sequence: Synthetic oligonucleotide
uuauaaagguucacugau

SEQ ID NO: 10925 - RNA, 18 nt, Artificial Sequence
  Description of Artificial Sequence: Synthetic oligonucleotide
aucuuuuauaaagguuca

SEQ ID NO: 10926 - RNA, 18 nt, Artificial Sequence
  Description of Artificial Sequence: Synthetic oligonucleotide
uguucaucuuuuauaaag

SEQ ID NO: 10927 - RNA, 18 nt, Artificial Sequence
  Description of Artificial Sequence: Synthetic oligonucleotide
aaaguuguucaucuuuua

SEQ ID NO: 10928 - RNA, 18 nt, Artificial Sequence
  Description of Artificial Sequence: Synthetic oligonucleotide
gcugaaaaguuguucauc

SEQ ID NO: 10929 - RNA, 18 nt, Artificial Sequence
  Description of Artificial Sequence: Synthetic oligonucleotide
agcaagcugaaaaguugu

SEQ ID NO: 10930 - RNA, 18 nt, Artificial Sequence
  Description of Artificial Sequence: Synthetic oligonucleotide
aauuaagcaagcugaaaa

SEQ ID NO: 10931 - RNA, 18 nt, Artificial Sequence
  Description of Artificial Sequence: Synthetic oligonucleotide
acugaaauuaagcaagcu

SEQ ID NO: 10932 - RNA, 18 nt, Artificial Sequence
  Description of Artificial Sequence: Synthetic oligonucleotide
aauuaacugaaauuaagc

SEQ ID NO: 10933 - RNA, 18 nt, Artificial Sequence
  Description of Artificial Sequence: Synthetic oligonucleotide
auguuaauuaacugaaau

SEQ ID NO: 10934 - RNA, 18 nt, Artificial Sequence
  Description of Artificial Sequence: Synthetic oligonucleotide
uauacauguuaauuaacu

SEQ ID NO: 10935 - RNA, 18 nt, Artificial Sequence
  Description of Artificial Sequence: Synthetic oligonucleotide
auaaguauacauguuaau

SEQ ID NO: 10936 - RNA, 18 nt, Artificial Sequence
  Description of Artificial Sequence: Synthetic oligonucleotide
cauagauaaguauacaug

SEQ ID NO: 10937 - RNA, 18 nt, Artificial Sequence
  Description of Artificial Sequence: Synthetic oligonucleotide
auuaacauagauaaguau

SEQ ID NO: 10938 - RNA, 18 nt, Artificial Sequence
  Description of Artificial Sequence: Synthetic oligonucleotide
aaaacauuaacauagaua

SEQ ID NO: 10939 - RNA, 18 nt, Artificial Sequence
  Description of Artificial Sequence: Synthetic oligonucleotide
gcaauaaaacauuaacau

SEQ ID NO: 10940 - RNA, 18 nt, Artificial Sequence
  Description of Artificial Sequence: Synthetic oligonucleotide
uuuaagcaauaaaacauu

SEQ ID NO: 10941 - RNA, 18 nt, Artificial Sequence
  Description of Artificial Sequence: Synthetic oligonucleotide
aacauuuuaagcaauaaa

SEQ ID NO: 10942 - RNA, 18 nt, Artificial Sequence
  Description of Artificial Sequence: Synthetic oligonucleotide
aauuaaacauuuuaagca

SEQ ID NO: 10943 - RNA, 18 nt, Artificial Sequence
  Description of Artificial Sequence: Synthetic oligonucleotide
auaaaaauuaaacauuuu

SEQ ID NO: 10944 - RNA, 18 nt, Artificial Sequence
  Description of Artificial Sequence: Synthetic oligonucleotide
caaauauaaaaauuaaac

SEQ ID NO: 10945 - RNA, 18 nt, Artificial Sequence
  Description of Artificial Sequence: Synthetic oligonucleotide
uuuaccaaauauaaaaau

SEQ ID NO: 10946 - RNA, 18 nt, Artificial Sequence
  Description of Artificial Sequence: Synthetic oligonucleotide
aucuguuuaccaaauaua

SEQ ID NO: 10947 - RNA, 18 nt, Artificial Sequence
  Description of Artificial Sequence: Synthetic oligonucleotide
aaacuaucuguuuaccaa

SEQ ID NO: 10948 - RNA, 18 nt, Artificial Sequence
  Description of Artificial Sequence: Synthetic oligonucleotide
agaaaaaacuaucuguuu

SEQ ID NO: 10949 - RNA, 18 nt, Artificial Sequence
  Description of Artificial Sequence: Synthetic oligonucleotide
gggagagaaaaaacuauc

SEQ ID NO: 10950 - RNA, 18 nt, Artificial Sequence
  Description of Artificial Sequence: Synthetic oligonucleotide
aagauggaaggaagaggg

SEQ ID NO: 10951 - RNA, 18 nt, Artificial Sequence
  Description of Artificial Sequence: Synthetic oligonucleotide
augaaagauggaaggaag

SEQ ID NO: 10952 - RNA, 18 nt, Artificial Sequence
  Description of Artificial Sequence: Synthetic oligonucleotide
uaguaaugaaagauggaa

SEQ ID NO: 10953 - RNA, 18 nt, Artificial Sequence
  Description of Artificial Sequence: Synthetic oligonucleotide
cagagagacauugugagc

SEQ ID NO: 10954 - RNA, 18 nt, Artificial Sequence
  Description of Artificial Sequence: Synthetic oligonucleotide
uggugcagagagacauug

SEQ ID NO: 10955 - RNA, 18 nt, Artificial Sequence
  Description of Artificial Sequence: Synthetic oligonucleotide
gagcuuggugcagagaga

SEQ ID NO: 10956 - RNA, 18 nt, Artificial Sequence
  Description of Artificial Sequence: Synthetic oligonucleotide
ucauggagcuuggugcag

SEQ ID NO: 10957 - RNA, 18 nt, Artificial Sequence
  Description of Artificial Sequence: Synthetic oligonucleotide
cugagucauggagcuugg

SEQ ID NO: 10958 - RNA, 18 nt, Artificial Sequence
  Description of Artificial Sequence: Synthetic oligonucleotide
aaauccugagucauggag

SEQ ID NO: 10959 - RNA, 18 nt, Artificial Sequence
  Description of Artificial Sequence: Synthetic oligonucleotide
caggcaaauccugaguca

SEQ ID NO: 10960 - RNA, 18 nt, Artificial Sequence
  Description of Artificial Sequence: Synthetic oligonucleotide
aacuccaggcaaauccug

SEQ ID NO: 10961 - RNA, 18 nt, Artificial Sequence
  Description of Artificial Sequence: Synthetic oligonucleotide
ccaggaacuccaggcaaa

SEQ ID NO: 10962 - RNA, 18 nt, Artificial Sequence
  Description of Artificial Sequence: Synthetic oligonucleotide
cuuucccaggaacuccag

SEQ ID NO: 10963 - RNA, 18 nt, Artificial Sequence
  Description of Artificial Sequence: Synthetic oligonucleotide
cuggucuuucccaggaac

SEQ ID NO: 10964 - RNA, 18 nt, Artificial Sequence
  Description of Artificial Sequence: Synthetic oligonucleotide
aacaacuggucuuuccca

SEQ ID NO: 10965 - RNA, 18 nt, Artificial Sequence
  Description of Artificial Sequence: Synthetic oligonucleotide
gugaaaacaacuggucuu

SEQ ID NO: 10966 - RNA, 18 nt, Artificial Sequence
  Description of Artificial Sequence: Synthetic oligonucleotide
aggcugugaaaacaacug

SEQ ID NO: 10967 - RNA, 18 nt, Artificial Sequence
  Description of Artificial Sequence: Synthetic oligonucleotide
acuggaggcugugaaaac

SEQ ID NO: 10968 - RNA, 18 nt, Artificial Sequence
  Description of Artificial Sequence: Synthetic oligonucleotide
uuaacacuggaggcugug

SEQ ID NO: 10969 - RNA, 18 nt, Artificial Sequence
  Description of Artificial Sequence: Synthetic oligonucleotide
uguccuuaacacuggagg

SEQ ID NO: 10970 - RNA, 18 nt, Artificial Sequence
  Description of Artificial Sequence: Synthetic oligonucleotide
gaagcuguccuuaacacu

SEQ ID NO: 10971 - RNA, 18 nt, Artificial Sequence
  Description of Artificial Sequence: Synthetic oligonucleotide
cuugugaagcuguccuua

SEQ ID NO: 10972 - RNA, 18 nt, Artificial Sequence
  Description of Artificial Sequence: Synthetic oligonucleotide
acccucuugugaagcugu

SEQ ID NO: 10973 - RNA, 18 nt, Artificial Sequence
  Description of Artificial Sequence: Synthetic oligonucleotide
uggcaacccucuugugaa

SEQ ID NO: 10974 - RNA, 18 nt, Artificial Sequence
  Description of Artificial Sequence: Synthetic oligonucleotide
guucuuggcaacccucuu

SEQ ID NO: 10975 - RNA, 18 nt, Artificial Sequence
  Description of Artificial Sequence: Synthetic oligonucleotide
uguaaguucuuggcaacc

SEQ ID NO: 10976 - RNA, 18 nt, Artificial Sequence
  Description of Artificial Sequence: Synthetic oligonucleotide
ucuuguguaaguucuugg

SEQ ID NO: 10977 - RNA, 18 nt, Artificial Sequence
  Description of Artificial Sequence: Synthetic oligonucleotide
uuuguucuuguguaaguu

SEQ ID NO: 10978 - RNA, 18 nt, Artificial Sequence
  Description of Artificial Sequence: Synthetic oligonucleotide
aucucuuuguucuugugu

SEQ ID NO: 10979 - RNA, 18 nt, Artificial Sequence
  Description of Artificial Sequence: Synthetic oligonucleotide
aguugaucucuuuguucu

SEQ ID NO: 10980 - RNA, 18 nt, Artificial Sequence
  Description of Artificial Sequence: Synthetic oligonucleotide
cccucaguugaucucuuu

SEQ ID NO: 10981 - RNA, 18 nt, Artificial Sequence
  Description of Artificial Sequence: Synthetic oligonucleotide
aucugcccucaguugauc

SEQ ID NO: 10982 - RNA, 18 nt, Artificial Sequence
  Description of Artificial Sequence: Synthetic oligonucleotide
cugauaucugcccucagu

SEQ ID NO: 10983 - RNA, 18 nt, Artificial Sequence
  Description of Artificial Sequence: Synthetic oligonucleotide
uaauacugauaucugccc

SEQ ID NO: 10984 - RNA, 18 nt, Artificial Sequence
  Description of Artificial Sequence: Synthetic oligonucleotide
uuugauaauacugauauc

SEQ ID NO: 10985 - RNA, 18 nt, Artificial Sequence
  Description of Artificial Sequence: Synthetic oligonucleotide
cugccuuugauaauacug

SEQ ID NO: 10986 - RNA, 18 nt, Artificial Sequence
  Description of Artificial Sequence: Synthetic oligonucleotide
gguaucugccuuugauaa

SEQ ID NO: 10987 - RNA, 18 nt, Artificial Sequence
  Description of Artificial Sequence: Synthetic oligonucleotide
gcuccgguaucugccuuu

SEQ ID NO: 10988 - RNA, 18 nt, Artificial Sequence
  Description of Artificial Sequence: Synthetic oligonucleotide
cuuuggcuccgguaucug

SEQ ID NO: 10989 - RNA, 18 nt, Artificial Sequence
  Description of Artificial Sequence: Synthetic oligonucleotide
acagaauuucacaucuuu

SEQ ID NO: 10990 - RNA, 18 nt, Artificial Sequence
  Description of Artificial Sequence: Synthetic oligonucleotide
auuacacagaauuucaca

SEQ ID NO: 10991 - RNA, 18 nt, Artificial Sequence
  Description of Artificial Sequence: Synthetic oligonucleotide
auuacauuacacagaauu

SEQ ID NO: 10992 - RNA, 18 nt, Artificial Sequence
  Description of Artificial Sequence: Synthetic oligonucleotide
uuuuuauuacauuacaca

SEQ ID NO: 10993 - RNA, 18 nt, Artificial Sequence
  Description of Artificial Sequence: Synthetic oligonucleotide
uuuauuuuuuauuacauu

SEQ ID NO: 10994 - RNA, 18 nt, Artificial Sequence
  Description of Artificial Sequence: Synthetic oligonucleotide
uccaauuuauuuuuuauu

SEQ ID NO: 10995 - RNA, 18 nt, Artificial Sequence
  Description of Artificial Sequence: Synthetic oligonucleotide
cacaguccaauuuauuuu

SEQ ID NO: 10996 - RNA, 18 nt, Artificial Sequence
  Description of Artificial Sequence: Synthetic oligonucleotide
uauaucacaguccaauuu

SEQ ID NO: 10997 - RNA, 18 nt, Artificial Sequence
  Description of Artificial Sequence: Synthetic oligonucleotide
uuguuuauaucacagucc

SEQ ID NO: 10998 - RNA, 18 nt, Artificial Sequence
  Description of Artificial Sequence: Synthetic oligonucleotide
ugaacuuguuuauaucac

SEQ ID NO: 10999 - RNA, 18 nt, Artificial Sequence
  Description of Artificial Sequence: Synthetic oligonucleotide
aucggugaacuuguuuau

SEQ ID NO: 11000 - RNA, 18 nt, Artificial Sequence
  Description of Artificial Sequence: Synthetic oligonucleotide
ucaagaucggugaacuug

SEQ ID NO: 11001 - RNA, 18 nt, Artificial Sequence
  Description of Artificial Sequence: Synthetic oligonucleotide
gcaggucaagaucgguga

SEQ ID NO: 11002 - RNA, 18 nt, Artificial Sequence
  Description of Artificial Sequence: Synthetic oligonucleotide
augcugcaggucaagauc

SEQ ID NO: 11003 - RNA, 18 nt, Artificial Sequence
  Description of Artificial Sequence: Synthetic oligonucleotide
gcuacaugcugcagguca

SEQ ID NO: 11004 - RNA, 18 nt, Artificial Sequence
  Description of Artificial Sequence: Synthetic oligonucleotide
cuuuagcuacaugcugca

SEQ ID NO: 11005 - RNA, 18 nt, Artificial Sequence
  Description of Artificial Sequence: Synthetic oligonucleotide
aguuucuuuagcuacaug

SEQ ID NO: 11006 - RNA, 18 nt, Artificial Sequence
  Description of Artificial Sequence: Synthetic oligonucleotide
ccgccaguuucuuuagcu

SEQ ID NO: 11007 - RNA, 18 nt, Artificial Sequence
  Description of Artificial Sequence: Synthetic oligonucleotide
caaacccgccaguuucuu

SEQ ID NO: 11008 - RNA, 18 nt, Artificial Sequence
  Description of Artificial Sequence: Synthetic oligonucleotide
agccacaaacccgccagu

SEQ ID NO: 11009 - RNA, 18 nt, Artificial Sequence
  Description of Artificial Sequence: Synthetic oligonucleotide
ucucuagccacaaacccg

SEQ ID NO: 11010 - RNA, 18 nt, Artificial Sequence
  Description of Artificial Sequence: Synthetic oligonucleotide
uaaaaucucuagccacaa

SEQ ID NO: 11011 - RNA, 18 nt, Artificial Sequence
  Description of Artificial Sequence: Synthetic oligonucleotide
uacuguaaaaucucuagc

SEQ ID NO: 11012 - RNA, 18 nt, Artificial Sequence
  Description of Artificial Sequence: Synthetic oligonucleotide
acaaguacuguaaaaucu

SEQ ID NO: 11013 - RNA, 18 nt, Artificial Sequence
  Description of Artificial Sequence: Synthetic oligonucleotide
gauccacaaguacuguaa

SEQ ID NO: 11014 - RNA, 18 nt, Artificial Sequence
  Description of Artificial Sequence: Synthetic oligonucleotide
ggcucgauccacaaguac

SEQ ID NO: 11015 - RNA, 18 nt, Artificial Sequence
  Description of Artificial Sequence: Synthetic oligonucleotide
uguauggcucgauccaca

SEQ ID NO: 11016 - RNA, 18 nt, Artificial Sequence
  Description of Artificial Sequence: Synthetic oligonucleotide
gagaauguauggcucgau

SEQ ID NO: 11017 - RNA, 18 nt, Artificial Sequence
  Description of Artificial Sequence: Synthetic oligonucleotide
gagucgagaauguauggc

SEQ ID NO: 11018 - RNA, 18 nt, Artificial Sequence
  Description of Artificial Sequence: Synthetic oligonucleotide
cgagagagucgagaaugu

SEQ ID NO: 11019 - RNA, 18 nt, Artificial Sequence
  Description of Artificial Sequence: Synthetic oligonucleotide
ucugacgagagagucgag

SEQ ID NO: 11020 - RNA, 18 nt, Artificial Sequence
  Description of Artificial Sequence: Synthetic oligonucleotide
uauacucugacgagagag

SEQ ID NO: 11021 - RNA, 18 nt, Artificial Sequence
  Description of Artificial Sequence: Synthetic oligonucleotide
guggauauacucugacga

SEQ ID NO: 11022 - RNA, 18 nt, Artificial Sequence
  Description of Artificial Sequence: Synthetic oligonucleotide
cucugguggauauacucu

SEQ ID NO: 11023 - RNA, 18 nt, Artificial Sequence
  Description of Artificial Sequence: Synthetic oligonucleotide
cagguuuuaauaguaaaa

SEQ ID NO: 11024 - RNA, 18 nt, Artificial Sequence
  Description of Artificial Sequence: Synthetic oligonucleotide
aaguucagguuuuaauag

SEQ ID NO: 11025 - RNA, 18 nt, Artificial Sequence
  Description of Artificial Sequence: Synthetic oligonucleotide
auuccaaguucagguuuu

SEQ ID NO: 11026 - RNA, 18 nt, Artificial Sequence
  Description of Artificial Sequence: Synthetic oligonucleotide
agaagauuccaaguucag

SEQ ID NO: 11027 - RNA, 18 nt, Artificial Sequence
  Description of Artificial Sequence: Synthetic oligonucleotide
uagaaagaagauuccaag

SEQ ID NO: 11028 - RNA, 18 nt, Artificial Sequence
  Description of Artificial Sequence: Synthetic oligonucleotide
cacaauagaaagaagauu

SEQ ID NO: 11029 - RNA, 18 nt, Artificial Sequence
  Description of Artificial Sequence: Synthetic oligonucleotide
uucuccacaauagaaaga

SEQ ID NO: 11030 - RNA, 18 nt, Artificial Sequence
  Description of Artificial Sequence: Synthetic oligonucleotide
uacauuucuccacaauag

SEQ ID NO: 11031 - RNA, 18 nt, Artificial Sequence
  Description of Artificial Sequence: Synthetic oligonucleotide
acaauuacauuucuccac

SEQ ID NO: 11032 - RNA, 18 nt, Artificial Sequence
  Description of Artificial Sequence: Synthetic oligonucleotide
uuacuacaauuacauuuc

SEQ ID NO: 11033 - RNA, 18 nt, Artificial Sequence
  Description of Artificial Sequence: Synthetic oligonucleotide
uugucuuacuacaauuac

SEQ ID NO: 11034 - RNA, 18 nt, Artificial Sequence
  Description of Artificial Sequence: Synthetic oligonucleotide
aauucuugucuuacuaca

SEQ ID NO: 11035 - RNA, 18 nt, Artificial Sequence
  Description of Artificial Sequence: Synthetic oligonucleotide
uauuuaauucuugucuua

SEQ ID NO: 11036 - RNA, 18 nt, Artificial Sequence
  Description of Artificial Sequence: Synthetic oligonucleotide
gaauauauuuaauucuug

SEQ ID NO: 11037 - RNA, 18 nt, Artificial Sequence
  Description of Artificial Sequence: Synthetic oligonucleotide
caauggaauauauuuaau

SEQ ID NO: 11038 - RNA, 18 nt, Artificial Sequence
  Description of Artificial Sequence: Synthetic oligonucleotide
uacuacaauggaauauau

SEQ ID NO: 11039 - RNA, 18 nt, Artificial Sequence
  Description of Artificial Sequence: Synthetic oligonucleotide
ucaaauacuacaauggaa

SEQ ID NO: 11040 - RNA, 18 nt, Artificial Sequence
  Description of Artificial Sequence: Synthetic oligonucleotide
cuuauucaaauacuacaa

SEQ ID NO: 11041 - RNA, 18 nt, Artificial Sequence
  Description of Artificial Sequence: Synthetic oligonucleotide
aacugcuuauucaaauac

SEQ ID NO: 11042 - RNA, 18 nt, Artificial Sequence
  Description of Artificial Sequence: Synthetic oligonucleotide
caaauaacugcuuauuca

SEQ ID NO: 11043 - RNA, 18 nt, Artificial Sequence
  Description of Artificial Sequence: Synthetic oligonucleotide
cuacucaaauaacugcuu

SEQ ID NO: 11044 - RNA, 18 nt, Artificial Sequence
  Description of Artificial Sequence: Synthetic oligonucleotide
auuuucuacucaaauaac

SEQ ID NO: 11045 - RNA, 18 nt, Artificial Sequence
  Description of Artificial Sequence: Synthetic oligonucleotide
cacuaauuuucuacucaa

SEQ ID NO: 11046 - RNA, 18 nt, Artificial Sequence
  Description of Artificial Sequence: Synthetic oligonucleotide
ggaaacacuaauuuucua

SEQ ID NO: 11047 - RNA, 18 nt, Artificial Sequence
  Description of Artificial Sequence: Synthetic oligonucleotide
cuacaauggaauauauuu

SEQ ID NO: 11048 - RNA, 18 nt, Artificial Sequence
  Description of Artificial Sequence: Synthetic oligonucleotide
aaauacuacaauggaaua

SEQ ID NO: 11049 - RNA, 18 nt, Artificial Sequence
  Description of Artificial Sequence: Synthetic oligonucleotide
uauucaaauacuacaaug

SEQ ID NO: 11050 - RNA, 18 nt, Artificial Sequence
  Description of Artificial Sequence: Synthetic oligonucleotide
cugcuuauucaaauacua

SEQ ID NO: 11051 - RNA, 18 nt, Artificial Sequence
  Description of Artificial Sequence: Synthetic oligonucleotide
aauaacugcuuauucaaa

SEQ ID NO: 11052 - RNA, 18 nt, Artificial Sequence
  Description of Artificial Sequence: Synthetic oligonucleotide
acucaaauaacugcuuau

SEQ ID NO: 11053 - RNA, 18 nt, Artificial Sequence
  Description of Artificial Sequence: Synthetic oligonucleotide
uuucuacucaaauaacug

SEQ ID NO: 11054 - RNA, 18 nt, Artificial Sequence
  Description of Artificial Sequence: Synthetic oligonucleotide
cuaauuuucuacucaaau

SEQ ID NO: 11055 - RNA, 18 nt, Artificial Sequence
  Description of Artificial Sequence: Synthetic oligonucleotide
aaacacuaauuuucuacu

SEQ ID NO: 11056 - RNA, 18 nt, Artificial Sequence
  Description of Artificial Sequence: Synthetic oligonucleotide
gcuggaaacacuaauuuu

SEQ ID NO: 11057 - RNA, 18 nt, Artificial Sequence
  Description of Artificial Sequence: Synthetic oligonucleotide
ucuuagcuggaaacacua

SEQ ID NO: 11058 - RNA, 18 nt, Artificial Sequence
  Description of Artificial Sequence: Synthetic oligonucleotide
caucaucuuagcuggaaa

SEQ ID NO: 11059 - RNA, 18 nt, Artificial Sequence
  Description of Artificial Sequence: Synthetic oligonucleotide
uaugccaucaucuuagcu

SEQ ID NO: 11060 - RNA, 18 nt, Artificial Sequence
  Description of Artificial Sequence: Synthetic oligonucleotide
caaaauaugccaucaucu

SEQ ID NO: 11061 - RNA, 18 nt, Artificial Sequence
  Description of Artificial Sequence: Synthetic oligonucleotide
auuuucaaaauaugccau

SEQ ID NO: 11062 - RNA, 18 nt, Artificial Sequence
  Description of Artificial Sequence: Synthetic oligonucleotide
uaugaauuuucaaaauau

SEQ ID NO: 11063 - RNA, 18 nt, Artificial Sequence
  Description of Artificial Sequence: Synthetic oligonucleotide
cacuauaugaauuuucaa

SEQ ID NO: 11064 - RNA, 18 nt, Artificial Sequence
  Description of Artificial Sequence: Synthetic oligonucleotide
auauucacuauaugaauu

SEQ ID NO: 11065 - RNA, 18 nt, Artificial Sequence
  Description of Artificial Sequence: Synthetic oligonucleotide
uaguuauauucacuauau

SEQ ID NO: 11066 - RNA, 18 nt, Artificial Sequence
  Description of Artificial Sequence: Synthetic oligonucleotide
uuuacuaguuauauucac

SEQ ID NO: 11067 - RNA, 18 nt, Artificial Sequence
  Description of Artificial Sequence: Synthetic oligonucleotide
cuucuuuuacuaguuaua

SEQ ID NO: 11068 - RNA, 18 nt, Artificial Sequence
  Description of Artificial Sequence: Synthetic oligonucleotide
caaaacuucuuuuacuag

SEQ ID NO: 11069 - RNA, 18 nt, Artificial Sequence
  Description of Artificial Sequence: Synthetic oligonucleotide
aauguuguuaaaacuaau

SEQ ID NO: 11070 - RNA, 18 nt, Artificial Sequence
  Description of Artificial Sequence: Synthetic oligonucleotide
aguccaauguuguuaaaa

SEQ ID NO: 11071 - RNA, 18 nt, Artificial Sequence
  Description of Artificial Sequence: Synthetic oligonucleotide
uuggaaguccaauguugu

SEQ ID NO: 11072 - RNA, 18 nt, Artificial Sequence
  Description of Artificial Sequence: Synthetic oligonucleotide
gccuuuuggaaguccaau

SEQ ID NO: 11073 - RNA, 18 nt, Artificial Sequence
  Description of Artificial Sequence: Synthetic oligonucleotide
ggagagccuuuuggaagu

SEQ ID NO: 11074 - RNA, 18 nt, Artificial Sequence
  Description of Artificial Sequence: Synthetic oligonucleotide
uccgcggagagccuuuug

SEQ ID NO: 11075 - RNA, 18 nt, Artificial Sequence
  Description of Artificial Sequence: Synthetic oligonucleotide
agaaauccgcggagagcc

SEQ ID NO: 11076 - RNA, 18 nt, Artificial Sequence
  Description of Artificial Sequence: Synthetic oligonucleotide
caggaagaaauccgcgga

SEQ ID NO: 11077 - RNA, 18 nt, Artificial Sequence
  Description of Artificial Sequence: Synthetic oligonucleotide
agacgcaggaagaaaucc

SEQ ID NO: 11078 - RNA, 18 nt, Artificial Sequence
  Description of Artificial Sequence: Synthetic oligonucleotide
cgcaaagacgcaggaaga

SEQ ID NO: 11079 - RNA, 18 nt, Artificial Sequence
  Description of Artificial Sequence: Synthetic oligonucleotide
cacuucgcaaagacgcag

SEQ ID NO: 11080 - RNA, 18 nt, Artificial Sequence
  Description of Artificial Sequence: Synthetic oligonucleotide
guugacacuucgcaaaga

SEQ ID NO: 11081 - RNA, 18 nt, Artificial Sequence
  Description of Artificial Sequence: Synthetic oligonucleotide
ugcagguugacacuucgc

SEQ ID NO: 11082 - RNA, 18 nt, Artificial Sequence
  Description of Artificial Sequence: Synthetic oligonucleotide
guuuaugcagguugacac

SEQ ID NO: 11083 - RNA, 18 nt, Artificial Sequence
  Description of Artificial Sequence: Synthetic oligonucleotide
ucuagguuuaugcagguu

SEQ ID NO: 11084 - RNA, 18 nt, Artificial Sequence
  Description of Artificial Sequence: Synthetic oligonucleotide
aggucucuagguuuaugc

SEQ ID NO: 11085 - RNA, 18 nt, Artificial Sequence
  Description of Artificial Sequence: Synthetic oligonucleotide
aacccaggucucuagguu

SEQ ID NO: 11086 - RNA, 18 nt, Artificial Sequence
  Description of Artificial Sequence: Synthetic oligonucleotide
gucccaacccaggucucu

SEQ ID NO: 11087 - RNA, 18 nt, Artificial Sequence
  Description of Artificial Sequence: Synthetic oligonucleotide
aucuugucccaacccagg

SEQ ID NO: 11088 - RNA, 18 nt, Artificial Sequence
  Description of Artificial Sequence: Synthetic oligonucleotide
caccaaucuugucccaac

SEQ ID NO: 11089 - RNA, 18 nt, Artificial Sequence
  Description of Artificial Sequence: Synthetic oligonucleotide
uaacccaccaaucuuguc

SEQ ID NO: 11090 - RNA, 18 nt, Artificial Sequence
  Description of Artificial Sequence: Synthetic oligonucleotide
ucauguaacccaccaauc

SEQ ID NO: 11091 - RNA, 18 nt, Artificial Sequence
  Description of Artificial Sequence: Synthetic oligonucleotide
uaacuucauguaacccac

SEQ ID NO: 11092 - RNA, 18 nt, Artificial Sequence
  Description of Artificial Sequence: Synthetic oligonucleotide
cugccuaacuucauguaa

SEQ ID NO: 11093 - RNA, 18 nt, Artificial Sequence
  Description of Artificial Sequence: Synthetic oligonucleotide
aguaucugccuaacuuca

SEQ ID NO: 11094 - RNA, 18 nt, Artificial Sequence
  Description of Artificial Sequence: Synthetic oligonucleotide
ccaugaguaucugccuaa

SEQ ID NO: 11095 - RNA, 18 nt, Artificial Sequence
  Description of Artificial Sequence: Synthetic oligonucleotide
aguauccaugaguaucug

SEQ ID NO: 11096 - RNA, 18 nt, Artificial Sequence
  Description of Artificial Sequence: Synthetic oligonucleotide
uggauaguauccaugagu

SEQ ID NO: 11097 - RNA, 18 nt, Artificial Sequence
  Description of Artificial Sequence: Synthetic oligonucleotide
guaacuggauaguaucca

SEQ ID NO: 11098 - RNA, 18 nt, Artificial Sequence
  Description of Artificial Sequence: Synthetic oligonucleotide
ggcagguaacuggauagu

SEQ ID NO: 11099 - RNA, 18 nt, Artificial Sequence
  Description of Artificial Sequence: Synthetic oligonucleotide
cgccuaaggaauucacuc

SEQ ID NO: 11100 - RNA, 18 nt, Artificial Sequence
  Description of Artificial Sequence: Synthetic oligonucleotide
ggauacgccuaaggaauu

SEQ ID NO: 11101 - RNA, 18 nt, Artificial Sequence
  Description of Artificial Sequence: Synthetic oligonucleotide
aaggaggauacgccuaag

SEQ ID NO: 11102 - RNA, 18 nt, Artificial Sequence
  Description of Artificial Sequence: Synthetic oligonucleotide
gcuccaaggaggauacgc

SEQ ID NO: 11103 - RNA, 18 nt, Artificial Sequence
  Description of Artificial Sequence: Synthetic oligonucleotide
gaugugcuccaaggagga

SEQ ID NO: 11104 - RNA, 18 nt, Artificial Sequence
  Description of Artificial Sequence: Synthetic oligonucleotide
ugagugaugugcuccaag

SEQ ID NO: 11105 - RNA, 18 nt, Artificial Sequence
  Description of Artificial Sequence: Synthetic oligonucleotide
ggcugugagugaugugcu

SEQ ID NO: 11106 - RNA, 18 nt, Artificial Sequence
  Description of Artificial Sequence: Synthetic oligonucleotide
caggaggcugugagugau

SEQ ID NO: 11107 - RNA, 18 nt, Artificial Sequence
  Description of Artificial Sequence: Synthetic oligonucleotide
cgucccaggaggcuguga

SEQ ID NO: 11108 - RNA, 18 nt, Artificial Sequence
  Description of Artificial Sequence: Synthetic oligonucleotide
aagggcgucccaggaggc

SEQ ID NO: 11109 - RNA, 18 nt, Artificial Sequence
  Description of Artificial Sequence: Synthetic oligonucleotide
agacaaagggcgucccag

SEQ ID NO: 11110 - RNA, 18 nt, Artificial Sequence
  Description of Artificial Sequence: Synthetic oligonucleotide
ugccgagacaaagggcgu

SEQ ID NO: 11111 - RNA, 18 nt, Artificial Sequence
  Description of Artificial Sequence: Synthetic oligonucleotide
ucagcugccgagacaaag

SEQ ID NO: 11112 - RNA, 18 nt, Artificial Sequence
  Description of Artificial Sequence: Synthetic oligonucleotide
agacaucagcugccgaga

SEQ ID NO: 11113 - RNA, 18 nt, Artificial Sequence
  Description of Artificial Sequence: Synthetic oligonucleotide
acaagagacaucagcugc

SEQ ID NO: 11114 - RNA, 18 nt, Artificial Sequence
  Description of Artificial Sequence: Synthetic oligonucleotide
cugcaacaagagacauca

SEQ ID NO: 11115 - RNA, 18 nt, Artificial Sequence
  Description of Artificial Sequence: Synthetic oligonucleotide
aaguccugcaacaagaga

SEQ ID NO: 11116 - RNA, 18 nt, Artificial Sequence
  Description of Artificial Sequence: Synthetic oligonucleotide
uuccuaaguccugcaaca

SEQ ID NO: 11117 - RNA, 18 nt, Artificial Sequence
  Description of Artificial Sequence: Synthetic oligonucleotide
cuccauuccuaaguccug

SEQ ID NO: 11118 - RNA, 18 nt, Artificial Sequence
  Description of Artificial Sequence: Synthetic oligonucleotide
aagagcuccauuccuaag

SEQ ID NO: 11119 - RNA, 18 nt, Artificial Sequence
  Description of Artificial Sequence: Synthetic oligonucleotide
aguaaaagagcuccauuc

SEQ ID NO: 11120 - RNA, 18 nt, Artificial Sequence
  Description of Artificial Sequence: Synthetic oligonucleotide
cugugaguaaaagagcuc

SEQ ID NO: 11121 - RNA, 18 nt, Artificial Sequence
  Description of Artificial Sequence: Synthetic oligonucleotide
uccuccugugaguaaaag

SEQ ID NO: 11122 - RNA, 18 nt, Artificial Sequence
  Description of Artificial Sequence: Synthetic oligonucleotide
augaacacaccuuaacca

SEQ ID NO: 11123 - RNA, 18 nt, Artificial Sequence
  Description of Artificial Sequence: Synthetic oligonucleotide
gaaaaaugaacacaccuu

SEQ ID NO: 11124 - RNA, 18 nt, Artificial Sequence
  Description of Artificial Sequence: Synthetic oligonucleotide
uuacagaaaaaugaacac

SEQ ID NO: 11125 - RNA, 18 nt, Artificial Sequence
  Description of Artificial Sequence: Synthetic oligonucleotide
aaauguuacagaaaaaug

SEQ ID NO: 11126 - RNA, 18 nt, Artificial Sequence
  Description of Artificial Sequence: Synthetic oligonucleotide
uuauuaaauguuacagaa

SEQ ID NO: 11127 - RNA, 18 nt, Artificial Sequence
  Description of Artificial Sequence: Synthetic oligonucleotide
aaaaguuauuaaauguua

SEQ ID NO: 11128 - RNA, 18 nt, Artificial Sequence
  Description of Artificial Sequence: Synthetic oligonucleotide
aaaugaaaaguuauuaaa

SEQ ID NO: 11129 - RNA, 18 nt, Artificial Sequence
  Description of Artificial Sequence: Synthetic oligonucleotide
aagauaaaugaaaaguua

SEQ ID NO: 11130 - RNA, 18 nt, Artificial Sequence
  Description of Artificial Sequence: Synthetic oligonucleotide
aaagaaagauaaaugaaa

SEQ ID NO: 11131 - RNA, 18 nt, Artificial Sequence
  Description of Artificial Sequence: Synthetic oligonucleotide
aacccaaagaaagauaaa

SEQ ID NO: 11132 - RNA, 18 nt, Artificial Sequence
  Description of Artificial Sequence: Synthetic oligonucleotide
gucaaaacccaaagaaag

SEQ ID NO: 11133 - RNA, 18 nt, Artificial Sequence
  Description of Artificial Sequence: Synthetic oligonucleotide
agauggucaaaacccaaa

SEQ ID NO: 11134 - RNA, 18 nt, Artificial Sequence
  Description of Artificial Sequence: Synthetic oligonucleotide
auaauagauggucaaaac

SEQ ID NO: 11135 - RNA, 18 nt, Artificial Sequence
  Description of Artificial Sequence: Synthetic oligonucleotide
ccuauauaauagaugguc

SEQ ID NO: 11136 - RNA, 18 nt, Artificial Sequence
  Description of Artificial Sequence: Synthetic oligonucleotide
cccacccuauauaauaga

SEQ ID NO: 11137 - RNA, 18 nt, Artificial Sequence
  Description of Artificial Sequence: Synthetic oligonucleotide
caaaacccacccuauaua

SEQ ID NO: 11138 - RNA, 18 nt, Artificial Sequence
  Description of Artificial Sequence: Synthetic oligonucleotide
auggucaaaacccacccu

SEQ ID NO: 11139 - RNA, 18 nt, Artificial Sequence
  Description of Artificial Sequence: Synthetic oligonucleotide
aauagauggucaaaaccc

SEQ ID NO: 11140 - RNA, 18 nt, Artificial Sequence
  Description of Artificial Sequence: Synthetic oligonucleotide
uauauaauagauggucaa

SEQ ID NO: 11141 - RNA, 18 nt, Artificial Sequence
  Description of Artificial Sequence: Synthetic oligonucleotide
aacccuauauaauagaug

SEQ ID NO: 11142 - RNA, 18 nt, Artificial Sequence
  Description of Artificial Sequence: Synthetic oligonucleotide
guauaaacccuauauaau

SEQ ID NO: 11143 - RNA, 18 nt, Artificial Sequence
  Description of Artificial Sequence: Synthetic oligonucleotide
augucguauaaacccuau

SEQ ID NO: 11144 - RNA, 18 nt, Artificial Sequence
  Description of Artificial Sequence: Synthetic oligonucleotide
uccauaugucguauaaac

SEQ ID NO: 11145 - RNA, 18 nt, Artificial Sequence
  Description of Artificial Sequence: Synthetic oligonucleotide
ugcuuuccauaugucgua

SEQ ID NO: 11146 - RNA, 18 nt, Artificial Sequence
  Description of Artificial Sequence: Synthetic oligonucleotide
augaaugcuuuccauaug

SEQ ID NO: 11147 - RNA, 18 nt, Artificial Sequence
  Description of Artificial Sequence: Synthetic oligonucleotide
aauaaaugaaugcuuucc

SEQ ID NO: 11148 - RNA, 18 nt, Artificial Sequence
  Description of Artificial Sequence: Synthetic oligonucleotide
uagugaauaaaugaaugc

SEQ ID NO: 11149 - RNA, 18 nt, Artificial Sequence
  Description of Artificial Sequence: Synthetic oligonucleotide
aauauuagugaauaaaug

SEQ ID NO: 11150 - RNA, 18 nt, Artificial Sequence
  Description of Artificial Sequence: Synthetic oligonucleotide
acagaaauauuagugaau

SEQ ID NO: 11151 - RNA, 18 nt, Artificial Sequence
  Description of Artificial Sequence: Synthetic oligonucleotide
gacacacagaaauauuag

SEQ ID NO: 11152 - RNA, 18 nt, Artificial Sequence
  Description of Artificial Sequence: Synthetic oligonucleotide
aagcagacacacagaaau

SEQ ID NO: 11153 - RNA, 18 nt, Artificial Sequence
  Description of Artificial Sequence: Synthetic oligonucleotide
ccuaaaagcagacacaca

SEQ ID NO: 11154 - RNA, 18 nt, Artificial Sequence
  Description of Artificial Sequence: Synthetic oligonucleotide
caacaccuaaaagcagac

SEQ ID NO: 11155 - RNA, 18 nt, Artificial Sequence
  Description of Artificial Sequence: Synthetic oligonucleotide
ucccccaacaccuaaaag

SEQ ID NO: 11156 - RNA, 18 nt, Artificial Sequence
  Description of Artificial Sequence: Synthetic oligonucleotide
aucacucccccaacaccu

SEQ ID NO: 11157 - RNA, 18 nt, Artificial Sequence
  Description of Artificial Sequence: Synthetic oligonucleotide
ucgucaucacucccccaa

SEQ ID NO: 11158 - RNA, 18 nt, Artificial Sequence
  Description of Artificial Sequence: Synthetic oligonucleotide
cuuauucgucaucacucc

SEQ ID NO: 11159 - RNA, 18 nt, Artificial Sequence
  Description of Artificial Sequence: Synthetic oligonucleotide
ucagucuuauucgucauc

SEQ ID NO: 11160 - RNA, 18 nt, Artificial Sequence
  Description of Artificial Sequence: Synthetic oligonucleotide
gaacaucagucuuauucg

SEQ ID NO: 11161 - RNA, 18 nt, Artificial Sequence
  Description of Artificial Sequence: Synthetic oligonucleotide
auggagaacaucagucuu

SEQ ID NO: 11162 - RNA, 18 nt, Artificial Sequence
  Description of Artificial Sequence: Synthetic oligonucleotide
agggcauggagaacauca

SEQ ID NO: 11163 - RNA, 18 nt, Artificial Sequence
  Description of Artificial Sequence: Synthetic oligonucleotide
gaaaaagggcauggagaa

SEQ ID NO: 11164 - RNA, 18 nt, Artificial Sequence
  Description of Artificial Sequence: Synthetic oligonucleotide
acacagaaaaagggcaug

SEQ ID NO: 11165 - RNA, 18 nt, Artificial Sequence
  Description of Artificial Sequence: Synthetic oligonucleotide
aacugacacagaaaaagg

SEQ ID NO: 11166 - RNA, 18 nt, Artificial Sequence
  Description of Artificial Sequence: Synthetic oligonucleotide
guaucaacugacacagaa

SEQ ID NO: 11167 - RNA, 18 nt, Artificial Sequence
  Description of Artificial Sequence: Synthetic oligonucleotide
uaauuguaucaacugaca

SEQ ID NO: 11168 - RNA, 18 nt, Artificial Sequence
  Description of Artificial Sequence: Synthetic oligonucleotide
ccauauaauuguaucaac

SEQ ID NO: 11169 - RNA, 18 nt, Artificial Sequence
  Description of Artificial Sequence: Synthetic oligonucleotide
aaaaaccauauaauugua

SEQ ID NO: 11170 - RNA, 18 nt, Artificial Sequence
  Description of Artificial Sequence: Synthetic oligonucleotide
aaaagaaaaaccauauaa

SEQ ID NO: 11171 - RNA, 18 nt, Artificial Sequence
  Description of Artificial Sequence: Synthetic oligonucleotide
ccuaaaaaagaaaaacca

SEQ ID NO: 11172 - RNA, 18 nt, Artificial Sequence
  Description of Artificial Sequence: Synthetic oligonucleotide
aauagccuaaaaaagaaa

SEQ ID NO: 11173 - RNA, 18 nt, Artificial Sequence
  Description of Artificial Sequence: Synthetic oligonucleotide
caccuaauagccuaaaaa

SEQ ID NO: 11174 - RNA, 18 nt, Artificial Sequence
  Description of Artificial Sequence: Synthetic oligonucleotide
aucaacaccuaauagccu

SEQ ID NO: 11175 - RNA, 18 nt, Artificial Sequence
  Description of Artificial Sequence: Synthetic oligonucleotide
acccuaucaacaccuaau

SEQ ID NO: 11176 - RNA, 18 nt, Artificial Sequence
  Description of Artificial Sequence: Synthetic oligonucleotide
acucaacccuaucaacac

SEQ ID NO: 11177 - RNA, 18 nt, Artificial Sequence
  Description of Artificial Sequence: Synthetic oligonucleotide
aaguuacucaacccuauc

SEQ ID NO: 11178 - RNA, 18 nt, Artificial Sequence
  Description of Artificial Sequence: Synthetic oligonucleotide
uuuguaaguuacucaacc

SEQ ID NO: 11179 - RNA, 18 nt, Artificial Sequence
  Description of Artificial Sequence: Synthetic oligonucleotide
caacauuuguaaguuacu

SEQ ID NO: 11180 - RNA, 18 nt, Artificial Sequence
  Description of Artificial Sequence: Synthetic oligonucleotide
ugguucaacauuuguaag

SEQ ID NO: 11181 - RNA, 18 nt, Artificial Sequence
  Description of Artificial Sequence: Synthetic oligonucleotide
aaggcugguucaacauuu

SEQ ID NO: 11182 - RNA, 18 nt, Artificial Sequence
  Description of Artificial Sequence: Synthetic oligonucleotide
uaugcaaggcugguucaa

SEQ ID NO: 11183 - RNA, 18 nt, Artificial Sequence
  Description of Artificial Sequence: Synthetic oligonucleotide
acagguaugcaaggcugg

SEQ ID NO: 11184 - RNA, 18 nt, Artificial Sequence
  Description of Artificial Sequence: Synthetic oligonucleotide
uuaucacagguaugcaag

SEQ ID NO: 11185 - RNA, 18 nt, Artificial Sequence
  Description of Artificial Sequence: Synthetic oligonucleotide
gguauuuaucacagguau

SEQ ID NO: 11186 - RNA, 18 nt, Artificial Sequence
  Description of Artificial Sequence: Synthetic oligonucleotide
uacgugguauuuaucaca

SEQ ID NO: 11187 - RNA, 18 nt, Artificial Sequence
  Description of Artificial Sequence: Synthetic oligonucleotide
acaacuacgugguauuua

SEQ ID NO: 11188 - RNA, 18 nt, Artificial Sequence
  Description of Artificial Sequence: Synthetic oligonucleotide
acaccacaacuacguggu

SEQ ID NO: 11189 - RNA, 18 nt, Artificial Sequence
  Description of Artificial Sequence: Synthetic oligonucleotide
cugguucaacauuuguaa

SEQ ID NO: 11190 - RNA, 18 nt, Artificial Sequence
  Description of Artificial Sequence: Synthetic oligonucleotide
caaggcugguucaacauu

SEQ ID NO: 11191 - RNA, 18 nt, Artificial Sequence
  Description of Artificial Sequence: Synthetic oligonucleotide
guaugcaaggcugguuca

SEQ ID NO: 11192 - RNA, 18 nt, Artificial Sequence
  Description of Artificial Sequence: Synthetic oligonucleotide
cacagguaugcaaggcug

SEQ ID NO: 11193 - RNA, 18 nt, Artificial Sequence
  Description of Artificial Sequence: Synthetic oligonucleotide
uuuaucacagguaugcaa

SEQ ID NO: 11194 - RNA, 18 nt, Artificial Sequence
  Description of Artificial Sequence: Synthetic oligonucleotide
ugguauuuaucacaggua

SEQ ID NO: 11195 - RNA, 18 nt, Artificial Sequence
  Description of Artificial Sequence: Synthetic oligonucleotide
cuacgugguauuuaucac

SEQ ID NO: 11196 - RNA, 18 nt, Artificial Sequence
  Description of Artificial Sequence: Synthetic oligonucleotide
cacaacuacgugguauuu

SEQ ID NO: 11197 - RNA, 18 nt, Artificial Sequence
  Description of Artificial Sequence: Synthetic oligonucleotide
uacaccacaacuacgugg

SEQ ID NO: 11198 - RNA, 18 nt, Artificial Sequence
  Description of Artificial Sequence: Synthetic oligonucleotide
aaugauacaccacaacua

SEQ ID NO: 11199 - RNA, 18 nt, Artificial Sequence
  Description of Artificial Sequence: Synthetic oligonucleotide
gaaagaaugauacaccac

SEQ ID NO: 11200 - RNA, 18 nt, Artificial Sequence
  Description of Artificial Sequence: Synthetic oligonucleotide
auguagaaagaaugauac

SEQ ID NO: 11201 - RNA, 18 nt, Artificial Sequence
  Description of Artificial Sequence: Synthetic oligonucleotide
cagcaauguagaaagaau

SEQ ID NO: 11202 - RNA, 18 nt, Artificial Sequence
  Description of Artificial Sequence: Synthetic oligonucleotide
aaacucagcaauguagaa

SEQ ID NO: 11203 - RNA, 18 nt, Artificial Sequence
  Description of Artificial Sequence: Synthetic oligonucleotide
agauaaaacucagcaaug

SEQ ID NO: 11204 - RNA, 18 nt, Artificial Sequence
  Description of Artificial Sequence: Synthetic oligonucleotide
uuagcagauaaaacucag

SEQ ID NO: 11205 - RNA, 18 nt, Artificial Sequence
  Description of Artificial Sequence: Synthetic oligonucleotide
gaacauuagcagauaaaa

SEQ ID NO: 11206 - RNA, 18 nt, Artificial Sequence
  Description of Artificial Sequence: Synthetic oligonucleotide
caacagaacauuagcaga

SEQ ID NO: 11207 - RNA, 18 nt, Artificial Sequence
  Description of Artificial Sequence: Synthetic oligonucleotide
aagcucaacagaacauua

SEQ ID NO: 11208 - RNA, 18 nt, Artificial Sequence
  Description of Artificial Sequence: Synthetic oligonucleotide
gacaaaagcucaacagaa

SEQ ID NO: 11209 - RNA, 18 nt, Artificial Sequence
  Description of Artificial Sequence: Synthetic oligonucleotide
aaauggacaaaagcucaa

SEQ ID NO: 11210 - RNA, 18 nt, Artificial Sequence
  Description of Artificial Sequence: Synthetic oligonucleotide
aacuuaaauggacaaaag

SEQ ID NO: 11211 - RNA, 18 nt, Artificial Sequence
  Description of Artificial Sequence: Synthetic oligonucleotide
uuucaaacuuaaauggac

SEQ ID NO: 11212 - RNA, 18 nt, Artificial Sequence
  Description of Artificial Sequence: Synthetic oligonucleotide
aucacuuucaaacuuaaa

SEQ ID NO: 11213 - RNA, 18 nt, Artificial Sequence
  Description of Artificial Sequence: Synthetic oligonucleotide
aacuaaucacuuucaaac

SEQ ID NO: 11214 - RNA, 18 nt, Artificial Sequence
  Description of Artificial Sequence: Synthetic oligonucleotide
cugcaaacuaaucacuuu

SEQ ID NO: 11215 - RNA, 18 nt, Artificial Sequence
  Description of Artificial Sequence: Synthetic oligonucleotide
gaaaacugcaaacuaauc

SEQ ID NO: 11216 - RNA, 18 nt, Artificial Sequence
  Description of Artificial Sequence: Synthetic oligonucleotide
aaacagaaaacugcaaac

SEQ ID NO: 11217 - RNA, 18 nt, Artificial Sequence
  Description of Artificial Sequence: Synthetic oligonucleotide
cacaaaaacagaaaacug

SEQ ID NO: 11218 - RNA, 18 nt, Artificial Sequence
  Description of Artificial Sequence: Synthetic oligonucleotide
gacaacacaaaaacagaa

SEQ ID NO: 11219 - RNA, 18 nt, Artificial Sequence
  Description of Artificial Sequence: Synthetic oligonucleotide
acaaagacaacacaaaaa

SEQ ID NO: 11220 - RNA, 18 nt, Artificial Sequence
  Description of Artificial Sequence: Synthetic oligonucleotide
accagacaaagacaacac

SEQ ID NO: 11221 - RNA, 18 nt, Artificial Sequence
  Description of Artificial Sequence: Synthetic oligonucleotide
gcaaaaccagacaaagac

SEQ ID NO: 11222 - RNA, 18 nt, Artificial Sequence
  Description of Artificial Sequence: Synthetic oligonucleotide
ggauagcaaaaccagaca

SEQ ID NO: 11223 - RNA, 18 nt, Artificial Sequence
  Description of Artificial Sequence: Synthetic oligonucleotide
uacacggauagcaaaacc

SEQ ID NO: 11224 - RNA, 18 nt, Artificial Sequence
  Description of Artificial Sequence: Synthetic oligonucleotide
agauuuacacggauagca

SEQ ID NO: 11225 - RNA, 18 nt, Artificial Sequence
  Description of Artificial Sequence: Synthetic oligonucleotide
aggccagauuuacacgga

SEQ ID NO: 11226 - RNA, 18 nt, Artificial Sequence
  Description of Artificial Sequence: Synthetic oligonucleotide
uuaugaggccagauuuac

SEQ ID NO: 11227 - RNA, 18 nt, Artificial Sequence
  Description of Artificial Sequence: Synthetic oligonucleotide
ucauuuuaugaggccaga

SEQ ID NO: 11228 - RNA, 18 nt, Artificial Sequence
  Description of Artificial Sequence: Synthetic oligonucleotide
ccaucucauuuuaugagg

SEQ ID NO: 11229 - RNA, 18 nt, Artificial Sequence
  Description of Artificial Sequence: Synthetic oligonucleotide
acuucccaucucauuuua

SEQ ID NO: 11230 - RNA, 18 nt, Artificial Sequence
  Description of Artificial Sequence: Synthetic oligonucleotide
agaauacuucccaucuca

SEQ ID NO: 11231 - RNA, 18 nt, Artificial Sequence
  Description of Artificial Sequence: Synthetic oligonucleotide
aggagagaauacuuccca

SEQ ID NO: 11232 - RNA, 18 nt, Artificial Sequence
  Description of Artificial Sequence: Synthetic oligonucleotide
agaagaggagagaauacu

SEQ ID NO: 11233 - RNA, 18 nt, Artificial Sequence
  Description of Artificial Sequence: Synthetic oligonucleotide
acaaaagaagaggagaga

SEQ ID NO: 11234 - RNA, 18 nt, Artificial Sequence
  Description of Artificial Sequence: Synthetic oligonucleotide
aaaaaacaaaagaagagg

SEQ ID NO: 11235 - RNA, 18 nt, Artificial Sequence
  Description of Artificial Sequence: Synthetic oligonucleotide
uuccaaaaaaacaaaaga

SEQ ID NO: 11236 - RNA, 18 nt, Artificial Sequence
  Description of Artificial Sequence: Synthetic oligonucleotide
accucuuccaaaaaaaca

SEQ ID NO: 11237 - RNA, 18 nt, Artificial Sequence
  Description of Artificial Sequence: Synthetic oligonucleotide
auacaaccucuuccaaaa

SEQ ID NO: 11238 - RNA, 18 nt, Artificial Sequence
  Description of Artificial Sequence: Synthetic oligonucleotide
auuuuauacaaccucuuc

SEQ ID NO: 11239 - RNA, 18 nt, Artificial Sequence
  Description of Artificial Sequence: Synthetic oligonucleotide
ccucaauuuuauacaacc

SEQ ID NO: 11240 - RNA, 18 nt, Artificial Sequence
  Description of Artificial Sequence: Synthetic oligonucleotide
uucagccucaauuuuaua

SEQ ID NO: 11241 - RNA, 18 nt, Artificial Sequence
  Description of Artificial Sequence: Synthetic oligonucleotide
caagauucagccucaauu

SEQ ID NO: 11242 - RNA, 18 nt, Artificial Sequence
  Description of Artificial Sequence: Synthetic oligonucleotide
accaccaagauucagccu

SEQ ID NO: 11243 - RNA, 18 nt, Artificial Sequence
  Description of Artificial Sequence: Synthetic oligonucleotide
uggcaaccaccaagauuc

SEQ ID NO: 11244 - RNA, 18 nt, Artificial Sequence
  Description of Artificial Sequence: Synthetic oligonucleotide
cauuguggcaaccaccaa

SEQ ID NO: 11245 - RNA, 18 nt, Artificial Sequence
  Description of Artificial Sequence: Synthetic oligonucleotide
ccugucauuguggcaacc

SEQ ID NO: 11246 - RNA, 18 nt, Artificial Sequence
  Description of Artificial Sequence: Synthetic oligonucleotide
uaguuccugucauugugg

SEQ ID NO: 11247 - RNA, 18 nt, Artificial Sequence
  Description of Artificial Sequence: Synthetic oligonucleotide
agaaauaguuccugucau

SEQ ID NO: 11248 - RNA, 18 nt, Artificial Sequence
  Description of Artificial Sequence: Synthetic oligonucleotide
gucacagaaauaguuccu

SEQ ID NO: 11249 - RNA, 18 nt, Artificial Sequence
  Description of Artificial Sequence: Synthetic oligonucleotide
auucagucacagaaauag

SEQ ID NO: 11250 - RNA, 18 nt, Artificial Sequence
  Description of Artificial Sequence: Synthetic oligonucleotide
aauauauucagucacaga

SEQ ID NO: 11251 - RNA, 18 nt, Artificial Sequence
  Description of Artificial Sequence: Synthetic oligonucleotide
uucccaauauauucaguc

SEQ ID NO: 11252 - RNA, 18 nt, Artificial Sequence
  Description of Artificial Sequence: Synthetic oligonucleotide
aggaauucccaauauauu

SEQ ID NO: 11253 - RNA, 18 nt, Artificial Sequence
  Description of Artificial Sequence: Synthetic oligonucleotide
uuuauaggaauucccaau

SEQ ID NO: 11254 - RNA, 18 nt, Artificial Sequence
  Description of Artificial Sequence: Synthetic oligonucleotide
aaguugauuuuccacuuc

SEQ ID NO: 11255 - RNA, 18 nt, Artificial Sequence
  Description of Artificial Sequence: Synthetic oligonucleotide
ggcuaaaguugauuuucc

SEQ ID NO: 11256 - RNA, 18 nt, Artificial Sequence
  Description of Artificial Sequence: Synthetic oligonucleotide
gcuuuggcuaaaguugau

SEQ ID NO: 11257 - RNA, 18 nt, Artificial Sequence
  Description of Artificial Sequence: Synthetic oligonucleotide
agauugcuuuggcuaaag

SEQ ID NO: 11258 - RNA, 18 nt, Artificial Sequence
  Description of Artificial Sequence: Synthetic oligonucleotide
uuuacagauugcuuuggc

SEQ ID NO: 11259 - RNA, 18 nt, Artificial Sequence
  Description of Artificial Sequence: Synthetic oligonucleotide
gcuucuuuacagauugcu

SEQ ID NO: 11260 - RNA, 18 nt, Artificial Sequence
  Description of Artificial Sequence: Synthetic oligonucleotide
caaaugcuucuuuacaga

SEQ ID NO: 11261 - RNA, 18 nt, Artificial Sequence
  Description of Artificial Sequence: Synthetic oligonucleotide
uuugucaaaugcuucuuu

SEQ ID NO: 11262 - RNA, 18 nt, Artificial Sequence
  Description of Artificial Sequence: Synthetic oligonucleotide
uccaguuugucaaaugcu

SEQ ID NO: 11263 - RNA, 18 nt, Artificial Sequence
  Description of Artificial Sequence: Synthetic oligonucleotide
gggcauccaguuugucaa

SEQ ID NO: 11264 - RNA, 18 nt, Artificial Sequence
  Description of Artificial Sequence: Synthetic oligonucleotide
cacaugggcauccaguuu

SEQ ID NO: 11265 - RNA, 18 nt, Artificial Sequence
  Description of Artificial Sequence: Synthetic oligonucleotide
cucuccacaugggcaucc

SEQ ID NO: 11266 - RNA, 18 nt, Artificial Sequence
  Description of Artificial Sequence: Synthetic oligonucleotide
caacucucuccacauggg

SEQ ID NO: 11267 - RNA, 18 nt, Artificial Sequence
  Description of Artificial Sequence: Synthetic oligonucleotide
acagucaacucucuccac

SEQ ID NO: 11268 - RNA, 18 nt, Artificial Sequence
  Description of Artificial Sequence: Synthetic oligonucleotide
gcuuuacagucaacucuc

SEQ ID NO: 11269 - RNA, 18 nt, Artificial Sequence
  Description of Artificial Sequence: Synthetic oligonucleotide
guaaagcuuuacagucaa

SEQ ID NO: 11270 - RNA, 18 nt, Artificial Sequence
  Description of Artificial Sequence: Synthetic oligonucleotide
uagcagccaauacauaaa

SEQ ID NO: 11271 - RNA, 18 nt, Artificial Sequence
  Description of Artificial Sequence: Synthetic oligonucleotide
acuaguagcagccaauac

SEQ ID NO: 11272 - RNA, 18 nt, Artificial Sequence
  Description of Artificial Sequence: Synthetic oligonucleotide
gggcgacuaguagcagcc

SEQ ID NO: 11273 - RNA, 18 nt, Artificial Sequence
  Description of Artificial Sequence: Synthetic oligonucleotide
agucagggcgacuaguag

SEQ ID NO: 11274 - RNA, 18 nt, Artificial Sequence
  Description of Artificial Sequence: Synthetic oligonucleotide
aaucaagucagggcgacu

SEQ ID NO: 11275 - RNA, 18 nt, Artificial Sequence
  Description of Artificial Sequence: Synthetic oligonucleotide
gggucaaucaagucaggg

SEQ ID NO: 11276 - RNA, 18 nt, Artificial Sequence
  Description of Artificial Sequence: Synthetic oligonucleotide
gggcagggucaaucaagu

SEQ ID NO: 11277 - RNA, 18 nt, Artificial Sequence
  Description of Artificial Sequence: Synthetic oligonucleotide
aagcagggcagggucaau

SEQ ID NO: 11278 - RNA, 18 nt, Artificial Sequence
  Description of Artificial Sequence: Synthetic oligonucleotide
ggccuaagcagggcaggg

SEQ ID NO: 11279 - RNA, 18 nt, Artificial Sequence
  Description of Artificial Sequence: Synthetic oligonucleotide
gaccaggccuaagcaggg

SEQ ID NO: 11280 - RNA, 18 nt, Artificial Sequence
  Description of Artificial Sequence: Synthetic oligonucleotide
uagucgaccaggccuaag

SEQ ID NO: 11281 - RNA, 18 nt, Artificial Sequence
  Description of Artificial Sequence: Synthetic oligonucleotide
uuaucuagucgaccaggc

SEQ ID NO: 11282 - RNA, 18 nt, Artificial Sequence
  Description of Artificial Sequence: Synthetic oligonucleotide
cacauuuaucuagucgac

SEQ ID NO: 11283 - RNA, 18 nt, Artificial Sequence
  Description of Artificial Sequence: Synthetic oligonucleotide
guauacacauuuaucuag

SEQ ID NO: 11284 - RNA, 18 nt, Artificial Sequence
  Description of Artificial Sequence: Synthetic oligonucleotide
ggacaguauacacauuua

SEQ ID NO: 11285 - RNA, 18 nt, Artificial Sequence
  Description of Artificial Sequence: Synthetic oligonucleotide
gaggaggacaguauacac

SEQ ID NO: 11286 - RNA, 18 nt, Artificial Sequence
  Description of Artificial Sequence: Synthetic oligonucleotide
aucaggaggaggacagua

SEQ ID NO: 11287 - RNA, 18 nt, Artificial Sequence
  Description of Artificial Sequence: Synthetic oligonucleotide
gacucuaaauaugaaauu

SEQ ID NO: 11288 - RNA, 18 nt, Artificial Sequence
  Description of Artificial Sequence: Synthetic oligonucleotide
uuuuggacucuaaauaug

SEQ ID NO: 11289 - RNA, 18 nt, Artificial Sequence
  Description of Artificial Sequence: Synthetic oligonucleotide
uuggguuuuggacucuaa

SEQ ID NO: 11290 - RNA, 18 nt, Artificial Sequence
  Description of Artificial Sequence: Synthetic oligonucleotide
auuuguuggguuuuggac

SEQ ID NO: 11291 - RNA, 18 nt, Artificial Sequence
  Description of Artificial Sequence: Synthetic oligonucleotide
guagcauuuguuggguuu

SEQ ID NO: 11292 - RNA, 18 nt, Artificial Sequence
  Description of Artificial Sequence: Synthetic oligonucleotide
agaguguagcauuuguug

SEQ ID NO: 11293 - RNA, 18 nt, Artificial Sequence
  Description of Artificial Sequence: Synthetic oligonucleotide
aggaaagaguguagcauu

SEQ ID NO: 11294 - RNA, 18 nt, Artificial Sequence
  Description of Artificial Sequence: Synthetic oligonucleotide
ucacaaggaaagagugua

SEQ ID NO: 11295 - RNA, 18 nt, Artificial Sequence
  Description of Artificial Sequence: Synthetic oligonucleotide
aaagcucacaaggaaaga

SEQ ID NO: 11296 - RNA, 18 nt, Artificial Sequence
  Description of Artificial Sequence: Synthetic oligonucleotide
gaaguaaagcucacaagg

SEQ ID NO: 11297 - RNA, 18 nt, Artificial Sequence
  Description of Artificial Sequence: Synthetic oligonucleotide
uggcagaaguaaagcuca

SEQ ID NO: 11298 - RNA, 18 nt, Artificial Sequence
  Description of Artificial Sequence: Synthetic oligonucleotide
uuaccuggcagaaguaaa

SEQ ID NO: 11299 - RNA, 18 nt, Artificial Sequence
  Description of Artificial Sequence: Synthetic oligonucleotide
ugccauuaccuggcagaa

SEQ ID NO: 11300 - RNA, 18 nt, Artificial Sequence
  Description of Artificial Sequence: Synthetic oligonucleotide
acaauugccauuaccugg

SEQ ID NO: 11301 - RNA, 18 nt, Artificial Sequence
  Description of Artificial Sequence: Synthetic oligonucleotide
uaaggacaauugccauua

SEQ ID NO: 11302 - RNA, 18 nt, Artificial Sequence
  Description of Artificial Sequence: Synthetic oligonucleotide
ucuucuaaggacaauugc

SEQ ID NO: 11303 - RNA, 18 nt, Artificial Sequence
  Description of Artificial Sequence: Synthetic oligonucleotide
gcuggucuucuaaggaca

SEQ ID NO: 11304 - RNA, 18 nt, Artificial Sequence
  Description of Artificial Sequence: Synthetic oligonucleotide
agaaagcuggucuucuaa

SEQ ID NO: 11305 - RNA, 18 nt, Artificial Sequence
  Description of Artificial Sequence: Synthetic oligonucleotide
cccuaagaaagcuggucu

SEQ ID NO: 11306 - RNA, 18 nt, Artificial Sequence
  Description of Artificial Sequence: Synthetic oligonucleotide
cuuuucccuaagaaagcu

SEQ ID NO: 11307 - RNA, 18 nt, Artificial Sequence
  Description of Artificial Sequence: Synthetic oligonucleotide
uaaagcuuuucccuaaga

SEQ ID NO: 11308 - RNA, 18 nt, Artificial Sequence
  Description of Artificial Sequence: Synthetic oligonucleotide
guggcuaaagcuuuuccc

SEQ ID NO: 11309 - RNA, 18 nt, Artificial Sequence
  Description of Artificial Sequence: Synthetic oligonucleotide
aaacaguggcuaaagcuu

SEQ ID NO: 11310 - RNA, 18 nt, Artificial Sequence
  Description of Artificial Sequence: Synthetic oligonucleotide
ugagcaaacaguggcuaa

SEQ ID NO: 11311 - RNA, 18 nt, Artificial Sequence
  Description of Artificial Sequence: Synthetic oligonucleotide
ugcuuugagcaaacagug

SEQ ID NO: 11312 - RNA, 18 nt, Artificial Sequence
  Description of Artificial Sequence: Synthetic oligonucleotide
uuuuaugcuuugagcaaa

SEQ ID NO: 11313 - RNA, 18 nt, Artificial Sequence
  Description of Artificial Sequence: Synthetic oligonucleotide
aaucuuuuuaugcuuuga

SEQ ID NO: 11314 - RNA, 18 nt, Artificial Sequence
  Description of Artificial Sequence: Synthetic oligonucleotide
uucagaaucuuuuuaugc

SEQ ID NO: 11315 - RNA, 18 nt, Artificial Sequence
  Description of Artificial Sequence: Synthetic oligonucleotide
ucuaauucagaaucuuuu

SEQ ID NO: 11316 - RNA, 18 nt, Artificial Sequence
  Description of Artificial Sequence: Synthetic oligonucleotide
uugcaucuaauucagaau

SEQ ID NO: 11317 - RNA, 18 nt, Artificial Sequence
  Description of Artificial Sequence: Synthetic oligonucleotide
aggcuuugcaucuaauuc

SEQ ID NO: 11318 - RNA, 18 nt, Artificial Sequence
  Description of Artificial Sequence: Synthetic oligonucleotide
aaaaaaggcuuugcaucu

SEQ ID NO: 11319 - RNA, 18 nt, Artificial Sequence
  Description of Artificial Sequence: Synthetic oligonucleotide
ggccaaaaaaaggcuuug

SEQ ID NO: 11320 - RNA, 18 nt, Artificial Sequence
  Description of Artificial Sequence: Synthetic oligonucleotide
cacugggccaaaaaaagg

SEQ ID NO: 11321 - RNA, 18 nt, Artificial Sequence
  Description of Artificial Sequence: Synthetic oligonucleotide
acuugcacugggccaaaa

SEQ ID NO: 11322 - RNA, 18 nt, Artificial Sequence
  Description of Artificial Sequence: Synthetic oligonucleotide
uucagacuugcacugggc

SEQ ID NO: 11323 - RNA, 18 nt, Artificial Sequence
  Description of Artificial Sequence: Synthetic oligonucleotide
aaguuuucagacuugcac

SEQ ID NO: 11324 - RNA, 18 nt, Artificial Sequence
  Description of Artificial Sequence: Synthetic oligonucleotide
uuacaaaguuuucagacu

SEQ ID NO: 11325 - RNA, 18 nt, Artificial Sequence
  Description of Artificial Sequence: Synthetic oligonucleotide
aaggauuacaaaguuuuc

SEQ ID NO: 11326 - RNA, 18 nt, Artificial Sequence
  Description of Artificial Sequence: Synthetic oligonucleotide
cacagaaggauuacaaag

SEQ ID NO: 11327 - RNA, 18 nt, Artificial Sequence
  Description of Artificial Sequence: Synthetic oligonucleotide
gccaacacagaaggauua

SEQ ID NO: 11328 - RNA, 18 nt, Artificial Sequence
  Description of Artificial Sequence: Synthetic oligonucleotide
aaucagccaacacagaag

SEQ ID NO: 11329 - RNA, 18 nt, Artificial Sequence
  Description of Artificial Sequence: Synthetic oligonucleotide
uccccaaucagccaacac

SEQ ID NO: 11330 - RNA, 18 nt, Artificial Sequence
  Description of Artificial Sequence: Synthetic oligonucleotide
uuuuuuccccaaucagcc

SEQ ID NO: 11331 - RNA, 18 nt, Artificial Sequence
  Description of Artificial Sequence: Synthetic oligonucleotide
cauuuuuuuuuccccaau

SEQ ID NO: 11332 - RNA, 18 nt, Artificial Sequence
  Description of Artificial Sequence: Synthetic oligonucleotide
ucuugcauuuuuuuuucc

SEQ ID NO: 11333 - RNA, 18 nt, Artificial Sequence
  Description of Artificial Sequence: Synthetic oligonucleotide
agguuucuugcauuuuuu

SEQ ID NO: 11334 - RNA, 18 nt, Artificial Sequence
  Description of Artificial Sequence: Synthetic oligonucleotide
acauuagguuucuugcau

SEQ ID NO: 11335 - RNA, 18 nt, Artificial Sequence
  Description of Artificial Sequence: Synthetic oligonucleotide
auaauacauuagguuucu

SEQ ID NO: 11336 - RNA, 18 nt, Artificial Sequence
  Description of Artificial Sequence: Synthetic oligonucleotide
aaaauauaauacauuagg

SEQ ID NO: 11337 - RNA, 18 nt, Artificial Sequence
  Description of Artificial Sequence: Synthetic oligonucleotide
augugaaaauauaauaca

SEQ ID NO: 11338 - RNA, 18 nt, Artificial Sequence
  Description of Artificial Sequence: Synthetic oligonucleotide
agauaaugugaaaauaua

SEQ ID NO: 11339 - RNA, 18 nt, Artificial Sequence
  Description of Artificial Sequence: Synthetic oligonucleotide
acagaagauaaugugaaa

SEQ ID NO: 11340 - RNA, 18 nt, Artificial Sequence
  Description of Artificial Sequence: Synthetic oligonucleotide
uuugaacagaagauaaug

SEQ ID NO: 11341 - RNA, 18 nt, Artificial Sequence
  Description of Artificial Sequence: Synthetic oligonucleotide
uaaucuuugaacagaaga

SEQ ID NO: 11342 - RNA, 18 nt, Artificial Sequence
  Description of Artificial Sequence: Synthetic oligonucleotide
guauguaaucuuugaaca

SEQ ID NO: 11343 - RNA, 18 nt, Artificial Sequence
  Description of Artificial Sequence: Synthetic oligonucleotide
uggaaguauguaaucuuu

SEQ ID NO: 11344 - RNA, 18 nt, Artificial Sequence
  Description of Artificial Sequence: Synthetic oligonucleotide
gauaauggaaguauguaa

SEQ ID NO: 11345 - RNA, 18 nt, Artificial Sequence
  Description of Artificial Sequence: Synthetic oligonucleotide
gacaggauaauggaagua

SEQ ID NO: 11346 - RNA, 18 nt, Artificial Sequence
  Description of Artificial Sequence: Synthetic oligonucleotide
uuuuugacaggauaaugg

SEQ ID NO: 11347 - RNA, 18 nt, Artificial Sequence
  Description of Artificial Sequence: Synthetic oligonucleotide
uuuuuuuuuugacaggau

SEQ ID NO: 11348 - RNA, 18 nt, Artificial Sequence
  Description of Artificial Sequence: Synthetic oligonucleotide
cagaguuuuuuuuuugac

SEQ ID NO: 11349 - RNA, 18 nt, Artificial Sequence
  Description of Artificial Sequence: Synthetic oligonucleotide
uguaucagaguuuuuuuu

SEQ ID NO: 11350 - RNA, 18 nt, Artificial Sequence
  Description of Artificial Sequence: Synthetic oligonucleotide
gauucuguaucagaguuu

SEQ ID NO: 11351 - RNA, 18 nt, Artificial Sequence
  Description of Artificial Sequence: Synthetic oligonucleotide
ugcuugauucuguaucag

SEQ ID NO: 11352 - RNA, 18 nt, Artificial Sequence
  Description of Artificial Sequence: Synthetic oligonucleotide
ucacaugcuugauucugu

SEQ ID NO: 11353 - RNA, 18 nt, Artificial Sequence
  Description of Artificial Sequence: Synthetic oligonucleotide
acgauucacaugcuugau

SEQ ID NO: 11354 - RNA, 18 nt, Artificial Sequence
  Description of Artificial Sequence: Synthetic oligonucleotide
ugcuuacgauucacaugc

SEQ ID NO: 11355 - RNA, 18 nt, Artificial Sequence
  Description of Artificial Sequence: Synthetic oligonucleotide
uuacaugcuuacgauuca

SEQ ID NO: 11356 - RNA, 18 nt, Artificial Sequence
  Description of Artificial Sequence: Synthetic oligonucleotide
ccugcuuacaugcuuacg

SEQ ID NO: 11357 - RNA, 18 nt, Artificial Sequence
  Description of Artificial Sequence: Synthetic oligonucleotide
ugaaaccugcuuacaugc

SEQ ID NO: 11358 - RNA, 18 nt, Artificial Sequence
  Description of Artificial Sequence: Synthetic oligonucleotide
cucuaugaaaccugcuua

SEQ ID NO: 11359 - RNA, 18 nt, Artificial Sequence
  Description of Artificial Sequence: Synthetic oligonucleotide
auuaucucuaugaaaccu

SEQ ID NO: 11360 - RNA, 18 nt, Artificial Sequence
  Description of Artificial Sequence: Synthetic oligonucleotide
gaaaaauuaucucuauga

SEQ ID NO: 11361 - RNA, 18 nt, Artificial Sequence
  Description of Artificial Sequence: Synthetic oligonucleotide
gaguugaaaaauuaucuc

SEQ ID NO: 11362 - RNA, 18 nt, Artificial Sequence
  Description of Artificial Sequence: Synthetic oligonucleotide
aggaagaguugaaaaauu

SEQ ID NO: 11363 - RNA, 18 nt, Artificial Sequence
  Description of Artificial Sequence: Synthetic oligonucleotide
ggacaaggaagaguugaa

SEQ ID NO: 11364 - RNA, 18 nt, Artificial Sequence
  Description of Artificial Sequence: Synthetic oligonucleotide
acacaggacaaggaagag

SEQ ID NO: 11365 - RNA, 18 nt, Artificial Sequence
  Description of Artificial Sequence: Synthetic oligonucleotide
gaacaacacaggacaagg

SEQ ID NO: 11366 - RNA, 18 nt, Artificial Sequence
  Description of Artificial Sequence: Synthetic oligonucleotide
aguuggaacaacacagga

SEQ ID NO: 11367 - RNA, 18 nt, Artificial Sequence
  Description of Artificial Sequence: Synthetic oligonucleotide
auaagaguuggaacaaca

SEQ ID NO: 11368 - RNA, 18 nt, Artificial Sequence
  Description of Artificial Sequence: Synthetic oligonucleotide
ggagaauaagaguuggaa

SEQ ID NO: 11369 - RNA, 18 nt, Artificial Sequence
  Description of Artificial Sequence: Synthetic oligonucleotide
aaauuggagaauaagagu

SEQ ID NO: 11370 - RNA, 18 nt, Artificial Sequence
  Description of Artificial Sequence: Synthetic oligonucleotide
cuucuaaauuggagaaua

SEQ ID NO: 11371 - RNA, 18 nt, Artificial Sequence
  Description of Artificial Sequence: Synthetic oligonucleotide
guuugcuucuaaauugga

SEQ ID NO: 11372 - RNA, 18 nt, Artificial Sequence
  Description of Artificial Sequence: Synthetic oligonucleotide
uauuuguuugcuucuaaa

SEQ ID NO: 11373 - RNA, 18 nt, Artificial Sequence
  Description of Artificial Sequence: Synthetic oligonucleotide
ucauuuauuuguuugcuu

SEQ ID NO: 11374 - RNA, 18 nt, Artificial Sequence
  Description of Artificial Sequence: Synthetic oligonucleotide
uucauucauuuauuuguu

SEQ ID NO: 11375 - RNA, 18 nt, Artificial Sequence
  Description of Artificial Sequence: Synthetic oligonucleotide
guucuuucauucauuuau

SEQ ID NO: 11376 - RNA, 18 nt, Artificial Sequence
  Description of Artificial Sequence: Synthetic oligonucleotide
uaucuguucuuucauuca

SEQ ID NO: 11377 - RNA, 18 nt, Artificial Sequence
  Description of Artificial Sequence: Synthetic oligonucleotide
uugucuaucuguucuuuc

SEQ ID NO: 11378 - RNA, 18 nt, Artificial Sequence
  Description of Artificial Sequence: Synthetic oligonucleotide
uucauuugucuaucuguu

SEQ ID NO: 11379 - RNA, 18 nt, Artificial Sequence
  Description of Artificial Sequence: Synthetic oligonucleotide
gacuauucauuugucuau

SEQ ID NO: 11380 - RNA, 18 nt, Artificial Sequence
  Description of Artificial Sequence: Synthetic oligonucleotide
ccuuugacuauucauuug

SEQ ID NO: 11381 - RNA, 18 nt, Artificial Sequence
  Description of Artificial Sequence: Synthetic oligonucleotide
uuauaccuuugacuauuc

SEQ ID NO: 11382 - RNA, 18 nt, Artificial Sequence
  Description of Artificial Sequence: Synthetic oligonucleotide
auacuuuauaccuuugac

SEQ ID NO: 11383 - RNA, 18 nt, Artificial Sequence
  Description of Artificial Sequence: Synthetic oligonucleotide
uacagauacuuuauaccu

SEQ ID NO: 11384 - RNA, 18 nt, Artificial Sequence
  Description of Artificial Sequence: Synthetic oligonucleotide
auauauacagauacuuua

SEQ ID NO: 11385 - RNA, 18 nt, Artificial Sequence
  Description of Artificial Sequence: Synthetic oligonucleotide
guaacauauauacagaua

SEQ ID NO: 11386 - RNA, 18 nt, Artificial Sequence
  Description of Artificial Sequence: Synthetic oligonucleotide
ugagaccuugucugaaaa

SEQ ID NO: 11387 - RNA, 18 nt, Artificial Sequence
  Description of Artificial Sequence: Synthetic oligonucleotide
caaagugagaccuugucu

SEQ ID NO: 11388 - RNA, 18 nt, Artificial Sequence
  Description of Artificial Sequence: Synthetic oligonucleotide
ggugacaaagugagaccu

SEQ ID NO: 11389 - RNA, 18 nt, Artificial Sequence
  Description of Artificial Sequence: Synthetic oligonucleotide
gccugggugacaaaguga

SEQ ID NO: 11390 - RNA, 18 nt, Artificial Sequence
  Description of Artificial Sequence: Synthetic oligonucleotide
cuccagccugggugacaa

SEQ ID NO: 11391 - RNA, 18 nt, Artificial Sequence
  Description of Artificial Sequence: Synthetic oligonucleotide
guguacuccagccugggu

SEQ ID NO: 11392 - RNA, 18 nt, Artificial Sequence
  Description of Artificial Sequence: Synthetic oligonucleotide
uaccaguguacuccagcc

SEQ ID NO: 11393 - RNA, 18 nt, Artificial Sequence
  Description of Artificial Sequence: Synthetic oligonucleotide
gaucguaccaguguacuc

SEQ ID NO: 11394 - RNA, 18 nt, Artificial Sequence
  Description of Artificial Sequence: Synthetic oligonucleotide
guugugaucguaccagug

SEQ ID NO: 11395 - RNA, 18 nt, Artificial Sequence
  Description of Artificial Sequence: Synthetic oligonucleotide
agugaguugugaucguac

SEQ ID NO: 11396 - RNA, 18 nt, Artificial Sequence
  Description of Artificial Sequence: Synthetic oligonucleotide
gcugcagugaguugugau

SEQ ID NO: 11397 - RNA, 18 nt, Artificial Sequence
  Description of Artificial Sequence: Synthetic oligonucleotide
uagaggcugcagugaguu

SEQ ID NO: 11398 - RNA, 18 nt, Artificial Sequence
  Description of Artificial Sequence: Synthetic oligonucleotide
ggccauagaggcugcagu

SEQ ID NO: 11399 - RNA, 18 nt, Artificial Sequence
  Description of Artificial Sequence: Synthetic oligonucleotide
gccugggccauagaggcu

SEQ ID NO: 11400 - RNA, 18 nt, Artificial Sequence
  Description of Artificial Sequence: Synthetic oligonucleotide
cuugagccugggccauag

SEQ ID NO: 11401 - RNA, 18 nt, Artificial Sequence
  Description of Artificial Sequence: Synthetic oligonucleotide
gauugcuugagccugggc

SEQ ID NO: 11402 - RNA, 18 nt, Artificial Sequence
  Description of Artificial Sequence: Synthetic oligonucleotide
ucgggaggcugagguggg

SEQ ID NO: 11403 - RNA, 18 nt, Artificial Sequence
  Description of Artificial Sequence: Synthetic oligonucleotide
gcuacucgggaggcugag

SEQ ID NO: 11404 - RNA, 18 nt, Artificial Sequence
  Description of Artificial Sequence: Synthetic oligonucleotide
ucccagcuacucgggagg

SEQ ID NO: 11405 - RNA, 18 nt, Artificial Sequence
  Description of Artificial Sequence: Synthetic oligonucleotide
uguggucccagcuacucg

SEQ ID NO: 11406 - RNA, 18 nt, Artificial Sequence
  Description of Artificial Sequence: Synthetic oligonucleotide
gugccuguggucccagcu

SEQ ID NO: 11407 - RNA, 18 nt, Artificial Sequence
  Description of Artificial Sequence: Synthetic oligonucleotide
agcgugugccuguggucc

SEQ ID NO: 11408 - RNA, 18 nt, Artificial Sequence
  Description of Artificial Sequence: Synthetic oligonucleotide
augguagcgugugccugu

SEQ ID NO: 11409 - RNA, 18 nt, Artificial Sequence
  Description of Artificial Sequence: Synthetic oligonucleotide
ugggcaugguagcgugug

SEQ ID NO: 11410 - RNA, 18 nt, Artificial Sequence
  Description of Artificial Sequence: Synthetic oligonucleotide
uuaucugggcaugguagc

SEQ ID NO: 11411 - RNA, 18 nt, Artificial Sequence
  Description of Artificial Sequence: Synthetic oligonucleotide
uaaaauuaucugggcaug

SEQ ID NO: 11412 - RNA, 18 nt, Artificial Sequence
  Description of Artificial Sequence: Synthetic oligonucleotide
aauaauaaaauuaucugg

SEQ ID NO: 11413 - RNA, 18 nt, Artificial Sequence
  Description of Artificial Sequence: Synthetic oligonucleotide
aaauuaauaauaaaauua

SEQ ID NO: 11414 - RNA, 18 nt, Artificial Sequence
  Description of Artificial Sequence: Synthetic oligonucleotide
uacaaaaauuaauaauaa

SEQ ID NO: 11415 - RNA, 18 nt, Artificial Sequence
  Description of Artificial Sequence: Synthetic oligonucleotide
cucuauacaaaaauuaau

SEQ ID NO: 11416 - RNA, 18 nt, Artificial Sequence
  Description of Artificial Sequence: Synthetic oligonucleotide
cccaucucuauacaaaaa

SEQ ID NO: 11417 - RNA, 18 nt, Artificial Sequence
  Description of Artificial Sequence: Synthetic oligonucleotide
gagaccccaucucuauac

SEQ ID NO: 11418 - RNA, 18 nt, Artificial Sequence
  Description of Artificial Sequence: Synthetic oligonucleotide
acagggagaccccaucuc

SEQ ID NO: 11419 - RNA, 18 nt, Artificial Sequence
  Description of Artificial Sequence: Synthetic oligonucleotide
gcaacacagggagacccc

SEQ ID NO: 11420 - RNA, 18 nt, Artificial Sequence
  Description of Artificial Sequence: Synthetic oligonucleotide
ccugggcaacacagggag

SEQ ID NO: 11421 - RNA, 18 nt, Artificial Sequence
  Description of Artificial Sequence: Synthetic oligonucleotide
gaaagccugggcaacaca

SEQ ID NO: 11422 - RNA, 18 nt, Artificial Sequence
  Description of Artificial Sequence: Synthetic oligonucleotide
uucaagaaagccugggca

SEQ ID NO: 11423 - RNA, 18 nt, Artificial Sequence
  Description of Artificial Sequence: Synthetic oligonucleotide
uggaguucaagaaagccu

SEQ ID NO: 11424 - RNA, 18 nt, Artificial Sequence
  Description of Artificial Sequence: Synthetic oligonucleotide
agcccuggaguucaagaa

SEQ ID NO: 11425 - RNA, 18 nt, Artificial Sequence
  Description of Artificial Sequence: Synthetic oligonucleotide
acuugagcccuggaguuc

SEQ ID NO: 11426 - RNA, 18 nt, Artificial Sequence
  Description of Artificial Sequence: Synthetic oligonucleotide
ggaucacuugagcccugg

SEQ ID NO: 11427 - RNA, 18 nt, Artificial Sequence
  Description of Artificial Sequence: Synthetic oligonucleotide
ugggaggaucacuugagc

SEQ ID NO: 11428 - RNA, 18 nt, Artificial Sequence
  Description of Artificial Sequence: Synthetic oligonucleotide
ugaggugggaggaucacu

SEQ ID NO: 11429 - RNA, 18 nt, Artificial Sequence
  Description of Artificial Sequence: Synthetic oligonucleotide
gagguugaggugggagga

SEQ ID NO: 11430 - RNA, 18 nt, Artificial Sequence
  Description of Artificial Sequence: Synthetic oligonucleotide
uuugggagguugaggugg

SEQ ID NO: 11431 - RNA, 18 nt, Artificial Sequence
  Description of Artificial Sequence: Synthetic oligonucleotide
aacacuuugggagguuga

SEQ ID NO: 11432 - RNA, 18 nt, Artificial Sequence
  Description of Artificial Sequence: Synthetic oligonucleotide
aucccaacacuuugggag

SEQ ID NO: 11433 - RNA, 18 nt, Artificial Sequence
  Description of Artificial Sequence: Synthetic oligonucleotide
cuguaaucccaacacuuu

SEQ ID NO: 11434 - RNA, 18 nt, Artificial Sequence
  Description of Artificial Sequence: Synthetic oligonucleotide
cacgccuguaaucccaac

SEQ ID NO: 11435 - RNA, 18 nt, Artificial Sequence
  Description of Artificial Sequence: Synthetic oligonucleotide
uggcucacgccuguaauc

SEQ ID NO: 11436 - RNA, 18 nt, Artificial Sequence
  Description of Artificial Sequence: Synthetic oligonucleotide
caugguggcucacgccug

SEQ ID NO: 11437 - RNA, 18 nt, Artificial Sequence
  Description of Artificial Sequence: Synthetic oligonucleotide
cugggcaugguggcucac

SEQ ID NO: 11438 - RNA, 18 nt, Artificial Sequence
  Description of Artificial Sequence: Synthetic oligonucleotide
uaaggcugggcauggugg

SEQ ID NO: 11439 - RNA, 18 nt, Artificial Sequence
  Description of Artificial Sequence: Synthetic oligonucleotide
acucuuaaggcugggcau

SEQ ID NO: 11440 - RNA, 18 nt, Artificial Sequence
  Description of Artificial Sequence: Synthetic oligonucleotide
caaacacucuuaaggcug

SEQ ID NO: 11441 - RNA, 18 nt, Artificial Sequence
  Description of Artificial Sequence: Synthetic oligonucleotide
aaaaucaaacacucuuaa

SEQ ID NO: 11442 - RNA, 18 nt, Artificial Sequence
  Description of Artificial Sequence: Synthetic oligonucleotide
gaaugaaaaucaaacacu

SEQ ID NO: 11443 - RNA, 18 nt, Artificial Sequence
  Description of Artificial Sequence: Synthetic oligonucleotide
aaaaugaaugaaaaucaa

SEQ ID NO: 11444 - RNA, 18 nt, Artificial Sequence
  Description of Artificial Sequence: Synthetic oligonucleotide
auaggaaaaugaaugaaa

SEQ ID NO: 11445 - RNA, 18 nt, Artificial Sequence
  Description of Artificial Sequence: Synthetic oligonucleotide
uauauauaggaaaaugaa

SEQ ID NO: 11446 - RNA, 18 nt, Artificial Sequence
  Description of Artificial Sequence: Synthetic oligonucleotide
aauaauauauauaggaaa

SEQ ID NO: 11447 - RNA, 18 nt, Artificial Sequence
  Description of Artificial Sequence: Synthetic oligonucleotide
acagaaauaauauauaua

SEQ ID NO: 11448 - RNA, 18 nt, Artificial Sequence
  Description of Artificial Sequence: Synthetic oligonucleotide
ccccaacagaaauaauau

SEQ ID NO: 11449 - RNA, 18 nt, Artificial Sequence
  Description of Artificial Sequence: Synthetic oligonucleotide
uuuuuccccaacagaaau

SEQ ID NO: 11450 - RNA, 18 nt, Artificial Sequence
  Description of Artificial Sequence: Synthetic oligonucleotide
ggaauuuuuuccccaaca

SEQ ID NO: 11451 - RNA, 18 nt, Artificial Sequence
  Description of Artificial Sequence: Synthetic oligonucleotide
uccuuggaauuuuuuccc

SEQ ID NO: 11452 - RNA, 18 nt, Artificial Sequence
  Description of Artificial Sequence: Synthetic oligonucleotide
uaucuuccuuggaauuuu

SEQ ID NO: 11453 - RNA, 18 nt, Artificial Sequence
  Description of Artificial Sequence: Synthetic oligonucleotide
cuauuuaucuuccuugga

SEQ ID NO: 11454 - RNA, 18 nt, Artificial Sequence
  Description of Artificial Sequence: Synthetic oligonucleotide
gccuacuauuuaucuucc

SEQ ID NO: 11455 - RNA, 18 nt, Artificial Sequence
  Description of Artificial Sequence: Synthetic oligonucleotide
caacagccuacuauuuau

SEQ ID NO: 11456 - RNA, 18 nt, Artificial Sequence
  Description of Artificial Sequence: Synthetic oligonucleotide
uguaccaacagccuacua

SEQ ID NO: 11457 - RNA, 18 nt, Artificial Sequence
  Description of Artificial Sequence: Synthetic oligonucleotide
agaaauguaccaacagcc

SEQ ID NO: 11458 - RNA, 18 nt, Artificial Sequence
  Description of Artificial Sequence: Synthetic oligonucleotide
aguugagaaauguaccaa

SEQ ID NO: 11459 - RNA, 18 nt, Artificial Sequence
  Description of Artificial Sequence: Synthetic oligonucleotide
aaguaaguugagaaaugu

SEQ ID NO: 11460 - RNA, 18 nt, Artificial Sequence
  Description of Artificial Sequence: Synthetic oligonucleotide
uuuauaaguaaguugaga

SEQ ID NO: 11461 - RNA, 18 nt, Artificial Sequence
  Description of Artificial Sequence: Synthetic oligonucleotide
aaagcuuuauaaguaagu

SEQ ID NO: 11462 - RNA, 18 nt, Artificial Sequence
  Description of Artificial Sequence: Synthetic oligonucleotide
ucuaaaaagcuuuauaag

SEQ ID NO: 11463 - RNA, 18 nt, Artificial Sequence
  Description of Artificial Sequence: Synthetic oligonucleotide
auauaucuaaaaagcuuu

SEQ ID NO: 11464 - RNA, 18 nt, Artificial Sequence
  Description of Artificial Sequence: Synthetic oligonucleotide
accuuauauaucuaaaaa

SEQ ID NO: 11465 - RNA, 18 nt, Artificial Sequence
  Description of Artificial Sequence: Synthetic oligonucleotide
aauuaaccuuauauaucu

SEQ ID NO: 11466 - RNA, 18 nt, Artificial Sequence
  Description of Artificial Sequence: Synthetic oligonucleotide
ucauaaauuaaccuuaua

SEQ ID NO: 11467 - RNA, 18 nt, Artificial Sequence
  Description of Artificial Sequence: Synthetic oligonucleotide
uuucuucauaaauuaacc

SEQ ID NO: 11468 - RNA, 18 nt, Artificial Sequence
  Description of Artificial Sequence: Synthetic oligonucleotide
augauuuucuucauaaau

SEQ ID NO: 11469 - RNA, 18 nt, Artificial Sequence
  Description of Artificial Sequence: Synthetic oligonucleotide
aucuuaugauuuucuuca

SEQ ID NO: 11470 - RNA, 18 nt, Artificial Sequence
  Description of Artificial Sequence: Synthetic oligonucleotide
uguguaucuuaugauuuu

SEQ ID NO: 11471 - RNA, 18 nt, Artificial Sequence
  Description of Artificial Sequence: Synthetic oligonucleotide
uaaauuguguaucuuaug

SEQ ID NO: 11472 - RNA, 18 nt, Artificial Sequence
  Description of Artificial Sequence: Synthetic oligonucleotide
uaucuuaaauuguguauc

SEQ ID NO: 11473 - RNA, 18 nt, Artificial Sequence
  Description of Artificial Sequence: Synthetic oligonucleotide
aauauuaucuuaaauugu

SEQ ID NO: 11474 - RNA, 18 nt, Artificial Sequence
  Description of Artificial Sequence: Synthetic oligonucleotide
uuaaaaauauuaucuuaa

SEQ ID NO: 11475 - RNA, 18 nt, Artificial Sequence
  Description of Artificial Sequence: Synthetic oligonucleotide
uaaaauuaaaaauauuau

SEQ ID NO: 11476 - RNA, 18 nt, Artificial Sequence
  Description of Artificial Sequence: Synthetic oligonucleotide
aaaaauaaaauuaaaaau

SEQ ID NO: 11477 - RNA, 18 nt, Artificial Sequence
  Description of Artificial Sequence: Synthetic oligonucleotide
aaauaaaaaauaaaauua

SEQ ID NO: 11478 - RNA, 18 nt, Artificial Sequence
  Description of Artificial Sequence: Synthetic oligonucleotide
uuaacaaauaaaaaauaa

SEQ ID NO: 11479 - RNA, 18 nt, Artificial Sequence
  Description of Artificial Sequence: Synthetic oligonucleotide
uuuauuuaacaaauaaaa

SEQ ID NO: 11480 - RNA, 18 nt, Artificial Sequence
  Description of Artificial Sequence: Synthetic oligonucleotide
aaauuucaagacgugaca

SEQ ID NO: 11481 - RNA, 18 nt, Artificial Sequence
  Description of Artificial Sequence: Synthetic oligonucleotide
auuuaaaauuucaagacg

SEQ ID NO: 11482 - RNA, 18 nt, Artificial Sequence
  Description of Artificial Sequence: Synthetic oligonucleotide
aggacauuuaaaauuuca

SEQ ID NO: 11483 - RNA, 18 nt, Artificial Sequence
  Description of Artificial Sequence: Synthetic oligonucleotide
cacugaggacauuuaaaa

SEQ ID NO: 11484 - RNA, 18 nt, Artificial Sequence
  Description of Artificial Sequence: Synthetic oligonucleotide
agagucacugaggacauu

SEQ ID NO: 11485 - RNA, 18 nt, Artificial Sequence
  Description of Artificial Sequence: Synthetic oligonucleotide
gguagagagucacugagg

SEQ ID NO: 11486 - RNA, 18 nt, Artificial Sequence
  Description of Artificial Sequence: Synthetic oligonucleotide
ccagagguagagagucac

SEQ ID NO: 11487 - RNA, 18 nt, Artificial Sequence
  Description of Artificial Sequence: Synthetic oligonucleotide
aucugccagagguagaga

SEQ ID NO: 11488 - RNA, 18 nt, Artificial Sequence
  Description of Artificial Sequence: Synthetic oligonucleotide
acaucaucugccagaggu

SEQ ID NO: 11489 - RNA, 18 nt, Artificial Sequence
  Description of Artificial Sequence: Synthetic oligonucleotide
ggucaacaucaucugcca

SEQ ID NO: 11490 - RNA, 18 nt, Artificial Sequence
  Description of Artificial Sequence: Synthetic oligonucleotide
cugaaggucaacaucauc

SEQ ID NO: 11491 - RNA, 18 nt, Artificial Sequence
  Description of Artificial Sequence: Synthetic oligonucleotide
acaugcugaaggucaaca

SEQ ID NO: 11492 - RNA, 18 nt, Artificial Sequence
  Description of Artificial Sequence: Synthetic oligonucleotide
augcuacaugcugaaggu

SEQ ID NO: 11493 - RNA, 18 nt, Artificial Sequence
  Description of Artificial Sequence: Synthetic oligonucleotide
uacugaugcuacaugcug

SEQ ID NO: 11494 - RNA, 18 nt, Artificial Sequence
  Description of Artificial Sequence: Synthetic oligonucleotide
ucaguuacugaugcuaca

SEQ ID NO: 11495 - RNA, 18 nt, Artificial Sequence
  Description of Artificial Sequence: Synthetic oligonucleotide
aggagucaguuacugaug

SEQ ID NO: 11496 - RNA, 18 nt, Artificial Sequence
  Description of Artificial Sequence: Synthetic oligonucleotide
aguaaaggagucaguuac

SEQ ID NO: 11497 - RNA, 18 nt, Artificial Sequence
  Description of Artificial Sequence: Synthetic oligonucleotide
gcuccaguaaaggaguca

SEQ ID NO: 11498 - RNA, 18 nt, Artificial Sequence
  Description of Artificial Sequence: Synthetic oligonucleotide
gaucagcuccaguaaagg

SEQ ID NO: 11499 - RNA, 18 nt, Artificial Sequence
  Description of Artificial Sequence: Synthetic oligonucleotide
uuucagaucagcuccagu

SEQ ID NO: 11500 - RNA, 18 nt, Artificial Sequence
  Description of Artificial Sequence: Synthetic oligonucleotide
aaagcuuucagaucagcu

SEQ ID NO: 11501 - RNA, 18 nt, Artificial Sequence
  Description of Artificial Sequence: Synthetic oligonucleotide
aaaguaaagcuuucagau

SEQ ID NO: 11502 - RNA, 18 nt, Artificial Sequence
  Description of Artificial Sequence: Synthetic oligonucleotide
auuguaaaguaaagcuuu

SEQ ID NO: 11503 - RNA, 18 nt, Artificial Sequence
  Description of Artificial Sequence: Synthetic oligonucleotide
ugggcauuguaaaguaaa

SEQ ID NO: 11504 - RNA, 18 nt, Artificial Sequence
  Description of Artificial Sequence: Synthetic oligonucleotide
ccaauugggcauuguaaa

SEQ ID NO: 11505 - RNA, 18 nt, Artificial Sequence
  Description of Artificial Sequence: Synthetic oligonucleotide
ggccuccaauugggcauu

SEQ ID NO: 11506 - RNA, 18 nt, Artificial Sequence
  Description of Artificial Sequence: Synthetic oligonucleotide
uguaaggccuccaauugg

SEQ ID NO: 11507 - RNA, 18 nt, Artificial Sequence
  Description of Artificial Sequence: Synthetic oligonucleotide
uuccauguaaggccucca

SEQ ID NO: 11508 - RNA, 18 nt, Artificial Sequence
  Description of Artificial Sequence: Synthetic oligonucleotide
cagcauuccauguaaggc

SEQ ID NO: 11509 - RNA, 18 nt, Artificial Sequence
  Description of Artificial Sequence: Synthetic oligonucleotide
gagagcagcauuccaugu

SEQ ID NO: 11510 - RNA, 18 nt, Artificial Sequence
  Description of Artificial Sequence: Synthetic oligonucleotide
cacucgagagcagcauuc

SEQ ID NO: 11511 - RNA, 18 nt, Artificial Sequence
  Description of Artificial Sequence: Synthetic oligonucleotide
gaguccacucgagagcag

SEQ ID NO: 11512 - RNA, 18 nt, Artificial Sequence
  Description of Artificial Sequence: Synthetic oligonucleotide
agagcuggaacuuccauc

SEQ ID NO: 11513 - RNA, 18 nt, Artificial Sequence
  Description of Artificial Sequence: Synthetic oligonucleotide
cuaucagagcuggaacuu

SEQ ID NO: 11514 - RNA, 18 nt, Artificial Sequence
  Description of Artificial Sequence: Synthetic oligonucleotide
ggucacuaucagagcugg

SEQ ID NO: 11515 - RNA, 18 nt, Artificial Sequence
  Description of Artificial Sequence: Synthetic oligonucleotide
acuuaggucacuaucaga

SEQ ID NO: 11516 - RNA, 18 nt, Artificial Sequence
  Description of Artificial Sequence: Synthetic oligonucleotide
gacagacuuaggucacua

SEQ ID NO: 11517 - RNA, 18 nt, Artificial Sequence
  Description of Artificial Sequence: Synthetic oligonucleotide
uugaagacagacuuaggu

SEQ ID NO: 11518 - RNA, 18 nt, Artificial Sequence
  Description of Artificial Sequence: Synthetic oligonucleotide
gaccauugaagacagacu

SEQ ID NO: 11519 - RNA, 18 nt, Artificial Sequence
  Description of Artificial Sequence: Synthetic oligonucleotide
agaaagaccauugaagac

SEQ ID NO: 11520 - RNA, 18 nt, Artificial Sequence
  Description of Artificial Sequence: Synthetic oligonucleotide
gguuaagaaagaccauug

SEQ ID NO: 11521 - RNA, 18 nt, Artificial Sequence
  Description of Artificial Sequence: Synthetic oligonucleotide
gcuaugguuaagaaagac

SEQ ID NO: 11522 - RNA, 18 nt, Artificial Sequence
  Description of Artificial Sequence: Synthetic oligonucleotide
ccacugcuaugguuaaga

SEQ ID NO: 11523 - RNA, 18 nt, Artificial Sequence
  Description of Artificial Sequence: Synthetic oligonucleotide
cagagccacugcuauggu

SEQ ID NO: 11524 - RNA, 18 nt, Artificial Sequence
  Description of Artificial Sequence: Synthetic oligonucleotide
aucgucagagccacugcu

SEQ ID NO: 11525 - RNA, 18 nt, Artificial Sequence
  Description of Artificial Sequence: Synthetic oligonucleotide
gcugaaucgucagagcca

SEQ ID NO: 11526 - RNA, 18 nt, Artificial Sequence
  Description of Artificial Sequence: Synthetic oligonucleotide
cuccagcugaaucgucag

SEQ ID NO: 11527 - RNA, 18 nt, Artificial Sequence
  Description of Artificial Sequence: Synthetic oligonucleotide
uccaucuccagcugaauc

SEQ ID NO: 11528 - RNA, 18 nt, Artificial Sequence
  Description of Artificial Sequence: Synthetic oligonucleotide
cauucuccaucuccagcu

SEQ ID NO: 11529 - RNA, 18 nt, Artificial Sequence
  Description of Artificial Sequence: Synthetic oligonucleotide
agccacauucuccaucuc

SEQ ID NO: 11530 - RNA, 18 nt, Artificial Sequence
  Description of Artificial Sequence: Synthetic oligonucleotide
aucuaagccacauucucc

SEQ ID NO: 11531 - RNA, 18 nt, Artificial Sequence
  Description of Artificial Sequence: Synthetic oligonucleotide
gacugaucuaagccacau

SEQ ID NO: 11532 - RNA, 18 nt, Artificial Sequence
  Description of Artificial Sequence: Synthetic oligonucleotide
caagggacugaucuaagc

SEQ ID NO: 11533 - RNA, 18 nt, Artificial Sequence
  Description of Artificial Sequence: Synthetic oligonucleotide
agaaacaagggacugauc

SEQ ID NO: 11534 - RNA, 18 nt, Artificial Sequence
  Description of Artificial Sequence: Synthetic oligonucleotide
ucuaaagaaacaagggac

SEQ ID NO: 11535 - RNA, 18 nt, Artificial Sequence
  Description of Artificial Sequence: Synthetic oligonucleotide
acaucucuaaagaaacaa

SEQ ID NO: 11536 - RNA, 18 nt, Artificial Sequence
  Description of Artificial Sequence: Synthetic oligonucleotide
cucggacaucucuaaaga

SEQ ID NO: 11537 - RNA, 18 nt, Artificial Sequence
  Description of Artificial Sequence: Synthetic oligonucleotide
aggaucucggacaucucu

SEQ ID NO: 11538 - RNA, 18 nt, Artificial Sequence
  Description of Artificial Sequence: Synthetic oligonucleotide
cuggaaggaucucggaca

SEQ ID NO: 11539 - RNA, 18 nt, Artificial Sequence
  Description of Artificial Sequence: Synthetic oligonucleotide
uucaucuggaaggaucuc

SEQ ID NO: 11540 - RNA, 18 nt, Artificial Sequence
  Description of Artificial Sequence: Synthetic oligonucleotide
uuugauucaucuggaagg

SEQ ID NO: 11541 - RNA, 18 nt, Artificial Sequence
  Description of Artificial Sequence: Synthetic oligonucleotide
ugaauuuugauucaucug

SEQ ID NO: 11542 - RNA, 18 nt, Artificial Sequence
  Description of Artificial Sequence: Synthetic oligonucleotide
cauauugaauuuugauuc

SEQ ID NO: 11543 - RNA, 18 nt, Artificial Sequence
  Description of Artificial Sequence: Synthetic oligonucleotide
cgguacauauugaauuuu

SEQ ID NO: 11544 - RNA, 18 nt, Artificial Sequence
  Description of Artificial Sequence: Synthetic oligonucleotide
agagccgguacauauuga

SEQ ID NO: 11545 - RNA, 18 nt, Artificial Sequence
  Description of Artificial Sequence: Synthetic oligonucleotide
aaaguagagccgguacau

SEQ ID NO: 11546 - RNA, 18 nt, Artificial Sequence
  Description of Artificial Sequence: Synthetic oligonucleotide
cuuccaaaguagagccgg

SEQ ID NO: 11547 - RNA, 18 nt, Artificial Sequence
  Description of Artificial Sequence: Synthetic oligonucleotide
aagagcuuccaaaguaga

SEQ ID NO: 11548 - RNA, 18 nt, Artificial Sequence
  Description of Artificial Sequence: Synthetic oligonucleotide
uucauaagagcuuccaaa

SEQ ID NO: 11549 - RNA, 18 nt, Artificial Sequence
  Description of Artificial Sequence: Synthetic oligonucleotide
ucugauucauaagagcuu

SEQ ID NO: 11550 - RNA, 18 nt, Artificial Sequence
  Description of Artificial Sequence: Synthetic oligonucleotide
caaguucugauucauaag

SEQ ID NO: 11551 - RNA, 18 nt, Artificial Sequence
  Description of Artificial Sequence: Synthetic oligonucleotide
auuuccaaguucugauuc

SEQ ID NO: 11552 - RNA, 18 nt, Artificial Sequence
  Description of Artificial Sequence: Synthetic oligonucleotide
guuccauuuccaaguucu

SEQ ID NO: 11553 - RNA, 18 nt, Artificial Sequence
  Description of Artificial Sequence: Synthetic oligonucleotide
aagagguuccauuuccaa

SEQ ID NO: 11554 - RNA, 18 nt, Artificial Sequence
  Description of Artificial Sequence: Synthetic oligonucleotide
aucagaagagguuccauu

SEQ ID NO: 11555 - RNA, 18 nt, Artificial Sequence
  Description of Artificial Sequence: Synthetic oligonucleotide
auaaugaugacugcacaa

SEQ ID NO: 11556 - RNA, 18 nt, Artificial Sequence
  Description of Artificial Sequence: Synthetic oligonucleotide
acuguauaaugaugacug

SEQ ID NO: 11557 - RNA, 18 nt, Artificial Sequence
  Description of Artificial Sequence: Synthetic oligonucleotide
ucagaacuguauaaugau

SEQ ID NO: 11558 - RNA, 18 nt, Artificial Sequence
  Description of Artificial Sequence: Synthetic oligonucleotide
auauuucagaacuguaua

SEQ ID NO: 11559 - RNA, 18 nt, Artificial Sequence
  Description of Artificial Sequence: Synthetic oligonucleotide
gcuuuauauuucagaacu

SEQ ID NO: 11560 - RNA, 18 nt, Artificial Sequence
  Description of Artificial Sequence: Synthetic oligonucleotide
auauagcuuuauauuuca

SEQ ID NO: 11561 - RNA, 18 nt, Artificial Sequence
  Description of Artificial Sequence: Synthetic oligonucleotide
ccaacauauagcuuuaua

SEQ ID NO: 11562 - RNA, 18 nt, Artificial Sequence
  Description of Artificial Sequence: Synthetic oligonucleotide
uuacaccaacauauagcu

SEQ ID NO: 11563 - RNA, 18 nt, Artificial Sequence
  Description of Artificial Sequence: Synthetic oligonucleotide
caacuuuacaccaacaua

SEQ ID NO: 11564 - RNA, 18 nt, Artificial Sequence
  Description of Artificial Sequence: Synthetic oligonucleotide
cacugcaacuuuacacca

SEQ ID NO: 11565 - RNA, 18 nt, Artificial Sequence
  Description of Artificial Sequence: Synthetic oligonucleotide
gaaaucacugcaacuuua

SEQ ID NO: 11566 - RNA, 18 nt, Artificial Sequence
  Description of Artificial Sequence: Synthetic oligonucleotide
ggagagaaaucacugcaa

SEQ ID NO: 11567 - RNA, 18 nt, Artificial Sequence
  Description of Artificial Sequence: Synthetic oligonucleotide
gguuaggagagaaaucac

SEQ ID NO: 11568 - RNA, 18 nt, Artificial Sequence
  Description of Artificial Sequence: Synthetic oligonucleotide
gggcugguuaggagagaa

SEQ ID NO: 11569 - RNA, 18 nt, Artificial Sequence
  Description of Artificial Sequence: Synthetic oligonucleotide
ccaaccaggaagaauaug

SEQ ID NO: 11570 - RNA, 18 nt, Artificial Sequence
  Description of Artificial Sequence: Synthetic oligonucleotide
accaaccaaccaggaaga

SEQ ID NO: 11571 - RNA, 18 nt, Artificial Sequence
  Description of Artificial Sequence: Synthetic oligonucleotide
gaagaaccaaccaaccag

SEQ ID NO: 11572 - RNA, 18 nt, Artificial Sequence
  Description of Artificial Sequence: Synthetic oligonucleotide
uuacugaagaaccaacca

SEQ ID NO: 11573 - RNA, 18 nt, Artificial Sequence
  Description of Artificial Sequence: Synthetic oligonucleotide
cuauuuuacugaagaacc

SEQ ID NO: 11574 - RNA, 18 nt, Artificial Sequence
  Description of Artificial Sequence: Synthetic oligonucleotide
caagacuauuuuacugaa

SEQ ID NO: 11575 - RNA, 18 nt, Artificial Sequence
  Description of Artificial Sequence: Synthetic oligonucleotide
agaaacaagacuauuuua

SEQ ID NO: 11576 - RNA, 18 nt, Artificial Sequence
  Description of Artificial Sequence: Synthetic oligonucleotide
aagcaagaaacaagacua

SEQ ID NO: 11577 - RNA, 18 nt, Artificial Sequence
  Description of Artificial Sequence: Synthetic oligonucleotide
aguguaagcaagaaacaa

SEQ ID NO: 11578 - RNA, 18 nt, Artificial Sequence
  Description of Artificial Sequence: Synthetic oligonucleotide
caauuaguguaagcaaga

SEQ ID NO: 11579 - RNA, 18 nt, Artificial Sequence
  Description of Artificial Sequence: Synthetic oligonucleotide
auuaccaauuaguguaag

SEQ ID NO: 11580 - RNA, 18 nt, Artificial Sequence
  Description of Artificial Sequence: Synthetic oligonucleotide
ugcaaauuaccaauuagu

SEQ ID NO: 11581 - RNA, 18 nt, Artificial Sequence
  Description of Artificial Sequence: Synthetic oligonucleotide
aggaaugcaaauuaccaa

SEQ ID NO: 11582 - RNA, 18 nt, Artificial Sequence
  Description of Artificial Sequence: Synthetic oligonucleotide
uaacaaggaaugcaaauu

SEQ ID NO: 11583 - RNA, 18 nt, Artificial Sequence
  Description of Artificial Sequence: Synthetic oligonucleotide
aaucuuaacaaggaaugc

SEQ ID NO: 11584 - RNA, 18 nt, Artificial Sequence
  Description of Artificial Sequence: Synthetic oligonucleotide
uugaaaaucuuaacaagg

SEQ ID NO: 11585 - RNA, 18 nt, Artificial Sequence
  Description of Artificial Sequence: Synthetic oligonucleotide
cugucuugaaaaucuuaa

SEQ ID NO: 11586 - RNA, 18 nt, Artificial Sequence
  Description of Artificial Sequence: Synthetic oligonucleotide
cagcccugucuugaaaau

SEQ ID NO: 11587 - RNA, 18 nt, Artificial Sequence
  Description of Artificial Sequence: Synthetic oligonucleotide
gcucccagcccugucuug

SEQ ID NO: 11588 - RNA, 18 nt, Artificial Sequence
  Description of Artificial Sequence: Synthetic oligonucleotide
uccuugcucccagcccug

SEQ ID NO: 11589 - RNA, 18 nt, Artificial Sequence
  Description of Artificial Sequence: Synthetic oligonucleotide
uugguuccuugcucccag

SEQ ID NO: 11590 - RNA, 18 nt, Artificial Sequence
  Description of Artificial Sequence: Synthetic oligonucleotide
cuacuuugguuccuugcu

SEQ ID NO: 11591 - RNA, 18 nt, Artificial Sequence
  Description of Artificial Sequence: Synthetic oligonucleotide
acgcgcuacuuugguucc

SEQ ID NO: 11592 - RNA, 18 nt, Artificial Sequence
  Description of Artificial Sequence: Synthetic oligonucleotide
caaccacgcgcuacuuug

SEQ ID NO: 11593 - RNA, 18 nt, Artificial Sequence
  Description of Artificial Sequence: Synthetic oligonucleotide
aaucacaaccacgcgcua

SEQ ID NO: 11594 - RNA, 18 nt, Artificial Sequence
  Description of Artificial Sequence: Synthetic oligonucleotide
aagguaaucacaaccacg

SEQ ID NO: 11595 - RNA, 18 nt, Artificial Sequence
  Description of Artificial Sequence: Synthetic oligonucleotide
aaccaaagguaaucacaa

SEQ ID NO: 11596 - RNA, 18 nt, Artificial Sequence
  Description of Artificial Sequence: Synthetic oligonucleotide
aaagaaaccaaagguaau

SEQ ID NO: 11597 - RNA, 18 nt, Artificial Sequence
  Description of Artificial Sequence: Synthetic oligonucleotide
accucaaagaaaccaaag

SEQ ID NO: 11598 - RNA, 18 nt, Artificial Sequence
  Description of Artificial Sequence: Synthetic oligonucleotide
gagaaaccucaaagaaac

SEQ ID NO: 11599 - RNA, 18 nt, Artificial Sequence
  Description of Artificial Sequence: Synthetic oligonucleotide
gguaagagaaaccucaaa

SEQ ID NO: 11600 - RNA, 18 nt, Artificial Sequence
  Description of Artificial Sequence: Synthetic oligonucleotide
cacuagguaagagaaacc

SEQ ID NO: 11601 - RNA, 18 nt, Artificial Sequence
  Description of Artificial Sequence: Synthetic oligonucleotide
aaagccacuagguaagag

SEQ ID NO: 11602 - RNA, 18 nt, Artificial Sequence
  Description of Artificial Sequence: Synthetic oligonucleotide
guuuuaaagccacuaggu

SEQ ID NO: 11603 - RNA, 18 nt, Artificial Sequence
  Description of Artificial Sequence: Synthetic oligonucleotide
aagauguuuuaaagccac

SEQ ID NO: 11604 - RNA, 18 nt, Artificial Sequence
  Description of Artificial Sequence: Synthetic oligonucleotide
uccuaaagauguuuuaaa

SEQ ID NO: 11605 - RNA, 18 nt, Artificial Sequence
  Description of Artificial Sequence: Synthetic oligonucleotide
acugcuccuaaagauguu

SEQ ID NO: 11606 - RNA, 18 nt, Artificial Sequence
  Description of Artificial Sequence: Synthetic oligonucleotide
auggaacugcuccuaaag

SEQ ID NO: 11607 - RNA, 18 nt, Artificial Sequence
  Description of Artificial Sequence: Synthetic oligonucleotide
auaaaauggaacugcucc

SEQ ID NO: 11608 - RNA, 18 nt, Artificial Sequence
  Description of Artificial Sequence: Synthetic oligonucleotide
uuacuauaaaauggaacu

SEQ ID NO: 11609 - RNA, 18 nt, Artificial Sequence
  Description of Artificial Sequence: Synthetic oligonucleotide
uaaguuuacuauaaaaug

SEQ ID NO: 11610 - RNA, 18 nt, Artificial Sequence
  Description of Artificial Sequence: Synthetic oligonucleotide
gaauuuaaguuuacuaua

SEQ ID NO: 11611 - RNA, 18 nt, Artificial Sequence
  Description of Artificial Sequence: Synthetic oligonucleotide
uaacagaauuuaaguuua

SEQ ID NO: 11612 - RNA, 18 nt, Artificial Sequence
  Description of Artificial Sequence: Synthetic oligonucleotide
caugauaacagaauuuaa

SEQ ID NO: 11613 - RNA, 18 nt, Artificial Sequence
  Description of Artificial Sequence: Synthetic oligonucleotide
cuguucaugauaacagaa

SEQ ID NO: 11614 - RNA, 18 nt, Artificial Sequence
  Description of Artificial Sequence: Synthetic oligonucleotide
cucaacuguucaugauaa

SEQ ID NO: 11615 - RNA, 18 nt, Artificial Sequence
  Description of Artificial Sequence: Synthetic oligonucleotide
uuauccucaacuguucau

SEQ ID NO: 11616 - RNA, 18 nt, Artificial Sequence
  Description of Artificial Sequence: Synthetic oligonucleotide
auucauuauccucaacug

SEQ ID NO: 11617 - RNA, 18 nt, Artificial Sequence
  Description of Artificial Sequence: Synthetic oligonucleotide
aaauuauucauuauccuc

SEQ ID NO: 11618 - RNA, 18 nt, Artificial Sequence
  Description of Artificial Sequence: Synthetic oligonucleotide
guaucaaauuauucauua

SEQ ID NO: 11619 - RNA, 18 nt, Artificial Sequence
  Description of Artificial Sequence: Synthetic oligonucleotide
uuauuguaucaaauuauu

SEQ ID NO: 11620 - RNA, 18 nt, Artificial Sequence
  Description of Artificial Sequence: Synthetic oligonucleotide
uuacauuauuguaucaaa

SEQ ID NO: 11621 - RNA, 18 nt, Artificial Sequence
  Description of Artificial Sequence: Synthetic oligonucleotide
auuucuuacauuauugua

SEQ ID NO: 11622 - RNA, 18 nt, Artificial Sequence
  Description of Artificial Sequence: Synthetic oligonucleotide
caggaauuucuuacauua

SEQ ID NO: 11623 - RNA, 18 nt, Artificial Sequence
  Description of Artificial Sequence: Synthetic oligonucleotide
guuuucaggaauuucuua

SEQ ID NO: 11624 - RNA, 18 nt, Artificial Sequence
  Description of Artificial Sequence: Synthetic oligonucleotide
acuuuguuuucaggaauu

SEQ ID NO: 11625 - RNA, 18 nt, Artificial Sequence
  Description of Artificial Sequence: Synthetic oligonucleotide
auaacacuuuguuuucag

SEQ ID NO: 11626 - RNA, 18 nt, Artificial Sequence
  Description of Artificial Sequence: Synthetic oligonucleotide
cacagauaacacuuuguu

SEQ ID NO: 11627 - RNA, 18 nt, Artificial Sequence
  Description of Artificial Sequence: Synthetic oligonucleotide
aguaucacagauaacacu

SEQ ID NO: 11628 - RNA, 18 nt, Artificial Sequence
  Description of Artificial Sequence: Synthetic oligonucleotide
gcaaaaguaucacagaua

SEQ ID NO: 11629 - RNA, 18 nt, Artificial Sequence
  Description of Artificial Sequence: Synthetic oligonucleotide
augcagcaaaaguaucac

SEQ ID NO: 11630 - RNA, 18 nt, Artificial Sequence
  Description of Artificial Sequence: Synthetic oligonucleotide
uuacuaugcagcaaaagu

SEQ ID NO: 11631 - RNA, 18 nt, Artificial Sequence
  Description of Artificial Sequence: Synthetic oligonucleotide
ugugcuuacuaugcagca

SEQ ID NO: 11632 - RNA, 18 nt, Artificial Sequence
  Description of Artificial Sequence: Synthetic oligonucleotide
uucauugugcuuacuaug

SEQ ID NO: 11633 - RNA, 18 nt, Artificial Sequence
  Description of Artificial Sequence: Synthetic oligonucleotide
uacacuucauugugcuua

SEQ ID NO: 11634 - RNA, 18 nt, Artificial Sequence
  Description of Artificial Sequence: Synthetic oligonucleotide
aucaguacacuucauugu

SEQ ID NO: 11635 - RNA, 18 nt, Artificial Sequence
  Description of Artificial Sequence: Synthetic oligonucleotide
acauuaucaguacacuuc

SEQ ID NO: 11636 - RNA, 18 nt, Artificial Sequence
  Description of Artificial Sequence: Synthetic oligonucleotide
uugaaacauuaucaguac

SEQ ID NO: 11637 - RNA, 18 nt, Artificial Sequence
  Description of Artificial Sequence: Synthetic oligonucleotide
uccuguugaaacauuauc

SEQ ID NO: 11638 - RNA, 18 nt, Artificial Sequence
  Description of Artificial Sequence: Synthetic oligonucleotide
cacuuuccuguugaaaca

SEQ ID NO: 11639 - RNA, 18 nt, Artificial Sequence
  Description of Artificial Sequence: Synthetic oligonucleotide
caaaacacuuuccuguug

SEQ ID NO: 11640 - RNA, 18 nt, Artificial Sequence
  Description of Artificial Sequence: Synthetic oligonucleotide
uuaaucaaaacacuuucc

SEQ ID NO: 11641 - RNA, 18 nt, Artificial Sequence
  Description of Artificial Sequence: Synthetic oligonucleotide
cacauuuaaucaaaacac

SEQ ID NO: 11642 - RNA, 18 nt, Artificial Sequence
  Description of Artificial Sequence: Synthetic oligonucleotide
cugcccacauuuaaucaa

SEQ ID NO: 11643 - RNA, 18 nt, Artificial Sequence
  Description of Artificial Sequence: Synthetic oligonucleotide
ugauacugcccacauuua

SEQ ID NO: 11644 - RNA, 18 nt, Artificial Sequence
  Description of Artificial Sequence: Synthetic oligonucleotide
aacagugauacugcccac

SEQ ID NO: 11645 - RNA, 18 nt, Artificial Sequence
  Description of Artificial Sequence: Synthetic oligonucleotide
aguagaacagugauacug

SEQ ID NO: 11646 - RNA, 18 nt, Artificial Sequence
  Description of Artificial Sequence: Synthetic oligonucleotide
augcuaguagaacaguga

SEQ ID NO: 11647 - RNA, 18 nt, Artificial Sequence
  Description of Artificial Sequence: Synthetic oligonucleotide
guugaaugcuaguagaac

SEQ ID NO: 11648 - RNA, 18 nt, Artificial Sequence
  Description of Artificial Sequence: Synthetic oligonucleotide
gagauguugaaugcuagu

SEQ ID NO: 11649 - RNA, 18 nt, Artificial Sequence
  Description of Artificial Sequence: Synthetic oligonucleotide
uagaagagauguugaaug

SEQ ID NO: 11650 - RNA, 18 nt, Artificial Sequence
  Description of Artificial Sequence: Synthetic oligonucleotide
auuuuuagaagagauguu

SEQ ID NO: 11651 - RNA, 18 nt, Artificial Sequence
  Description of Artificial Sequence: Synthetic oligonucleotide
gcagauagcuugagccca

SEQ ID NO: 11652 - RNA, 18 nt, Artificial Sequence
  Description of Artificial Sequence: Synthetic oligonucleotide
ggcacgcagauagcuuga

SEQ ID NO: 11653 - RNA, 18 nt, Artificial Sequence
  Description of Artificial Sequence: Synthetic oligonucleotide
gucaaggcacgcagauag

SEQ ID NO: 11654 - RNA, 18 nt, Artificial Sequence
  Description of Artificial Sequence: Synthetic oligonucleotide
gggaggucaaggcacgca

SEQ ID NO: 11655 - RNA, 18 nt, Artificial Sequence
  Description of Artificial Sequence: Synthetic oligonucleotide
acuuugggaggucaaggc

SEQ ID NO: 11656 - RNA, 18 nt, Artificial Sequence
  Description of Artificial Sequence: Synthetic oligonucleotide
cuagcacuuugggagguc

SEQ ID NO: 11657 - RNA, 18 nt, Artificial Sequence
  Description of Artificial Sequence: Synthetic oligonucleotide
uaauccuagcacuuuggg

SEQ ID NO: 11658 - RNA, 18 nt, Artificial Sequence
  Description of Artificial Sequence: Synthetic oligonucleotide
accuguaauccuagcacu

SEQ ID NO: 11659 - RNA, 18 nt, Artificial Sequence
  Description of Artificial Sequence: Synthetic oligonucleotide
cucacaccuguaauccua

SEQ ID NO: 11660 - RNA, 18 nt, Artificial Sequence
  Description of Artificial Sequence: Synthetic oligonucleotide
aguggcucacaccuguaa

SEQ ID NO: 11661 - RNA, 18 nt, Artificial Sequence
  Description of Artificial Sequence: Synthetic oligonucleotide
ggcauaguggcucacacc

SEQ ID NO: 11662 - RNA, 18 nt, Artificial Sequence
  Description of Artificial Sequence: Synthetic oligonucleotide
ggcuaggcauaguggcuc

SEQ ID NO: 11663 - RNA, 18 nt, Artificial Sequence
  Description of Artificial Sequence: Synthetic oligonucleotide
aguuaggcuaggcauagu

SEQ ID NO: 11664 - RNA, 18 nt, Artificial Sequence
  Description of Artificial Sequence: Synthetic oligonucleotide
gucugaguuaggcuaggc

SEQ ID NO: 11665 - RNA, 18 nt, Artificial Sequence
  Description of Artificial Sequence: Synthetic oligonucleotide
uuaaagucugaguuaggc

SEQ ID NO: 11666 - RNA, 18 nt, Artificial Sequence
  Description of Artificial Sequence: Synthetic oligonucleotide
uauuuuuaaagucugagu

SEQ ID NO: 11667 - RNA, 18 nt, Artificial Sequence
  Description of Artificial Sequence: Synthetic oligonucleotide
uuuuauauuuuuaaaguc

SEQ ID NO: 11668 - RNA, 18 nt, Artificial Sequence
  Description of Artificial Sequence: Synthetic oligonucleotide
auugcuuuuauauuuuua

SEQ ID NO: 11669 - RNA, 18 nt, Artificial Sequence
  Description of Artificial Sequence: Synthetic oligonucleotide
aaugaauugcuuuuauau

SEQ ID NO: 11670 - RNA, 18 nt, Artificial Sequence
  Description of Artificial Sequence: Synthetic oligonucleotide
auaaaaaugaauugcuuu

SEQ ID NO: 11671 - RNA, 18 nt, Artificial Sequence
  Description of Artificial Sequence: Synthetic oligonucleotide
ugggaauaaaaaugaauu

SEQ ID NO: 11672 - RNA, 18 nt, Artificial Sequence
  Description of Artificial Sequence: Synthetic oligonucleotide
guucuugggaauaaaaau

SEQ ID NO: 11673 - RNA, 18 nt, Artificial Sequence
  Description of Artificial Sequence: Synthetic oligonucleotide
uuacuguucuugggaaua

SEQ ID NO: 11674 - RNA, 18 nt, Artificial Sequence
  Description of Artificial Sequence: Synthetic oligonucleotide
ccaccuuacuguucuugg

SEQ ID NO: 11675 - RNA, 18 nt, Artificial Sequence
  Description of Artificial Sequence: Synthetic oligonucleotide
aaccaccaccuuacuguu

SEQ ID NO: 11676 - RNA, 18 nt, Artificial Sequence
  Description of Artificial Sequence: Synthetic oligonucleotide
aauuaaaccaccaccuua

SEQ ID NO: 11677 - RNA, 18 nt, Artificial Sequence
  Description of Artificial Sequence: Synthetic oligonucleotide
acuaaaauuaaaccacca

SEQ ID NO: 11678 - RNA, 18 nt, Artificial Sequence
  Description of Artificial Sequence: Synthetic oligonucleotide
uaaagacuaaaauuaaac

SEQ ID NO: 11679 - RNA, 18 nt, Artificial Sequence
  Description of Artificial Sequence: Synthetic oligonucleotide
agaauuaaagacuaaaau

SEQ ID NO: 11680 - RNA, 18 nt, Artificial Sequence
  Description of Artificial Sequence: Synthetic oligonucleotide
aaaacagaauuaaagacu

SEQ ID NO: 11681 - RNA, 18 nt, Artificial Sequence
  Description of Artificial Sequence: Synthetic oligonucleotide
aauuaaaaacagaauuaa

SEQ ID NO: 11682 - RNA, 18 nt, Artificial Sequence
  Description of Artificial Sequence: Synthetic oligonucleotide
gaauaaauuaaaaacaga

SEQ ID NO: 11683 - RNA, 18 nt, Artificial Sequence
  Description of Artificial Sequence: Synthetic oligonucleotide
aaauagaauaaauuaaaa

SEQ ID NO: 11684 - RNA, 18 nt, Artificial Sequence
  Description of Artificial Sequence: Synthetic oligonucleotide
uuucuaaauagaauaaau

SEQ ID NO: 11685 - RNA, 18 nt, Artificial Sequence
  Description of Artificial Sequence: Synthetic oligonucleotide
ggacauuucuaaauagaa

SEQ ID NO: 11686 - RNA, 18 nt, Artificial Sequence
  Description of Artificial Sequence: Synthetic oligonucleotide
uucugggacauuucuaaa

SEQ ID NO: 11687 - RNA, 18 nt, Artificial Sequence
  Description of Artificial Sequence: Synthetic oligonucleotide
uaaguuucugggacauuu

SEQ ID NO: 11688 - RNA, 18 nt, Artificial Sequence
  Description of Artificial Sequence: Synthetic oligonucleotide
uauacuaaguuucuggga

SEQ ID NO: 11689 - RNA, 18 nt, Artificial Sequence
  Description of Artificial Sequence: Synthetic oligonucleotide
aaaguuauacuaaguuuc

SEQ ID NO: 11690 - RNA, 18 nt, Artificial Sequence
  Description of Artificial Sequence: Synthetic oligonucleotide
aaaguaaaguuauacuaa

SEQ ID NO: 11691 - RNA, 18 nt, Artificial Sequence
  Description of Artificial Sequence: Synthetic oligonucleotide
uucagaaaguaaaguuau

SEQ ID NO: 11692 - RNA, 18 nt, Artificial Sequence
  Description of Artificial Sequence: Synthetic oligonucleotide
ucauuuucagaaaguaaa

SEQ ID NO: 11693 - RNA, 18 nt, Artificial Sequence
  Description of Artificial Sequence: Synthetic oligonucleotide
uuucuucauuuucagaaa

SEQ ID NO: 11694 - RNA, 18 nt, Artificial Sequence
  Description of Artificial Sequence: Synthetic oligonucleotide
acagguuucuucauuuuc

SEQ ID NO: 11695 - RNA, 18 nt, Artificial Sequence
  Description of Artificial Sequence: Synthetic oligonucleotide
caaggacagguuucuuca

SEQ ID NO: 11696 - RNA, 18 nt, Artificial Sequence
  Description of Artificial Sequence: Synthetic oligonucleotide
augcccaaggacagguuu

SEQ ID NO: 11697 - RNA, 18 nt, Artificial Sequence
  Description of Artificial Sequence: Synthetic oligonucleotide
cacuaaugcccaaggaca

SEQ ID NO: 11698 - RNA, 18 nt, Artificial Sequence
  Description of Artificial Sequence: Synthetic oligonucleotide
caacacacuaaugcccaa

SEQ ID NO: 11699 - RNA, 18 nt, Artificial Sequence
  Description of Artificial Sequence: Synthetic oligonucleotide
aaauccaacacacuaaug

SEQ ID NO: 11700 - RNA, 18 nt, Artificial Sequence
  Description of Artificial Sequence: Synthetic oligonucleotide
ugcuuaaauccaacacac

SEQ ID NO: 11701 - RNA, 18 nt, Artificial Sequence
  Description of Artificial Sequence: Synthetic oligonucleotide
uuuguugcuuaaauccaa

SEQ ID NO: 11702 - RNA, 18 nt, Artificial Sequence
  Description of Artificial Sequence: Synthetic oligonucleotide
uuaacuuuguugcuuaaa

SEQ ID NO: 11703 - RNA, 18 nt, Artificial Sequence
  Description of Artificial Sequence: Synthetic oligonucleotide
uuuuuuuaacuuuguugc

SEQ ID NO: 11704 - RNA, 18 nt, Artificial Sequence
  Description of Artificial Sequence: Synthetic oligonucleotide
guagguuuuuuuaacuuu

SEQ ID NO: 11705 - RNA, 18 nt, Artificial Sequence
  Description of Artificial Sequence: Synthetic oligonucleotide
acaggguagguuuuuuua

SEQ ID NO: 11706 - RNA, 18 nt, Artificial Sequence
  Description of Artificial Sequence: Synthetic oligonucleotide
auaacacaggguagguuu

SEQ ID NO: 11707 - RNA, 18 nt, Artificial Sequence
  Description of Artificial Sequence: Synthetic oligonucleotide
uugccauaacacagggua

SEQ ID NO: 11708 - RNA, 18 nt, Artificial Sequence
  Description of Artificial Sequence: Synthetic oligonucleotide
gaaaauugccauaacaca

SEQ ID NO: 11709 - RNA, 18 nt, Artificial Sequence
  Description of Artificial Sequence: Synthetic oligonucleotide
caagugaaaauugccaua

SEQ ID NO: 11710 - RNA, 18 nt, Artificial Sequence
  Description of Artificial Sequence: Synthetic oligonucleotide
accaucaagugaaaauug

SEQ ID NO: 11711 - RNA, 18 nt, Artificial Sequence
  Description of Artificial Sequence: Synthetic oligonucleotide
gaaccaccaucaagugaa

SEQ ID NO: 11712 - RNA, 18 nt, Artificial Sequence
  Description of Artificial Sequence: Synthetic oligonucleotide
uuauagaaccaccaucaa

SEQ ID NO: 11713 - RNA, 18 nt, Artificial Sequence
  Description of Artificial Sequence: Synthetic oligonucleotide
cuguguuauagaaccacc

SEQ ID NO: 11714 - RNA, 18 nt, Artificial Sequence
  Description of Artificial Sequence: Synthetic oligonucleotide
gauaccuguguuauagaa

SEQ ID NO: 11715 - RNA, 18 nt, Artificial Sequence
  Description of Artificial Sequence: Synthetic oligonucleotide
ucacugauaccuguguua

SEQ ID NO: 11716 - RNA, 18 nt, Artificial Sequence
  Description of Artificial Sequence: Synthetic oligonucleotide
aagguucacugauaccug

SEQ ID NO: 11717 - RNA, 18 nt, Artificial Sequence
  Description of Artificial Sequence: Synthetic oligonucleotide
uuauaaagguucacugau

SEQ ID NO: 11718 - RNA, 18 nt, Artificial Sequence
  Description of Artificial Sequence: Synthetic oligonucleotide
aucuuuuauaaagguuca

SEQ ID NO: 11719 - RNA, 18 nt, Artificial Sequence
  Description of Artificial Sequence: Synthetic oligonucleotide
uguucaucuuuuauaaag

SEQ ID NO: 11720 - RNA, 18 nt, Artificial Sequence
  Description of Artificial Sequence: Synthetic oligonucleotide
aaaguuguucaucuuuua

SEQ ID NO: 11721 - RNA, 18 nt, Artificial Sequence
  Description of Artificial Sequence: Synthetic oligonucleotide
gcugaaaaguuguucauc

SEQ ID NO: 11722 - RNA, 18 nt, Artificial Sequence
  Description of Artificial Sequence: Synthetic oligonucleotide
agcaagcugaaaaguugu

SEQ ID NO: 11723 - RNA, 18 nt, Artificial Sequence
  Description of Artificial Sequence: Synthetic oligonucleotide
aauuaagcaagcugaaaa

SEQ ID NO: 11724 - RNA, 18 nt, Artificial Sequence
  Description of Artificial Sequence: Synthetic oligonucleotide
acugaaauuaagcaagcu

SEQ ID NO: 11725 - RNA, 18 nt, Artificial Sequence
  Description of Artificial Sequence: Synthetic oligonucleotide
aauuaacugaaauuaagc

SEQ ID NO: 11726 - RNA, 18 nt, Artificial Sequence
  Description of Artificial Sequence: Synthetic oligonucleotide
auguuaauuaacugaaau

SEQ ID NO: 11727 - RNA, 18 nt, Artificial Sequence
  Description of Artificial Sequence: Synthetic oligonucleotide
uauacauguuaauuaacu

SEQ ID NO: 11728 - RNA, 18 nt, Artificial Sequence
  Description of Artificial Sequence: Synthetic oligonucleotide
auaaguauacauguuaau

SEQ ID NO: 11729 - RNA, 18 nt, Artificial Sequence
  Description of Artificial Sequence: Synthetic oligonucleotide
cauagauaaguauacaug

SEQ ID NO: 11730 - RNA, 18 nt, Artificial Sequence
  Description of Artificial Sequence: Synthetic oligonucleotide
auuaacauagauaaguau

SEQ ID NO: 11731 - RNA, 18 nt, Artificial Sequence
  Description of Artificial Sequence: Synthetic oligonucleotide
aaaacauuaacauagaua

SEQ ID NO: 11732 - RNA, 18 nt, Artificial Sequence
  Description of Artificial Sequence: Synthetic oligonucleotide
gcaauaaaacauuaacau

SEQ ID NO: 11733 - RNA, 18 nt, Artificial Sequence
  Description of Artificial Sequence: Synthetic oligonucleotide
uuuaagcaauaaaacauu

SEQ ID NO: 11734 - RNA, 18 nt, Artificial Sequence
  Description of Artificial Sequence: Synthetic oligonucleotide
aacauuuuaagcaauaaa

SEQ ID NO: 11735 - RNA, 18 nt, Artificial Sequence
  Description of Artificial Sequence: Synthetic oligonucleotide
aauuaaacauuuuaagca

SEQ ID NO: 11736 - RNA, 18 nt, Artificial Sequence
  Description of Artificial Sequence: Synthetic oligonucleotide
auaaaaauuaaacauuuu

SEQ ID NO: 11737 - RNA, 18 nt, Artificial Sequence
  Description of Artificial Sequence: Synthetic oligonucleotide
caaauauaaaaauuaaac

SEQ ID NO: 11738 - RNA, 18 nt, Artificial Sequence
  Description of Artificial Sequence: Synthetic oligonucleotide
uuuaccaaauauaaaaau

SEQ ID NO: 11739 - RNA, 18 nt, Artificial Sequence
  Description of Artificial Sequence: Synthetic oligonucleotide
aucuguuuaccaaauaua

SEQ ID NO: 11740 - RNA, 18 nt, Artificial Sequence
  Description of Artificial Sequence: Synthetic oligonucleotide
aaacuaucuguuuaccaa

SEQ ID NO: 11741 - RNA, 18 nt, Artificial Sequence
  Description of Artificial Sequence: Synthetic oligonucleotide
agaaaaaacuaucuguuu

SEQ ID NO: 11742 - RNA, 18 nt, Artificial Sequence
  Description of Artificial Sequence: Synthetic oligonucleotide
gggagagaaaaaacuauc

SEQ ID NO: 11743 - RNA, 18 nt, Artificial Sequence
  Description of Artificial Sequence: Synthetic oligonucleotide
aagauggaaggaagaggg

SEQ ID NO: 11744 - RNA, 18 nt, Artificial Sequence
  Description of Artificial Sequence: Synthetic oligonucleotide
augaaagauggaaggaag

SEQ ID NO: 11745 - RNA, 18 nt, Artificial Sequence
  Description of Artificial Sequence: Synthetic oligonucleotide
uaguaaugaaagauggaa

SEQ ID NO: 11746 - RNA, 18 nt, Artificial Sequence
  Description of Artificial Sequence: Synthetic oligonucleotide
cagagagacauugugagc

SEQ ID NO: 11747 - RNA, 18 nt, Artificial Sequence
  Description of Artificial Sequence: Synthetic oligonucleotide
uggugcagagagacauug

SEQ ID NO: 11748 - RNA, 18 nt, Artificial Sequence
  Description of Artificial Sequence: Synthetic oligonucleotide
gagcuuggugcagagaga

SEQ ID NO: 11749 - RNA, 18 nt, Artificial Sequence
  Description of Artificial Sequence: Synthetic oligonucleotide
ucauggagcuuggugcag

SEQ ID NO: 11750 - RNA, 18 nt, Artificial Sequence
  Description of Artificial Sequence: Synthetic oligonucleotide
cugagucauggagcuugg

SEQ ID NO: 11751 - RNA, 18 nt, Artificial Sequence
  Description of Artificial Sequence: Synthetic oligonucleotide
aaauccugagucauggag

SEQ ID NO: 11752 - RNA, 18 nt, Artificial Sequence
  Description of Artificial Sequence: Synthetic oligonucleotide
caggcaaauccugaguca

SEQ ID NO: 11753 - RNA, 18 nt, Artificial Sequence
  Description of Artificial Sequence: Synthetic oligonucleotide
aacuccaggcaaauccug

SEQ ID NO: 11754 - RNA, 18 nt, Artificial Sequence
  Description of Artificial Sequence: Synthetic oligonucleotide
ccaggaacuccaggcaaa

SEQ ID NO: 11755 - RNA, 18 nt, Artificial Sequence
  Description of Artificial Sequence: Synthetic oligonucleotide
cuuucccaggaacuccag

SEQ ID NO: 11756 - RNA, 18 nt, Artificial Sequence
  Description of Artificial Sequence: Synthetic oligonucleotide
cuggucuuucccaggaac

SEQ ID NO: 11757 - RNA, 18 nt, Artificial Sequence
  Description of Artificial Sequence: Synthetic oligonucleotide
aacaacuggucuuuccca

SEQ ID NO: 11758 - RNA, 18 nt, Artificial Sequence
  Description of Artificial Sequence: Synthetic oligonucleotide
gugaaaacaacuggucuu

SEQ ID NO: 11759 - RNA, 18 nt, Artificial Sequence
  Description of Artificial Sequence: Synthetic oligonucleotide
aggcugugaaaacaacug

SEQ ID NO: 11760 - RNA, 18 nt, Artificial Sequence
  Description of Artificial Sequence: Synthetic oligonucleotide
acuggaggcugugaaaac

SEQ ID NO: 11761 - RNA, 18 nt, Artificial Sequence
  Description of Artificial Sequence: Synthetic oligonucleotide
uuaacacuggaggcugug

SEQ ID NO: 11762 - RNA, 18 nt, Artificial Sequence
  Description of Artificial Sequence: Synthetic oligonucleotide
uguccuuaacacuggagg

SEQ ID NO: 11763 - RNA, 18 nt, Artificial Sequence
  Description of Artificial Sequence: Synthetic oligonucleotide
gaagcuguccuuaacacu

SEQ ID NO: 11764 - RNA, 18 nt, Artificial Sequence
  Description of Artificial Sequence: Synthetic oligonucleotide
cuugugaagcuguccuua

SEQ ID NO: 11765 - RNA, 18 nt, Artificial Sequence
  Description of Artificial Sequence: Synthetic oligonucleotide
acccucuugugaagcugu

SEQ ID NO: 11766 - RNA, 18 nt, Artificial Sequence
  Description of Artificial Sequence: Synthetic oligonucleotide
uggcaacccucuugugaa

SEQ ID NO: 11767 - RNA, 18 nt, Artificial Sequence
  Description of Artificial Sequence: Synthetic oligonucleotide
guucuuggcaacccucuu

SEQ ID NO: 11768 - RNA, 18 nt, Artificial Sequence
  Description of Artificial Sequence: Synthetic oligonucleotide
uguaaguucuuggcaacc

SEQ ID NO: 11769 - RNA, 18 nt, Artificial Sequence
  Description of Artificial Sequence: Synthetic oligonucleotide
ucuuguguaaguucuugg

SEQ ID NO: 11770 - RNA, 18 nt, Artificial Sequence
  Description of Artificial Sequence: Synthetic oligonucleotide
uuuguucuuguguaaguu

SEQ ID NO: 11771 - RNA, 18 nt, Artificial Sequence
  Description of Artificial Sequence: Synthetic oligonucleotide
aucucuuuguucuugugu

SEQ ID NO: 11772 - RNA, 18 nt, Artificial Sequence
  Description of Artificial Sequence: Synthetic oligonucleotide
aguugaucucuuuguucu

SEQ ID NO: 11773 - RNA, 18 nt, Artificial Sequence
  Description of Artificial Sequence: Synthetic oligonucleotide
cccucaguugaucucuuu

SEQ ID NO: 11774 - RNA, 18 nt, Artificial Sequence
  Description of Artificial Sequence: Synthetic oligonucleotide
aucugcccucaguugauc

SEQ ID NO: 11775 - RNA, 18 nt, Artificial Sequence
  Description of Artificial Sequence: Synthetic oligonucleotide
cugauaucugcccucagu

SEQ ID NO: 11776 - RNA, 18 nt, Artificial Sequence
  Description of Artificial Sequence: Synthetic oligonucleotide
uaauacugauaucugccc

SEQ ID NO: 11777 - RNA, 18 nt, Artificial Sequence
  Description of Artificial Sequence: Synthetic oligonucleotide
uuugauaauacugauauc

SEQ ID NO: 11778 - RNA, 18 nt, Artificial Sequence
  Description of Artificial Sequence: Synthetic oligonucleotide
cugccuuugauaauacug

SEQ ID NO: 11779 - RNA, 18 nt, Artificial Sequence
  Description of Artificial Sequence: Synthetic oligonucleotide
gguaucugccuuugauaa

SEQ ID NO: 11780 - RNA, 18 nt, Artificial Sequence
  Description of Artificial Sequence: Synthetic oligonucleotide
gcuccgguaucugccuuu

SEQ ID NO: 11781 - RNA, 18 nt, Artificial Sequence
  Description of Artificial Sequence: Synthetic oligonucleotide
cuuuggcuccgguaucug

SEQ ID NO: 11782 - RNA, 18 nt, Artificial Sequence
  Description of Artificial Sequence: Synthetic oligonucleotide
acagaauuucacaucuuu

SEQ ID NO: 11783 - RNA, 18 nt, Artificial Sequence
  Description of Artificial Sequence: Synthetic oligonucleotide
auuacacagaauuucaca

SEQ ID NO: 11784 - RNA, 18 nt, Artificial Sequence
  Description of Artificial Sequence: Synthetic oligonucleotide
auuacauuacacagaauu

SEQ ID NO: 11785 - RNA, 18 nt, Artificial Sequence
  Description of Artificial Sequence: Synthetic oligonucleotide
uuuuuauuacauuacaca

SEQ ID NO: 11786 - RNA, 18 nt, Artificial Sequence
  Description of Artificial Sequence: Synthetic oligonucleotide
uuuauuuuuuauuacauu

SEQ ID NO: 11787 - RNA, 18 nt, Artificial Sequence
  Description of Artificial Sequence: Synthetic oligonucleotide
uccaauuuauuuuuuauu

SEQ ID NO: 11788 - RNA, 18 nt, Artificial Sequence
  Description of Artificial Sequence: Synthetic oligonucleotide
cacaguccaauuuauuuu

SEQ ID NO: 11789 - RNA, 18 nt, Artificial Sequence
  Description of Artificial Sequence: Synthetic oligonucleotide
uauaucacaguccaauuu

SEQ ID NO: 11790 - RNA, 18 nt, Artificial Sequence
  Description of Artificial Sequence: Synthetic oligonucleotide
uuguuuauaucacagucc

SEQ ID NO: 11791 - RNA, 18 nt, Artificial Sequence
  Description of Artificial Sequence: Synthetic oligonucleotide
ugaacuuguuuauaucac

SEQ ID NO: 11792 - RNA, 18 nt, Artificial Sequence
  Description of Artificial Sequence: Synthetic oligonucleotide
aucggugaacuuguuuau

SEQ ID NO: 11793 - RNA, 18 nt, Artificial Sequence
  Description of Artificial Sequence: Synthetic oligonucleotide
ucaagaucggugaacuug

SEQ ID NO: 11794 - RNA, 18 nt, Artificial Sequence
  Description of Artificial Sequence: Synthetic oligonucleotide
gcaggucaagaucgguga

SEQ ID NO: 11795 - RNA, 18 nt, Artificial Sequence
  Description of Artificial Sequence: Synthetic oligonucleotide
augcugcaggucaagauc

SEQ ID NO: 11796 - RNA, 18 nt, Artificial Sequence
  Description of Artificial Sequence: Synthetic oligonucleotide
gcuacaugcugcagguca

SEQ ID NO: 11797 - RNA, 18 nt, Artificial Sequence
  Description of Artificial Sequence: Synthetic oligonucleotide
cuuuagcuacaugcugca

SEQ ID NO: 11798 - RNA, 18 nt, Artificial Sequence
  Description of Artificial Sequence: Synthetic oligonucleotide
aguuucuuuagcuacaug

SEQ ID NO: 11799 - RNA, 18 nt, Artificial Sequence
  Description of Artificial Sequence: Synthetic oligonucleotide
ccgccaguuucuuuagcu

SEQ ID NO: 11800 - RNA, 18 nt, Artificial Sequence
  Description of Artificial Sequence: Synthetic oligonucleotide
caaacccgccaguuucuu

SEQ ID NO: 11801 - RNA, 18 nt, Artificial Sequence
  Description of Artificial Sequence: Synthetic oligonucleotide
agccacaaacccgccagu

SEQ ID NO: 11802 - RNA, 18 nt, Artificial Sequence
  Description of Artificial Sequence: Synthetic oligonucleotide
ucucuagccacaaacccg

SEQ ID NO: 11803 - RNA, 18 nt, Artificial Sequence
  Description of Artificial Sequence: Synthetic oligonucleotide
uaaaaucucuagccacaa

SEQ ID NO: 11804 - RNA, 18 nt, Artificial Sequence
  Description of Artificial Sequence: Synthetic oligonucleotide
uacuguaaaaucucuagc

SEQ ID NO: 11805 - RNA, 18 nt, Artificial Sequence
  Description of Artificial Sequence: Synthetic oligonucleotide
acaaguacuguaaaaucu

SEQ ID NO: 11806 - RNA, 18 nt, Artificial Sequence
  Description of Artificial Sequence: Synthetic oligonucleotide
gauccacaaguacuguaa

SEQ ID NO: 11807 - RNA, 18 nt, Artificial Sequence
  Description of Artificial Sequence: Synthetic oligonucleotide
ggcucgauccacaaguac

SEQ ID NO: 11808 - RNA, 18 nt, Artificial Sequence
  Description of Artificial Sequence: Synthetic oligonucleotide
uguauggcucgauccaca

SEQ ID NO: 11809 - RNA, 18 nt, Artificial Sequence
  Description of Artificial Sequence: Synthetic oligonucleotide
gagaauguauggcucgau

SEQ ID NO: 11810 - RNA, 18 nt, Artificial Sequence
  Description of Artificial Sequence: Synthetic oligonucleotide
gagucgagaauguauggc

SEQ ID NO: 11811 - RNA, 18 nt, Artificial Sequence
  Description of Artificial Sequence: Synthetic oligonucleotide
cgagagagucgagaaugu

SEQ ID NO: 11812 - RNA, 18 nt, Artificial Sequence
  Description of Artificial Sequence: Synthetic oligonucleotide
ucugacgagagagucgag

SEQ ID NO: 11813 - RNA, 18 nt, Artificial Sequence
  Description of Artificial Sequence: Synthetic oligonucleotide
uauacucugacgagagag

SEQ ID NO: 11814 - RNA, 18 nt, Artificial Sequence
  Description of Artificial Sequence: Synthetic oligonucleotide
guggauauacucugacga

SEQ ID NO: 11815 - RNA, 18 nt, Artificial Sequence
  Description of Artificial Sequence: Synthetic oligonucleotide
cucugguggauauacucu

SEQ ID NO: 11816 - RNA, 18 nt, Artificial Sequence
  Description of Artificial Sequence: Synthetic oligonucleotide
cagguuuuaauaguaaaa

SEQ ID NO: 11817 - RNA, 18 nt, Artificial Sequence
  Description of Artificial Sequence: Synthetic oligonucleotide
aaguucagguuuuaauag

SEQ ID NO: 11818 - RNA, 18 nt, Artificial Sequence
  Description of Artificial Sequence: Synthetic oligonucleotide
auuccaaguucagguuuu

SEQ ID NO: 11819 - RNA, 18 nt, Artificial Sequence
  Description of Artificial Sequence: Synthetic oligonucleotide
agaagauuccaaguucag

SEQ ID NO: 11820 - RNA, 18 nt, Artificial Sequence
  Description of Artificial Sequence: Synthetic oligonucleotide
uagaaagaagauuccaag

SEQ ID NO: 11821 - RNA, 18 nt, Artificial Sequence
  Description of Artificial Sequence: Synthetic oligonucleotide
cacaauagaaagaagauu

SEQ ID NO: 11822 - RNA, 18 nt, Artificial Sequence
  Description of Artificial Sequence: Synthetic oligonucleotide
uucuccacaauagaaaga

SEQ ID NO: 11823 - RNA, 18 nt, Artificial Sequence
  Description of Artificial Sequence: Synthetic oligonucleotide
uacauuucuccacaauag

SEQ ID NO: 11824 - RNA, 18 nt, Artificial Sequence
  Description of Artificial Sequence: Synthetic oligonucleotide
acaauuacauuucuccac

SEQ ID NO: 11825 - RNA, 18 nt, Artificial Sequence
  Description of Artificial Sequence: Synthetic oligonucleotide
uuacuacaauuacauuuc

SEQ ID NO: 11826 - RNA, 18 nt, Artificial Sequence
  Description of Artificial Sequence: Synthetic oligonucleotide
uugucuuacuacaauuac

SEQ ID NO: 11827 - RNA, 18 nt, Artificial Sequence
  Description of Artificial Sequence: Synthetic oligonucleotide
aauucuugucuuacuaca

SEQ ID NO: 11828 - RNA, 18 nt, Artificial Sequence
  Description of Artificial Sequence: Synthetic oligonucleotide
uauuuaauucuugucuua

SEQ ID NO: 11829 - RNA, 18 nt, Artificial Sequence
  Description of Artificial Sequence: Synthetic oligonucleotide
gaauauauuuaauucuug

SEQ ID NO: 11830 - RNA, 18 nt, Artificial Sequence
  Description of Artificial Sequence: Synthetic oligonucleotide
caauggaauauauuuaau

SEQ ID NO: 11831 - RNA, 18 nt, Artificial Sequence
  Description of Artificial Sequence: Synthetic oligonucleotide
uacuacaauggaauauau

SEQ ID NO: 11832 - RNA, 18 nt, Artificial Sequence
  Description of Artificial Sequence: Synthetic oligonucleotide
ucaaauacuacaauggaa

SEQ ID NO: 11833 - RNA, 18 nt, Artificial Sequence
  Description of Artificial Sequence: Synthetic oligonucleotide
cuuauucaaauacuacaa

SEQ ID NO: 11834 - RNA, 18 nt, Artificial Sequence
  Description of Artificial Sequence: Synthetic oligonucleotide
aacugcuuauucaaauac

SEQ ID NO: 11835 - RNA, 18 nt, Artificial Sequence
  Description of Artificial Sequence: Synthetic oligonucleotide
caaauaacugcuuauuca

SEQ ID NO: 11836 - RNA, 18 nt, Artificial Sequence
  Description of Artificial Sequence: Synthetic oligonucleotide
cuacucaaauaacugcuu

SEQ ID NO: 11837 - RNA, 18 nt, Artificial Sequence
  Description of Artificial Sequence: Synthetic oligonucleotide
auuuucuacucaaauaac

SEQ ID NO: 11838 - RNA, 18 nt, Artificial Sequence
  Description of Artificial Sequence: Synthetic oligonucleotide
cacuaauuuucuacucaa

SEQ ID NO: 11839 - RNA, 18 nt, Artificial Sequence
  Description of Artificial Sequence: Synthetic oligonucleotide
ggaaacacuaauuuucua

SEQ ID NO: 11840 - RNA, 18 nt, Artificial Sequence
  Description of Artificial Sequence: Synthetic oligonucleotide
cuacaauggaauauauuu

SEQ ID NO: 11841 - RNA, 18 nt, Artificial Sequence
  Description of Artificial Sequence: Synthetic oligonucleotide
aaauacuacaauggaaua

SEQ ID NO: 11842 - RNA, 18 nt, Artificial Sequence
  Description of Artificial Sequence: Synthetic oligonucleotide
uauucaaauacuacaaug

SEQ ID NO: 11843 - RNA, 18 nt, Artificial Sequence
  Description of Artificial Sequence: Synthetic oligonucleotide
cugcuuauucaaauacua

SEQ ID NO: 11844 - RNA, 18 nt, Artificial Sequence
  Description of Artificial Sequence: Synthetic oligonucleotide
aauaacugcuuauucaaa

SEQ ID NO: 11845 - RNA, 18 nt, Artificial Sequence
  Description of Artificial Sequence: Synthetic oligonucleotide
acucaaauaacugcuuau

SEQ ID NO: 11846 - RNA, 18 nt, Artificial Sequence
  Description of Artificial Sequence: Synthetic oligonucleotide
uuucuacucaaauaacug

SEQ ID NO: 11847 - RNA, 18 nt, Artificial Sequence
  Description of Artificial Sequence: Synthetic oligonucleotide
cuaauuuucuacucaaau

SEQ ID NO: 11848 - RNA, 18 nt, Artificial Sequence
  Description of Artificial Sequence: Synthetic oligonucleotide
aaacacuaauuuucuacu

SEQ ID NO: 11849 - RNA, 18 nt, Artificial Sequence
  Description of Artificial Sequence: Synthetic oligonucleotide
gcuggaaacacuaauuuu

SEQ ID NO: 11850 - RNA, 18 nt, Artificial Sequence
  Description of Artificial Sequence: Synthetic oligonucleotide
ucuuagcuggaaacacua

SEQ ID NO: 11851 - RNA, 18 nt, Artificial Sequence
  Description of Artificial Sequence: Synthetic oligonucleotide
caucaucuuagcuggaaa

SEQ ID NO: 11852 - RNA, 18 nt, Artificial Sequence
  Description of Artificial Sequence: Synthetic oligonucleotide
uaugccaucaucuuagcu

SEQ ID NO: 11853 - RNA, 18 nt, Artificial Sequence
  Description of Artificial Sequence: Synthetic oligonucleotide
caaaauaugccaucaucu

SEQ ID NO: 11854 - RNA, 18 nt, Artificial Sequence
  Description of Artificial Sequence: Synthetic oligonucleotide
auuuucaaaauaugccau

SEQ ID NO: 11855 - RNA, 18 nt, Artificial Sequence
  Description of Artificial Sequence: Synthetic oligonucleotide
uaugaauuuucaaaauau

SEQ ID NO: 11856 - RNA, 18 nt, Artificial Sequence
  Description of Artificial Sequence: Synthetic oligonucleotide
cacuauaugaauuuucaa

SEQ ID NO: 11857 - RNA, 18 nt, Artificial Sequence
  Description of Artificial Sequence: Synthetic oligonucleotide
auauucacuauaugaauu

SEQ ID NO: 11858 - RNA, 18 nt, Artificial Sequence
  Description of Artificial Sequence: Synthetic oligonucleotide
uaguuauauucacuauau

SEQ ID NO: 11859 - RNA, 18 nt, Artificial Sequence
  Description of Artificial Sequence: Synthetic oligonucleotide
uuuacuaguuauauucac

SEQ ID NO: 11860 - RNA, 18 nt, Artificial Sequence
  Description of Artificial Sequence: Synthetic oligonucleotide
cuucuuuuacuaguuaua

SEQ ID NO: 11861 - RNA, 18 nt, Artificial Sequence
  Description of Artificial Sequence: Synthetic oligonucleotide
caaaacuucuuuuacuag

SEQ ID NO: 11862 - RNA, 18 nt, Artificial Sequence
  Description of Artificial Sequence: Synthetic oligonucleotide
aauguuguuaaaacuaau

SEQ ID NO: 11863 - RNA, 18 nt, Artificial Sequence
  Description of Artificial Sequence: Synthetic oligonucleotide
aguccaauguuguuaaaa

SEQ ID NO: 11864 - RNA, 18 nt, Artificial Sequence
  Description of Artificial Sequence: Synthetic oligonucleotide
uuggaaguccaauguugu

SEQ ID NO: 11865 - RNA, 18 nt, Artificial Sequence
  Description of Artificial Sequence: Synthetic oligonucleotide
gccuuuuggaaguccaau

SEQ ID NO: 11866 - RNA, 18 nt, Artificial Sequence
  Description of Artificial Sequence: Synthetic oligonucleotide
ggagagccuuuuggaagu

SEQ ID NO: 11867 - RNA, 18 nt, Artificial Sequence
  Description of Artificial Sequence: Synthetic oligonucleotide
uccgcggagagccuuuug

SEQ ID NO: 11868 - RNA, 18 nt, Artificial Sequence
  Description of Artificial Sequence: Synthetic oligonucleotide
agaaauccgcggagagcc

SEQ ID NO: 11869 - RNA, 18 nt, Artificial Sequence
  Description of Artificial Sequence: Synthetic oligonucleotide
caggaagaaauccgcgga

SEQ ID NO: 11870 - RNA, 18 nt, Artificial Sequence
  Description of Artificial Sequence: Synthetic oligonucleotide
agacgcaggaagaaaucc

SEQ ID NO: 11871 - RNA, 18 nt, Artificial Sequence
  Description of Artificial Sequence: Synthetic oligonucleotide
cgcaaagacgcaggaaga

SEQ ID NO: 11872 - RNA, 18 nt, Artificial Sequence
  Description of Artificial Sequence: Synthetic oligonucleotide
cacuucgcaaagacgcag

SEQ ID NO: 11873 - RNA, 18 nt, Artificial Sequence
  Description of Artificial Sequence: Synthetic oligonucleotide
guugacacuucgcaaaga

SEQ ID NO: 11874 - RNA, 18 nt, Artificial Sequence
  Description of Artificial Sequence: Synthetic oligonucleotide
ugcagguugacacuucgc

SEQ ID NO: 11875 - RNA, 18 nt, Artificial Sequence
  Description of Artificial Sequence: Synthetic oligonucleotide
guuuaugcagguugacac

SEQ ID NO: 11876 - RNA, 18 nt, Artificial Sequence
  Description of Artificial Sequence: Synthetic oligonucleotide
ucuagguuuaugcagguu

SEQ ID NO: 11877 - RNA, 18 nt, Artificial Sequence
  Description of Artificial Sequence: Synthetic oligonucleotide
aggucucuagguuuaugc

SEQ ID NO: 11878 - RNA, 18 nt, Artificial Sequence
  Description of Artificial Sequence: Synthetic oligonucleotide
aacccaggucucuagguu

SEQ ID NO: 11879 - RNA, 18 nt, Artificial Sequence
  Description of Artificial Sequence: Synthetic oligonucleotide
gucccaacccaggucucu

SEQ ID NO: 11880 - RNA, 18 nt, Artificial Sequence
  Description of Artificial Sequence: Synthetic oligonucleotide
aucuugucccaacccagg

SEQ ID NO: 11881 - RNA, 18 nt, Artificial Sequence
  Description of Artificial Sequence: Synthetic oligonucleotide
caccaaucuugucccaac

SEQ ID NO: 11882 - RNA, 18 nt, Artificial Sequence
  Description of Artificial Sequence: Synthetic oligonucleotide
uaacccaccaaucuuguc

SEQ ID NO: 11883 - RNA, 18 nt, Artificial Sequence
  Description of Artificial Sequence: Synthetic oligonucleotide
ucauguaacccaccaauc

SEQ ID NO: 11884 - RNA, 18 nt, Artificial Sequence
  Description of Artificial Sequence: Synthetic oligonucleotide
uaacuucauguaacccac

SEQ ID NO: 11885 - RNA, 18 nt, Artificial Sequence
  Description of Artificial Sequence: Synthetic oligonucleotide
cugccuaacuucauguaa

SEQ ID NO: 11886 - RNA, 18 nt, Artificial Sequence
  Description of Artificial Sequence: Synthetic oligonucleotide
aguaucugccuaacuuca

SEQ ID NO: 11887 - RNA, 18 nt, Artificial Sequence
  Description of Artificial Sequence: Synthetic oligonucleotide
ccaugaguaucugccuaa

SEQ ID NO: 11888 - RNA, 18 nt, Artificial Sequence
  Description of Artificial Sequence: Synthetic oligonucleotide
aguauccaugaguaucug

SEQ ID NO: 11889 - RNA, 18 nt, Artificial Sequence
  Description of Artificial Sequence: Synthetic oligonucleotide
uggauaguauccaugagu

SEQ ID NO: 11890 - RNA, 18 nt, Artificial Sequence
  Description of Artificial Sequence: Synthetic oligonucleotide
guaacuggauaguaucca

SEQ ID NO: 11891 - RNA, 18 nt, Artificial Sequence
  Description of Artificial Sequence: Synthetic oligonucleotide
ggcagguaacuggauagu

SEQ ID NO: 11892 - RNA, 18 nt, Artificial Sequence
  Description of Artificial Sequence: Synthetic oligonucleotide
cgccuaaggaauucacuc

SEQ ID NO: 11893 - RNA, 18 nt, Artificial Sequence
  Description of Artificial Sequence: Synthetic oligonucleotide
ggauacgccuaaggaauu

SEQ ID NO: 11894 - RNA, 18 nt, Artificial Sequence
  Description of Artificial Sequence: Synthetic oligonucleotide
aaggaggauacgccuaag

SEQ ID NO: 11895 - RNA, 18 nt, Artificial Sequence
  Description of Artificial Sequence: Synthetic oligonucleotide
gcuccaaggaggauacgc

SEQ ID NO: 11896 - RNA, 18 nt, Artificial Sequence
  Description of Artificial Sequence: Synthetic oligonucleotide
gaugugcuccaaggagga

SEQ ID NO: 11897 - RNA, 18 nt, Artificial Sequence
  Description of Artificial Sequence: Synthetic oligonucleotide
ugagugaugugcuccaag

SEQ ID NO: 11898 - RNA, 18 nt, Artificial Sequence
  Description of Artificial Sequence: Synthetic oligonucleotide
ggcugugagugaugugcu

SEQ ID NO: 11899 - RNA, 18 nt, Artificial Sequence
  Description of Artificial Sequence: Synthetic oligonucleotide
caggaggcugugagugau

SEQ ID NO: 11900 - RNA, 18 nt, Artificial Sequence
  Description of Artificial Sequence: Synthetic oligonucleotide
cgucccaggaggcuguga

SEQ ID NO: 11901 - RNA, 18 nt, Artificial Sequence
  Description of Artificial Sequence: Synthetic oligonucleotide
aagggcgucccaggaggc

SEQ ID NO: 11902 - RNA, 18 nt, Artificial Sequence
  Description of Artificial Sequence: Synthetic oligonucleotide
agacaaagggcgucccag

SEQ ID NO: 11903 - RNA, 18 nt, Artificial Sequence
  Description of Artificial Sequence: Synthetic oligonucleotide
ugccgagacaaagggcgu

SEQ ID NO: 11904 - RNA, 18 nt, Artificial Sequence
  Description of Artificial Sequence: Synthetic oligonucleotide
ucagcugccgagacaaag

SEQ ID NO: 11905 - RNA, 18 nt, Artificial Sequence
  Description of Artificial Sequence: Synthetic oligonucleotide
agacaucagcugccgaga

SEQ ID NO: 11906 - RNA, 18 nt, Artificial Sequence
  Description of Artificial Sequence: Synthetic oligonucleotide
acaagagacaucagcugc

SEQ ID NO: 11907 - RNA, 18 nt, Artificial Sequence
  Description of Artificial Sequence: Synthetic oligonucleotide
cugcaacaagagacauca

SEQ ID NO: 11908 - RNA, 18 nt, Artificial Sequence
  Description of Artificial Sequence: Synthetic oligonucleotide
aaguccugcaacaagaga

SEQ ID NO: 11909 - RNA, 18 nt, Artificial Sequence
  Description of Artificial Sequence: Synthetic oligonucleotide
uuccuaaguccugcaaca

SEQ ID NO: 11910 - RNA, 18 nt, Artificial Sequence
  Description of Artificial Sequence: Synthetic oligonucleotide
cuccauuccuaaguccug

SEQ ID NO: 11911 - RNA, 18 nt, Artificial Sequence
  Description of Artificial Sequence: Synthetic oligonucleotide
aagagcuccauuccuaag

SEQ ID NO: 11912 - RNA, 18 nt, Artificial Sequence
  Description of Artificial Sequence: Synthetic oligonucleotide
aguaaaagagcuccauuc

SEQ ID NO: 11913 - RNA, 18 nt, Artificial Sequence
  Description of Artificial Sequence: Synthetic oligonucleotide
cugugaguaaaagagcuc

SEQ ID NO: 11914 - RNA, 18 nt, Artificial Sequence
  Description of Artificial Sequence: Synthetic oligonucleotide
uccuccugugaguaaaag

SEQ ID NO: 11915 - RNA, 18 nt, Artificial Sequence
  Description of Artificial Sequence: Synthetic oligonucleotide
augaacacaccuuaacca

SEQ ID NO: 11916 - RNA, 18 nt, Artificial Sequence
  Description of Artificial Sequence: Synthetic oligonucleotide
gaaaaaugaacacaccuu

SEQ ID NO: 11917 - RNA, 18 nt, Artificial Sequence
  Description of Artificial Sequence: Synthetic oligonucleotide
uuacagaaaaaugaacac

SEQ ID NO: 11918 - RNA, 18 nt, Artificial Sequence
  Description of Artificial Sequence: Synthetic oligonucleotide
aaauguuacagaaaaaug

SEQ ID NO: 11919 - RNA, 18 nt, Artificial Sequence
  Description of Artificial Sequence: Synthetic oligonucleotide
uuauuaaauguuacagaa

SEQ ID NO: 11920 - RNA, 18 nt, Artificial Sequence
  Description of Artificial Sequence: Synthetic oligonucleotide
aaaaguuauuaaauguua

SEQ ID NO: 11921 - RNA, 18 nt, Artificial Sequence
  Description of Artificial Sequence: Synthetic oligonucleotide
aaaugaaaaguuauuaaa

SEQ ID NO: 11922 - RNA, 18 nt, Artificial Sequence
  Description of Artificial Sequence: Synthetic oligonucleotide
aagauaaaugaaaaguua

SEQ ID NO: 11923 - RNA, 18 nt, Artificial Sequence
  Description of Artificial Sequence: Synthetic oligonucleotide
aaagaaagauaaaugaaa

SEQ ID NO: 11924 - RNA, 18 nt, Artificial Sequence
  Description of Artificial Sequence: Synthetic oligonucleotide
aacccaaagaaagauaaa

SEQ ID NO: 11925 - RNA, 18 nt, Artificial Sequence
  Description of Artificial Sequence: Synthetic oligonucleotide
gucaaaacccaaagaaag

SEQ ID NO: 11926 - RNA, 18 nt, Artificial Sequence
  Description of Artificial Sequence: Synthetic oligonucleotide
agauggucaaaacccaaa

SEQ ID NO: 11927 - RNA, 18 nt, Artificial Sequence
  Description of Artificial Sequence: Synthetic oligonucleotide
auaauagauggucaaaac

SEQ ID NO: 11928 - RNA, 18 nt, Artificial Sequence
  Description of Artificial Sequence: Synthetic oligonucleotide
ccuauauaauagaugguc

SEQ ID NO: 11929 - RNA, 18 nt, Artificial Sequence
  Description of Artificial Sequence: Synthetic oligonucleotide
cccacccuauauaauaga

SEQ ID NO: 11930 - RNA, 18 nt, Artificial Sequence
  Description of Artificial Sequence: Synthetic oligonucleotide
caaaacccacccuauaua

SEQ ID NO: 11931 - RNA, 18 nt, Artificial Sequence
  Description of Artificial Sequence: Synthetic oligonucleotide
auggucaaaacccacccu

SEQ ID NO: 11932 - RNA, 18 nt, Artificial Sequence
  Description of Artificial Sequence: Synthetic oligonucleotide
aauagauggucaaaaccc

SEQ ID NO: 11933 - RNA, 18 nt, Artificial Sequence
  Description of Artificial Sequence: Synthetic oligonucleotide
uauauaauagauggucaa

SEQ ID NO: 11934 - RNA, 18 nt, Artificial Sequence
  Description of Artificial Sequence: Synthetic oligonucleotide
aacccuauauaauagaug

SEQ ID NO: 11935 - RNA, 18 nt, Artificial Sequence
  Description of Artificial Sequence: Synthetic oligonucleotide
guauaaacccuauauaau

SEQ ID NO: 11936 - RNA, 18 nt, Artificial Sequence
  Description of Artificial Sequence: Synthetic oligonucleotide
augucguauaaacccuau

SEQ ID NO: 11937 - RNA, 18 nt, Artificial Sequence
  Description of Artificial Sequence: Synthetic oligonucleotide
uccauaugucguauaaac

SEQ ID NO: 11938 - RNA, 18 nt, Artificial Sequence
  Description of Artificial Sequence: Synthetic oligonucleotide
ugcuuuccauaugucgua

SEQ ID NO: 11939 - RNA, 18 nt, Artificial Sequence
  Description of Artificial Sequence: Synthetic oligonucleotide
augaaugcuuuccauaug

SEQ ID NO: 11940 - RNA, 18 nt, Artificial Sequence
  Description of Artificial Sequence: Synthetic oligonucleotide
aauaaaugaaugcuuucc

SEQ ID NO: 11941 - RNA, 18 nt, Artificial Sequence
  Description of Artificial Sequence: Synthetic oligonucleotide
uagugaauaaaugaaugc

SEQ ID NO: 11942 - RNA, 18 nt, Artificial Sequence
  Description of Artificial Sequence: Synthetic oligonucleotide
aauauuagugaauaaaug

SEQ ID NO: 11943 - RNA, 18 nt, Artificial Sequence
  Description of Artificial Sequence: Synthetic oligonucleotide
acagaaauauuagugaau

SEQ ID NO: 11944 - RNA, 18 nt, Artificial Sequence
  Description of Artificial Sequence: Synthetic oligonucleotide
gacacacagaaauauuag

SEQ ID NO: 11945 - RNA, 18 nt, Artificial Sequence
  Description of Artificial Sequence: Synthetic oligonucleotide
aagcagacacacagaaau

SEQ ID NO: 11946 - RNA, 18 nt, Artificial Sequence
  Description of Artificial Sequence: Synthetic oligonucleotide
ccuaaaagcagacacaca

SEQ ID NO: 11947 - RNA, 18 nt, Artificial Sequence
  Description of Artificial Sequence: Synthetic oligonucleotide
caacaccuaaaagcagac

SEQ ID NO: 11948 - RNA, 18 nt, Artificial Sequence
  Description of Artificial Sequence: Synthetic oligonucleotide
ucccccaacaccuaaaag

SEQ ID NO: 11949 - RNA, 18 nt, Artificial Sequence
  Description of Artificial Sequence: Synthetic oligonucleotide
aucacucccccaacaccu

SEQ ID NO: 11950 - RNA, 18 nt, Artificial Sequence
  Description of Artificial Sequence: Synthetic oligonucleotide
ucgucaucacucccccaa

SEQ ID NO: 11951 - RNA, 18 nt, Artificial Sequence
  Description of Artificial Sequence: Synthetic oligonucleotide
cuuauucgucaucacucc

SEQ ID NO: 11952 - RNA, 18 nt, Artificial Sequence
  Description of Artificial Sequence: Synthetic oligonucleotide
ucagucuuauucgucauc

SEQ ID NO: 11953 - RNA, 18 nt, Artificial Sequence
  Description of Artificial Sequence: Synthetic oligonucleotide
gaacaucagucuuauucg

SEQ ID NO: 11954 - RNA, 18 nt, Artificial Sequence
  Description of Artificial Sequence: Synthetic oligonucleotide
auggagaacaucagucuu

SEQ ID NO: 11955 - RNA, 18 nt, Artificial Sequence
  Description of Artificial Sequence: Synthetic oligonucleotide
agggcauggagaacauca

SEQ ID NO: 11956 - RNA, 18 nt, Artificial Sequence
  Description of Artificial Sequence: Synthetic oligonucleotide
gaaaaagggcauggagaa

SEQ ID NO: 11957 - RNA, 18 nt, Artificial Sequence
  Description of Artificial Sequence: Synthetic oligonucleotide
acacagaaaaagggcaug

SEQ ID NO: 11958 - RNA, 18 nt, Artificial Sequence
  Description of Artificial Sequence: Synthetic oligonucleotide
aacugacacagaaaaagg

SEQ ID NO: 11959 - RNA, 18 nt, Artificial Sequence
  Description of Artificial Sequence: Synthetic oligonucleotide
guaucaacugacacagaa

SEQ ID NO: 11960 - RNA, 18 nt, Artificial Sequence
  Description of Artificial Sequence: Synthetic oligonucleotide
uaauuguaucaacugaca

SEQ ID NO: 11961 - RNA, 18 nt, Artificial Sequence
  Description of Artificial Sequence: Synthetic oligonucleotide
ccauauaauuguaucaac

SEQ ID NO: 11962 - RNA, 18 nt, Artificial Sequence
  Description of Artificial Sequence: Synthetic oligonucleotide
aaaaaccauauaauugua

SEQ ID NO: 11963 - RNA, 18 nt, Artificial Sequence
  Description of Artificial Sequence: Synthetic oligonucleotide
aaaagaaaaaccauauaa

SEQ ID NO: 11964 - RNA, 18 nt, Artificial Sequence
  Description of Artificial Sequence: Synthetic oligonucleotide
ccuaaaaaagaaaaacca

SEQ ID NO: 11965 - RNA, 18 nt, Artificial Sequence
  Description of Artificial Sequence: Synthetic oligonucleotide
aauagccuaaaaaagaaa

SEQ ID NO: 11966 - RNA, 18 nt, Artificial Sequence
  Description of Artificial Sequence: Synthetic oligonucleotide
caccuaauagccuaaaaa

SEQ ID NO: 11967 - RNA, 18 nt, Artificial Sequence
  Description of Artificial Sequence: Synthetic oligonucleotide
aucaacaccuaauagccu

SEQ ID NO: 11968 - RNA, 18 nt, Artificial Sequence
  Description of Artificial Sequence: Synthetic oligonucleotide
acccuaucaacaccuaau

SEQ ID NO: 11969 - RNA, 18 nt, Artificial Sequence
  Description of Artificial Sequence: Synthetic oligonucleotide
acucaacccuaucaacac

SEQ ID NO: 11970 - RNA, 18 nt, Artificial Sequence
  Description of Artificial Sequence: Synthetic oligonucleotide
aaguuacucaacccuauc

SEQ ID NO: 11971 - RNA, 18 nt, Artificial Sequence
  Description of Artificial Sequence: Synthetic oligonucleotide
uuuguaaguuacucaacc

SEQ ID NO: 11972 - RNA, 18 nt, Artificial Sequence
  Description of Artificial Sequence: Synthetic oligonucleotide
caacauuuguaaguuacu

SEQ ID NO: 11973 - RNA, 18 nt, Artificial Sequence
  Description of Artificial Sequence: Synthetic oligonucleotide
ugguucaacauuuguaag

SEQ ID NO: 11974 - RNA, 18 nt, Artificial Sequence
  Description of Artificial Sequence: Synthetic oligonucleotide
aaggcugguucaacauuu

SEQ ID NO: 11975 - RNA, 18 nt, Artificial Sequence
  Description of Artificial Sequence: Synthetic oligonucleotide
uaugcaaggcugguucaa

SEQ ID NO: 11976 - RNA, 18 nt, Artificial Sequence
  Description of Artificial Sequence: Synthetic oligonucleotide
acagguaugcaaggcugg

SEQ ID NO: 11977 - RNA, 18 nt, Artificial Sequence
  Description of Artificial Sequence: Synthetic oligonucleotide
uuaucacagguaugcaag

SEQ ID NO: 11978 - RNA, 18 nt, Artificial Sequence
  Description of Artificial Sequence: Synthetic oligonucleotide
gguauuuaucacagguau

SEQ ID NO: 11979 - RNA, 18 nt, Artificial Sequence
  Description of Artificial Sequence: Synthetic oligonucleotide
uacgugguauuuaucaca

SEQ ID NO: 11980 - RNA, 18 nt, Artificial Sequence
  Description of Artificial Sequence: Synthetic oligonucleotide
acaacuacgugguauuua

SEQ ID NO: 11981 - RNA, 18 nt, Artificial Sequence
  Description of Artificial Sequence: Synthetic oligonucleotide
acaccacaacuacguggu

SEQ ID NO: 11982 - RNA, 18 nt, Artificial Sequence
  Description of Artificial Sequence: Synthetic oligonucleotide
cugguucaacauuuguaa

SEQ ID NO: 11983 - RNA, 18 nt, Artificial Sequence
  Description of Artificial Sequence: Synthetic oligonucleotide
caaggcugguucaacauu

SEQ ID NO: 11984 - RNA, 18 nt, Artificial Sequence
  Description of Artificial Sequence: Synthetic oligonucleotide
guaugcaaggcugguuca

SEQ ID NO: 11985 - RNA, 18 nt, Artificial Sequence
  Description of Artificial Sequence: Synthetic oligonucleotide
cacagguaugcaaggcug

SEQ ID NO: 11986 - RNA, 18 nt, Artificial Sequence
  Description of Artificial Sequence: Synthetic oligonucleotide
uuuaucacagguaugcaa

SEQ ID NO: 11987 - RNA, 18 nt, Artificial Sequence
  Description of Artificial Sequence: Synthetic oligonucleotide
ugguauuuaucacaggua

SEQ ID NO: 11988 - RNA, 18 nt, Artificial Sequence
  Description of Artificial Sequence: Synthetic oligonucleotide
cuacgugguauuuaucac

SEQ ID NO: 11989 - RNA, 18 nt, Artificial Sequence
  Description of Artificial Sequence: Synthetic oligonucleotide
cacaacuacgugguauuu

SEQ ID NO: 11990 - RNA, 18 nt, Artificial Sequence
  Description of Artificial Sequence: Synthetic oligonucleotide
uacaccacaacuacgugg

SEQ ID NO: 11991 - RNA, 18 nt, Artificial Sequence
  Description of Artificial Sequence: Synthetic oligonucleotide
aaugauacaccacaacua

SEQ ID NO: 11992 - RNA, 18 nt, Artificial Sequence
  Description of Artificial Sequence: Synthetic oligonucleotide
gaaagaaugauacaccac

SEQ ID NO: 11993 - RNA, 18 nt, Artificial Sequence
  Description of Artificial Sequence: Synthetic oligonucleotide
auguagaaagaaugauac

SEQ ID NO: 11994 - RNA, 18 nt, Artificial Sequence
  Description of Artificial Sequence: Synthetic oligonucleotide
cagcaauguagaaagaau

SEQ ID NO: 11995 - RNA, 18 nt, Artificial Sequence
  Description of Artificial Sequence: Synthetic oligonucleotide
aaacucagcaauguagaa

SEQ ID NO: 11996 - RNA, 18 nt, Artificial Sequence
  Description of Artificial Sequence: Synthetic oligonucleotide
agauaaaacucagcaaug

SEQ ID NO: 11997 - RNA, 18 nt, Artificial Sequence
  Description of Artificial Sequence: Synthetic oligonucleotide
uuagcagauaaaacucag

SEQ ID NO: 11998 - RNA, 18 nt, Artificial Sequence
  Description of Artificial Sequence: Synthetic oligonucleotide
gaacauuagcagauaaaa

SEQ ID NO: 11999 - RNA, 18 nt, Artificial Sequence
  Description of Artificial Sequence: Synthetic oligonucleotide
caacagaacauuagcaga

SEQ ID NO: 12000 - RNA, 18 nt, Artificial Sequence
  Description of Artificial Sequence: Synthetic oligonucleotide
aagcucaacagaacauua

SEQ ID NO: 12001 - RNA, 18 nt, Artificial Sequence
  Description of Artificial Sequence: Synthetic oligonucleotide
gacaaaagcucaacagaa

SEQ ID NO: 12002 - RNA, 18 nt, Artificial Sequence
  Description of Artificial Sequence: Synthetic oligonucleotide
aaauggacaaaagcucaa

SEQ ID NO: 12003 - RNA, 18 nt, Artificial Sequence
  Description of Artificial Sequence: Synthetic oligonucleotide
aacuuaaauggacaaaag

SEQ ID NO: 12004 - RNA, 18 nt, Artificial Sequence
  Description of Artificial Sequence: Synthetic oligonucleotide
uuucaaacuuaaauggac

SEQ ID NO: 12005 - RNA, 18 nt, Artificial Sequence
  Description of Artificial Sequence: Synthetic oligonucleotide
aucacuuucaaacuuaaa

SEQ ID NO: 12006 - RNA, 18 nt, Artificial Sequence
  Description of Artificial Sequence: Synthetic oligonucleotide
aacuaaucacuuucaaac

SEQ ID NO: 12007 - RNA, 18 nt, Artificial Sequence
  Description of Artificial Sequence: Synthetic oligonucleotide
cugcaaacuaaucacuuu

SEQ ID NO: 12008 - RNA, 18 nt, Artificial Sequence
  Description of Artificial Sequence: Synthetic oligonucleotide
gaaaacugcaaacuaauc

SEQ ID NO: 12009 - RNA, 18 nt, Artificial Sequence
  Description of Artificial Sequence: Synthetic oligonucleotide
aaacagaaaacugcaaac

SEQ ID NO: 12010 - RNA, 18 nt, Artificial Sequence
  Description of Artificial Sequence: Synthetic oligonucleotide
cacaaaaacagaaaacug

SEQ ID NO: 12011 - RNA, 18 nt, Artificial Sequence
  Description of Artificial Sequence: Synthetic oligonucleotide
gacaacacaaaaacagaa

SEQ ID NO: 12012 - RNA, 18 nt, Artificial Sequence
  Description of Artificial Sequence: Synthetic oligonucleotide
acaaagacaacacaaaaa

SEQ ID NO: 12013 - RNA, 18 nt, Artificial Sequence
  Description of Artificial Sequence: Synthetic oligonucleotide
accagacaaagacaacac

SEQ ID NO: 12014 - RNA, 18 nt, Artificial Sequence
  Description of Artificial Sequence: Synthetic oligonucleotide
gcaaaaccagacaaagac

SEQ ID NO: 12015 - RNA, 18 nt, Artificial Sequence
  Description of Artificial Sequence: Synthetic oligonucleotide
ggauagcaaaaccagaca

SEQ ID NO: 12016 - RNA, 18 nt, Artificial Sequence
  Description of Artificial Sequence: Synthetic oligonucleotide
uacacggauagcaaaacc

SEQ ID NO: 12017 - RNA, 18 nt, Artificial Sequence
  Description of Artificial Sequence: Synthetic oligonucleotide
agauuuacacggauagca

SEQ ID NO: 12018 - RNA, 18 nt, Artificial Sequence
  Description of Artificial Sequence: Synthetic oligonucleotide
aggccagauuuacacgga

SEQ ID NO: 12019 - RNA, 18 nt, Artificial Sequence
  Description of Artificial Sequence: Synthetic oligonucleotide
uuaugaggccagauuuac

SEQ ID NO: 12020 - RNA, 18 nt, Artificial Sequence
  Description of Artificial Sequence: Synthetic oligonucleotide
ucauuuuaugaggccaga

SEQ ID NO: 12021 - RNA, 18 nt, Artificial Sequence
  Description of Artificial Sequence: Synthetic oligonucleotide
ccaucucauuuuaugagg

SEQ ID NO: 12022 - RNA, 18 nt, Artificial Sequence
  Description of Artificial Sequence: Synthetic oligonucleotide
acuucccaucucauuuua

SEQ ID NO: 12023 - RNA, 18 nt, Artificial Sequence
  Description of Artificial Sequence: Synthetic oligonucleotide
agaauacuucccaucuca

SEQ ID NO: 12024 - RNA, 18 nt, Artificial Sequence
  Description of Artificial Sequence: Synthetic oligonucleotide
aggagagaauacuuccca

SEQ ID NO: 12025 - RNA, 18 nt, Artificial Sequence
  Description of Artificial Sequence: Synthetic oligonucleotide
agaagaggagagaauacu

SEQ ID NO: 12026 - RNA, 18 nt, Artificial Sequence
  Description of Artificial Sequence: Synthetic oligonucleotide
acaaaagaagaggagaga

SEQ ID NO: 12027 - RNA, 18 nt, Artificial Sequence
  Description of Artificial Sequence: Synthetic oligonucleotide
aaaaaacaaaagaagagg

SEQ ID NO: 12028 - RNA, 18 nt, Artificial Sequence
  Description of Artificial Sequence: Synthetic oligonucleotide
uuccaaaaaaacaaaaga

SEQ ID NO: 12029 - RNA, 18 nt, Artificial Sequence
  Description of Artificial Sequence: Synthetic oligonucleotide
accucuuccaaaaaaaca

SEQ ID NO: 12030 - RNA, 18 nt, Artificial Sequence
  Description of Artificial Sequence: Synthetic oligonucleotide
auacaaccucuuccaaaa

SEQ ID NO: 12031 - RNA, 18 nt, Artificial Sequence
  Description of Artificial Sequence: Synthetic oligonucleotide
auuuuauacaaccucuuc

SEQ ID NO: 12032 - RNA, 18 nt, Artificial Sequence
  Description of Artificial Sequence: Synthetic oligonucleotide
ccucaauuuuauacaacc

SEQ ID NO: 12033 - RNA, 18 nt, Artificial Sequence
  Description of Artificial Sequence: Synthetic oligonucleotide
uucagccucaauuuuaua

SEQ ID NO: 12034 - RNA, 18 nt, Artificial Sequence
  Description of Artificial Sequence: Synthetic oligonucleotide
caagauucagccucaauu

SEQ ID NO: 12035 - RNA, 18 nt, Artificial Sequence
  Description of Artificial Sequence: Synthetic oligonucleotide
accaccaagauucagccu

SEQ ID NO: 12036 - RNA, 18 nt, Artificial Sequence
  Description of Artificial Sequence: Synthetic oligonucleotide
uggcaaccaccaagauuc

SEQ ID NO: 12037 - RNA, 18 nt, Artificial Sequence
  Description of Artificial Sequence: Synthetic oligonucleotide
cauuguggcaaccaccaa

SEQ ID NO: 12038 - RNA, 18 nt, Artificial Sequence
  Description of Artificial Sequence: Synthetic oligonucleotide
ccugucauuguggcaacc

SEQ ID NO: 12039 - RNA, 18 nt, Artificial Sequence
  Description of Artificial Sequence: Synthetic oligonucleotide
uaguuccugucauugugg

SEQ ID NO: 12040 - RNA, 18 nt, Artificial Sequence
  Description of Artificial Sequence: Synthetic oligonucleotide
agaaauaguuccugucau

SEQ ID NO: 12041 - RNA, 18 nt, Artificial Sequence
  Description of Artificial Sequence: Synthetic oligonucleotide
gucacagaaauaguuccu

SEQ ID NO: 12042 - RNA, 18 nt, Artificial Sequence
  Description of Artificial Sequence: Synthetic oligonucleotide
auucagucacagaaauag

SEQ ID NO: 12043 - RNA, 18 nt, Artificial Sequence
  Description of Artificial Sequence: Synthetic oligonucleotide
aauauauucagucacaga

SEQ ID NO: 12044 - RNA, 18 nt, Artificial Sequence
  Description of Artificial Sequence: Synthetic oligonucleotide
uucccaauauauucaguc

SEQ ID NO: 12045 - RNA, 18 nt, Artificial Sequence
  Description of Artificial Sequence: Synthetic oligonucleotide
aggaauucccaauauauu

SEQ ID NO: 12046 - RNA, 18 nt, Artificial Sequence
  Description of Artificial Sequence: Synthetic oligonucleotide
uuuauaggaauucccaau

SEQ ID NO: 12047 - RNA, 18 nt, Artificial Sequence
  Description of Artificial Sequence: Synthetic oligonucleotide
aaguugauuuuccacuuc

SEQ ID NO: 12048 - RNA, 18 nt, Artificial Sequence
  Description of Artificial Sequence: Synthetic oligonucleotide
ggcuaaaguugauuuucc

SEQ ID NO: 12049 - RNA, 18 nt, Artificial Sequence
  Description of Artificial Sequence: Synthetic oligonucleotide
gcuuuggcuaaaguugau

SEQ ID NO: 12050 - RNA, 18 nt, Artificial Sequence
  Description of Artificial Sequence: Synthetic oligonucleotide
agauugcuuuggcuaaag

SEQ ID NO: 12051 - RNA, 18 nt, Artificial Sequence
  Description of Artificial Sequence: Synthetic oligonucleotide
uuuacagauugcuuuggc

SEQ ID NO: 12052 - RNA, 18 nt, Artificial Sequence
  Description of Artificial Sequence: Synthetic oligonucleotide
gcuucuuuacagauugcu

SEQ ID NO: 12053 - RNA, 18 nt, Artificial Sequence
  Description of Artificial Sequence: Synthetic oligonucleotide
caaaugcuucuuuacaga

SEQ ID NO: 12054 - RNA, 18 nt, Artificial Sequence
  Description of Artificial Sequence: Synthetic oligonucleotide
uuugucaaaugcuucuuu

SEQ ID NO: 12055 - RNA, 18 nt, Artificial Sequence
  Description of Artificial Sequence: Synthetic oligonucleotide
uccaguuugucaaaugcu

SEQ ID NO: 12056 - RNA, 18 nt, Artificial Sequence
  Description of Artificial Sequence: Synthetic oligonucleotide
gggcauccaguuugucaa

SEQ ID NO: 12057 - RNA, 18 nt, Artificial Sequence
  Description of Artificial Sequence: Synthetic oligonucleotide
cacaugggcauccaguuu

SEQ ID NO: 12058 - RNA, 18 nt, Artificial Sequence
  Description of Artificial Sequence: Synthetic oligonucleotide
cucuccacaugggcaucc

SEQ ID NO: 12059 - RNA, 18 nt, Artificial Sequence
  Description of Artificial Sequence: Synthetic oligonucleotide
caacucucuccacauggg

SEQ ID NO: 12060 - RNA, 18 nt, Artificial Sequence
  Description of Artificial Sequence: Synthetic oligonucleotide
acagucaacucucuccac

SEQ ID NO: 12061 - RNA, 18 nt, Artificial Sequence
  Description of Artificial Sequence: Synthetic oligonucleotide
gcuuuacagucaacucuc

SEQ ID NO: 12062 - RNA, 18 nt, Artificial Sequence
  Description of Artificial Sequence: Synthetic oligonucleotide
guaaagcuuuacagucaa

SEQ ID NO: 12063 - RNA, 18 nt, Artificial Sequence
  Description of Artificial Sequence: Synthetic oligonucleotide
uagcagccaauacauaaa

SEQ ID NO: 12064 - RNA, 18 nt, Artificial Sequence
  Description of Artificial Sequence: Synthetic oligonucleotide
acuaguagcagccaauac

SEQ ID NO: 12065 - RNA, 18 nt, Artificial Sequence
  Description of Artificial Sequence: Synthetic oligonucleotide
gggcgacuaguagcagcc

SEQ ID NO: 12066 - RNA, 18 nt, Artificial Sequence
  Description of Artificial Sequence: Synthetic oligonucleotide
agucagggcgacuaguag

SEQ ID NO: 12067 - RNA, 18 nt, Artificial Sequence
  Description of Artificial Sequence: Synthetic oligonucleotide
aaucaagucagggcgacu

SEQ ID NO: 12068 - RNA, 18 nt, Artificial Sequence
  Description of Artificial Sequence: Synthetic oligonucleotide
gggucaaucaagucaggg

SEQ ID NO: 12069 - RNA, 18 nt, Artificial Sequence
  Description of Artificial Sequence: Synthetic oligonucleotide
gggcagggucaaucaagu

SEQ ID NO: 12070 - RNA, 18 nt, Artificial Sequence
  Description of Artificial Sequence: Synthetic oligonucleotide
aagcagggcagggucaau

SEQ ID NO: 12071 - RNA, 18 nt, Artificial Sequence
  Description of Artificial Sequence: Synthetic oligonucleotide
ggccuaagcagggcaggg

SEQ ID NO: 12072 - RNA, 18 nt, Artificial Sequence
  Description of Artificial Sequence: Synthetic oligonucleotide
gaccaggccuaagcaggg

SEQ ID NO: 12073 - RNA, 18 nt, Artificial Sequence
  Description of Artificial Sequence: Synthetic oligonucleotide
uagucgaccaggccuaag

SEQ ID NO: 12074 - RNA, 18 nt, Artificial Sequence
  Description of Artificial Sequence: Synthetic oligonucleotide
uuaucuagucgaccaggc

SEQ ID NO: 12075 - RNA, 18 nt, Artificial Sequence
  Description of Artificial Sequence: Synthetic oligonucleotide
cacauuuaucuagucgac

SEQ ID NO: 12076 - RNA, 18 nt, Artificial Sequence
  Description of Artificial Sequence: Synthetic oligonucleotide
guauacacauuuaucuag

SEQ ID NO: 12077 - RNA, 18 nt, Artificial Sequence
  Description of Artificial Sequence: Synthetic oligonucleotide
ggacaguauacacauuua

SEQ ID NO: 12078 - RNA, 18 nt, Artificial Sequence
  Description of Artificial Sequence: Synthetic oligonucleotide
gaggaggacaguauacac

SEQ ID NO: 12079 - RNA, 18 nt, Artificial Sequence
  Description of Artificial Sequence: Synthetic oligonucleotide
aucaggaggaggacagua

SEQ ID NO: 12080 - RNA, 18 nt, Artificial Sequence
  Description of Artificial Sequence: Synthetic oligonucleotide
gacucuaaauaugaaauu

SEQ ID NO: 12081 - RNA, 18 nt, Artificial Sequence
  Description of Artificial Sequence: Synthetic oligonucleotide
uuuuggacucuaaauaug

SEQ ID NO: 12082 - RNA, 18 nt, Artificial Sequence
  Description of Artificial Sequence: Synthetic oligonucleotide
uuggguuuuggacucuaa

SEQ ID NO: 12083 - RNA, 18 nt, Artificial Sequence
  Description of Artificial Sequence: Synthetic oligonucleotide
auuuguuggguuuuggac

SEQ ID NO: 12084 - RNA, 18 nt, Artificial Sequence
  Description of Artificial Sequence: Synthetic oligonucleotide
guagcauuuguuggguuu

SEQ ID NO: 12085 - RNA, 18 nt, Artificial Sequence
  Description of Artificial Sequence: Synthetic oligonucleotide
agaguguagcauuuguug

SEQ ID NO: 12086 - RNA, 18 nt, Artificial Sequence
  Description of Artificial Sequence: Synthetic oligonucleotide
aggaaagaguguagcauu

SEQ ID NO: 12087 - RNA, 18 nt, Artificial Sequence
  Description of Artificial Sequence: Synthetic oligonucleotide
ucacaaggaaagagugua

SEQ ID NO: 12088 - RNA, 18 nt, Artificial Sequence
  Description of Artificial Sequence: Synthetic oligonucleotide
aaagcucacaaggaaaga

SEQ ID NO: 12089 - RNA, 18 nt, Artificial Sequence
  Description of Artificial Sequence: Synthetic oligonucleotide
gaaguaaagcucacaagg

SEQ ID NO: 12090 - RNA, 18 nt, Artificial Sequence
  Description of Artificial Sequence: Synthetic oligonucleotide
uggcagaaguaaagcuca

SEQ ID NO: 12091 - RNA, 18 nt, Artificial Sequence
  Description of Artificial Sequence: Synthetic oligonucleotide
uuaccuggcagaaguaaa

SEQ ID NO: 12092 - RNA, 18 nt, Artificial Sequence
  Description of Artificial Sequence: Synthetic oligonucleotide
ugccauuaccuggcagaa

SEQ ID NO: 12093 - RNA, 18 nt, Artificial Sequence
  Description of Artificial Sequence: Synthetic oligonucleotide
acaauugccauuaccugg

SEQ ID NO: 12094 - RNA, 18 nt, Artificial Sequence
  Description of Artificial Sequence: Synthetic oligonucleotide
uaaggacaauugccauua

SEQ ID NO: 12095 - RNA, 18 nt, Artificial Sequence
  Description of Artificial Sequence: Synthetic oligonucleotide
ucuucuaaggacaauugc

SEQ ID NO: 12096 - RNA, 18 nt, Artificial Sequence
  Description of Artificial Sequence: Synthetic oligonucleotide
gcuggucuucuaaggaca

SEQ ID NO: 12097 - RNA, 18 nt, Artificial Sequence
  Description of Artificial Sequence: Synthetic oligonucleotide
agaaagcuggucuucuaa

SEQ ID NO: 12098 - RNA, 18 nt, Artificial Sequence
  Description of Artificial Sequence: Synthetic oligonucleotide
cccuaagaaagcuggucu

SEQ ID NO: 12099 - RNA, 18 nt, Artificial Sequence
  Description of Artificial Sequence: Synthetic oligonucleotide
cuuuucccuaagaaagcu

SEQ ID NO: 12100 - RNA, 18 nt, Artificial Sequence
  Description of Artificial Sequence: Synthetic oligonucleotide
uaaagcuuuucccuaaga

SEQ ID NO: 12101 - RNA, 18 nt, Artificial Sequence
  Description of Artificial Sequence: Synthetic oligonucleotide
guggcuaaagcuuuuccc

SEQ ID NO: 12102 - RNA, 18 nt, Artificial Sequence
  Description of Artificial Sequence: Synthetic oligonucleotide
aaacaguggcuaaagcuu

SEQ ID NO: 12103 - RNA, 18 nt, Artificial Sequence
  Description of Artificial Sequence: Synthetic oligonucleotide
ugagcaaacaguggcuaa

SEQ ID NO: 12104 - RNA, 18 nt, Artificial Sequence
  Description of Artificial Sequence: Synthetic oligonucleotide
ugcuuugagcaaacagug

SEQ ID NO: 12105 - RNA, 18 nt, Artificial Sequence
  Description of Artificial Sequence: Synthetic oligonucleotide
uuuuaugcuuugagcaaa

SEQ ID NO: 12106 - RNA, 18 nt, Artificial Sequence
  Description of Artificial Sequence: Synthetic oligonucleotide
aaucuuuuuaugcuuuga

SEQ ID NO: 12107 - RNA, 18 nt, Artificial Sequence
  Description of Artificial Sequence: Synthetic oligonucleotide
uucagaaucuuuuuaugc

SEQ ID NO: 12108 - RNA, 18 nt, Artificial Sequence
  Description of Artificial Sequence: Synthetic oligonucleotide
ucuaauucagaaucuuuu

SEQ ID NO: 12109 - RNA, 18 nt, Artificial Sequence
  Description of Artificial Sequence: Synthetic oligonucleotide
uugcaucuaauucagaau

SEQ ID NO: 12110 - RNA, 18 nt, Artificial Sequence
  Description of Artificial Sequence: Synthetic oligonucleotide
aggcuuugcaucuaauuc

SEQ ID NO: 12111 - RNA, 18 nt, Artificial Sequence
  Description of Artificial Sequence: Synthetic oligonucleotide
aaaaaaggcuuugcaucu

SEQ ID NO: 12112 - RNA, 18 nt, Artificial Sequence
  Description of Artificial Sequence: Synthetic oligonucleotide
ggccaaaaaaaggcuuug

SEQ ID NO: 12113 - RNA, 18 nt, Artificial Sequence
  Description of Artificial Sequence: Synthetic oligonucleotide
cacugggccaaaaaaagg

SEQ ID NO: 12114 - RNA, 18 nt, Artificial Sequence
  Description of Artificial Sequence: Synthetic oligonucleotide
acuugcacugggccaaaa

SEQ ID NO: 12115 - RNA, 18 nt, Artificial Sequence
  Description of Artificial Sequence: Synthetic oligonucleotide
uucagacuugcacugggc

SEQ ID NO: 12116 - RNA, 18 nt, Artificial Sequence
  Description of Artificial Sequence: Synthetic oligonucleotide
aaguuuucagacuugcac

SEQ ID NO: 12117 - RNA, 18 nt, Artificial Sequence
  Description of Artificial Sequence: Synthetic oligonucleotide
uuacaaaguuuucagacu

SEQ ID NO: 12118 - RNA, 18 nt, Artificial Sequence
  Description of Artificial Sequence: Synthetic oligonucleotide
aaggauuacaaaguuuuc

SEQ ID NO: 12119 - RNA, 18 nt, Artificial Sequence
  Description of Artificial Sequence: Synthetic oligonucleotide
cacagaaggauuacaaag

SEQ ID NO: 12120 - RNA, 18 nt, Artificial Sequence
  Description of Artificial Sequence: Synthetic oligonucleotide
gccaacacagaaggauua

SEQ ID NO: 12121 - RNA, 18 nt, Artificial Sequence
  Description of Artificial Sequence: Synthetic oligonucleotide
aaucagccaacacagaag

SEQ ID NO: 12122 - RNA, 18 nt, Artificial Sequence
  Description of Artificial Sequence: Synthetic oligonucleotide
uccccaaucagccaacac

SEQ ID NO: 12123 - RNA, 18 nt, Artificial Sequence
  Description of Artificial Sequence: Synthetic oligonucleotide
uuuuuuccccaaucagcc

SEQ ID NO: 12124 - RNA, 18 nt, Artificial Sequence
  Description of Artificial Sequence: Synthetic oligonucleotide
cauuuuuuuuuccccaau

SEQ ID NO: 12125 - RNA, 18 nt, Artificial Sequence
  Description of Artificial Sequence: Synthetic oligonucleotide
ucuugcauuuuuuuuucc

SEQ ID NO: 12126 - RNA, 18 nt, Artificial Sequence
  Description of Artificial Sequence: Synthetic oligonucleotide
agguuucuugcauuuuuu

SEQ ID NO: 12127 - RNA, 18 nt, Artificial Sequence
  Description of Artificial Sequence: Synthetic oligonucleotide
acauuagguuucuugcau

SEQ ID NO: 12128 - RNA, 18 nt, Artificial Sequence
  Description of Artificial Sequence: Synthetic oligonucleotide
auaauacauuagguuucu

SEQ ID NO: 12129 - RNA, 18 nt, Artificial Sequence
  Description of Artificial Sequence: Synthetic oligonucleotide
aaaauauaauacauuagg

SEQ ID NO: 12130 - RNA, 18 nt, Artificial Sequence
  Description of Artificial Sequence: Synthetic oligonucleotide
augugaaaauauaauaca

SEQ ID NO: 12131 - RNA, 18 nt, Artificial Sequence
  Description of Artificial Sequence: Synthetic oligonucleotide
agauaaugugaaaauaua

SEQ ID NO: 12132 - RNA, 18 nt, Artificial Sequence
  Description of Artificial Sequence: Synthetic oligonucleotide
acagaagauaaugugaaa

SEQ ID NO: 12133 - RNA, 18 nt, Artificial Sequence
  Description of Artificial Sequence: Synthetic oligonucleotide
uuugaacagaagauaaug

SEQ ID NO: 12134 - RNA, 18 nt, Artificial Sequence
  Description of Artificial Sequence: Synthetic oligonucleotide
uaaucuuugaacagaaga

SEQ ID NO: 12135 - RNA, 18 nt, Artificial Sequence
  Description of Artificial Sequence: Synthetic oligonucleotide
guauguaaucuuugaaca

SEQ ID NO: 12136 - RNA, 18 nt, Artificial Sequence
  Description of Artificial Sequence: Synthetic oligonucleotide
uggaaguauguaaucuuu

SEQ ID NO: 12137 - RNA, 18 nt, Artificial Sequence
  Description of Artificial Sequence: Synthetic oligonucleotide
gauaauggaaguauguaa

SEQ ID NO: 12138 - RNA, 18 nt, Artificial Sequence
  Description of Artificial Sequence: Synthetic oligonucleotide
gacaggauaauggaagua

SEQ ID NO: 12139 - RNA, 18 nt, Artificial Sequence
  Description of Artificial Sequence: Synthetic oligonucleotide
uuuuugacaggauaaugg

SEQ ID NO: 12140 - RNA, 18 nt, Artificial Sequence
  Description of Artificial Sequence: Synthetic oligonucleotide
uuuuuuuuuugacaggau

SEQ ID NO: 12141 - RNA, 18 nt, Artificial Sequence
  Description of Artificial Sequence: Synthetic oligonucleotide
cagaguuuuuuuuuugac

SEQ ID NO: 12142 - RNA, 18 nt, Artificial Sequence
  Description of Artificial Sequence: Synthetic oligonucleotide
uguaucagaguuuuuuuu

SEQ ID NO: 12143 - RNA, 18 nt, Artificial Sequence
  Description of Artificial Sequence: Synthetic oligonucleotide
gauucuguaucagaguuu

SEQ ID NO: 12144 - RNA, 18 nt, Artificial Sequence
  Description of Artificial Sequence: Synthetic oligonucleotide
ugcuugauucuguaucag

SEQ ID NO: 12145 - RNA, 18 nt, Artificial Sequence
  Description of Artificial Sequence: Synthetic oligonucleotide
ucacaugcuugauucugu

SEQ ID NO: 12146 - RNA, 18 nt, Artificial Sequence
  Description of Artificial Sequence: Synthetic oligonucleotide
acgauucacaugcuugau

SEQ ID NO: 12147 - RNA, 18 nt, Artificial Sequence
  Description of Artificial Sequence: Synthetic oligonucleotide
ugcuuacgauucacaugc

SEQ ID NO: 12148 - RNA, 18 nt, Artificial Sequence
  Description of Artificial Sequence: Synthetic oligonucleotide
uuacaugcuuacgauuca

SEQ ID NO: 12149 - RNA, 18 nt, Artificial Sequence
  Description of Artificial Sequence: Synthetic oligonucleotide
ccugcuuacaugcuuacg

SEQ ID NO: 12150 - RNA, 18 nt, Artificial Sequence
  Description of Artificial Sequence: Synthetic oligonucleotide
ugaaaccugcuuacaugc

SEQ ID NO: 12151 - RNA, 18 nt, Artificial Sequence
  Description of Artificial Sequence: Synthetic oligonucleotide
cucuaugaaaccugcuua

SEQ ID NO: 12152 - RNA, 18 nt, Artificial Sequence
  Description of Artificial Sequence: Synthetic oligonucleotide
auuaucucuaugaaaccu

SEQ ID NO: 12153 - RNA, 18 nt, Artificial Sequence
  Description of Artificial Sequence: Synthetic oligonucleotide
gaaaaauuaucucuauga

SEQ ID NO: 12154 - RNA, 18 nt, Artificial Sequence
  Description of Artificial Sequence: Synthetic oligonucleotide
gaguugaaaaauuaucuc

SEQ ID NO: 12155 - RNA, 18 nt, Artificial Sequence
  Description of Artificial Sequence: Synthetic oligonucleotide
aggaagaguugaaaaauu

SEQ ID NO: 12156 - RNA, 18 nt, Artificial Sequence
  Description of Artificial Sequence: Synthetic oligonucleotide
ggacaaggaagaguugaa

SEQ ID NO: 12157 - RNA, 18 nt, Artificial Sequence
  Description of Artificial Sequence: Synthetic oligonucleotide
acacaggacaaggaagag

SEQ ID NO: 12158 - RNA, 18 nt, Artificial Sequence
  Description of Artificial Sequence: Synthetic oligonucleotide
gaacaacacaggacaagg

SEQ ID NO: 12159 - RNA, 18 nt, Artificial Sequence
  Description of Artificial Sequence: Synthetic oligonucleotide
aguuggaacaacacagga

SEQ ID NO: 12160 - RNA, 18 nt, Artificial Sequence
  Description of Artificial Sequence: Synthetic oligonucleotide
auaagaguuggaacaaca

SEQ ID NO: 12161 - RNA, 18 nt, Artificial Sequence
  Description of Artificial Sequence: Synthetic oligonucleotide
ggagaauaagaguuggaa

SEQ ID NO: 12162 - RNA, 18 nt, Artificial Sequence
  Description of Artificial Sequence: Synthetic oligonucleotide
aaauuggagaauaagagu

SEQ ID NO: 12163 - RNA, 18 nt, Artificial Sequence
  Description of Artificial Sequence: Synthetic oligonucleotide
cuucuaaauuggagaaua

SEQ ID NO: 12164 - RNA, 18 nt, Artificial Sequence
  Description of Artificial Sequence: Synthetic oligonucleotide
guuugcuucuaaauugga

SEQ ID NO: 12165 - RNA, 18 nt, Artificial Sequence
  Description of Artificial Sequence: Synthetic oligonucleotide
uauuuguuugcuucuaaa

SEQ ID NO: 12166 - RNA, 18 nt, Artificial Sequence
  Description of Artificial Sequence: Synthetic oligonucleotide
ucauuuauuuguuugcuu

SEQ ID NO: 12167 - RNA, 18 nt, Artificial Sequence
  Description of Artificial Sequence: Synthetic oligonucleotide
uucauucauuuauuuguu

SEQ ID NO: 12168 - RNA, 18 nt, Artificial Sequence
  Description of Artificial Sequence: Synthetic oligonucleotide
guucuuucauucauuuau

SEQ ID NO: 12169 - RNA, 18 nt, Artificial Sequence
  Description of Artificial Sequence: Synthetic oligonucleotide
uaucuguucuuucauuca

SEQ ID NO: 12170 - RNA, 18 nt, Artificial Sequence
  Description of Artificial Sequence: Synthetic oligonucleotide
uugucuaucuguucuuuc

SEQ ID NO: 12171 - RNA, 18 nt, Artificial Sequence
  Description of Artificial Sequence: Synthetic oligonucleotide
uucauuugucuaucuguu

SEQ ID NO: 12172 - RNA, 18 nt, Artificial Sequence
  Description of Artificial Sequence: Synthetic oligonucleotide
gacuauucauuugucuau

SEQ ID NO: 12173 - RNA, 18 nt, Artificial Sequence
  Description of Artificial Sequence: Synthetic oligonucleotide
ccuuugacuauucauuug

SEQ ID NO: 12174 - RNA, 18 nt, Artificial Sequence
  Description of Artificial Sequence: Synthetic oligonucleotide
uuauaccuuugacuauuc

SEQ ID NO: 12175 - RNA, 18 nt, Artificial Sequence
  Description of Artificial Sequence: Synthetic oligonucleotide
auacuuuauaccuuugac

SEQ ID NO: 12176 - RNA, 18 nt, Artificial Sequence
  Description of Artificial Sequence: Synthetic oligonucleotide
uacagauacuuuauaccu

SEQ ID NO: 12177 - RNA, 18 nt, Artificial Sequence
  Description of Artificial Sequence: Synthetic oligonucleotide
auauauacagauacuuua

SEQ ID NO: 12178 - RNA, 18 nt, Artificial Sequence
  Description of Artificial Sequence: Synthetic oligonucleotide
guaacauauauacagaua

SEQ ID NO: 12179 - RNA, 18 nt, Artificial Sequence
  Description of Artificial Sequence: Synthetic oligonucleotide
ugagaccuugucugaaaa

SEQ ID NO: 12180 - RNA, 18 nt, Artificial Sequence
  Description of Artificial Sequence: Synthetic oligonucleotide
caaagugagaccuugucu

SEQ ID NO: 12181 - RNA, 18 nt, Artificial Sequence
  Description of Artificial Sequence: Synthetic oligonucleotide
ggugacaaagugagaccu

SEQ ID NO: 12182 - RNA, 18 nt, Artificial Sequence
  Description of Artificial Sequence: Synthetic oligonucleotide
gccugggugacaaaguga

SEQ ID NO: 12183 - RNA, 18 nt, Artificial Sequence
  Description of Artificial Sequence: Synthetic oligonucleotide
cuccagccugggugacaa

SEQ ID NO: 12184 - RNA, 18 nt, Artificial Sequence
  Description of Artificial Sequence: Synthetic oligonucleotide
guguacuccagccugggu

SEQ ID NO: 12185 - RNA, 18 nt, Artificial Sequence
  Description of Artificial Sequence: Synthetic oligonucleotide
uaccaguguacuccagcc

SEQ ID NO: 12186 - RNA, 18 nt, Artificial Sequence
  Description of Artificial Sequence: Synthetic oligonucleotide
gaucguaccaguguacuc

SEQ ID NO: 12187 - RNA, 18 nt, Artificial Sequence
  Description of Artificial Sequence: Synthetic oligonucleotide
guugugaucguaccagug

SEQ ID NO: 12188 - RNA, 18 nt, Artificial Sequence
  Description of Artificial Sequence: Synthetic oligonucleotide
agugaguugugaucguac

SEQ ID NO: 12189 - RNA, 18 nt, Artificial Sequence
  Description of Artificial Sequence: Synthetic oligonucleotide
gcugcagugaguugugau

SEQ ID NO: 12190 - RNA, 18 nt, Artificial Sequence
  Description of Artificial Sequence: Synthetic oligonucleotide
uagaggcugcagugaguu

SEQ ID NO: 12191 - RNA, 18 nt, Artificial Sequence
  Description of Artificial Sequence: Synthetic oligonucleotide
ggccauagaggcugcagu

SEQ ID NO: 12192 - RNA, 18 nt, Artificial Sequence
  Description of Artificial Sequence: Synthetic oligonucleotide
gccugggccauagaggcu

SEQ ID NO: 12193 - RNA, 18 nt, Artificial Sequence
  Description of Artificial Sequence: Synthetic oligonucleotide
cuugagccugggccauag

SEQ ID NO: 12194 - RNA, 18 nt, Artificial Sequence
  Description of Artificial Sequence: Synthetic oligonucleotide
gauugcuugagccugggc

SEQ ID NO: 12195 - RNA, 18 nt, Artificial Sequence
  Description of Artificial Sequence: Synthetic oligonucleotide
ucgggaggcugagguggg

SEQ ID NO: 12196 - RNA, 18 nt, Artificial Sequence
  Description of Artificial Sequence: Synthetic oligonucleotide
gcuacucgggaggcugag

SEQ ID NO: 12197 - RNA, 18 nt, Artificial Sequence
  Description of Artificial Sequence: Synthetic oligonucleotide
ucccagcuacucgggagg

SEQ ID NO: 12198 - RNA, 18 nt, Artificial Sequence
  Description of Artificial Sequence: Synthetic oligonucleotide
uguggucccagcuacucg

SEQ ID NO: 12199 - RNA, 18 nt, Artificial Sequence
  Description of Artificial Sequence: Synthetic oligonucleotide
gugccuguggucccagcu

SEQ ID NO: 12200 - RNA, 18 nt, Artificial Sequence
  Description of Artificial Sequence: Synthetic oligonucleotide
agcgugugccuguggucc

SEQ ID NO: 12201 - RNA, 18 nt, Artificial Sequence
  Description of Artificial Sequence: Synthetic oligonucleotide
augguagcgugugccugu

SEQ ID NO: 12202 - RNA, 18 nt, Artificial Sequence
  Description of Artificial Sequence: Synthetic oligonucleotide
ugggcaugguagcgugug

SEQ ID NO: 12203 - RNA, 18 nt, Artificial Sequence
  Description of Artificial Sequence: Synthetic oligonucleotide
uuaucugggcaugguagc

SEQ ID NO: 12204 - RNA, 18 nt, Artificial Sequence
  Description of Artificial Sequence: Synthetic oligonucleotide
uaaaauuaucugggcaug

SEQ ID NO: 12205 - RNA, 18 nt, Artificial Sequence
  Description of Artificial Sequence: Synthetic oligonucleotide
aauaauaaaauuaucugg

SEQ ID NO: 12206 - RNA, 18 nt, Artificial Sequence
  Description of Artificial Sequence: Synthetic oligonucleotide
aaauuaauaauaaaauua

SEQ ID NO: 12207 - RNA, 18 nt, Artificial Sequence
  Description of Artificial Sequence: Synthetic oligonucleotide
uacaaaaauuaauaauaa

SEQ ID NO: 12208 - RNA, 18 nt, Artificial Sequence
  Description of Artificial Sequence: Synthetic oligonucleotide
cucuauacaaaaauuaau

SEQ ID NO: 12209 - RNA, 18 nt, Artificial Sequence
  Description of Artificial Sequence: Synthetic oligonucleotide
cccaucucuauacaaaaa

SEQ ID NO: 12210 - RNA, 18 nt, Artificial Sequence
  Description of Artificial Sequence: Synthetic oligonucleotide
gagaccccaucucuauac

SEQ ID NO: 12211 - RNA, 18 nt, Artificial Sequence
  Description of Artificial Sequence: Synthetic oligonucleotide
acagggagaccccaucuc

SEQ ID NO: 12212 - RNA, 18 nt, Artificial Sequence
  Description of Artificial Sequence: Synthetic oligonucleotide
gcaacacagggagacccc

SEQ ID NO: 12213 - RNA, 18 nt, Artificial Sequence
  Description of Artificial Sequence: Synthetic oligonucleotide
ccugggcaacacagggag

SEQ ID NO: 12214 - RNA, 18 nt, Artificial Sequence
  Description of Artificial Sequence: Synthetic oligonucleotide
gaaagccugggcaacaca

SEQ ID NO: 12215 - RNA, 18 nt, Artificial Sequence
  Description of Artificial Sequence: Synthetic oligonucleotide
uucaagaaagccugggca

SEQ ID NO: 12216 - RNA, 18 nt, Artificial Sequence
  Description of Artificial Sequence: Synthetic oligonucleotide
uggaguucaagaaagccu

SEQ ID NO: 12217 - RNA, 18 nt, Artificial Sequence
  Description of Artificial Sequence: Synthetic oligonucleotide
agcccuggaguucaagaa

SEQ ID NO: 12218 - RNA, 18 nt, Artificial Sequence
  Description of Artificial Sequence: Synthetic oligonucleotide
acuugagcccuggaguuc

SEQ ID NO: 12219 - RNA, 18 nt, Artificial Sequence
  Description of Artificial Sequence: Synthetic oligonucleotide
ggaucacuugagcccugg

SEQ ID NO: 12220 - RNA, 18 nt, Artificial Sequence
  Description of Artificial Sequence: Synthetic oligonucleotide
ugggaggaucacuugagc

SEQ ID NO: 12221 - RNA, 18 nt, Artificial Sequence
  Description of Artificial Sequence: Synthetic oligonucleotide
ugaggugggaggaucacu

SEQ ID NO: 12222 - RNA, 18 nt, Artificial Sequence
  Description of Artificial Sequence: Synthetic oligonucleotide
gagguugaggugggagga

SEQ ID NO: 12223 - RNA, 18 nt, Artificial Sequence
  Description of Artificial Sequence: Synthetic oligonucleotide
uuugggagguugaggugg

SEQ ID NO: 12224 - RNA, 18 nt, Artificial Sequence
  Description of Artificial Sequence: Synthetic oligonucleotide
aacacuuugggagguuga

SEQ ID NO: 12225 - RNA, 18 nt, Artificial Sequence
  Description of Artificial Sequence: Synthetic oligonucleotide
aucccaacacuuugggag

SEQ ID NO: 12226 - RNA, 18 nt, Artificial Sequence
  Description of Artificial Sequence: Synthetic oligonucleotide
cuguaaucccaacacuuu

SEQ ID NO: 12227 - RNA, 18 nt, Artificial Sequence
  Description of Artificial Sequence: Synthetic oligonucleotide
cacgccuguaaucccaac

SEQ ID NO: 12228 - RNA, 18 nt, Artificial Sequence
  Description of Artificial Sequence: Synthetic oligonucleotide
uggcucacgccuguaauc

SEQ ID NO: 12229 - RNA, 18 nt, Artificial Sequence
  Description of Artificial Sequence: Synthetic oligonucleotide
caugguggcucacgccug

SEQ ID NO: 12230 - RNA, 18 nt, Artificial Sequence
  Description of Artificial Sequence: Synthetic oligonucleotide
cugggcaugguggcucac

SEQ ID NO: 12231 - RNA, 18 nt, Artificial Sequence
  Description of Artificial Sequence: Synthetic oligonucleotide
uaaggcugggcauggugg

SEQ ID NO: 12232 - RNA, 18 nt, Artificial Sequence
  Description of Artificial Sequence: Synthetic oligonucleotide
acucuuaaggcugggcau

SEQ ID NO: 12233 - RNA, 18 nt, Artificial Sequence
  Description of Artificial Sequence: Synthetic oligonucleotide
caaacacucuuaaggcug

SEQ ID NO: 12234 - RNA, 18 nt, Artificial Sequence
  Description of Artificial Sequence: Synthetic oligonucleotide
aaaaucaaacacucuuaa

SEQ ID NO: 12235 - RNA, 18 nt, Artificial Sequence
  Description of Artificial Sequence: Synthetic oligonucleotide
gaaugaaaaucaaacacu

SEQ ID NO: 12236 - RNA, 18 nt, Artificial Sequence
  Description of Artificial Sequence: Synthetic oligonucleotide
aaaaugaaugaaaaucaa

SEQ ID NO: 12237 - RNA, 18 nt, Artificial Sequence
  Description of Artificial Sequence: Synthetic oligonucleotide
auaggaaaaugaaugaaa

SEQ ID NO: 12238 - RNA, 18 nt, Artificial Sequence
  Description of Artificial Sequence: Synthetic oligonucleotide
uauauauaggaaaaugaa

SEQ ID NO: 12239 - RNA, 18 nt, Artificial Sequence
  Description of Artificial Sequence: Synthetic oligonucleotide
aauaauauauauaggaaa

SEQ ID NO: 12240 - RNA, 18 nt, Artificial Sequence
  Description of Artificial Sequence: Synthetic oligonucleotide
acagaaauaauauauaua

SEQ ID NO: 12241 - RNA, 18 nt, Artificial Sequence
  Description of Artificial Sequence: Synthetic oligonucleotide
ccccaacagaaauaauau

SEQ ID NO: 12242 - RNA, 18 nt, Artificial Sequence
  Description of Artificial Sequence: Synthetic oligonucleotide
uuuuuccccaacagaaau

SEQ ID NO: 12243 - RNA, 18 nt, Artificial Sequence
  Description of Artificial Sequence: Synthetic oligonucleotide
ggaauuuuuuccccaaca

SEQ ID NO: 12244 - RNA, 18 nt, Artificial Sequence
  Description of Artificial Sequence: Synthetic oligonucleotide
uccuuggaauuuuuuccc

SEQ ID NO: 12245 - RNA, 18 nt, Artificial Sequence
  Description of Artificial Sequence: Synthetic oligonucleotide
uaucuuccuuggaauuuu

SEQ ID NO: 12246 - RNA, 18 nt, Artificial Sequence
  Description of Artificial Sequence: Synthetic oligonucleotide
cuauuuaucuuccuugga

SEQ ID NO: 12247 - RNA, 18 nt, Artificial Sequence
  Description of Artificial Sequence: Synthetic oligonucleotide
gccuacuauuuaucuucc

SEQ ID NO: 12248 - RNA, 18 nt, Artificial Sequence
  Description of Artificial Sequence: Synthetic oligonucleotide
caacagccuacuauuuau

SEQ ID NO: 12249 - RNA, 18 nt, Artificial Sequence
  Description of Artificial Sequence: Synthetic oligonucleotide
uguaccaacagccuacua

SEQ ID NO: 12250 - RNA, 18 nt, Artificial Sequence
  Description of Artificial Sequence: Synthetic oligonucleotide
agaaauguaccaacagcc

SEQ ID NO: 12251 - RNA, 18 nt, Artificial Sequence
  Description of Artificial Sequence: Synthetic oligonucleotide
aguugagaaauguaccaa

SEQ ID NO: 12252 - RNA, 18 nt, Artificial Sequence
  Description of Artificial Sequence: Synthetic oligonucleotide
aaguaaguugagaaaugu

SEQ ID NO: 12253 - RNA, 18 nt, Artificial Sequence
  Description of Artificial Sequence: Synthetic oligonucleotide
uuuauaaguaaguugaga

SEQ ID NO: 12254 - RNA, 18 nt, Artificial Sequence
  Description of Artificial Sequence: Synthetic oligonucleotide
aaagcuuuauaaguaagu

SEQ ID NO: 12255 - RNA, 18 nt, Artificial Sequence
  Description of Artificial Sequence: Synthetic oligonucleotide
ucuaaaaagcuuuauaag

SEQ ID NO: 12256 - RNA, 18 nt, Artificial Sequence
  Description of Artificial Sequence: Synthetic oligonucleotide
auauaucuaaaaagcuuu

SEQ ID NO: 12257 - RNA, 18 nt, Artificial Sequence
  Description of Artificial Sequence: Synthetic oligonucleotide
accuuauauaucuaaaaa

SEQ ID NO: 12258 - RNA, 18 nt, Artificial Sequence
  Description of Artificial Sequence: Synthetic oligonucleotide
aauuaaccuuauauaucu

SEQ ID NO: 12259 - RNA, 18 nt, Artificial Sequence
  Description of Artificial Sequence: Synthetic oligonucleotide
ucauaaauuaaccuuaua

SEQ ID NO: 12260 - RNA, 18 nt, Artificial Sequence
  Description of Artificial Sequence: Synthetic oligonucleotide
uuucuucauaaauuaacc

SEQ ID NO: 12261 - RNA, 18 nt, Artificial Sequence
  Description of Artificial Sequence: Synthetic oligonucleotide
augauuuucuucauaaau

SEQ ID NO: 12262 - RNA, 18 nt, Artificial Sequence
  Description of Artificial Sequence: Synthetic oligonucleotide
aucuuaugauuuucuuca

SEQ ID NO: 12263 - RNA, 18 nt, Artificial Sequence
  Description of Artificial Sequence: Synthetic oligonucleotide
uguguaucuuaugauuuu

SEQ ID NO: 12264 - RNA, 18 nt, Artificial Sequence
  Description of Artificial Sequence: Synthetic oligonucleotide
uaaauuguguaucuuaug

SEQ ID NO: 12265 - RNA, 18 nt, Artificial Sequence
  Description of Artificial Sequence: Synthetic oligonucleotide
uaucuuaaauuguguauc

SEQ ID NO: 12266 - RNA, 18 nt, Artificial Sequence
  Description of Artificial Sequence: Synthetic oligonucleotide
aauauuaucuuaaauugu

SEQ ID NO: 12267 - RNA, 18 nt, Artificial Sequence
  Description of Artificial Sequence: Synthetic oligonucleotide
uuaaaaauauuaucuuaa

SEQ ID NO: 12268 - RNA, 18 nt, Artificial Sequence
  Description of Artificial Sequence: Synthetic oligonucleotide
uaaaauuaaaaauauuau

SEQ ID NO: 12269 - RNA, 18 nt, Artificial Sequence
  Description of Artificial Sequence: Synthetic oligonucleotide
aaaaauaaaauuaaaaau

SEQ ID NO: 12270 - RNA, 18 nt, Artificial Sequence
  Description of Artificial Sequence: Synthetic oligonucleotide
aaauaaaaaauaaaauua

SEQ ID NO: 12271 - RNA, 18 nt, Artificial Sequence
  Description of Artificial Sequence: Synthetic oligonucleotide
uuaacaaauaaaaaauaa

SEQ ID NO: 12272 - RNA, 18 nt, Artificial Sequence
  Description of Artificial Sequence: Synthetic oligonucleotide
uuuauuuaacaaauaaaa

SEQ ID NO: 12273 - RNA, 18 nt, Artificial Sequence
  Description of Artificial Sequence: Synthetic oligonucleotide
aaauuucaagacgugaca

SEQ ID NO: 12274 - RNA, 18 nt, Artificial Sequence
  Description of Artificial Sequence: Synthetic oligonucleotide
auuuaaaauuucaagacg

SEQ ID NO: 12275 - RNA, 18 nt, Artificial Sequence
  Description of Artificial Sequence: Synthetic oligonucleotide
aggacauuuaaaauuuca

SEQ ID NO: 12276 - RNA, 18 nt, Artificial Sequence
  Description of Artificial Sequence: Synthetic oligonucleotide
cacugaggacauuuaaaa

SEQ ID NO: 12277 - RNA, 18 nt, Artificial Sequence
  Description of Artificial Sequence: Synthetic oligonucleotide
agagucacugaggacauu

SEQ ID NO: 12278 - RNA, 18 nt, Artificial Sequence
  Description of Artificial Sequence: Synthetic oligonucleotide
gguagagagucacugagg

SEQ ID NO: 12279 - RNA, 18 nt, Artificial Sequence
  Description of Artificial Sequence: Synthetic oligonucleotide
ccagagguagagagucac

SEQ ID NO: 12280 - RNA, 18 nt, Artificial Sequence
  Description of Artificial Sequence: Synthetic oligonucleotide
aucugccagagguagaga

SEQ ID NO: 12281 - RNA, 18 nt, Artificial Sequence
  Description of Artificial Sequence: Synthetic oligonucleotide
acaucaucugccagaggu

SEQ ID NO: 12282 - RNA, 18 nt, Artificial Sequence
  Description of Artificial Sequence: Synthetic oligonucleotide
ggucaacaucaucugcca

SEQ ID NO: 12283 - RNA, 18 nt, Artificial Sequence
  Description of Artificial Sequence: Synthetic oligonucleotide
cugaaggucaacaucauc

SEQ ID NO: 12284 - RNA, 18 nt, Artificial Sequence
  Description of Artificial Sequence: Synthetic oligonucleotide
acaugcugaaggucaaca

SEQ ID NO: 12285 - RNA, 18 nt, Artificial Sequence
  Description of Artificial Sequence: Synthetic oligonucleotide
augcuacaugcugaaggu

SEQ ID NO: 12286 - RNA, 18 nt, Artificial Sequence
  Description of Artificial Sequence: Synthetic oligonucleotide
uacugaugcuacaugcug

SEQ ID NO: 12287 - RNA, 18 nt, Artificial Sequence
  Description of Artificial Sequence: Synthetic oligonucleotide
ucaguuacugaugcuaca

SEQ ID NO: 12288 - RNA, 18 nt, Artificial Sequence
  Description of Artificial Sequence: Synthetic oligonucleotide
aggagucaguuacugaug

SEQ ID NO: 12289 - RNA, 18 nt, Artificial Sequence
  Description of Artificial Sequence: Synthetic oligonucleotide
aguaaaggagucaguuac

SEQ ID NO: 12290 - RNA, 18 nt, Artificial Sequence
  Description of Artificial Sequence: Synthetic oligonucleotide
gcuccaguaaaggaguca

SEQ ID NO: 12291 - RNA, 18 nt, Artificial Sequence
  Description of Artificial Sequence: Synthetic oligonucleotide
gaucagcuccaguaaagg

SEQ ID NO: 12292 - RNA, 18 nt, Artificial Sequence
  Description of Artificial Sequence: Synthetic oligonucleotide
uuucagaucagcuccagu

SEQ ID NO: 12293 - RNA, 18 nt, Artificial Sequence
  Description of Artificial Sequence: Synthetic oligonucleotide
aaagcuuucagaucagcu

SEQ ID NO: 12294 - RNA, 18 nt, Artificial Sequence
  Description of Artificial Sequence: Synthetic oligonucleotide
aaaguaaagcuuucagau

SEQ ID NO: 12295 - RNA, 18 nt, Artificial Sequence
  Description of Artificial Sequence: Synthetic oligonucleotide
auuguaaaguaaagcuuu

SEQ ID NO: 12296 - RNA, 18 nt, Artificial Sequence
  Description of Artificial Sequence: Synthetic oligonucleotide
ugggcauuguaaaguaaa

SEQ ID NO: 12297 - RNA, 18 nt, Artificial Sequence
  Description of Artificial Sequence: Synthetic oligonucleotide
ccaauugggcauuguaaa

SEQ ID NO: 12298 - RNA, 18 nt, Artificial Sequence
  Description of Artificial Sequence: Synthetic oligonucleotide
ggccuccaauugggcauu

SEQ ID NO: 12299 - RNA, 18 nt, Artificial Sequence
  Description of Artificial Sequence: Synthetic oligonucleotide
uguaaggccuccaauugg

SEQ ID NO: 12300 - RNA, 18 nt, Artificial Sequence
  Description of Artificial Sequence: Synthetic oligonucleotide
uuccauguaaggccucca

SEQ ID NO: 12301 - RNA, 18 nt, Artificial Sequence
  Description of Artificial Sequence: Synthetic oligonucleotide
cagcauuccauguaaggc

SEQ ID NO: 12302 - RNA, 18 nt, Artificial Sequence
  Description of Artificial Sequence: Synthetic oligonucleotide
gagagcagcauuccaugu

SEQ ID NO: 12303 - RNA, 18 nt, Artificial Sequence
  Description of Artificial Sequence: Synthetic oligonucleotide
cacucgagagcagcauuc

SEQ ID NO: 12304 - RNA, 18 nt, Artificial Sequence
  Description of Artificial Sequence: Synthetic oligonucleotide
gaguccacucgagagcag

SEQ ID NO: 12305 - RNA, 18 nt, Artificial Sequence
  Description of Artificial Sequence: Synthetic oligonucleotide
agagcuggaacuuccauc

SEQ ID NO: 12306 - RNA, 18 nt, Artificial Sequence
  Description of Artificial Sequence: Synthetic oligonucleotide
cuaucagagcuggaacuu

SEQ ID NO: 12307 - RNA, 18 nt, Artificial Sequence
  Description of Artificial Sequence: Synthetic oligonucleotide
ggucacuaucagagcugg

SEQ ID NO: 12308 - RNA, 18 nt, Artificial Sequence
  Description of Artificial Sequence: Synthetic oligonucleotide
acuuaggucacuaucaga

SEQ ID NO: 12309 - RNA, 18 nt, Artificial Sequence
  Description of Artificial Sequence: Synthetic oligonucleotide
gacagacuuaggucacua

SEQ ID NO: 12310 - RNA, 18 nt, Artificial Sequence
  Description of Artificial Sequence: Synthetic oligonucleotide
uugaagacagacuuaggu

SEQ ID NO: 12311 - RNA, 18 nt, Artificial Sequence
  Description of Artificial Sequence: Synthetic oligonucleotide
gaccauugaagacagacu

SEQ ID NO: 12312 - RNA, 18 nt, Artificial Sequence
  Description of Artificial Sequence: Synthetic oligonucleotide
agaaagaccauugaagac

SEQ ID NO: 12313 - RNA, 18 nt, Artificial Sequence
  Description of Artificial Sequence: Synthetic oligonucleotide
gguuaagaaagaccauug

SEQ ID NO: 12314 - RNA, 18 nt, Artificial Sequence
  Description of Artificial Sequence: Synthetic oligonucleotide
gcuaugguuaagaaagac

SEQ ID NO: 12315 - RNA, 18 nt, Artificial Sequence
  Description of Artificial Sequence: Synthetic oligonucleotide
ccacugcuaugguuaaga

SEQ ID NO: 12316 - RNA, 18 nt, Artificial Sequence
  Description of Artificial Sequence: Synthetic oligonucleotide
cagagccacugcuauggu

SEQ ID NO: 12317 - RNA, 18 nt, Artificial Sequence
  Description of Artificial Sequence: Synthetic oligonucleotide
aucgucagagccacugcu

SEQ ID NO: 12318 - RNA, 18 nt, Artificial Sequence
  Description of Artificial Sequence: Synthetic oligonucleotide
gcugaaucgucagagcca

SEQ ID NO: 12319 - RNA, 18 nt, Artificial Sequence
  Description of Artificial Sequence: Synthetic oligonucleotide
cuccagcugaaucgucag

SEQ ID NO: 12320 - RNA, 18 nt, Artificial Sequence
  Description of Artificial Sequence: Synthetic oligonucleotide
uccaucuccagcugaauc

SEQ ID NO: 12321 - RNA, 18 nt, Artificial Sequence
  Description of Artificial Sequence: Synthetic oligonucleotide
cauucuccaucuccagcu

SEQ ID NO: 12322 - RNA, 18 nt, Artificial Sequence
  Description of Artificial Sequence: Synthetic oligonucleotide
agccacauucuccaucuc

SEQ ID NO: 12323 - RNA, 18 nt, Artificial Sequence
  Description of Artificial Sequence: Synthetic oligonucleotide
aucuaagccacauucucc

SEQ ID NO: 12324 - RNA, 18 nt, Artificial Sequence
  Description of Artificial Sequence: Synthetic oligonucleotide
gacugaucuaagccacau

SEQ ID NO: 12325 - RNA, 18 nt, Artificial Sequence
  Description of Artificial Sequence: Synthetic oligonucleotide
caagggacugaucuaagc

SEQ ID NO: 12326 - RNA, 18 nt, Artificial Sequence
  Description of Artificial Sequence: Synthetic oligonucleotide
agaaacaagggacugauc

SEQ ID NO: 12327 - RNA, 18 nt, Artificial Sequence
  Description of Artificial Sequence: Synthetic oligonucleotide
ucuaaagaaacaagggac

SEQ ID NO: 12328 - RNA, 18 nt, Artificial Sequence
  Description of Artificial Sequence: Synthetic oligonucleotide
acaucucuaaagaaacaa

SEQ ID NO: 12329 - RNA, 18 nt, Artificial Sequence
  Description of Artificial Sequence: Synthetic oligonucleotide
cucggacaucucuaaaga

SEQ ID NO: 12330 - RNA, 18 nt, Artificial Sequence
  Description of Artificial Sequence: Synthetic oligonucleotide
aggaucucggacaucucu

SEQ ID NO: 12331 - RNA, 18 nt, Artificial Sequence
  Description of Artificial Sequence: Synthetic oligonucleotide
cuggaaggaucucggaca

SEQ ID NO: 12332 - RNA, 18 nt, Artificial Sequence
  Description of Artificial Sequence: Synthetic oligonucleotide
uucaucuggaaggaucuc

SEQ ID NO: 12333 - RNA, 18 nt, Artificial Sequence
  Description of Artificial Sequence: Synthetic oligonucleotide
uuugauucaucuggaagg

SEQ ID NO: 12334 - RNA, 18 nt, Artificial Sequence
  Description of Artificial Sequence: Synthetic oligonucleotide
ugaauuuugauucaucug

SEQ ID NO: 12335 - RNA, 18 nt, Artificial Sequence
  Description of Artificial Sequence: Synthetic oligonucleotide
cauauugaauuuugauuc

SEQ ID NO: 12336 - RNA, 18 nt, Artificial Sequence
  Description of Artificial Sequence: Synthetic oligonucleotide
cgguacauauugaauuuu

SEQ ID NO: 12337 - RNA, 18 nt, Artificial Sequence
  Description of Artificial Sequence: Synthetic oligonucleotide
agagccgguacauauuga

SEQ ID NO: 12338 - RNA, 18 nt, Artificial Sequence
  Description of Artificial Sequence: Synthetic oligonucleotide
aaaguagagccgguacau

SEQ ID NO: 12339 - RNA, 18 nt, Artificial Sequence
  Description of Artificial Sequence: Synthetic oligonucleotide
cuuccaaaguagagccgg

SEQ ID NO: 12340 - RNA, 18 nt, Artificial Sequence
  Description of Artificial Sequence: Synthetic oligonucleotide
aagagcuuccaaaguaga

SEQ ID NO: 12341 - RNA, 18 nt, Artificial Sequence
  Description of Artificial Sequence: Synthetic oligonucleotide
uucauaagagcuuccaaa

SEQ ID NO: 12342 - RNA, 18 nt, Artificial Sequence
  Description of Artificial Sequence: Synthetic oligonucleotide
ucugauucauaagagcuu

SEQ ID NO: 12343 - RNA, 18 nt, Artificial Sequence
  Description of Artificial Sequence: Synthetic oligonucleotide
caaguucugauucauaag

SEQ ID NO: 12344 - RNA, 18 nt, Artificial Sequence
  Description of Artificial Sequence: Synthetic oligonucleotide
auuuccaaguucugauuc

SEQ ID NO: 12345 - RNA, 18 nt, Artificial Sequence
  Description of Artificial Sequence: Synthetic oligonucleotide
guuccauuuccaaguucu

SEQ ID NO: 12346 - RNA, 18 nt, Artificial Sequence
  Description of Artificial Sequence: Synthetic oligonucleotide
aagagguuccauuuccaa

SEQ ID NO: 12347 - RNA, 18 nt, Artificial Sequence
  Description of Artificial Sequence: Synthetic oligonucleotide
aucagaagagguuccauu

SEQ ID NO: 12348 - RNA, 18 nt, Artificial Sequence
  Description of Artificial Sequence: Synthetic oligonucleotide
auaaugaugacugcacaa

SEQ ID NO: 12349 - RNA, 18 nt, Artificial Sequence
  Description of Artificial Sequence: Synthetic oligonucleotide
acuguauaaugaugacug

SEQ ID NO: 12350 - RNA, 18 nt, Artificial Sequence
  Description of Artificial Sequence: Synthetic oligonucleotide
ucagaacuguauaaugau

SEQ ID NO: 12351 - RNA, 18 nt, Artificial Sequence
  Description of Artificial Sequence: Synthetic oligonucleotide
auauuucagaacuguaua

SEQ ID NO: 12352 - RNA, 18 nt, Artificial Sequence
  Description of Artificial Sequence: Synthetic oligonucleotide
gcuuuauauuucagaacu

SEQ ID NO: 12353 - RNA, 18 nt, Artificial Sequence
  Description of Artificial Sequence: Synthetic oligonucleotide
auauagcuuuauauuuca

SEQ ID NO: 12354 - RNA, 18 nt, Artificial Sequence
  Description of Artificial Sequence: Synthetic oligonucleotide
ccaacauauagcuuuaua

SEQ ID NO: 12355 - RNA, 18 nt, Artificial Sequence
  Description of Artificial Sequence: Synthetic oligonucleotide
uuacaccaacauauagcu

SEQ ID NO: 12356 - RNA, 18 nt, Artificial Sequence
  Description of Artificial Sequence: Synthetic oligonucleotide
caacuuuacaccaacaua

SEQ ID NO: 12357 - RNA, 18 nt, Artificial Sequence
  Description of Artificial Sequence: Synthetic oligonucleotide
cacugcaacuuuacacca

SEQ ID NO: 12358 - RNA, 18 nt, Artificial Sequence
  Description of Artificial Sequence: Synthetic oligonucleotide
gaaaucacugcaacuuua

SEQ ID NO: 12359 - RNA, 18 nt, Artificial Sequence
  Description of Artificial Sequence: Synthetic oligonucleotide
ggagagaaaucacugcaa

SEQ ID NO: 12360 - RNA, 18 nt, Artificial Sequence
  Description of Artificial Sequence: Synthetic oligonucleotide
gguuaggagagaaaucac

SEQ ID NO: 12361 - RNA, 18 nt, Artificial Sequence
  Description of Artificial Sequence: Synthetic oligonucleotide
gggcugguuaggagagaa

SEQ ID NO: 12362 - RNA, 18 nt, Artificial Sequence
  Description of Artificial Sequence: Synthetic oligonucleotide
ccaaccaggaagaauaug

SEQ ID NO: 12363 - RNA, 18 nt, Artificial Sequence
  Description of Artificial Sequence: Synthetic oligonucleotide
accaaccaaccaggaaga

SEQ ID NO: 12364 - RNA, 18 nt, Artificial Sequence
  Description of Artificial Sequence: Synthetic oligonucleotide
gaagaaccaaccaaccag

SEQ ID NO: 12365 - RNA, 18 nt, Artificial Sequence
  Description of Artificial Sequence: Synthetic oligonucleotide
uuacugaagaaccaacca

SEQ ID NO: 12366 - RNA, 18 nt, Artificial Sequence
  Description of Artificial Sequence: Synthetic oligonucleotide
cuauuuuacugaagaacc

SEQ ID NO: 12367 - RNA, 18 nt, Artificial Sequence
  Description of Artificial Sequence: Synthetic oligonucleotide
caagacuauuuuacugaa

SEQ ID NO: 12368 - RNA, 18 nt, Artificial Sequence
  Description of Artificial Sequence: Synthetic oligonucleotide
agaaacaagacuauuuua

SEQ ID NO: 12369 - RNA, 18 nt, Artificial Sequence
  Description of Artificial Sequence: Synthetic oligonucleotide
aagcaagaaacaagacua

SEQ ID NO: 12370 - RNA, 18 nt, Artificial Sequence
  Description of Artificial Sequence: Synthetic oligonucleotide
aguguaagcaagaaacaa

SEQ ID NO: 12371 - RNA, 18 nt, Artificial Sequence
  Description of Artificial Sequence: Synthetic oligonucleotide
caauuaguguaagcaaga

SEQ ID NO: 12372 - RNA, 18 nt, Artificial Sequence
  Description of Artificial Sequence: Synthetic oligonucleotide
auuaccaauuaguguaag

SEQ ID NO: 12373 - RNA, 18 nt, Artificial Sequence
  Description of Artificial Sequence: Synthetic oligonucleotide
ugcaaauuaccaauuagu

SEQ ID NO: 12374 - RNA, 18 nt, Artificial Sequence
  Description of Artificial Sequence: Synthetic oligonucleotide
aggaaugcaaauuaccaa

SEQ ID NO: 12375 - RNA, 18 nt, Artificial Sequence
  Description of Artificial Sequence: Synthetic oligonucleotide
uaacaaggaaugcaaauu

SEQ ID NO: 12376 - RNA, 18 nt, Artificial Sequence
  Description of Artificial Sequence: Synthetic oligonucleotide
aaucuuaacaaggaaugc

SEQ ID NO: 12377 - RNA, 18 nt, Artificial Sequence
  Description of Artificial Sequence: Synthetic oligonucleotide
uugaaaaucuuaacaagg

SEQ ID NO: 12378 - RNA, 18 nt, Artificial Sequence
  Description of Artificial Sequence: Synthetic oligonucleotide
cugucuugaaaaucuuaa

SEQ ID NO: 12379 - RNA, 18 nt, Artificial Sequence
  Description of Artificial Sequence: Synthetic oligonucleotide
cagcccugucuugaaaau

SEQ ID NO: 12380 - RNA, 18 nt, Artificial Sequence
  Description of Artificial Sequence: Synthetic oligonucleotide
gcucccagcccugucuug

SEQ ID NO: 12381 - RNA, 18 nt, Artificial Sequence
  Description of Artificial Sequence: Synthetic oligonucleotide
uccuugcucccagcccug

SEQ ID NO: 12382 - RNA, 18 nt, Artificial Sequence
  Description of Artificial Sequence: Synthetic oligonucleotide
uugguuccuugcucccag

SEQ ID NO: 12383 - RNA, 18 nt, Artificial Sequence
  Description of Artificial Sequence: Synthetic oligonucleotide
cuacuuugguuccuugcu

SEQ ID NO: 12384 - RNA, 18 nt, Artificial Sequence
  Description of Artificial Sequence: Synthetic oligonucleotide
acgcgcuacuuugguucc

SEQ ID NO: 12385 - RNA, 18 nt, Artificial Sequence
  Description of Artificial Sequence: Synthetic oligonucleotide
caaccacgcgcuacuuug

SEQ ID NO: 12386 - RNA, 18 nt, Artificial Sequence
  Description of Artificial Sequence: Synthetic oligonucleotide
aaucacaaccacgcgcua

SEQ ID NO: 12387 - RNA, 18 nt, Artificial Sequence
  Description of Artificial Sequence: Synthetic oligonucleotide
aagguaaucacaaccacg

SEQ ID NO: 12388 - RNA, 18 nt, Artificial Sequence
  Description of Artificial Sequence: Synthetic oligonucleotide
aaccaaagguaaucacaa

SEQ ID NO: 12389 - RNA, 18 nt, Artificial Sequence
  Description of Artificial Sequence: Synthetic oligonucleotide
aaagaaaccaaagguaau

SEQ ID NO: 12390 - RNA, 18 nt, Artificial Sequence
  Description of Artificial Sequence: Synthetic oligonucleotide
accucaaagaaaccaaag

SEQ ID NO: 12391 - RNA, 18 nt, Artificial Sequence
  Description of Artificial Sequence: Synthetic oligonucleotide
gagaaaccucaaagaaac

SEQ ID NO: 12392 - RNA, 18 nt, Artificial Sequence
  Description of Artificial Sequence: Synthetic oligonucleotide
gguaagagaaaccucaaa

SEQ ID NO: 12393 - RNA, 18 nt, Artificial Sequence
  Description of Artificial Sequence: Synthetic oligonucleotide
cacuagguaagagaaacc

SEQ ID NO: 12394 - RNA, 18 nt, Artificial Sequence
  Description of Artificial Sequence: Synthetic oligonucleotide
aaagccacuagguaagag

SEQ ID NO: 12395 - RNA, 18 nt, Artificial Sequence
  Description of Artificial Sequence: Synthetic oligonucleotide
guuuuaaagccacuaggu

SEQ ID NO: 12396 - RNA, 18 nt, Artificial Sequence
  Description of Artificial Sequence: Synthetic oligonucleotide
aagauguuuuaaagccac

SEQ ID NO: 12397 - RNA, 18 nt, Artificial Sequence
  Description of Artificial Sequence: Synthetic oligonucleotide
uccuaaagauguuuuaaa

SEQ ID NO: 12398 - RNA, 18 nt, Artificial Sequence
  Description of Artificial Sequence: Synthetic oligonucleotide
acugcuccuaaagauguu

SEQ ID NO: 12399 - RNA, 18 nt, Artificial Sequence
  Description of Artificial Sequence: Synthetic oligonucleotide
auggaacugcuccuaaag

SEQ ID NO: 12400 - RNA, 18 nt, Artificial Sequence
  Description of Artificial Sequence: Synthetic oligonucleotide
auaaaauggaacugcucc

SEQ ID NO: 12401 - RNA, 18 nt, Artificial Sequence
  Description of Artificial Sequence: Synthetic oligonucleotide
uuacuauaaaauggaacu

SEQ ID NO: 12402 - RNA, 18 nt, Artificial Sequence
  Description of Artificial Sequence: Synthetic oligonucleotide
uaaguuuacuauaaaaug

SEQ ID NO: 12403 - RNA, 18 nt, Artificial Sequence
  Description of Artificial Sequence: Synthetic oligonucleotide
gaauuuaaguuuacuaua

SEQ ID NO: 12404 - RNA, 18 nt, Artificial Sequence
  Description of Artificial Sequence: Synthetic oligonucleotide
uaacagaauuuaaguuua

SEQ ID NO: 12405 - RNA, 18 nt, Artificial Sequence
  Description of Artificial Sequence: Synthetic oligonucleotide
caugauaacagaauuuaa

SEQ ID NO: 12406 - RNA, 18 nt, Artificial Sequence
  Description of Artificial Sequence: Synthetic oligonucleotide
cuguucaugauaacagaa

SEQ ID NO: 12407 - RNA, 18 nt, Artificial Sequence
  Description of Artificial Sequence: Synthetic oligonucleotide
cucaacuguucaugauaa

SEQ ID NO: 12408 - RNA, 18 nt, Artificial Sequence
  Description of Artificial Sequence: Synthetic oligonucleotide
uuauccucaacuguucau

SEQ ID NO: 12409 - RNA, 18 nt, Artificial Sequence
  Description of Artificial Sequence: Synthetic oligonucleotide
auucauuauccucaacug

SEQ ID NO: 12410 - RNA, 18 nt, Artificial Sequence
  Description of Artificial Sequence: Synthetic oligonucleotide
aaauuauucauuauccuc

SEQ ID NO: 12411 - RNA, 18 nt, Artificial Sequence
  Description of Artificial Sequence: Synthetic oligonucleotide
guaucaaauuauucauua

SEQ ID NO: 12412 - RNA, 18 nt, Artificial Sequence
  Description of Artificial Sequence: Synthetic oligonucleotide
uuauuguaucaaauuauu

SEQ ID NO: 12413 - RNA, 18 nt, Artificial Sequence
  Description of Artificial Sequence: Synthetic oligonucleotide
uuacauuauuguaucaaa

SEQ ID NO: 12414 - RNA, 18 nt, Artificial Sequence
  Description of Artificial Sequence: Synthetic oligonucleotide
auuucuuacauuauugua

SEQ ID NO: 12415 - RNA, 18 nt, Artificial Sequence
  Description of Artificial Sequence: Synthetic oligonucleotide
caggaauuucuuacauua

SEQ ID NO: 12416 - RNA, 18 nt, Artificial Sequence
  Description of Artificial Sequence: Synthetic oligonucleotide
guuuucaggaauuucuua

SEQ ID NO: 12417 - RNA, 18 nt, Artificial Sequence
  Description of Artificial Sequence: Synthetic oligonucleotide
acuuuguuuucaggaauu

SEQ ID NO: 12418 - RNA, 18 nt, Artificial Sequence
  Description of Artificial Sequence: Synthetic oligonucleotide
auaacacuuuguuuucag

SEQ ID NO: 12419 - RNA, 18 nt, Artificial Sequence
  Description of Artificial Sequence: Synthetic oligonucleotide
cacagauaacacuuuguu

SEQ ID NO: 12420 - RNA, 18 nt, Artificial Sequence
  Description of Artificial Sequence: Synthetic oligonucleotide
aguaucacagauaacacu

SEQ ID NO: 12421 - RNA, 18 nt, Artificial Sequence
  Description of Artificial Sequence: Synthetic oligonucleotide
gcaaaaguaucacagaua

SEQ ID NO: 12422 - RNA, 18 nt, Artificial Sequence
  Description of Artificial Sequence: Synthetic oligonucleotide
augcagcaaaaguaucac

SEQ ID NO: 12423 - RNA, 18 nt, Artificial Sequence
  Description of Artificial Sequence: Synthetic oligonucleotide
uuacuaugcagcaaaagu

SEQ ID NO: 12424 - RNA, 18 nt, Artificial Sequence
  Description of Artificial Sequence: Synthetic oligonucleotide
ugugcuuacuaugcagca

SEQ ID NO: 12425 - RNA, 18 nt, Artificial Sequence
  Description of Artificial Sequence: Synthetic oligonucleotide
uucauugugcuuacuaug

SEQ ID NO: 12426 - RNA, 18 nt, Artificial Sequence
  Description of Artificial Sequence: Synthetic oligonucleotide
uacacuucauugugcuua

SEQ ID NO: 12427 - RNA, 18 nt, Artificial Sequence
  Description of Artificial Sequence: Synthetic oligonucleotide
aucaguacacuucauugu

SEQ ID NO: 12428 - RNA, 18 nt, Artificial Sequence
  Description of Artificial Sequence: Synthetic oligonucleotide
acauuaucaguacacuuc

SEQ ID NO: 12429 - RNA, 18 nt, Artificial Sequence
  Description of Artificial Sequence: Synthetic oligonucleotide
uugaaacauuaucaguac

SEQ ID NO: 12430 - RNA, 18 nt, Artificial Sequence
  Description of Artificial Sequence: Synthetic oligonucleotide
uccuguugaaacauuauc

SEQ ID NO: 12431 - RNA, 18 nt, Artificial Sequence
  Description of Artificial Sequence: Synthetic oligonucleotide
cacuuuccuguugaaaca

SEQ ID NO: 12432 - RNA, 18 nt, Artificial Sequence
  Description of Artificial Sequence: Synthetic oligonucleotide
caaaacacuuuccuguug

SEQ ID NO: 12433 - RNA, 18 nt, Artificial Sequence
  Description of Artificial Sequence: Synthetic oligonucleotide
uuaaucaaaacacuuucc

SEQ ID NO: 12434 - RNA, 18 nt, Artificial Sequence
  Description of Artificial Sequence: Synthetic oligonucleotide
cacauuuaaucaaaacac

SEQ ID NO: 12435 - RNA, 18 nt, Artificial Sequence
  Description of Artificial Sequence: Synthetic oligonucleotide
cugcccacauuuaaucaa

SEQ ID NO: 12436 - RNA, 18 nt, Artificial Sequence
  Description of Artificial Sequence: Synthetic oligonucleotide
ugauacugcccacauuua

SEQ ID NO: 12437 - RNA, 18 nt, Artificial Sequence
  Description of Artificial Sequence: Synthetic oligonucleotide
aacagugauacugcccac

SEQ ID NO: 12438 - RNA, 18 nt, Artificial Sequence
  Description of Artificial Sequence: Synthetic oligonucleotide
aguagaacagugauacug

SEQ ID NO: 12439 - RNA, 18 nt, Artificial Sequence
  Description of Artificial Sequence: Synthetic oligonucleotide
augcuaguagaacaguga

SEQ ID NO: 12440 - RNA, 18 nt, Artificial Sequence
  Description of Artificial Sequence: Synthetic oligonucleotide
guugaaugcuaguagaac

SEQ ID NO: 12441 - RNA, 18 nt, Artificial Sequence
  Description of Artificial Sequence: Synthetic oligonucleotide
gagauguugaaugcuagu

SEQ ID NO: 12442 - RNA, 18 nt, Artificial Sequence
  Description of Artificial Sequence: Synthetic oligonucleotide
uagaagagauguugaaug

SEQ ID NO: 12443 - RNA, 18 nt, Artificial Sequence
  Description of Artificial Sequence: Synthetic oligonucleotide
auuuuuagaagagauguu

SEQ ID NO: 12444 - RNA, 18 nt, Artificial Sequence
  Description of Artificial Sequence: Synthetic oligonucleotide
gcagauagcuugagccca

SEQ ID NO: 12445 - RNA, 18 nt, Artificial Sequence
  Description of Artificial Sequence: Synthetic oligonucleotide
ggcacgcagauagcuuga

SEQ ID NO: 12446 - RNA, 18 nt, Artificial Sequence
  Description of Artificial Sequence: Synthetic oligonucleotide
gucaaggcacgcagauag

SEQ ID NO: 12447 - RNA, 18 nt, Artificial Sequence
  Description of Artificial Sequence: Synthetic oligonucleotide
gggaggucaaggcacgca

SEQ ID NO: 12448 - RNA, 18 nt, Artificial Sequence
  Description of Artificial Sequence: Synthetic oligonucleotide
acuuugggaggucaaggc

SEQ ID NO: 12449 - RNA, 18 nt, Artificial Sequence
  Description of Artificial Sequence: Synthetic oligonucleotide
cuagcacuuugggagguc

SEQ ID NO: 12450 - RNA, 18 nt, Artificial Sequence
  Description of Artificial Sequence: Synthetic oligonucleotide
uaauccuagcacuuuggg

SEQ ID NO: 12451 - RNA, 18 nt, Artificial Sequence
  Description of Artificial Sequence: Synthetic oligonucleotide
accuguaauccuagcacu

SEQ ID NO: 12452 - RNA, 18 nt, Artificial Sequence
  Description of Artificial Sequence: Synthetic oligonucleotide
cucacaccuguaauccua

SEQ ID NO: 12453 - RNA, 18 nt, Artificial Sequence
  Description of Artificial Sequence: Synthetic oligonucleotide
aguggcucacaccuguaa

SEQ ID NO: 12454 - RNA, 18 nt, Artificial Sequence
  Description of Artificial Sequence: Synthetic oligonucleotide
ggcauaguggcucacacc

SEQ ID NO: 12455 - RNA, 18 nt, Artificial Sequence
  Description of Artificial Sequence: Synthetic oligonucleotide
ggcuaggcauaguggcuc

SEQ ID NO: 12456 - RNA, 18 nt, Artificial Sequence
  Description of Artificial Sequence: Synthetic oligonucleotide
aguuaggcuaggcauagu

SEQ ID NO: 12457 - RNA, 18 nt, Artificial Sequence
  Description of Artificial Sequence: Synthetic oligonucleotide
gucugaguuaggcuaggc

SEQ ID NO: 12458 - RNA, 18 nt, Artificial Sequence
  Description of Artificial Sequence: Synthetic oligonucleotide
uuaaagucugaguuaggc

SEQ ID NO: 12459 - RNA, 18 nt, Artificial Sequence
  Description of Artificial Sequence: Synthetic oligonucleotide
uauuuuuaaagucugagu

SEQ ID NO: 12460 - RNA, 18 nt, Artificial Sequence
  Description of Artificial Sequence: Synthetic oligonucleotide
uuuuauauuuuuaaaguc

SEQ ID NO: 12461 - RNA, 18 nt, Artificial Sequence
  Description of Artificial Sequence: Synthetic oligonucleotide
auugcuuuuauauuuuua

SEQ ID NO: 12462 - RNA, 18 nt, Artificial Sequence
  Description of Artificial Sequence: Synthetic oligonucleotide
aaugaauugcuuuuauau

SEQ ID NO: 12463 - RNA, 18 nt, Artificial Sequence
  Description of Artificial Sequence: Synthetic oligonucleotide
auaaaaaugaauugcuuu

SEQ ID NO: 12464 - RNA, 18 nt, Artificial Sequence
  Description of Artificial Sequence: Synthetic oligonucleotide
ugggaauaaaaaugaauu

SEQ ID NO: 12465 - RNA, 18 nt, Artificial Sequence
  Description of Artificial Sequence: Synthetic oligonucleotide
guucuugggaauaaaaau

SEQ ID NO: 12466 - RNA, 18 nt, Artificial Sequence
  Description of Artificial Sequence: Synthetic oligonucleotide
uuacuguucuugggaaua

SEQ ID NO: 12467 - RNA, 18 nt, Artificial Sequence
  Description of Artificial Sequence: Synthetic oligonucleotide
ccaccuuacuguucuugg

SEQ ID NO: 12468 - RNA, 18 nt, Artificial Sequence
  Description of Artificial Sequence: Synthetic oligonucleotide
aaccaccaccuuacuguu

SEQ ID NO: 12469 - RNA, 18 nt, Artificial Sequence
  Description of Artificial Sequence: Synthetic oligonucleotide
aauuaaaccaccaccuua

SEQ ID NO: 12470 - RNA, 18 nt, Artificial Sequence
  Description of Artificial Sequence: Synthetic oligonucleotide
acuaaaauuaaaccacca

SEQ ID NO: 12471 - RNA, 18 nt, Artificial Sequence
  Description of Artificial Sequence: Synthetic oligonucleotide
uaaagacuaaaauuaaac

SEQ ID NO: 12472 - RNA, 18 nt, Artificial Sequence
  Description of Artificial Sequence: Synthetic oligonucleotide
agaauuaaagacuaaaau

SEQ ID NO: 12473 - RNA, 18 nt, Artificial Sequence
  Description of Artificial Sequence: Synthetic oligonucleotide
aaaacagaauuaaagacu

SEQ ID NO: 12474 - RNA, 18 nt, Artificial Sequence
  Description of Artificial Sequence: Synthetic oligonucleotide
aauuaaaaacagaauuaa

SEQ ID NO: 12475 - RNA, 18 nt, Artificial Sequence
  Description of Artificial Sequence: Synthetic oligonucleotide
gaauaaauuaaaaacaga

SEQ ID NO: 12476 - RNA, 18 nt, Artificial Sequence
  Description of Artificial Sequence: Synthetic oligonucleotide
aaauagaauaaauuaaaa

SEQ ID NO: 12477 - RNA, 18 nt, Artificial Sequence
  Description of Artificial Sequence: Synthetic oligonucleotide
uuucuaaauagaauaaau

SEQ ID NO: 12478 - RNA, 18 nt, Artificial Sequence
  Description of Artificial Sequence: Synthetic oligonucleotide
ggacauuucuaaauagaa

SEQ ID NO: 12479 - RNA, 18 nt, Artificial Sequence
  Description of Artificial Sequence: Synthetic oligonucleotide
uucugggacauuucuaaa

SEQ ID NO: 12480 - RNA, 18 nt, Artificial Sequence
  Description of Artificial Sequence: Synthetic oligonucleotide
uaaguuucugggacauuu

SEQ ID NO: 12481 - RNA, 18 nt, Artificial Sequence
  Description of Artificial Sequence: Synthetic oligonucleotide
uauacuaaguuucuggga

SEQ ID NO: 12482 - RNA, 18 nt, Artificial Sequence
  Description of Artificial Sequence: Synthetic oligonucleotide
aaaguuauacuaaguuuc

SEQ ID NO: 12483 - RNA, 18 nt, Artificial Sequence
  Description of Artificial Sequence: Synthetic oligonucleotide
aaaguaaaguuauacuaa

SEQ ID NO: 12484 - RNA, 18 nt, Artificial Sequence
  Description of Artificial Sequence: Synthetic oligonucleotide
uucagaaaguaaaguuau

SEQ ID NO: 12485 - RNA, 18 nt, Artificial Sequence
  Description of Artificial Sequence: Synthetic oligonucleotide
ucauuuucagaaaguaaa

SEQ ID NO: 12486 - RNA, 18 nt, Artificial Sequence
  Description of Artificial Sequence: Synthetic oligonucleotide
uuucuucauuuucagaaa

SEQ ID NO: 12487 - RNA, 18 nt, Artificial Sequence
  Description of Artificial Sequence: Synthetic oligonucleotide
acagguuucuucauuuuc

SEQ ID NO: 12488 - RNA, 18 nt, Artificial Sequence
  Description of Artificial Sequence: Synthetic oligonucleotide
caaggacagguuucuuca

SEQ ID NO: 12489 - RNA, 18 nt, Artificial Sequence
  Description of Artificial Sequence: Synthetic oligonucleotide
augcccaaggacagguuu

SEQ ID NO: 12490 - RNA, 18 nt, Artificial Sequence
  Description of Artificial Sequence: Synthetic oligonucleotide
cacuaaugcccaaggaca

SEQ ID NO: 12491 - RNA, 18 nt, Artificial Sequence
  Description of Artificial Sequence: Synthetic oligonucleotide
caacacacuaaugcccaa

SEQ ID NO: 12492 - RNA, 18 nt, Artificial Sequence
  Description of Artificial Sequence: Synthetic oligonucleotide
aaauccaacacacuaaug

SEQ ID NO: 12493 - RNA, 18 nt, Artificial Sequence
  Description of Artificial Sequence: Synthetic oligonucleotide
ugcuuaaauccaacacac

SEQ ID NO: 12494 - RNA, 18 nt, Artificial Sequence
  Description of Artificial Sequence: Synthetic oligonucleotide
uuuguugcuuaaauccaa

SEQ ID NO: 12495 - RNA, 18 nt, Artificial Sequence
  Description of Artificial Sequence: Synthetic oligonucleotide
uuaacuuuguugcuuaaa

SEQ ID NO: 12496 - RNA, 18 nt, Artificial Sequence
  Description of Artificial Sequence: Synthetic oligonucleotide
uuuuuuuaacuuuguugc

SEQ ID NO: 12497 - RNA, 18 nt, Artificial Sequence
  Description of Artificial Sequence: Synthetic oligonucleotide
guagguuuuuuuaacuuu

SEQ ID NO: 12498 - RNA, 18 nt, Artificial Sequence
  Description of Artificial Sequence: Synthetic oligonucleotide
acaggguagguuuuuuua

SEQ ID NO: 12499 - RNA, 18 nt, Artificial Sequence
  Description of Artificial Sequence: Synthetic oligonucleotide
auaacacaggguagguuu

SEQ ID NO: 12500 - RNA, 18 nt, Artificial Sequence
  Description of Artificial Sequence: Synthetic oligonucleotide
uugccauaacacagggua

SEQ ID NO: 12501 - RNA, 18 nt, Artificial Sequence
  Description of Artificial Sequence: Synthetic oligonucleotide
gaaaauugccauaacaca

SEQ ID NO: 12502 - RNA, 18 nt, Artificial Sequence
  Description of Artificial Sequence: Synthetic oligonucleotide
caagugaaaauugccaua

SEQ ID NO: 12503 - RNA, 18 nt, Artificial Sequence
  Description of Artificial Sequence: Synthetic oligonucleotide
accaucaagugaaaauug

SEQ ID NO: 12504 - RNA, 18 nt, Artificial Sequence
  Description of Artificial Sequence: Synthetic oligonucleotide
gaaccaccaucaagugaa

SEQ ID NO: 12505 - RNA, 18 nt, Artificial Sequence
  Description of Artificial Sequence: Synthetic oligonucleotide
uuauagaaccaccaucaa

SEQ ID NO: 12506 - RNA, 18 nt, Artificial Sequence
  Description of Artificial Sequence: Synthetic oligonucleotide
cuguguuauagaaccacc

SEQ ID NO: 12507 - RNA, 18 nt, Artificial Sequence
  Description of Artificial Sequence: Synthetic oligonucleotide
gauaccuguguuauagaa

SEQ ID NO: 12508 - RNA, 18 nt, Artificial Sequence
  Description of Artificial Sequence: Synthetic oligonucleotide
ucacugauaccuguguua

SEQ ID NO: 12509 - RNA, 18 nt, Artificial Sequence
  Description of Artificial Sequence: Synthetic oligonucleotide
aagguucacugauaccug

SEQ ID NO: 12510 - RNA, 18 nt, Artificial Sequence
  Description of Artificial Sequence: Synthetic oligonucleotide
uuauaaagguucacugau

SEQ ID NO: 12511 - RNA, 18 nt, Artificial Sequence
  Description of Artificial Sequence: Synthetic oligonucleotide
aucuuuuauaaagguuca

SEQ ID NO: 12512 - RNA, 18 nt, Artificial Sequence
  Description of Artificial Sequence: Synthetic oligonucleotide
uguucaucuuuuauaaag

SEQ ID NO: 12513 - RNA, 18 nt, Artificial Sequence
  Description of Artificial Sequence: Synthetic oligonucleotide
aaaguuguucaucuuuua

SEQ ID NO: 12514 - RNA, 18 nt, Artificial Sequence
  Description of Artificial Sequence: Synthetic oligonucleotide
gcugaaaaguuguucauc

SEQ ID NO: 12515 - RNA, 18 nt, Artificial Sequence
  Description of Artificial Sequence: Synthetic oligonucleotide
agcaagcugaaaaguugu

SEQ ID NO: 12516 - RNA, 18 nt, Artificial Sequence
  Description of Artificial Sequence: Synthetic oligonucleotide
aauuaagcaagcugaaaa

SEQ ID NO: 12517 - RNA, 18 nt, Artificial Sequence
  Description of Artificial Sequence: Synthetic oligonucleotide
acugaaauuaagcaagcu

SEQ ID NO: 12518 - RNA, 18 nt, Artificial Sequence
  Description of Artificial Sequence: Synthetic oligonucleotide
aauuaacugaaauuaagc

SEQ ID NO: 12519 - RNA, 18 nt, Artificial Sequence
  Description of Artificial Sequence: Synthetic oligonucleotide
auguuaauuaacugaaau

SEQ ID NO: 12520 - RNA, 18 nt, Artificial Sequence
  Description of Artificial Sequence: Synthetic oligonucleotide
uauacauguuaauuaacu

SEQ ID NO: 12521 - RNA, 18 nt, Artificial Sequence
  Description of Artificial Sequence: Synthetic oligonucleotide
auaaguauacauguuaau

SEQ ID NO: 12522 - RNA, 18 nt, Artificial Sequence
  Description of Artificial Sequence: Synthetic oligonucleotide
cauagauaaguauacaug

SEQ ID NO: 12523 - RNA, 18 nt, Artificial Sequence
  Description of Artificial Sequence: Synthetic oligonucleotide
auuaacauagauaaguau

SEQ ID NO: 12524 - RNA, 18 nt, Artificial Sequence
  Description of Artificial Sequence: Synthetic oligonucleotide
aaaacauuaacauagaua

SEQ ID NO: 12525 - RNA, 18 nt, Artificial Sequence
  Description of Artificial Sequence: Synthetic oligonucleotide
gcaauaaaacauuaacau

SEQ ID NO: 12526 - RNA, 18 nt, Artificial Sequence
  Description of Artificial Sequence: Synthetic oligonucleotide
uuuaagcaauaaaacauu

SEQ ID NO: 12527 - RNA, 18 nt, Artificial Sequence
  Description of Artificial Sequence: Synthetic oligonucleotide
aacauuuuaagcaauaaa

SEQ ID NO: 12528 - RNA, 18 nt, Artificial Sequence
  Description of Artificial Sequence: Synthetic oligonucleotide
aauuaaacauuuuaagca

SEQ ID NO: 12529 - RNA, 18 nt, Artificial Sequence
  Description of Artificial Sequence: Synthetic oligonucleotide
auaaaaauuaaacauuuu

SEQ ID NO: 12530 - RNA, 18 nt, Artificial Sequence
  Description of Artificial Sequence: Synthetic oligonucleotide
caaauauaaaaauuaaac

SEQ ID NO: 12531 - RNA, 18 nt, Artificial Sequence
  Description of Artificial Sequence: Synthetic oligonucleotide
uuuaccaaauauaaaaau

SEQ ID NO: 12532 - RNA, 18 nt, Artificial Sequence
  Description of Artificial Sequence: Synthetic oligonucleotide
aucuguuuaccaaauaua

SEQ ID NO: 12533 - RNA, 18 nt, Artificial Sequence
  Description of Artificial Sequence: Synthetic oligonucleotide
aaacuaucuguuuaccaa

SEQ ID NO: 12534 - RNA, 18 nt, Artificial Sequence
  Description of Artificial Sequence: Synthetic oligonucleotide
agaaaaaacuaucuguuu

SEQ ID NO: 12535 - RNA, 18 nt, Artificial Sequence
  Description of Artificial Sequence: Synthetic oligonucleotide
gggagagaaaaaacuauc

SEQ ID NO: 12536 - RNA, 18 nt, Artificial Sequence
  Description of Artificial Sequence: Synthetic oligonucleotide
aagauggaaggaagaggg

SEQ ID NO: 12537 - RNA, 18 nt, Artificial Sequence
  Description of Artificial Sequence: Synthetic oligonucleotide
augaaagauggaaggaag

SEQ ID NO: 12538 - RNA, 18 nt, Artificial Sequence
  Description of Artificial Sequence: Synthetic oligonucleotide
uaguaaugaaagauggaa

SEQ ID NO: 12539 - RNA, 18 nt, Artificial Sequence
  Description of Artificial Sequence: Synthetic oligonucleotide
cagagagacauugugagc

SEQ ID NO: 12540 - RNA, 18 nt, Artificial Sequence
  Description of Artificial Sequence: Synthetic oligonucleotide
uggugcagagagacauug

SEQ ID NO: 12541 - RNA, 18 nt, Artificial Sequence
  Description of Artificial Sequence: Synthetic oligonucleotide
gagcuuggugcagagaga

SEQ ID NO: 12542 - RNA, 18 nt, Artificial Sequence
  Description of Artificial Sequence: Synthetic oligonucleotide
ucauggagcuuggugcag

SEQ ID NO: 12543 - RNA, 18 nt, Artificial Sequence
  Description of Artificial Sequence: Synthetic oligonucleotide
cugagucauggagcuugg

SEQ ID NO: 12544 - RNA, 18 nt, Artificial Sequence
  Description of Artificial Sequence: Synthetic oligonucleotide
aaauccugagucauggag

SEQ ID NO: 12545 - RNA, 18 nt, Artificial Sequence
  Description of Artificial Sequence: Synthetic oligonucleotide
caggcaaauccugaguca

SEQ ID NO: 12546 - RNA, 18 nt, Artificial Sequence
  Description of Artificial Sequence: Synthetic oligonucleotide
aacuccaggcaaauccug

SEQ ID NO: 12547 - RNA, 18 nt, Artificial Sequence
  Description of Artificial Sequence: Synthetic oligonucleotide
ccaggaacuccaggcaaa

SEQ ID NO: 12548 - RNA, 18 nt, Artificial Sequence
  Description of Artificial Sequence: Synthetic oligonucleotide
cuuucccaggaacuccag

SEQ ID NO: 12549 - RNA, 18 nt, Artificial Sequence
  Description of Artificial Sequence: Synthetic oligonucleotide
cuggucuuucccaggaac

SEQ ID NO: 12550 - RNA, 18 nt, Artificial Sequence
  Description of Artificial Sequence: Synthetic oligonucleotide
aacaacuggucuuuccca

SEQ ID NO: 12551 - RNA, 18 nt, Artificial Sequence
  Description of Artificial Sequence: Synthetic oligonucleotide
gugaaaacaacuggucuu

SEQ ID NO: 12552 - RNA, 18 nt, Artificial Sequence
  Description of Artificial Sequence: Synthetic oligonucleotide
aggcugugaaaacaacug

SEQ ID NO: 12553 - RNA, 18 nt, Artificial Sequence
  Description of Artificial Sequence: Synthetic oligonucleotide
acuggaggcugugaaaac

SEQ ID NO: 12554 - RNA, 18 nt, Artificial Sequence
  Description of Artificial Sequence: Synthetic oligonucleotide
uuaacacuggaggcugug

SEQ ID NO: 12555 - RNA, 18 nt, Artificial Sequence
  Description of Artificial Sequence: Synthetic oligonucleotide
uguccuuaacacuggagg

SEQ ID NO: 12556 - RNA, 18 nt, Artificial Sequence
  Description of Artificial Sequence: Synthetic oligonucleotide
gaagcuguccuuaacacu

SEQ ID NO: 12557 - RNA, 18 nt, Artificial Sequence
  Description of Artificial Sequence: Synthetic oligonucleotide
cuugugaagcuguccuua

SEQ ID NO: 12558 - RNA, 18 nt, Artificial Sequence
  Description of Artificial Sequence: Synthetic oligonucleotide
acccucuugugaagcugu

SEQ ID NO: 12559 - RNA, 18 nt, Artificial Sequence
  Description of Artificial Sequence: Synthetic oligonucleotide
uggcaacccucuugugaa

SEQ ID NO: 12560 - RNA, 18 nt, Artificial Sequence
  Description of Artificial Sequence: Synthetic oligonucleotide
guucuuggcaacccucuu

SEQ ID NO: 12561 - RNA, 18 nt, Artificial Sequence
  Description of Artificial Sequence: Synthetic oligonucleotide
uguaaguucuuggcaacc

SEQ ID NO: 12562 - RNA, 18 nt, Artificial Sequence
  Description of Artificial Sequence: Synthetic oligonucleotide
ucuuguguaaguucuugg

SEQ ID NO: 12563 - RNA, 18 nt, Artificial Sequence
  Description of Artificial Sequence: Synthetic oligonucleotide
uuuguucuuguguaaguu

SEQ ID NO: 12564 - RNA, 18 nt, Artificial Sequence
  Description of Artificial Sequence: Synthetic oligonucleotide
aucucuuuguucuugugu

SEQ ID NO: 12565 - RNA, 18 nt, Artificial Sequence
  Description of Artificial Sequence: Synthetic oligonucleotide
aguugaucucuuuguucu

SEQ ID NO: 12566 - RNA, 18 nt, Artificial Sequence
  Description of Artificial Sequence: Synthetic oligonucleotide
cccucaguugaucucuuu

SEQ ID NO: 12567 - RNA, 18 nt, Artificial Sequence
  Description of Artificial Sequence: Synthetic oligonucleotide
aucugcccucaguugauc

SEQ ID NO: 12568 - RNA, 18 nt, Artificial Sequence
  Description of Artificial Sequence: Synthetic oligonucleotide
cugauaucugcccucagu

SEQ ID NO: 12569 - RNA, 18 nt, Artificial Sequence
  Description of Artificial Sequence: Synthetic oligonucleotide
uaauacugauaucugccc

SEQ ID NO: 12570 - RNA, 18 nt, Artificial Sequence
  Description of Artificial Sequence: Synthetic oligonucleotide
uuugauaauacugauauc

SEQ ID NO: 12571 - RNA, 18 nt, Artificial Sequence
  Description of Artificial Sequence: Synthetic oligonucleotide
cugccuuugauaauacug

SEQ ID NO: 12572 - RNA, 18 nt, Artificial Sequence
  Description of Artificial Sequence: Synthetic oligonucleotide
gguaucugccuuugauaa

SEQ ID NO: 12573 - RNA, 18 nt, Artificial Sequence
  Description of Artificial Sequence: Synthetic oligonucleotide
gcuccgguaucugccuuu

SEQ ID NO: 12574 - RNA, 18 nt, Artificial Sequence
  Description of Artificial Sequence: Synthetic oligonucleotide
cuuuggcuccgguaucug

SEQ ID NO: 12575 - RNA, 18 nt, Artificial Sequence
  Description of Artificial Sequence: Synthetic oligonucleotide
acagaauuucacaucuuu

SEQ ID NO: 12576 - RNA, 18 nt, Artificial Sequence
  Description of Artificial Sequence: Synthetic oligonucleotide
auuacacagaauuucaca

SEQ ID NO: 12577 - RNA, 18 nt, Artificial Sequence
  Description of Artificial Sequence: Synthetic oligonucleotide
auuacauuacacagaauu

SEQ ID NO: 12578 - RNA, 18 nt, Artificial Sequence
  Description of Artificial Sequence: Synthetic oligonucleotide
uuuuuauuacauuacaca

SEQ ID NO: 12579 - RNA, 18 nt, Artificial Sequence
  Description of Artificial Sequence: Synthetic oligonucleotide
uuuauuuuuuauuacauu

SEQ ID NO: 12580 - RNA, 18 nt, Artificial Sequence
  Description of Artificial Sequence: Synthetic oligonucleotide
uccaauuuauuuuuuauu

SEQ ID NO: 12581 - RNA, 18 nt, Artificial Sequence
  Description of Artificial Sequence: Synthetic oligonucleotide
cacaguccaauuuauuuu

SEQ ID NO: 12582 - RNA, 18 nt, Artificial Sequence
  Description of Artificial Sequence: Synthetic oligonucleotide
uauaucacaguccaauuu

SEQ ID NO: 12583 - RNA, 18 nt, Artificial Sequence
  Description of Artificial Sequence: Synthetic oligonucleotide
uuguuuauaucacagucc

SEQ ID NO: 12584 - RNA, 18 nt, Artificial Sequence
  Description of Artificial Sequence: Synthetic oligonucleotide
ugaacuuguuuauaucac

SEQ ID NO: 12585 - RNA, 18 nt, Artificial Sequence
  Description of Artificial Sequence: Synthetic oligonucleotide
aucggugaacuuguuuau

SEQ ID NO: 12586 - RNA, 18 nt, Artificial Sequence
  Description of Artificial Sequence: Synthetic oligonucleotide
ucaagaucggugaacuug

SEQ ID NO: 12587 - RNA, 18 nt, Artificial Sequence
  Description of Artificial Sequence: Synthetic oligonucleotide
gcaggucaagaucgguga

SEQ ID NO: 12588 - RNA, 18 nt, Artificial Sequence
  Description of Artificial Sequence: Synthetic oligonucleotide
augcugcaggucaagauc

SEQ ID NO: 12589 - RNA, 18 nt, Artificial Sequence
  Description of Artificial Sequence: Synthetic oligonucleotide
gcuacaugcugcagguca

SEQ ID NO: 12590 - RNA, 18 nt, Artificial Sequence
  Description of Artificial Sequence: Synthetic oligonucleotide
cuuuagcuacaugcugca

SEQ ID NO: 12591 - RNA, 18 nt, Artificial Sequence
  Description of Artificial Sequence: Synthetic oligonucleotide
aguuucuuuagcuacaug

SEQ ID NO: 12592 - RNA, 18 nt, Artificial Sequence
  Description of Artificial Sequence: Synthetic oligonucleotide
ccgccaguuucuuuagcu

SEQ ID NO: 12593 - RNA, 18 nt, Artificial Sequence
  Description of Artificial Sequence: Synthetic oligonucleotide
caaacccgccaguuucuu

SEQ ID NO: 12594 - RNA, 18 nt, Artificial Sequence
  Description of Artificial Sequence: Synthetic oligonucleotide
agccacaaacccgccagu

SEQ ID NO: 12595 - RNA, 18 nt, Artificial Sequence
  Description of Artificial Sequence: Synthetic oligonucleotide
ucucuagccacaaacccg

SEQ ID NO: 12596 - RNA, 18 nt, Artificial Sequence
  Description of Artificial Sequence: Synthetic oligonucleotide
uaaaaucucuagccacaa

SEQ ID NO: 12597 - RNA, 18 nt, Artificial Sequence
  Description of Artificial Sequence: Synthetic oligonucleotide
uacuguaaaaucucuagc

SEQ ID NO: 12598 - RNA, 18 nt, Artificial Sequence
  Description of Artificial Sequence: Synthetic oligonucleotide
acaaguacuguaaaaucu

SEQ ID NO: 12599 - RNA, 18 nt, Artificial Sequence
  Description of Artificial Sequence: Synthetic oligonucleotide
gauccacaaguacuguaa

SEQ ID NO: 12600 - RNA, 18 nt, Artificial Sequence
  Description of Artificial Sequence: Synthetic oligonucleotide
ggcucgauccacaaguac

SEQ ID NO: 12601 - RNA, 18 nt, Artificial Sequence
  Description of Artificial Sequence: Synthetic oligonucleotide
uguauggcucgauccaca

SEQ ID NO: 12602 - RNA, 18 nt, Artificial Sequence
  Description of Artificial Sequence: Synthetic oligonucleotide
gagaauguauggcucgau

SEQ ID NO: 12603 - RNA, 18 nt, Artificial Sequence
  Description of Artificial Sequence: Synthetic oligonucleotide
gagucgagaauguauggc

SEQ ID NO: 12604 - RNA, 18 nt, Artificial Sequence
  Description of Artificial Sequence: Synthetic oligonucleotide
cgagagagucgagaaugu

SEQ ID NO: 12605 - RNA, 18 nt, Artificial Sequence
  Description of Artificial Sequence: Synthetic oligonucleotide
ucugacgagagagucgag

SEQ ID NO: 12606 - RNA, 18 nt, Artificial Sequence
  Description of Artificial Sequence: Synthetic oligonucleotide
uauacucugacgagagag

SEQ ID NO: 12607 - RNA, 18 nt, Artificial Sequence
  Description of Artificial Sequence: Synthetic oligonucleotide
guggauauacucugacga

SEQ ID NO: 12608 - RNA, 18 nt, Artificial Sequence
  Description of Artificial Sequence: Synthetic oligonucleotide
cucugguggauauacucu

SEQ ID NO: 12609 - RNA, 18 nt, Artificial Sequence
  Description of Artificial Sequence: Synthetic oligonucleotide
cagguuuuaauaguaaaa

SEQ ID NO: 12610 - RNA, 18 nt, Artificial Sequence
  Description of Artificial Sequence: Synthetic oligonucleotide
aaguucagguuuuaauag

SEQ ID NO: 12611 - RNA, 18 nt, Artificial Sequence
  Description of Artificial Sequence: Synthetic oligonucleotide
auuccaaguucagguuuu

SEQ ID NO: 12612 - RNA, 18 nt, Artificial Sequence
  Description of Artificial Sequence: Synthetic oligonucleotide
agaagauuccaaguucag

SEQ ID NO: 12613 - RNA, 18 nt, Artificial Sequence
  Description of Artificial Sequence: Synthetic oligonucleotide
uagaaagaagauuccaag

SEQ ID NO: 12614 - RNA, 18 nt, Artificial Sequence
  Description of Artificial Sequence: Synthetic oligonucleotide
cacaauagaaagaagauu

SEQ ID NO: 12615 - RNA, 18 nt, Artificial Sequence
  Description of Artificial Sequence: Synthetic oligonucleotide
uucuccacaauagaaaga

SEQ ID NO: 12616 - RNA, 18 nt, Artificial Sequence
  Description of Artificial Sequence: Synthetic oligonucleotide
uacauuucuccacaauag

SEQ ID NO: 12617 - RNA, 18 nt, Artificial Sequence
  Description of Artificial Sequence: Synthetic oligonucleotide
acaauuacauuucuccac

SEQ ID NO: 12618 - RNA, 18 nt, Artificial Sequence
  Description of Artificial Sequence: Synthetic oligonucleotide
uuacuacaauuacauuuc

SEQ ID NO: 12619 - RNA, 18 nt, Artificial Sequence
  Description of Artificial Sequence: Synthetic oligonucleotide
uugucuuacuacaauuac

SEQ ID NO: 12620 - RNA, 18 nt, Artificial Sequence
  Description of Artificial Sequence: Synthetic oligonucleotide
aauucuugucuuacuaca

SEQ ID NO: 12621 - RNA, 18 nt, Artificial Sequence
  Description of Artificial Sequence: Synthetic oligonucleotide
uauuuaauucuugucuua

SEQ ID NO: 12622 - RNA, 18 nt, Artificial Sequence
  Description of Artificial Sequence: Synthetic oligonucleotide
gaauauauuuaauucuug

SEQ ID NO: 12623 - RNA, 18 nt, Artificial Sequence
  Description of Artificial Sequence: Synthetic oligonucleotide
caauggaauauauuuaau

SEQ ID NO: 12624 - RNA, 18 nt, Artificial Sequence
  Description of Artificial Sequence: Synthetic oligonucleotide
uacuacaauggaauauau

SEQ ID NO: 12625 - RNA, 18 nt, Artificial Sequence
  Description of Artificial Sequence: Synthetic oligonucleotide
ucaaauacuacaauggaa

SEQ ID NO: 12626 - RNA, 18 nt, Artificial Sequence
  Description of Artificial Sequence: Synthetic oligonucleotide
cuuauucaaauacuacaa

SEQ ID NO: 12627 - RNA, 18 nt, Artificial Sequence
  Description of Artificial Sequence: Synthetic oligonucleotide
aacugcuuauucaaauac

SEQ ID NO: 12628 - RNA, 18 nt, Artificial Sequence
  Description of Artificial Sequence: Synthetic oligonucleotide
caaauaacugcuuauuca

SEQ ID NO: 12629 - RNA, 18 nt, Artificial Sequence
  Description of Artificial Sequence: Synthetic oligonucleotide
cuacucaaauaacugcuu

SEQ ID NO: 12630 - RNA, 18 nt, Artificial Sequence
  Description of Artificial Sequence: Synthetic oligonucleotide
auuuucuacucaaauaac

SEQ ID NO: 12631 - RNA, 18 nt, Artificial Sequence
  Description of Artificial Sequence: Synthetic oligonucleotide
cacuaauuuucuacucaa

SEQ ID NO: 12632 - RNA, 18 nt, Artificial Sequence
  Description of Artificial Sequence: Synthetic oligonucleotide
ggaaacacuaauuuucua

SEQ ID NO: 12633 - RNA, 18 nt, Artificial Sequence
  Description of Artificial Sequence: Synthetic oligonucleotide
cuacaauggaauauauuu

SEQ ID NO: 12634 - RNA, 18 nt, Artificial Sequence
  Description of Artificial Sequence: Synthetic oligonucleotide
aaauacuacaauggaaua

SEQ ID NO: 12635 - RNA, 18 nt, Artificial Sequence
  Description of Artificial Sequence: Synthetic oligonucleotide
uauucaaauacuacaaug

SEQ ID NO: 12636 - RNA, 18 nt, Artificial Sequence
  Description of Artificial Sequence: Synthetic oligonucleotide
cugcuuauucaaauacua

SEQ ID NO: 12637 - RNA, 18 nt, Artificial Sequence
  Description of Artificial Sequence: Synthetic oligonucleotide
aauaacugcuuauucaaa

SEQ ID NO: 12638 - RNA, 18 nt, Artificial Sequence
  Description of Artificial Sequence: Synthetic oligonucleotide
acucaaauaacugcuuau

SEQ ID NO: 12639 - RNA, 18 nt, Artificial Sequence
  Description of Artificial Sequence: Synthetic oligonucleotide
uuucuacucaaauaacug

SEQ ID NO: 12640 - RNA, 18 nt, Artificial Sequence
  Description of Artificial Sequence: Synthetic oligonucleotide
cuaauuuucuacucaaau

SEQ ID NO: 12641 - RNA, 18 nt, Artificial Sequence
  Description of Artificial Sequence: Synthetic oligonucleotide
aaacacuaauuuucuacu

SEQ ID NO: 12642 - RNA, 18 nt, Artificial Sequence
  Description of Artificial Sequence: Synthetic oligonucleotide
gcuggaaacacuaauuuu

SEQ ID NO: 12643 - RNA, 18 nt, Artificial Sequence
  Description of Artificial Sequence: Synthetic oligonucleotide
ucuuagcuggaaacacua

SEQ ID NO: 12644 - RNA, 18 nt, Artificial Sequence
  Description of Artificial Sequence: Synthetic oligonucleotide
caucaucuuagcuggaaa

SEQ ID NO: 12645 - RNA, 18 nt, Artificial Sequence
  Description of Artificial Sequence: Synthetic oligonucleotide
uaugccaucaucuuagcu

SEQ ID NO: 12646 - RNA, 18 nt, Artificial Sequence
  Description of Artificial Sequence: Synthetic oligonucleotide
caaaauaugccaucaucu

SEQ ID NO: 12647 - RNA, 18 nt, Artificial Sequence
  Description of Artificial Sequence: Synthetic oligonucleotide
auuuucaaaauaugccau

SEQ ID NO: 12648 - RNA, 18 nt, Artificial Sequence
  Description of Artificial Sequence: Synthetic oligonucleotide
uaugaauuuucaaaauau

SEQ ID NO: 12649 - RNA, 18 nt, Artificial Sequence
  Description of Artificial Sequence: Synthetic oligonucleotide
cacuauaugaauuuucaa

SEQ ID NO: 12650 - RNA, 18 nt, Artificial Sequence
  Description of Artificial Sequence: Synthetic oligonucleotide
auauucacuauaugaauu

SEQ ID NO: 12651 - RNA, 18 nt, Artificial Sequence
  Description of Artificial Sequence: Synthetic oligonucleotide
uaguuauauucacuauau

SEQ ID NO: 12652 - RNA, 18 nt, Artificial Sequence
  Description of Artificial Sequence: Synthetic oligonucleotide
uuuacuaguuauauucac

SEQ ID NO: 12653 - RNA, 18 nt, Artificial Sequence
  Description of Artificial Sequence: Synthetic oligonucleotide
cuucuuuuacuaguuaua

SEQ ID NO: 12654 - RNA, 18 nt, Artificial Sequence
  Description of Artificial Sequence: Synthetic oligonucleotide
caaaacuucuuuuacuag

SEQ ID NO: 12655 - RNA, 18 nt, Artificial Sequence
  Description of Artificial Sequence: Synthetic oligonucleotide
aauguuguuaaaacuaau

SEQ ID NO: 12656 - RNA, 18 nt, Artificial Sequence
  Description of Artificial Sequence: Synthetic oligonucleotide
aguccaauguuguuaaaa

SEQ ID NO: 12657 - RNA, 18 nt, Artificial Sequence
  Description of Artificial Sequence: Synthetic oligonucleotide
uuggaaguccaauguugu

SEQ ID NO: 12658 - RNA, 18 nt, Artificial Sequence
  Description of Artificial Sequence: Synthetic oligonucleotide
gccuuuuggaaguccaau

SEQ ID NO: 12659 - RNA, 18 nt, Artificial Sequence
  Description of Artificial Sequence: Synthetic oligonucleotide
ggagagccuuuuggaagu

SEQ ID NO: 12660 - RNA, 18 nt, Artificial Sequence
  Description of Artificial Sequence: Synthetic oligonucleotide
uccgcggagagccuuuug

SEQ ID NO: 12661 - RNA, 18 nt, Artificial Sequence
  Description of Artificial Sequence: Synthetic oligonucleotide
agaaauccgcggagagcc

SEQ ID NO: 12662 - RNA, 18 nt, Artificial Sequence
  Description of Artificial Sequence: Synthetic oligonucleotide
caggaagaaauccgcgga

SEQ ID NO: 12663 - RNA, 18 nt, Artificial Sequence
  Description of Artificial Sequence: Synthetic oligonucleotide
agacgcaggaagaaaucc

SEQ ID NO: 12664 - RNA, 18 nt, Artificial Sequence
  Description of Artificial Sequence: Synthetic oligonucleotide
cgcaaagacgcaggaaga

SEQ ID NO: 12665 - RNA, 18 nt, Artificial Sequence
  Description of Artificial Sequence: Synthetic oligonucleotide
cacuucgcaaagacgcag

SEQ ID NO: 12666 - RNA, 18 nt, Artificial Sequence
  Description of Artificial Sequence: Synthetic oligonucleotide
guugacacuucgcaaaga

SEQ ID NO: 12667 - RNA, 18 nt, Artificial Sequence
  Description of Artificial Sequence: Synthetic oligonucleotide
ugcagguugacacuucgc

SEQ ID NO: 12668 - RNA, 18 nt, Artificial Sequence
  Description of Artificial Sequence: Synthetic oligonucleotide
guuuaugcagguugacac

SEQ ID NO: 12669 - RNA, 18 nt, Artificial Sequence
  Description of Artificial Sequence: Synthetic oligonucleotide
ucuagguuuaugcagguu

SEQ ID NO: 12670 - RNA, 18 nt, Artificial Sequence
  Description of Artificial Sequence: Synthetic oligonucleotide
aggucucuagguuuaugc

SEQ ID NO: 12671 - RNA, 18 nt, Artificial Sequence
  Description of Artificial Sequence: Synthetic oligonucleotide
aacccaggucucuagguu

SEQ ID NO: 12672 - RNA, 18 nt, Artificial Sequence
  Description of Artificial Sequence: Synthetic oligonucleotide
gucccaacccaggucucu

SEQ ID NO: 12673 - RNA, 18 nt, Artificial Sequence
  Description of Artificial Sequence: Synthetic oligonucleotide
aucuugucccaacccagg

SEQ ID NO: 12674 - RNA, 18 nt, Artificial Sequence
  Description of Artificial Sequence: Synthetic oligonucleotide
caccaaucuugucccaac

SEQ ID NO: 12675 - RNA, 18 nt, Artificial Sequence
  Description of Artificial Sequence: Synthetic oligonucleotide
uaacccaccaaucuuguc

SEQ ID NO: 12676 - RNA, 18 nt, Artificial Sequence
  Description of Artificial Sequence: Synthetic oligonucleotide
ucauguaacccaccaauc

SEQ ID NO: 12677 - RNA, 18 nt, Artificial Sequence
  Description of Artificial Sequence: Synthetic oligonucleotide
uaacuucauguaacccac

SEQ ID NO: 12678 - RNA, 18 nt, Artificial Sequence
  Description of Artificial Sequence: Synthetic oligonucleotide
cugccuaacuucauguaa

SEQ ID NO: 12679 - RNA, 18 nt, Artificial Sequence
  Description of Artificial Sequence: Synthetic oligonucleotide
aguaucugccuaacuuca

SEQ ID NO: 12680 - RNA, 18 nt, Artificial Sequence
  Description of Artificial Sequence: Synthetic oligonucleotide
ccaugaguaucugccuaa

SEQ ID NO: 12681 - RNA, 18 nt, Artificial Sequence
  Description of Artificial Sequence: Synthetic oligonucleotide
aguauccaugaguaucug

SEQ ID NO: 12682 - RNA, 18 nt, Artificial Sequence
  Description of Artificial Sequence: Synthetic oligonucleotide
uggauaguauccaugagu

SEQ ID NO: 12683 - RNA, 18 nt, Artificial Sequence
  Description of Artificial Sequence: Synthetic oligonucleotide
guaacuggauaguaucca

SEQ ID NO: 12684 - RNA, 18 nt, Artificial Sequence
  Description of Artificial Sequence: Synthetic oligonucleotide
ggcagguaacuggauagu

SEQ ID NO: 12685 - RNA, 18 nt, Artificial Sequence
  Description of Artificial Sequence: Synthetic oligonucleotide
gccagugcccauagcggg

SEQ ID NO: 12686 - RNA, 18 nt, Artificial Sequence
  Description of Artificial Sequence: Synthetic oligonucleotide
cuuaugccagugcccaua

SEQ ID NO: 12687 - RNA, 18 nt, Artificial Sequence
  Description of Artificial Sequence: Synthetic oligonucleotide
uuguucuuaugccagugc

SEQ ID NO: 12688 - RNA, 18 nt, Artificial Sequence
  Description of Artificial Sequence: Synthetic oligonucleotide
gggccuuguucuuaugcc

SEQ ID NO: 12689 - RNA, 18 nt, Artificial Sequence
  Description of Artificial Sequence: Synthetic oligonucleotide
cugcgguacucgccuggg

SEQ ID NO: 12690 - RNA, 18 nt, Artificial Sequence
  Description of Artificial Sequence: Synthetic oligonucleotide
acugcgguacucgccugg

SEQ ID NO: 12691 - RNA, 18 nt, Artificial Sequence
  Description of Artificial Sequence: Synthetic oligonucleotide
gggccacugcgguacucg

SEQ ID NO: 12692 - RNA, 18 nt, Artificial Sequence
  Description of Artificial Sequence: Synthetic oligonucleotide
ugaaaaugaugaggcggg

SEQ ID NO: 12693 - RNA, 18 nt, Artificial Sequence
  Description of Artificial Sequence: Synthetic oligonucleotide
ggaugaaaaugaugaggc

SEQ ID NO: 12694 - RNA, 18 nt, Artificial Sequence
  Description of Artificial Sequence: Synthetic oligonucleotide
cccaaggaugaaaaugau

SEQ ID NO: 12695 - RNA, 18 nt, Artificial Sequence
  Description of Artificial Sequence: Synthetic oligonucleotide
acacccccaaggaugaaa

SEQ ID NO: 12696 - RNA, 18 nt, Artificial Sequence
  Description of Artificial Sequence: Synthetic oligonucleotide
ggcucacacccccaagga

SEQ ID NO: 12697 - RNA, 18 nt, Artificial Sequence
  Description of Artificial Sequence: Synthetic oligonucleotide
auucaggcucacaccccc

SEQ ID NO: 12698 - RNA, 18 nt, Artificial Sequence
  Description of Artificial Sequence: Synthetic oligonucleotide
aucucauucaggcucaca

SEQ ID NO: 12699 - RNA, 18 nt, Artificial Sequence
  Description of Artificial Sequence: Synthetic oligonucleotide
agcgcaucucauucaggc

SEQ ID NO: 12700 - RNA, 18 nt, Artificial Sequence
  Description of Artificial Sequence: Synthetic oligonucleotide
ggcgcagcgcaucucauu

SEQ ID NO: 12701 - RNA, 18 nt, Artificial Sequence
  Description of Artificial Sequence: Synthetic oligonucleotide
ucguaggcgcagcgcauc

SEQ ID NO: 12702 - RNA, 18 nt, Artificial Sequence
  Description of Artificial Sequence: Synthetic oligonucleotide
ucaccucguaggcgcagc

SEQ ID NO: 12703 - RNA, 18 nt, Artificial Sequence
  Description of Artificial Sequence: Synthetic oligonucleotide
cugggucaccucguaggc

SEQ ID NO: 12704 - RNA, 18 nt, Artificial Sequence
  Description of Artificial Sequence: Synthetic oligonucleotide
uuggccugggucaccucg

SEQ ID NO: 12705 - RNA, 18 nt, Artificial Sequence
  Description of Artificial Sequence: Synthetic oligonucleotide
uuccguuggccuggguca

SEQ ID NO: 12706 - RNA, 18 nt, Artificial Sequence
  Description of Artificial Sequence: Synthetic oligonucleotide
ccacuuuccguuggccug

SEQ ID NO: 12707 - RNA, 18 nt, Artificial Sequence
  Description of Artificial Sequence: Synthetic oligonucleotide
accucccacuuuccguug

SEQ ID NO: 12708 - RNA, 18 nt, Artificial Sequence
  Description of Artificial Sequence: Synthetic oligonucleotide
ucagcaccucccacuuuc

SEQ ID NO: 12709 - RNA, 18 nt, Artificial Sequence
  Description of Artificial Sequence: Synthetic oligonucleotide
ccgcuggaagcacggcca

SEQ ID NO: 12710 - RNA, 18 nt, Artificial Sequence
  Description of Artificial Sequence: Synthetic oligonucleotide
gccuuccgcuggaagcac

SEQ ID NO: 12711 - RNA, 18 nt, Artificial Sequence
  Description of Artificial Sequence: Synthetic oligonucleotide
gcggcgccuuccgcugga

SEQ ID NO: 12712 - RNA, 18 nt, Artificial Sequence
  Description of Artificial Sequence: Synthetic oligonucleotide
augcggcggcgccuuccg

SEQ ID NO: 12713 - RNA, 18 nt, Artificial Sequence
  Description of Artificial Sequence: Synthetic oligonucleotide
gugcgaugcggcggcgcc

SEQ ID NO: 12714 - RNA, 18 nt, Artificial Sequence
  Description of Artificial Sequence: Synthetic oligonucleotide
uugaggugcgaugcggcg

SEQ ID NO: 12715 - RNA, 18 nt, Artificial Sequence
  Description of Artificial Sequence: Synthetic oligonucleotide
uggaguugaggugcgaug

SEQ ID NO: 12716 - RNA, 18 nt, Artificial Sequence
  Description of Artificial Sequence: Synthetic oligonucleotide
uggaauggaguugaggug

SEQ ID NO: 12717 - RNA, 18 nt, Artificial Sequence
  Description of Artificial Sequence: Synthetic oligonucleotide
aagcguggaauggaguug

SEQ ID NO: 12718 - RNA, 18 nt, Artificial Sequence
  Description of Artificial Sequence: Synthetic oligonucleotide
caccaaagcguggaaugg

SEQ ID NO: 12719 - RNA, 18 nt, Artificial Sequence
  Description of Artificial Sequence: Synthetic oligonucleotide
ugcgacaccaaagcgugg

SEQ ID NO: 12720 - RNA, 18 nt, Artificial Sequence
  Description of Artificial Sequence: Synthetic oligonucleotide
cagaaugcgacaccaaag

SEQ ID NO: 12721 - RNA, 18 nt, Artificial Sequence
  Description of Artificial Sequence: Synthetic oligonucleotide
uaugacagaaugcgacac

SEQ ID NO: 12722 - RNA, 18 nt, Artificial Sequence
  Description of Artificial Sequence: Synthetic oligonucleotide
gagucuaugacagaaugc

SEQ ID NO: 12723 - RNA, 18 nt, Artificial Sequence
  Description of Artificial Sequence: Synthetic oligonucleotide
caagggagucuaugacag

SEQ ID NO: 12724 - RNA, 18 nt, Artificial Sequence
  Description of Artificial Sequence: Synthetic oligonucleotide
ugggucaagggagucuau

SEQ ID NO: 12725 - RNA, 18 nt, Artificial Sequence
  Description of Artificial Sequence: Synthetic oligonucleotide
uuuugugggucaagggag

SEQ ID NO: 12726 - RNA, 18 nt, Artificial Sequence
  Description of Artificial Sequence: Synthetic oligonucleotide
cuaaguuuugugggucaa

SEQ ID NO: 12727 - RNA, 18 nt, Artificial Sequence
  Description of Artificial Sequence: Synthetic oligonucleotide
aaagacuaaguuuugugg

SEQ ID NO: 12728 - RNA, 18 nt, Artificial Sequence
  Description of Artificial Sequence: Synthetic oligonucleotide
uaccuaaagacuaaguuu

SEQ ID NO: 12729 - RNA, 18 nt, Artificial Sequence
  Description of Artificial Sequence: Synthetic oligonucleotide
acaguuaccuaaagacua

SEQ ID NO: 12730 - RNA, 18 nt, Artificial Sequence
  Description of Artificial Sequence: Synthetic oligonucleotide
uguccacaguuaccuaaa

SEQ ID NO: 12731 - RNA, 18 nt, Artificial Sequence
  Description of Artificial Sequence: Synthetic oligonucleotide
ucugcuguccacaguuac

SEQ ID NO: 12732 - RNA, 18 nt, Artificial Sequence
  Description of Artificial Sequence: Synthetic oligonucleotide
uagcuucugcuguccaca

SEQ ID NO: 12733 - RNA, 18 nt, Artificial Sequence
  Description of Artificial Sequence: Synthetic oligonucleotide
gccccuagcuucugcugu

SEQ ID NO: 12734 - RNA, 18 nt, Artificial Sequence
  Description of Artificial Sequence: Synthetic oligonucleotide
ccuuugccccuagcuucu

SEQ ID NO: 12735 - RNA, 18 nt, Artificial Sequence
  Description of Artificial Sequence: Synthetic oligonucleotide
ggaacccuuugccccuag

SEQ ID NO: 12736 - RNA, 18 nt, Artificial Sequence
  Description of Artificial Sequence: Synthetic oligonucleotide
aggagggaacccuuugcc

SEQ ID NO: 12737 - RNA, 18 nt, Artificial Sequence
  Description of Artificial Sequence: Synthetic oligonucleotide
gaccaaggagggaacccu

SEQ ID NO: 12738 - RNA, 18 nt, Artificial Sequence
  Description of Artificial Sequence: Synthetic oligonucleotide
gggcagaccaaggaggga

SEQ ID NO: 12739 - RNA, 18 nt, Artificial Sequence
  Description of Artificial Sequence: Synthetic oligonucleotide
cagcagggcagaccaagg

SEQ ID NO: 12740 - RNA, 18 nt, Artificial Sequence
  Description of Artificial Sequence: Synthetic oligonucleotide
agaugcagcagggcagac

SEQ ID NO: 12741 - RNA, 18 nt, Artificial Sequence
  Description of Artificial Sequence: Synthetic oligonucleotide
uugagagaugcagcaggg

SEQ ID NO: 12742 - RNA, 18 nt, Artificial Sequence
  Description of Artificial Sequence: Synthetic oligonucleotide
uuccauugagagaugcag

SEQ ID NO: 12743 - RNA, 18 nt, Artificial Sequence
  Description of Artificial Sequence: Synthetic oligonucleotide
cugccuuccauugagaga

SEQ ID NO: 12744 - RNA, 18 nt, Artificial Sequence
  Description of Artificial Sequence: Synthetic oligonucleotide
ugaggcugccuuccauug

SEQ ID NO: 12745 - RNA, 18 nt, Artificial Sequence
  Description of Artificial Sequence: Synthetic oligonucleotide
ccucaugaggcugccuuc

SEQ ID NO: 12746 - RNA, 18 nt, Artificial Sequence
  Description of Artificial Sequence: Synthetic oligonucleotide
uccuaccucaugaggcug

SEQ ID NO: 12747 - RNA, 18 nt, Artificial Sequence
  Description of Artificial Sequence: Synthetic oligonucleotide
gcacuuccuaccucauga

SEQ ID NO: 12748 - RNA, 18 nt, Artificial Sequence
  Description of Artificial Sequence: Synthetic oligonucleotide
aucaggcacuuccuaccu

SEQ ID NO: 12749 - RNA, 18 nt, Artificial Sequence
  Description of Artificial Sequence: Synthetic oligonucleotide
cugggaucaggcacuucc

SEQ ID NO: 12750 - RNA, 18 nt, Artificial Sequence
  Description of Artificial Sequence: Synthetic oligonucleotide
ggacccugggaucaggca

SEQ ID NO: 12751 - RNA, 18 nt, Artificial Sequence
  Description of Artificial Sequence: Synthetic oligonucleotide
cugccggacccugggauc

SEQ ID NO: 12752 - RNA, 18 nt, Artificial Sequence
  Description of Artificial Sequence: Synthetic oligonucleotide
ugagucugccggacccug

SEQ ID NO: 12753 - RNA, 18 nt, Artificial Sequence
  Description of Artificial Sequence: Synthetic oligonucleotide
gagccugagucugccgga

SEQ ID NO: 12754 - RNA, 18 nt, Artificial Sequence
  Description of Artificial Sequence: Synthetic oligonucleotide
aaucugagccugagucug

SEQ ID NO: 12755 - RNA, 18 nt, Artificial Sequence
  Description of Artificial Sequence: Synthetic oligonucleotide
gcaggaaucugagccuga

SEQ ID NO: 12756 - RNA, 18 nt, Artificial Sequence
  Description of Artificial Sequence: Synthetic oligonucleotide
gcagagcaggaaucugag

SEQ ID NO: 12757 - RNA, 18 nt, Artificial Sequence
  Description of Artificial Sequence: Synthetic oligonucleotide
aguuugcagagcaggaau

SEQ ID NO: 12758 - RNA, 18 nt, Artificial Sequence
  Description of Artificial Sequence: Synthetic oligonucleotide
cuugcaguuugcagagca

SEQ ID NO: 12759 - RNA, 18 nt, Artificial Sequence
  Description of Artificial Sequence: Synthetic oligonucleotide
ccccacuugcaguuugca

SEQ ID NO: 12760 - RNA, 18 nt, Artificial Sequence
  Description of Artificial Sequence: Synthetic oligonucleotide
aggucccccacuugcagu

SEQ ID NO: 12761 - RNA, 18 nt, Artificial Sequence
  Description of Artificial Sequence: Synthetic oligonucleotide
gcucaaggucccccacuu

SEQ ID NO: 12762 - RNA, 18 nt, Artificial Sequence
  Description of Artificial Sequence: Synthetic oligonucleotide
cacuugcucaaggucccc

SEQ ID NO: 12763 - RNA, 18 nt, Artificial Sequence
  Description of Artificial Sequence: Synthetic oligonucleotide
cgaaccacuugcucaagg

SEQ ID NO: 12764 - RNA, 18 nt, Artificial Sequence
  Description of Artificial Sequence: Synthetic oligonucleotide
gagcucgaaccacuugcu

SEQ ID NO: 12765 - RNA, 18 nt, Artificial Sequence
  Description of Artificial Sequence: Synthetic oligonucleotide
uuggagagcucgaaccac

SEQ ID NO: 12766 - RNA, 18 nt, Artificial Sequence
  Description of Artificial Sequence: Synthetic oligonucleotide
aaugguuggagagcucga

SEQ ID NO: 12767 - RNA, 18 nt, Artificial Sequence
  Description of Artificial Sequence: Synthetic oligonucleotide
aaggaaaugguuggagag

SEQ ID NO: 12768 - RNA, 18 nt, Artificial Sequence
  Description of Artificial Sequence: Synthetic oligonucleotide
ugaguaaggaaaugguug

SEQ ID NO: 12769 - RNA, 18 nt, Artificial Sequence
  Description of Artificial Sequence: Synthetic oligonucleotide
uuugcugaguaaggaaau

SEQ ID NO: 12770 - RNA, 18 nt, Artificial Sequence
  Description of Artificial Sequence: Synthetic oligonucleotide
ccuguuuugcugaguaag

SEQ ID NO: 12771 - RNA, 18 nt, Artificial Sequence
  Description of Artificial Sequence: Synthetic oligonucleotide
cugauccuguuuugcuga

SEQ ID NO: 12772 - RNA, 18 nt, Artificial Sequence
  Description of Artificial Sequence: Synthetic oligonucleotide
uaugacugauccuguuuu

SEQ ID NO: 12773 - RNA, 18 nt, Artificial Sequence
  Description of Artificial Sequence: Synthetic oligonucleotide
augaguaugacugauccu

SEQ ID NO: 12774 - RNA, 18 nt, Artificial Sequence
  Description of Artificial Sequence: Synthetic oligonucleotide
ugugaaugaguaugacug

SEQ ID NO: 12775 - RNA, 18 nt, Artificial Sequence
  Description of Artificial Sequence: Synthetic oligonucleotide
aaggcugugaaugaguau

SEQ ID NO: 12776 - RNA, 18 nt, Artificial Sequence
  Description of Artificial Sequence: Synthetic oligonucleotide
aguucaaggcugugaaug

SEQ ID NO: 12777 - RNA, 18 nt, Artificial Sequence
  Description of Artificial Sequence: Synthetic oligonucleotide
ggccuaguucaaggcugu

SEQ ID NO: 12778 - RNA, 18 nt, Artificial Sequence
  Description of Artificial Sequence: Synthetic oligonucleotide
ucuugggccuaguucaag

SEQ ID NO: 12779 - RNA, 18 nt, Artificial Sequence
  Description of Artificial Sequence: Synthetic oligonucleotide
ccucaucuugggccuagu

SEQ ID NO: 12780 - RNA, 18 nt, Artificial Sequence
  Description of Artificial Sequence: Synthetic oligonucleotide
acagaccucaucuugggc

SEQ ID NO: 12781 - RNA, 18 nt, Artificial Sequence
  Description of Artificial Sequence: Synthetic oligonucleotide
gacugacagaccucaucu

SEQ ID NO: 12782 - RNA, 18 nt, Artificial Sequence
  Description of Artificial Sequence: Synthetic oligonucleotide
caggagacugacagaccu

SEQ ID NO: 12783 - RNA, 18 nt, Artificial Sequence
  Description of Artificial Sequence: Synthetic oligonucleotide
aaugccaggagacugaca

SEQ ID NO: 12784 - RNA, 18 nt, Artificial Sequence
  Description of Artificial Sequence: Synthetic oligonucleotide
aggccaaugccaggagac

SEQ ID NO: 12785 - RNA, 18 nt, Artificial Sequence
  Description of Artificial Sequence: Synthetic oligonucleotide
gcaugaggccaaugccag

SEQ ID NO: 12786 - RNA, 18 nt, Artificial Sequence
  Description of Artificial Sequence: Synthetic oligonucleotide
ccugggcaugaggccaau

SEQ ID NO: 12787 - RNA, 18 nt, Artificial Sequence
  Description of Artificial Sequence: Synthetic oligonucleotide
uccugccugggcaugagg

SEQ ID NO: 12788 - RNA, 18 nt, Artificial Sequence
  Description of Artificial Sequence: Synthetic oligonucleotide
cccauuccugccugggca

SEQ ID NO: 12789 - RNA, 18 nt, Artificial Sequence
  Description of Artificial Sequence: Synthetic oligonucleotide
cacugcccauuccugccu

SEQ ID NO: 12790 - RNA, 18 nt, Artificial Sequence
  Description of Artificial Sequence: Synthetic oligonucleotide
ccauucacugcccauucc

SEQ ID NO: 12791 - RNA, 18 nt, Artificial Sequence
  Description of Artificial Sequence: Synthetic oligonucleotide
gacugccauucacugccc

SEQ ID NO: 12792 - RNA, 18 nt, Artificial Sequence
  Description of Artificial Sequence: Synthetic oligonucleotide
cgauugacugccauucac

SEQ ID NO: 12793 - RNA, 18 nt, Artificial Sequence
  Description of Artificial Sequence: Synthetic oligonucleotide
ggcagcgauugacugcca

SEQ ID NO: 12794 - RNA, 18 nt, Artificial Sequence
  Description of Artificial Sequence: Synthetic oligonucleotide
gacagggcagcgauugac

SEQ ID NO: 12795 - RNA, 18 nt, Artificial Sequence
  Description of Artificial Sequence: Synthetic oligonucleotide
caccugacagggcagcga

SEQ ID NO: 12796 - RNA, 18 nt, Artificial Sequence
  Description of Artificial Sequence: Synthetic oligonucleotide
aucuccaccugacagggc

SEQ ID NO: 12797 - RNA, 18 nt, Artificial Sequence
  Description of Artificial Sequence: Synthetic oligonucleotide
uguccaucuccaccugac

SEQ ID NO: 12798 - RNA, 18 nt, Artificial Sequence
  Description of Artificial Sequence: Synthetic oligonucleotide
cugucuguccaucuccac

SEQ ID NO: 12799 - RNA, 18 nt, Artificial Sequence
  Description of Artificial Sequence: Synthetic oligonucleotide
cacagcugucuguccauc

SEQ ID NO: 12800 - RNA, 18 nt, Artificial Sequence
  Description of Artificial Sequence: Synthetic oligonucleotide
cugcucacagcugucugu

SEQ ID NO: 12801 - RNA, 18 nt, Artificial Sequence
  Description of Artificial Sequence: Synthetic oligonucleotide
agcaccugcucacagcug

SEQ ID NO: 12802 - RNA, 18 nt, Artificial Sequence
  Description of Artificial Sequence: Synthetic oligonucleotide
caggcagcaccugcucac

SEQ ID NO: 12803 - RNA, 18 nt, Artificial Sequence
  Description of Artificial Sequence: Synthetic oligonucleotide
aguuucaggcagcaccug

SEQ ID NO: 12804 - RNA, 18 nt, Artificial Sequence
  Description of Artificial Sequence: Synthetic oligonucleotide
gcaguaguuucaggcagc

SEQ ID NO: 12805 - RNA, 18 nt, Artificial Sequence
  Description of Artificial Sequence: Synthetic oligonucleotide
gucaggcaguaguuucag

SEQ ID NO: 12806 - RNA, 18 nt, Artificial Sequence
  Description of Artificial Sequence: Synthetic oligonucleotide
cagcggucaggcaguagu

SEQ ID NO: 12807 - RNA, 18 nt, Artificial Sequence
  Description of Artificial Sequence: Synthetic oligonucleotide
gaguccagcggucaggca

SEQ ID NO: 12808 - RNA, 18 nt, Artificial Sequence
  Description of Artificial Sequence: Synthetic oligonucleotide
acacgggaagcuugaggg

SEQ ID NO: 12809 - RNA, 18 nt, Artificial Sequence
  Description of Artificial Sequence: Synthetic oligonucleotide
accugacacgggaagcuu

SEQ ID NO: 12810 - RNA, 18 nt, Artificial Sequence
  Description of Artificial Sequence: Synthetic oligonucleotide
uggugaccugacacggga

SEQ ID NO: 12811 - RNA, 18 nt, Artificial Sequence
  Description of Artificial Sequence: Synthetic oligonucleotide
agagcuggugaccugaca

SEQ ID NO: 12812 - RNA, 18 nt, Artificial Sequence
  Description of Artificial Sequence: Synthetic oligonucleotide
uguggagagcuggugacc

SEQ ID NO: 12813 - RNA, 18 nt, Artificial Sequence
  Description of Artificial Sequence: Synthetic oligonucleotide
aguuauguggagagcugg

SEQ ID NO: 12814 - RNA, 18 nt, Artificial Sequence
  Description of Artificial Sequence: Synthetic oligonucleotide
aaaacaguuauguggaga

SEQ ID NO: 12815 - RNA, 18 nt, Artificial Sequence
  Description of Artificial Sequence: Synthetic oligonucleotide
agggaaaaacaguuaugu

SEQ ID NO: 12816 - RNA, 18 nt, Artificial Sequence
  Description of Artificial Sequence: Synthetic oligonucleotide
acagaagggaaaaacagu

SEQ ID NO: 12817 - RNA, 18 nt, Artificial Sequence
  Description of Artificial Sequence: Synthetic oligonucleotide
acacaacagaagggaaaa

SEQ ID NO: 12818 - RNA, 18 nt, Artificial Sequence
  Description of Artificial Sequence: Synthetic oligonucleotide
gggcuacacaacagaagg

SEQ ID NO: 12819 - RNA, 18 nt, Artificial Sequence
  Description of Artificial Sequence: Synthetic oligonucleotide
gagagcuuuaucaccggg

SEQ ID NO: 12820 - RNA, 18 nt, Artificial Sequence
  Description of Artificial Sequence: Synthetic oligonucleotide
agagagcuuuaucaccgg

SEQ ID NO: 12821 - RNA, 18 nt, Artificial Sequence
  Description of Artificial Sequence: Synthetic oligonucleotide
ggagcagagagcuuuauc

SEQ ID NO: 12822 - RNA, 18 nt, Artificial Sequence
  Description of Artificial Sequence: Synthetic oligonucleotide
agcagggagcagagagcu

SEQ ID NO: 12823 - RNA, 18 nt, Artificial Sequence
  Description of Artificial Sequence: Synthetic oligonucleotide
augcaagcagggagcaga

SEQ ID NO: 12824 - RNA, 18 nt, Artificial Sequence
  Description of Artificial Sequence: Synthetic oligonucleotide
uacauaugcaagcaggga

SEQ ID NO: 12825 - RNA, 18 nt, Artificial Sequence
  Description of Artificial Sequence: Synthetic oligonucleotide
ugcaauacauaugcaagc

SEQ ID NO: 12826 - RNA, 18 nt, Artificial Sequence
  Description of Artificial Sequence: Synthetic oligonucleotide
auucaugcaauacauaug

SEQ ID NO: 12827 - RNA, 18 nt, Artificial Sequence
  Description of Artificial Sequence: Synthetic oligonucleotide
acuacauucaugcaauac

SEQ ID NO: 12828 - RNA, 18 nt, Artificial Sequence
  Description of Artificial Sequence: Synthetic oligonucleotide
uacucacuacauucaugc

SEQ ID NO: 12829 - RNA, 18 nt, Artificial Sequence
  Description of Artificial Sequence: Synthetic oligonucleotide
agaauuacucacuacauu

SEQ ID NO: 12830 - RNA, 18 nt, Artificial Sequence
  Description of Artificial Sequence: Synthetic oligonucleotide
ggcucagaauuacucacu

SEQ ID NO: 12831 - RNA, 18 nt, Artificial Sequence
  Description of Artificial Sequence: Synthetic oligonucleotide
guuugggcucagaauuac

SEQ ID NO: 12832 - RNA, 18 nt, Artificial Sequence
  Description of Artificial Sequence: Synthetic oligonucleotide
gcuguguuugggcucaga

SEQ ID NO: 12833 - RNA, 18 nt, Artificial Sequence
  Description of Artificial Sequence: Synthetic oligonucleotide
gaaaagcuguguuugggc

SEQ ID NO: 12834 - RNA, 18 nt, Artificial Sequence
  Description of Artificial Sequence: Synthetic oligonucleotide
guccagaaaagcuguguu

SEQ ID NO: 12835 - RNA, 18 nt, Artificial Sequence
  Description of Artificial Sequence: Synthetic oligonucleotide
cuucuguccagaaaagcu

SEQ ID NO: 12836 - RNA, 18 nt, Artificial Sequence
  Description of Artificial Sequence: Synthetic oligonucleotide
gacagcuucuguccagaa

SEQ ID NO: 12837 - RNA, 18 nt, Artificial Sequence
  Description of Artificial Sequence: Synthetic oligonucleotide
gcugugacagcuucuguc

SEQ ID NO: 12838 - RNA, 18 nt, Artificial Sequence
  Description of Artificial Sequence: Synthetic oligonucleotide
gccuggcugugacagcuu

SEQ ID NO: 12839 - RNA, 18 nt, Artificial Sequence
  Description of Artificial Sequence: Synthetic oligonucleotide
ccaaagccuggcugugac

SEQ ID NO: 12840 - RNA, 18 nt, Artificial Sequence
  Description of Artificial Sequence: Synthetic oligonucleotide
uacacccaaagccuggcu

SEQ ID NO: 12841 - RNA, 18 nt, Artificial Sequence
  Description of Artificial Sequence: Synthetic oligonucleotide
agauuuacacccaaagcc

SEQ ID NO: 12842 - RNA, 18 nt, Artificial Sequence
  Description of Artificial Sequence: Synthetic oligonucleotide
aggucuaaagaugaaggg

SEQ ID NO: 12843 - RNA, 18 nt, Artificial Sequence
  Description of Artificial Sequence: Synthetic oligonucleotide
aagucaggucuaaagaug

SEQ ID NO: 12844 - RNA, 18 nt, Artificial Sequence
  Description of Artificial Sequence: Synthetic oligonucleotide
accucaagucaggucuaa

SEQ ID NO: 12845 - RNA, 18 nt, Artificial Sequence
  Description of Artificial Sequence: Synthetic oligonucleotide
auggaaccucaagucagg

SEQ ID NO: 12846 - RNA, 18 nt, Artificial Sequence
  Description of Artificial Sequence: Synthetic oligonucleotide
gauauauggaaccucaag

SEQ ID NO: 12847 - RNA, 18 nt, Artificial Sequence
  Description of Artificial Sequence: Synthetic oligonucleotide
cucccgauauauggaacc

SEQ ID NO: 12848 - RNA, 18 nt, Artificial Sequence
  Description of Artificial Sequence: Synthetic oligonucleotide
cccaccucccgauauaug

SEQ ID NO: 12849 - RNA, 18 nt, Artificial Sequence
  Description of Artificial Sequence: Synthetic oligonucleotide
agguucccaccucccgau

SEQ ID NO: 12850 - RNA, 18 nt, Artificial Sequence
  Description of Artificial Sequence: Synthetic oligonucleotide
cccccagguucccaccuc

SEQ ID NO: 12851 - RNA, 18 nt, Artificial Sequence
  Description of Artificial Sequence: Synthetic oligonucleotide
gcauacccccagguuccc

SEQ ID NO: 12852 - RNA, 18 nt, Artificial Sequence
  Description of Artificial Sequence: Synthetic oligonucleotide
caacugcauacccccagg

SEQ ID NO: 12853 - RNA, 18 nt, Artificial Sequence
  Description of Artificial Sequence: Synthetic oligonucleotide
augggcaacugcauaccc

SEQ ID NO: 12854 - RNA, 18 nt, Artificial Sequence
  Description of Artificial Sequence: Synthetic oligonucleotide
ucuucaugggcaacugca

SEQ ID NO: 12855 - RNA, 18 nt, Artificial Sequence
  Description of Artificial Sequence: Synthetic oligonucleotide
augaaucuucaugggcaa

SEQ ID NO: 12856 - RNA, 18 nt, Artificial Sequence
  Description of Artificial Sequence: Synthetic oligonucleotide
ccuccaugaaucuucaug

SEQ ID NO: 12857 - RNA, 18 nt, Artificial Sequence
  Description of Artificial Sequence: Synthetic oligonucleotide
aggccccuccaugaaucu

SEQ ID NO: 12858 - RNA, 18 nt, Artificial Sequence
  Description of Artificial Sequence: Synthetic oligonucleotide
gcgcgaggccccuccaug

SEQ ID NO: 12859 - RNA, 18 nt, Artificial Sequence
  Description of Artificial Sequence: Synthetic oligonucleotide
ugucugcgcgaggccccu

SEQ ID NO: 12860 - RNA, 18 nt, Artificial Sequence
  Description of Artificial Sequence: Synthetic oligonucleotide
ucagcugucugcgcgagg

SEQ ID NO: 12861 - RNA, 18 nt, Artificial Sequence
  Description of Artificial Sequence: Synthetic oligonucleotide
ggacgucagcugucugcg

SEQ ID NO: 12862 - RNA, 18 nt, Artificial Sequence
  Description of Artificial Sequence: Synthetic oligonucleotide
acagcggacgucagcugu

SEQ ID NO: 12863 - RNA, 18 nt, Artificial Sequence
  Description of Artificial Sequence: Synthetic oligonucleotide
gccacacagcggacguca

SEQ ID NO: 12864 - RNA, 18 nt, Artificial Sequence
  Description of Artificial Sequence: Synthetic oligonucleotide
gggaggccacacagcgga

SEQ ID NO: 12865 - RNA, 18 nt, Artificial Sequence
  Description of Artificial Sequence: Synthetic oligonucleotide
ggcaugcacaaagcaggg

SEQ ID NO: 12866 - RNA, 18 nt, Artificial Sequence
  Description of Artificial Sequence: Synthetic oligonucleotide
ggcuggcaugcacaaagc

SEQ ID NO: 12867 - RNA, 18 nt, Artificial Sequence
  Description of Artificial Sequence: Synthetic oligonucleotide
aaggaggcuggcaugcac

SEQ ID NO: 12868 - RNA, 18 nt, Artificial Sequence
  Description of Artificial Sequence: Synthetic oligonucleotide
guagcaaggaggcuggca

SEQ ID NO: 12869 - RNA, 18 nt, Artificial Sequence
  Description of Artificial Sequence: Synthetic oligonucleotide
acaugguagcaaggaggc

SEQ ID NO: 12870 - RNA, 18 nt, Artificial Sequence
  Description of Artificial Sequence: Synthetic oligonucleotide
aacacacaugguagcaag

SEQ ID NO: 12871 - RNA, 18 nt, Artificial Sequence
  Description of Artificial Sequence: Synthetic oligonucleotide
gcaugaacacacauggua

SEQ ID NO: 12872 - RNA, 18 nt, Artificial Sequence
  Description of Artificial Sequence: Synthetic oligonucleotide
agcgcgcaugaacacaca

SEQ ID NO: 12873 - RNA, 18 nt, Artificial Sequence
  Description of Artificial Sequence: Synthetic oligonucleotide
acacaagcgcgcaugaac

SEQ ID NO: 12874 - RNA, 18 nt, Artificial Sequence
  Description of Artificial Sequence: Synthetic oligonucleotide
cacacacacaagcgcgca

SEQ ID NO: 12875 - RNA, 18 nt, Artificial Sequence
  Description of Artificial Sequence: Synthetic oligonucleotide
auacacacacacacaagc

SEQ ID NO: 12876 - RNA, 18 nt, Artificial Sequence
  Description of Artificial Sequence: Synthetic oligonucleotide
caugcauacacacacaca

SEQ ID NO: 12877 - RNA, 18 nt, Artificial Sequence
  Description of Artificial Sequence: Synthetic oligonucleotide
gugcgcaugcauacacac

SEQ ID NO: 12878 - RNA, 18 nt, Artificial Sequence
  Description of Artificial Sequence: Synthetic oligonucleotide
caugugugcgcaugcaua

SEQ ID NO: 12879 - RNA, 18 nt, Artificial Sequence
  Description of Artificial Sequence: Synthetic oligonucleotide
acacacaugugugcgcau

SEQ ID NO: 12880 - RNA, 18 nt, Artificial Sequence
  Description of Artificial Sequence: Synthetic oligonucleotide
gacacacacacaugugug

SEQ ID NO: 12881 - RNA, 18 nt, Artificial Sequence
  Description of Artificial Sequence: Synthetic oligonucleotide
agcaagacacacacacau

SEQ ID NO: 12882 - RNA, 18 nt, Artificial Sequence
  Description of Artificial Sequence: Synthetic oligonucleotide
gagaaagcaagacacaca

SEQ ID NO: 12883 - RNA, 18 nt, Artificial Sequence
  Description of Artificial Sequence: Synthetic oligonucleotide
gguaugagaaagcaagac

SEQ ID NO: 12884 - RNA, 18 nt, Artificial Sequence
  Description of Artificial Sequence: Synthetic oligonucleotide
aaugagguaugagaaagc

SEQ ID NO: 12885 - RNA, 18 nt, Artificial Sequence
  Description of Artificial Sequence: Synthetic oligonucleotide
cagccaaugagguaugag

SEQ ID NO: 12886 - RNA, 18 nt, Artificial Sequence
  Description of Artificial Sequence: Synthetic oligonucleotide
uuaugcagccaaugaggu

SEQ ID NO: 12887 - RNA, 18 nt, Artificial Sequence
  Description of Artificial Sequence: Synthetic oligonucleotide
acauuuuaugcagccaau

SEQ ID NO: 12888 - RNA, 18 nt, Artificial Sequence
  Description of Artificial Sequence: Synthetic oligonucleotide
ggccuacauuuuaugcag

SEQ ID NO: 12889 - RNA, 18 nt, Artificial Sequence
  Description of Artificial Sequence: Synthetic oligonucleotide
acuuaggccuacauuuua

SEQ ID NO: 12890 - RNA, 18 nt, Artificial Sequence
  Description of Artificial Sequence: Synthetic oligonucleotide
ugccaacuuaggccuaca

SEQ ID NO: 12891 - RNA, 18 nt, Artificial Sequence
  Description of Artificial Sequence: Synthetic oligonucleotide
gaacaugccaacuuaggc

SEQ ID NO: 12892 - RNA, 18 nt, Artificial Sequence
  Description of Artificial Sequence: Synthetic oligonucleotide
cacaggaacaugccaacu

SEQ ID NO: 12893 - RNA, 18 nt, Artificial Sequence
  Description of Artificial Sequence: Synthetic oligonucleotide
uacgucacaggaacaugc

SEQ ID NO: 12894 - RNA, 18 nt, Artificial Sequence
  Description of Artificial Sequence: Synthetic oligonucleotide
aaagguacgucacaggaa

SEQ ID NO: 12895 - RNA, 18 nt, Artificial Sequence
  Description of Artificial Sequence: Synthetic oligonucleotide
ugaacaaagguacgucac

SEQ ID NO: 12896 - RNA, 18 nt, Artificial Sequence
  Description of Artificial Sequence: Synthetic oligonucleotide
cugcuugaacaaagguac

SEQ ID NO: 12897 - RNA, 18 nt, Artificial Sequence
  Description of Artificial Sequence: Synthetic oligonucleotide
gcugacugcuugaacaaa

SEQ ID NO: 12898 - RNA, 18 nt, Artificial Sequence
  Description of Artificial Sequence: Synthetic oligonucleotide
ggccagcugacugcuuga

SEQ ID NO: 12899 - RNA, 18 nt, Artificial Sequence
  Description of Artificial Sequence: Synthetic oligonucleotide
guaagaaugugaguagaa

SEQ ID NO: 12900 - RNA, 18 nt, Artificial Sequence
  Description of Artificial Sequence: Synthetic oligonucleotide
ugggaguaagaaugugag

SEQ ID NO: 12901 - RNA, 18 nt, Artificial Sequence
  Description of Artificial Sequence: Synthetic oligonucleotide
uuuggugggaguaagaau

SEQ ID NO: 12902 - RNA, 18 nt, Artificial Sequence
  Description of Artificial Sequence: Synthetic oligonucleotide
agaaauuuggugggagua

SEQ ID NO: 12903 - RNA, 18 nt, Artificial Sequence
  Description of Artificial Sequence: Synthetic oligonucleotide
ccaugagaaauuuggugg

SEQ ID NO: 12904 - RNA, 18 nt, Artificial Sequence
  Description of Artificial Sequence: Synthetic oligonucleotide
cagguccaugagaaauuu

SEQ ID NO: 12905 - RNA, 18 nt, Artificial Sequence
  Description of Artificial Sequence: Synthetic oligonucleotide
ugucucagguccaugaga

SEQ ID NO: 12906 - RNA, 18 nt, Artificial Sequence
  Description of Artificial Sequence: Synthetic oligonucleotide
gggugucucagguccaug

SEQ ID NO: 12907 - RNA, 18 nt, Artificial Sequence
  Description of Artificial Sequence: Synthetic oligonucleotide
ggacucccugaagucggg

SEQ ID NO: 12908 - RNA, 18 nt, Artificial Sequence
  Description of Artificial Sequence: Synthetic oligonucleotide
cuagaggacucccugaag

SEQ ID NO: 12909 - RNA, 18 nt, Artificial Sequence
  Description of Artificial Sequence: Synthetic oligonucleotide
auacccuagaggacuccc

SEQ ID NO: 12910 - RNA, 18 nt, Artificial Sequence
  Description of Artificial Sequence: Synthetic oligonucleotide
aaaagauacccuagagga

SEQ ID NO: 12911 - RNA, 18 nt, Artificial Sequence
  Description of Artificial Sequence: Synthetic oligonucleotide
uccucaaaagauacccua

SEQ ID NO: 12912 - RNA, 18 nt, Artificial Sequence
  Description of Artificial Sequence: Synthetic oligonucleotide
ccugauccucaaaagaua

SEQ ID NO: 12913 - RNA, 18 nt, Artificial Sequence
  Description of Artificial Sequence: Synthetic oligonucleotide
uggagccugauccucaaa

SEQ ID NO: 12914 - RNA, 18 nt, Artificial Sequence
  Description of Artificial Sequence: Synthetic oligonucleotide
auuguuggagccugaucc

SEQ ID NO: 12915 - RNA, 18 nt, Artificial Sequence
  Description of Artificial Sequence: Synthetic oligonucleotide
acuccauuguuggagccu

SEQ ID NO: 12916 - RNA, 18 nt, Artificial Sequence
  Description of Artificial Sequence: Synthetic oligonucleotide
cucucacuccauuguugg

SEQ ID NO: 12917 - RNA, 18 nt, Artificial Sequence
  Description of Artificial Sequence: Synthetic oligonucleotide
uuuggcucucacuccauu

SEQ ID NO: 12918 - RNA, 18 nt, Artificial Sequence
  Description of Artificial Sequence: Synthetic oligonucleotide
guuucuuuggcucucacu

SEQ ID NO: 12919 - RNA, 18 nt, Artificial Sequence
  Description of Artificial Sequence: Synthetic oligonucleotide
uaagaaugugaguagaac

SEQ ID NO: 12920 - RNA, 18 nt, Artificial Sequence
  Description of Artificial Sequence: Synthetic oligonucleotide
gggaguaagaaugugagu

SEQ ID NO: 12921 - RNA, 18 nt, Artificial Sequence
  Description of Artificial Sequence: Synthetic oligonucleotide
uuggugggaguaagaaug

SEQ ID NO: 12922 - RNA, 18 nt, Artificial Sequence
  Description of Artificial Sequence: Synthetic oligonucleotide
gaaauuuggugggaguaa

SEQ ID NO: 12923 - RNA, 18 nt, Artificial Sequence
  Description of Artificial Sequence: Synthetic oligonucleotide
caugagaaauuugguggg

SEQ ID NO: 12924 - RNA, 18 nt, Artificial Sequence
  Description of Artificial Sequence: Synthetic oligonucleotide
agguccaugagaaauuug

SEQ ID NO: 12925 - RNA, 18 nt, Artificial Sequence
  Description of Artificial Sequence: Synthetic oligonucleotide
gucucagguccaugagaa

SEQ ID NO: 12926 - RNA, 18 nt, Artificial Sequence
  Description of Artificial Sequence: Synthetic oligonucleotide
ggacucccugaagucggg

SEQ ID NO: 12927 - RNA, 18 nt, Artificial Sequence
  Description of Artificial Sequence: Synthetic oligonucleotide
cuagaggacucccugaag

SEQ ID NO: 12928 - RNA, 18 nt, Artificial Sequence
  Description of Artificial Sequence: Synthetic oligonucleotide
auacccuagaggacuccc

SEQ ID NO: 12929 - RNA, 18 nt, Artificial Sequence
  Description of Artificial Sequence: Synthetic oligonucleotide
aaaagauacccuagagga

SEQ ID NO: 12930 - RNA, 18 nt, Artificial Sequence
  Description of Artificial Sequence: Synthetic oligonucleotide
uccucaaaagauacccua

SEQ ID NO: 12931 - RNA, 18 nt, Artificial Sequence
  Description of Artificial Sequence: Synthetic oligonucleotide
ccugauccucaaaagaua

SEQ ID NO: 12932 - RNA, 18 nt, Artificial Sequence
  Description of Artificial Sequence: Synthetic oligonucleotide
uggagccugauccucaaa

SEQ ID NO: 12933 - RNA, 18 nt, Artificial Sequence
  Description of Artificial Sequence: Synthetic oligonucleotide
auuguuggagccugaucc

SEQ ID NO: 12934 - RNA, 18 nt, Artificial Sequence
  Description of Artificial Sequence: Synthetic oligonucleotide
acuccauuguuggagccu

SEQ ID NO: 12935 - RNA, 18 nt, Artificial Sequence
  Description of Artificial Sequence: Synthetic oligonucleotide
cucucacuccauuguugg

SEQ ID NO: 12936 - RNA, 18 nt, Artificial Sequence
  Description of Artificial Sequence: Synthetic oligonucleotide
uuuggcucucacuccauu

SEQ ID NO: 12937 - RNA, 18 nt, Artificial Sequence
  Description of Artificial Sequence: Synthetic oligonucleotide
guuucuuuggcucucacu

SEQ ID NO: 12938 - RNA, 18 nt, Artificial Sequence
  Description of Artificial Sequence: Synthetic oligonucleotide
uuucuguaauaagcugcu

SEQ ID NO: 12939 - RNA, 18 nt, Artificial Sequence
  Description of Artificial Sequence: Synthetic oligonucleotide
uuucuuuucuguaauaag

SEQ ID NO: 12940 - RNA, 18 nt, Artificial Sequence
  Description of Artificial Sequence: Synthetic oligonucleotide
aagaguuucuuuucugua

SEQ ID NO: 12941 - RNA, 18 nt, Artificial Sequence
  Description of Artificial Sequence: Synthetic oligonucleotide
aguggaagaguuucuuuu

SEQ ID NO: 12942 - RNA, 18 nt, Artificial Sequence
  Description of Artificial Sequence: Synthetic oligonucleotide
uucagaguggaagaguuu

SEQ ID NO: 12943 - RNA, 18 nt, Artificial Sequence
  Description of Artificial Sequence: Synthetic oligonucleotide
agcccuucagaguggaag

SEQ ID NO: 12944 - RNA, 18 nt, Artificial Sequence
  Description of Artificial Sequence: Synthetic oligonucleotide
aagaaagcccuucagagu

SEQ ID NO: 12945 - RNA, 18 nt, Artificial Sequence
  Description of Artificial Sequence: Synthetic oligonucleotide
aaucaaagaaagcccuuc

SEQ ID NO: 12946 - RNA, 18 nt, Artificial Sequence
  Description of Artificial Sequence: Synthetic oligonucleotide
ggaauaaucaaagaaagc

SEQ ID NO: 12947 - RNA, 18 nt, Artificial Sequence
  Description of Artificial Sequence: Synthetic oligonucleotide
gugacggaauaaucaaag

SEQ ID NO: 12948 - RNA, 18 nt, Artificial Sequence
  Description of Artificial Sequence: Synthetic oligonucleotide
aaagagugacggaauaau

SEQ ID NO: 12949 - RNA, 18 nt, Artificial Sequence
  Description of Artificial Sequence: Synthetic oligonucleotide
aagaaaaagagugacgga

SEQ ID NO: 12950 - RNA, 18 nt, Artificial Sequence
  Description of Artificial Sequence: Synthetic oligonucleotide
aaauaaagaaaaagagug

SEQ ID NO: 12951 - RNA, 18 nt, Artificial Sequence
  Description of Artificial Sequence: Synthetic oligonucleotide
ggaagaaauaaagaaaaa

SEQ ID NO: 12952 - RNA, 18 nt, Artificial Sequence
  Description of Artificial Sequence: Synthetic oligonucleotide
aaaaaggaagaaauaaag

SEQ ID NO: 12953 - RNA, 18 nt, Artificial Sequence
  Description of Artificial Sequence: Synthetic oligonucleotide
aaacuaaaaaggaagaaa

SEQ ID NO: 12954 - RNA, 18 nt, Artificial Sequence
  Description of Artificial Sequence: Synthetic oligonucleotide
auaauaaacuaaaaagga

SEQ ID NO: 12955 - RNA, 18 nt, Artificial Sequence
  Description of Artificial Sequence: Synthetic oligonucleotide
aauaaauaauaaacuaaa

SEQ ID NO: 12956 - RNA, 18 nt, Artificial Sequence
  Description of Artificial Sequence: Synthetic oligonucleotide
aaucaaauaaauaauaaa

SEQ ID NO: 12957 - RNA, 18 nt, Artificial Sequence
  Description of Artificial Sequence: Synthetic oligonucleotide
aacaaaaucaaauaaaua

SEQ ID NO: 12958 - RNA, 18 nt, Artificial Sequence
  Description of Artificial Sequence: Synthetic oligonucleotide
guugaaacaaaaucaaau

SEQ ID NO: 12959 - RNA, 18 nt, Artificial Sequence
  Description of Artificial Sequence: Synthetic oligonucleotide
uucuuguugaaacaaaau

SEQ ID NO: 12960 - RNA, 18 nt, Artificial Sequence
  Description of Artificial Sequence: Synthetic oligonucleotide
gcauuuucuuguugaaac

SEQ ID NO: 12961 - RNA, 18 nt, Artificial Sequence
  Description of Artificial Sequence: Synthetic oligonucleotide
ugcaagcauuuucuuguu

SEQ ID NO: 12962 - RNA, 18 nt, Artificial Sequence
  Description of Artificial Sequence: Synthetic oligonucleotide
agaacugcaagcauuuuc

SEQ ID NO: 12963 - RNA, 18 nt, Artificial Sequence
  Description of Artificial Sequence: Synthetic oligonucleotide
uguugagaacugcaagca

SEQ ID NO: 12964 - RNA, 18 nt, Artificial Sequence
  Description of Artificial Sequence: Synthetic oligonucleotide
aucgguguugagaacugc

SEQ ID NO: 12965 - RNA, 18 nt, Artificial Sequence
  Description of Artificial Sequence: Synthetic oligonucleotide
uuucaaucgguguugaga

SEQ ID NO: 12966 - RNA, 18 nt, Artificial Sequence
  Description of Artificial Sequence: Synthetic oligonucleotide
cacauuuucaaucggugu

SEQ ID NO: 12967 - RNA, 18 nt, Artificial Sequence
  Description of Artificial Sequence: Synthetic oligonucleotide
cuggacacauuuucaauc

SEQ ID NO: 12968 - RNA, 18 nt, Artificial Sequence
  Description of Artificial Sequence: Synthetic oligonucleotide
cagcacuggacacauuuu

SEQ ID NO: 12969 - RNA, 18 nt, Artificial Sequence
  Description of Artificial Sequence: Synthetic oligonucleotide
gagggcagcacuggacac

SEQ ID NO: 12970 - RNA, 18 nt, Artificial Sequence
  Description of Artificial Sequence: Synthetic oligonucleotide
gcugugagggcagcacug

SEQ ID NO: 12971 - RNA, 18 nt, Artificial Sequence
  Description of Artificial Sequence: Synthetic oligonucleotide
gcagggcugugagggcag

SEQ ID NO: 12972 - RNA, 18 nt, Artificial Sequence
  Description of Artificial Sequence: Synthetic oligonucleotide
ucauggcagggcugugag

SEQ ID NO: 12973 - RNA, 18 nt, Artificial Sequence
  Description of Artificial Sequence: Synthetic oligonucleotide
aggguucauggcagggcu

SEQ ID NO: 12974 - RNA, 18 nt, Artificial Sequence
  Description of Artificial Sequence: Synthetic oligonucleotide
cccagaggguucauggca

SEQ ID NO: 12975 - RNA, 18 nt, Artificial Sequence
  Description of Artificial Sequence: Synthetic oligonucleotide
cagagcccagaggguuca

SEQ ID NO: 12976 - RNA, 18 nt, Artificial Sequence
  Description of Artificial Sequence: Synthetic oligonucleotide
caggucagagcccagagg

SEQ ID NO: 12977 - RNA, 18 nt, Artificial Sequence
  Description of Artificial Sequence: Synthetic oligonucleotide
gccagcaggucagagccc

SEQ ID NO: 12978 - RNA, 18 nt, Artificial Sequence
  Description of Artificial Sequence: Synthetic oligonucleotide
ggugagccagcaggucag

SEQ ID NO: 12979 - RNA, 18 nt, Artificial Sequence
  Description of Artificial Sequence: Synthetic oligonucleotide
gcaugggugagccagcag

SEQ ID NO: 12980 - RNA, 18 nt, Artificial Sequence
  Description of Artificial Sequence: Synthetic oligonucleotide
ccaaggcaugggugagcc

SEQ ID NO: 12981 - RNA, 18 nt, Artificial Sequence
  Description of Artificial Sequence: Synthetic oligonucleotide
ggaacccaaggcaugggu

SEQ ID NO: 12982 - RNA, 18 nt, Artificial Sequence
  Description of Artificial Sequence: Synthetic oligonucleotide
agugcggaacccaaggca

SEQ ID NO: 12983 - RNA, 18 nt, Artificial Sequence
  Description of Artificial Sequence: Synthetic oligonucleotide
uaagcagugcggaaccca

SEQ ID NO: 12984 - RNA, 18 nt, Artificial Sequence
  Description of Artificial Sequence: Synthetic oligonucleotide
cugacuaagcagugcgga

SEQ ID NO: 12985 - RNA, 18 nt, Artificial Sequence
  Description of Artificial Sequence: Synthetic oligonucleotide
ggcgucugacuaagcagu

SEQ ID NO: 12986 - RNA, 18 nt, Artificial Sequence
  Description of Artificial Sequence: Synthetic oligonucleotide
cugcaggcgucugacuaa

SEQ ID NO: 12987 - RNA, 18 nt, Artificial Sequence
  Description of Artificial Sequence: Synthetic oligonucleotide
gcagccugcaggcgucug

SEQ ID NO: 12988 - RNA, 18 nt, Artificial Sequence
  Description of Artificial Sequence: Synthetic oligonucleotide
acccagcagccugcaggc

SEQ ID NO: 12989 - RNA, 18 nt, Artificial Sequence
  Description of Artificial Sequence: Synthetic oligonucleotide
uuuccacccagcagccug

SEQ ID NO: 12990 - RNA, 18 nt, Artificial Sequence
  Description of Artificial Sequence: Synthetic oligonucleotide
uuuaguuuccacccagca

SEQ ID NO: 12991 - RNA, 18 nt, Artificial Sequence
  Description of Artificial Sequence: Synthetic oligonucleotide
ucauuuuuaguuuccacc

SEQ ID NO: 12992 - RNA, 18 nt, Artificial Sequence
  Description of Artificial Sequence: Synthetic oligonucleotide
cauuaucauuuuuaguuu

SEQ ID NO: 12993 - RNA, 18 nt, Artificial Sequence
  Description of Artificial Sequence: Synthetic oligonucleotide
gcagucauuaucauuuuu

SEQ ID NO: 12994 - RNA, 18 nt, Artificial Sequence
  Description of Artificial Sequence: Synthetic oligonucleotide
ucacagcagucauuauca

SEQ ID NO: 12995 - RNA, 18 nt, Artificial Sequence
  Description of Artificial Sequence: Synthetic oligonucleotide
acuguucacagcagucau

SEQ ID NO: 12996 - RNA, 18 nt, Artificial Sequence
  Description of Artificial Sequence: Synthetic oligonucleotide
ugacaacuguucacagca

SEQ ID NO: 12997 - RNA, 18 nt, Artificial Sequence
  Description of Artificial Sequence: Synthetic oligonucleotide
cucucugacaacuguuca

SEQ ID NO: 12998 - RNA, 18 nt, Artificial Sequence
  Description of Artificial Sequence: Synthetic oligonucleotide
gcucccucucugacaacu

SEQ ID NO: 12999 - RNA, 18 nt, Artificial Sequence
  Description of Artificial Sequence: Synthetic oligonucleotide
cuucagcucccucucuga

SEQ ID NO: 13000 - RNA, 18 nt, Artificial Sequence
  Description of Artificial Sequence: Synthetic oligonucleotide
caaaacuucagcucccuc

SEQ ID NO: 13001 - RNA, 18 nt, Artificial Sequence
  Description of Artificial Sequence: Synthetic oligonucleotide
ucccccaaaacuucagcu

SEQ ID NO: 13002 - RNA, 18 nt, Artificial Sequence
  Description of Artificial Sequence: Synthetic oligonucleotide
aggcaucccccaaaacuu

SEQ ID NO: 13003 - RNA, 18 nt, Artificial Sequence
  Description of Artificial Sequence: Synthetic oligonucleotide
gccucaggcaucccccaa

SEQ ID NO: 13004 - RNA, 18 nt, Artificial Sequence
  Description of Artificial Sequence: Synthetic oligonucleotide
acugugccucaggcaucc

SEQ ID NO: 13005 - RNA, 18 nt, Artificial Sequence
  Description of Artificial Sequence: Synthetic oligonucleotide
ugggcacugugccucagg

SEQ ID NO: 13006 - RNA, 18 nt, Artificial Sequence
  Description of Artificial Sequence: Synthetic oligonucleotide
aggguugggcacugugcc

SEQ ID NO: 13007 - RNA, 18 nt, Artificial Sequence
  Description of Artificial Sequence: Synthetic oligonucleotide
ccagcaggguugggcacu

SEQ ID NO: 13008 - RNA, 18 nt, Artificial Sequence
  Description of Artificial Sequence: Synthetic oligonucleotide
ccagaccagcaggguugg

SEQ ID NO: 13009 - RNA, 18 nt, Artificial Sequence
  Description of Artificial Sequence: Synthetic oligonucleotide
ucaucccagaccagcagg

SEQ ID NO: 13010 - RNA, 18 nt, Artificial Sequence
  Description of Artificial Sequence: Synthetic oligonucleotide
caaauucaucccagacca

SEQ ID NO: 13011 - RNA, 18 nt, Artificial Sequence
  Description of Artificial Sequence: Synthetic oligonucleotide
ggccacaaauucauccca

SEQ ID NO: 13012 - RNA, 18 nt, Artificial Sequence
  Description of Artificial Sequence: Synthetic oligonucleotide
gggccacaaauucauccc

SEQ ID NO: 13013 - RNA, 18 nt, Artificial Sequence
  Description of Artificial Sequence: Synthetic oligonucleotide
cucuacauuccuuguggg

SEQ ID NO: 13014 - RNA, 18 nt, Artificial Sequence
  Description of Artificial Sequence: Synthetic oligonucleotide
ggacacucuacauuccuu

SEQ ID NO: 13015 - RNA, 18 nt, Artificial Sequence
  Description of Artificial Sequence: Synthetic oligonucleotide
aaccaggacacucuacau

SEQ ID NO: 13016 - RNA, 18 nt, Artificial Sequence
  Description of Artificial Sequence: Synthetic oligonucleotide
agcacaaccaggacacuc

SEQ ID NO: 13017 - RNA, 18 nt, Artificial Sequence
  Description of Artificial Sequence: Synthetic oligonucleotide
cacccagcacaaccagga

SEQ ID NO: 13018 - RNA, 18 nt, Artificial Sequence
  Description of Artificial Sequence: Synthetic oligonucleotide
ccccacacccagcacaac

SEQ ID NO: 13019 - RNA, 18 nt, Artificial Sequence
  Description of Artificial Sequence: Synthetic oligonucleotide
cagacccccacacccagc

SEQ ID NO: 13020 - RNA, 18 nt, Artificial Sequence
  Description of Artificial Sequence: Synthetic oligonucleotide
gcucucagacccccacac

SEQ ID NO: 13021 - RNA, 18 nt, Artificial Sequence
  Description of Artificial Sequence: Synthetic oligonucleotide
gccucgcucucagacccc

SEQ ID NO: 13022 - RNA, 18 nt, Artificial Sequence
  Description of Artificial Sequence: Synthetic oligonucleotide
cacuggccucgcucucag

SEQ ID NO: 13023 - RNA, 18 nt, Artificial Sequence
  Description of Artificial Sequence: Synthetic oligonucleotide
auguccacuggccucgcu

SEQ ID NO: 13024 - RNA, 18 nt, Artificial Sequence
  Description of Artificial Sequence: Synthetic oligonucleotide
ccugaauguccacuggcc

SEQ ID NO: 13025 - RNA, 18 nt, Artificial Sequence
  Description of Artificial Sequence: Synthetic oligonucleotide
uguucccugaauguccac

SEQ ID NO: 13026 - RNA, 18 nt, Artificial Sequence
  Description of Artificial Sequence: Synthetic oligonucleotide
caugguguucccugaaug

SEQ ID NO: 13027 - RNA, 18 nt, Artificial Sequence
  Description of Artificial Sequence: Synthetic oligonucleotide
cuggacaugguguucccu

SEQ ID NO: 13028 - RNA, 18 nt, Artificial Sequence
  Description of Artificial Sequence: Synthetic oligonucleotide
ccuuccuggacauggugu

SEQ ID NO: 13029 - RNA, 18 nt, Artificial Sequence
  Description of Artificial Sequence: Synthetic oligonucleotide
gccugccuuccuggacau

SEQ ID NO: 13030 - RNA, 18 nt, Artificial Sequence
  Description of Artificial Sequence: Synthetic oligonucleotide
ccaccgccugccuuccug

SEQ ID NO: 13031 - RNA, 18 nt, Artificial Sequence
  Description of Artificial Sequence: Synthetic oligonucleotide
cuccaccaccgccugccu

SEQ ID NO: 13032 - RNA, 18 nt, Artificial Sequence
  Description of Artificial Sequence: Synthetic oligonucleotide
gccaucuccaccaccgcc

SEQ ID NO: 13033 - RNA, 18 nt, Artificial Sequence
  Description of Artificial Sequence: Synthetic oligonucleotide
gaccagccaucuccacca

SEQ ID NO: 13034 - RNA, 18 nt, Artificial Sequence
  Description of Artificial Sequence: Synthetic oligonucleotide
cucacgaccagccaucuc

SEQ ID NO: 13035 - RNA, 18 nt, Artificial Sequence
  Description of Artificial Sequence: Synthetic oligonucleotide
cuucccucacgaccagcc

SEQ ID NO: 13036 - RNA, 18 nt, Artificial Sequence
  Description of Artificial Sequence: Synthetic oligonucleotide
cccuggugggugggaccu

SEQ ID NO: 13037 - RNA, 18 nt, Artificial Sequence
  Description of Artificial Sequence: Synthetic oligonucleotide
uacugcccuggugggugg

SEQ ID NO: 13038 - RNA, 18 nt, Artificial Sequence
  Description of Artificial Sequence: Synthetic oligonucleotide
guugguacugcccuggug

SEQ ID NO: 13039 - RNA, 18 nt, Artificial Sequence
  Description of Artificial Sequence: Synthetic oligonucleotide
agccaguugguacugccc

SEQ ID NO: 13040 - RNA, 18 nt, Artificial Sequence
  Description of Artificial Sequence: Synthetic oligonucleotide
gagccagccaguugguac

SEQ ID NO: 13041 - RNA, 18 nt, Artificial Sequence
  Description of Artificial Sequence: Synthetic oligonucleotide
ucugggagccagccaguu

SEQ ID NO: 13042 - RNA, 18 nt, Artificial Sequence
  Description of Artificial Sequence: Synthetic oligonucleotide
ugaccucugggagccagc

SEQ ID NO: 13043 - RNA, 18 nt, Artificial Sequence
  Description of Artificial Sequence: Synthetic oligonucleotide
uccacugaccucugggag

SEQ ID NO: 13044 - RNA, 18 nt, Artificial Sequence
  Description of Artificial Sequence: Synthetic oligonucleotide
gagaauccacugaccucu

SEQ ID NO: 13045 - RNA, 18 nt, Artificial Sequence
  Description of Artificial Sequence: Synthetic oligonucleotide
ccugggagaauccacuga

SEQ ID NO: 13046 - RNA, 18 nt, Artificial Sequence
  Description of Artificial Sequence: Synthetic oligonucleotide
agcccccugggagaaucc

SEQ ID NO: 13047 - RNA, 18 nt, Artificial Sequence
  Description of Artificial Sequence: Synthetic oligonucleotide
ggcaaagcccccugggag

SEQ ID NO: 13048 - RNA, 18 nt, Artificial Sequence
  Description of Artificial Sequence: Synthetic oligonucleotide
ugauaggcaaagcccccu

SEQ ID NO: 13049 - RNA, 18 nt, Artificial Sequence
  Description of Artificial Sequence: Synthetic oligonucleotide
gaaguugauaggcaaagc

SEQ ID NO: 13050 - RNA, 18 nt, Artificial Sequence
  Description of Artificial Sequence: Synthetic oligonucleotide
gagaggaaguugauaggc

SEQ ID NO: 13051 - RNA, 18 nt, Artificial Sequence
  Description of Artificial Sequence: Synthetic oligonucleotide
ccugggagaggaaguuga

SEQ ID NO: 13052 - RNA, 18 nt, Artificial Sequence
  Description of Artificial Sequence: Synthetic oligonucleotide
uggugccugggagaggaa

SEQ ID NO: 13053 - RNA, 18 nt, Artificial Sequence
  Description of Artificial Sequence: Synthetic oligonucleotide
aagcauggugccugggag

SEQ ID NO: 13054 - RNA, 18 nt, Artificial Sequence
  Description of Artificial Sequence: Synthetic oligonucleotide
guggaaagcauggugccu

SEQ ID NO: 13055 - RNA, 18 nt, Artificial Sequence
  Description of Artificial Sequence: Synthetic oligonucleotide
cauguguggaaagcaugg

SEQ ID NO: 13056 - RNA, 18 nt, Artificial Sequence
  Description of Artificial Sequence: Synthetic oligonucleotide
gggaccauguguggaaag

SEQ ID NO: 13057 - RNA, 18 nt, Artificial Sequence
  Description of Artificial Sequence: Synthetic oligonucleotide
gggccagaguugguaggg

SEQ ID NO: 13058 - RNA, 18 nt, Artificial Sequence
  Description of Artificial Sequence: Synthetic oligonucleotide
ggaaaggcugaaaauggg

SEQ ID NO: 13059 - RNA, 18 nt, Artificial Sequence
  Description of Artificial Sequence: Synthetic oligonucleotide
ggcagggaaaggcugaaa

SEQ ID NO: 13060 - RNA, 18 nt, Artificial Sequence
  Description of Artificial Sequence: Synthetic oligonucleotide
ggcaaggcagggaaaggc

SEQ ID NO: 13061 - RNA, 18 nt, Artificial Sequence
  Description of Artificial Sequence: Synthetic oligonucleotide
aacauggcaaggcaggga

SEQ ID NO: 13062 - RNA, 18 nt, Artificial Sequence
  Description of Artificial Sequence: Synthetic oligonucleotide
uuccaaacauggcaaggc

SEQ ID NO: 13063 - RNA, 18 nt, Artificial Sequence
  Description of Artificial Sequence: Synthetic oligonucleotide
agaaauuccaaacauggc

SEQ ID NO: 13064 - RNA, 18 nt, Artificial Sequence
  Description of Artificial Sequence: Synthetic oligonucleotide
gggagagaaauuccaaac

SEQ ID NO: 13065 - RNA, 18 nt, Artificial Sequence
  Description of Artificial Sequence: Synthetic oligonucleotide
agccagggagagaaauuc

SEQ ID NO: 13066 - RNA, 18 nt, Artificial Sequence
  Description of Artificial Sequence: Synthetic oligonucleotide
ggugaagccagggagaga

SEQ ID NO: 13067 - RNA, 18 nt, Artificial Sequence
  Description of Artificial Sequence: Synthetic oligonucleotide
cuccaggugaagccaggg

SEQ ID NO: 13068 - RNA, 18 nt, Artificial Sequence
  Description of Artificial Sequence: Synthetic oligonucleotide
uuaaacuccaggugaagc

SEQ ID NO: 13069 - RNA, 18 nt, Artificial Sequence
  Description of Artificial Sequence: Synthetic oligonucleotide
cacucuuaaacuccaggu

SEQ ID NO: 13070 - RNA, 18 nt, Artificial Sequence
  Description of Artificial Sequence: Synthetic oligonucleotide
uaauucacucuuaaacuc

SEQ ID NO: 13071 - RNA, 18 nt, Artificial Sequence
  Description of Artificial Sequence: Synthetic oligonucleotide
guuucuaauucacucuua

SEQ ID NO: 13072 - RNA, 18 nt, Artificial Sequence
  Description of Artificial Sequence: Synthetic oligonucleotide
gcugcguuucuaauucac

SEQ ID NO: 13073 - RNA, 18 nt, Artificial Sequence
  Description of Artificial Sequence: Synthetic oligonucleotide
gggcagcugcguuucuaa

SEQ ID NO: 13074 - RNA, 18 nt, Artificial Sequence
  Description of Artificial Sequence: Synthetic oligonucleotide
gugaugggcagcugcguu

SEQ ID NO: 13075 - RNA, 18 nt, Artificial Sequence
  Description of Artificial Sequence: Synthetic oligonucleotide
ugcaggugaugggcagcu

SEQ ID NO: 13076 - RNA, 18 nt, Artificial Sequence
  Description of Artificial Sequence: Synthetic oligonucleotide
ccaucugcaggugauggg

SEQ ID NO: 13077 - RNA, 18 nt, Artificial Sequence
  Description of Artificial Sequence: Synthetic oligonucleotide
cagagccaucugcaggug

SEQ ID NO: 13078 - RNA, 18 nt, Artificial Sequence
  Description of Artificial Sequence: Synthetic oligonucleotide
gggugcagagccaucugc

SEQ ID NO: 13079 - RNA, 18 nt, Artificial Sequence
  Description of Artificial Sequence: Synthetic oligonucleotide
caucagggugcagagcca

SEQ ID NO: 13080 - RNA, 18 nt, Artificial Sequence
  Description of Artificial Sequence: Synthetic oligonucleotide
cucaccaucagggugcag

SEQ ID NO: 13081 - RNA, 18 nt, Artificial Sequence
  Description of Artificial Sequence: Synthetic oligonucleotide
gcugccucaccaucaggg

SEQ ID NO: 13082 - RNA, 18 nt, Artificial Sequence
  Description of Artificial Sequence: Synthetic oligonucleotide
aacgagcugccucaccau

SEQ ID NO: 13083 - RNA, 18 nt, Artificial Sequence
  Description of Artificial Sequence: Synthetic oligonucleotide
caaggaacgagcugccuc

SEQ ID NO: 13084 - RNA, 18 nt, Artificial Sequence
  Description of Artificial Sequence: Synthetic oligonucleotide
ugcaccaaggaacgagcu

SEQ ID NO: 13085 - RNA, 18 nt, Artificial Sequence
  Description of Artificial Sequence: Synthetic oligonucleotide
caggcugcaccaaggaac

SEQ ID NO: 13086 - RNA, 18 nt, Artificial Sequence
  Description of Artificial Sequence: Synthetic oligonucleotide
ggucccaggcugcaccaa

SEQ ID NO: 13087 - RNA, 18 nt, Artificial Sequence
  Description of Artificial Sequence: Synthetic oligonucleotide
ggcagggucccaggcugc

SEQ ID NO: 13088 - RNA, 18 nt, Artificial Sequence
  Description of Artificial Sequence: Synthetic oligonucleotide
gcucaggcagggucccag

SEQ ID NO: 13089 - RNA, 18 nt, Artificial Sequence
  Description of Artificial Sequence: Synthetic oligonucleotide
cucuggcucaggcagggu

SEQ ID NO: 13090 - RNA, 18 nt, Artificial Sequence
  Description of Artificial Sequence: Synthetic oligonucleotide
acauccucuggcucaggc

SEQ ID NO: 13091 - RNA, 18 nt, Artificial Sequence
  Description of Artificial Sequence: Synthetic oligonucleotide
aaaacacauccucuggcu

SEQ ID NO: 13092 - RNA, 18 nt, Artificial Sequence
  Description of Artificial Sequence: Synthetic oligonucleotide
uaaacaaaacacauccuc

SEQ ID NO: 13093 - RNA, 18 nt, Artificial Sequence
  Description of Artificial Sequence: Synthetic oligonucleotide
guggauaaacaaaacaca

SEQ ID NO: 13094 - RNA, 18 nt, Artificial Sequence
  Description of Artificial Sequence: Synthetic oligonucleotide
gggcuguggauaaacaaa

SEQ ID NO: 13095 - RNA, 18 nt, Artificial Sequence
  Description of Artificial Sequence: Synthetic oligonucleotide
gccugggagauauuuggg

SEQ ID NO: 13096 - RNA, 18 nt, Artificial Sequence
  Description of Artificial Sequence: Synthetic oligonucleotide
aggccugggagauauuug

SEQ ID NO: 13097 - RNA, 18 nt, Artificial Sequence
  Description of Artificial Sequence: Synthetic oligonucleotide
gcaauaggccugggagau

SEQ ID NO: 13098 - RNA, 18 nt, Artificial Sequence
  Description of Artificial Sequence: Synthetic oligonucleotide
ccgucgcaauaggccugg

SEQ ID NO: 13099 - RNA, 18 nt, Artificial Sequence
  Description of Artificial Sequence: Synthetic oligonucleotide
gggucccgucgcaauagg

SEQ ID NO: 13100 - RNA, 18 nt, Artificial Sequence
  Description of Artificial Sequence: Synthetic oligonucleotide
uaguggaagcagggaggg

SEQ ID NO: 13101 - RNA, 18 nt, Artificial Sequence
  Description of Artificial Sequence: Synthetic oligonucleotide
auaguggaagcagggagg

SEQ ID NO: 13102 - RNA, 18 nt, Artificial Sequence
  Description of Artificial Sequence: Synthetic oligonucleotide
uggguauaguggaagcag

SEQ ID NO: 13103 - RNA, 18 nt, Artificial Sequence
  Description of Artificial Sequence: Synthetic oligonucleotide
uggucuggguauagugga

SEQ ID NO: 13104 - RNA, 18 nt, Artificial Sequence
  Description of Artificial Sequence: Synthetic oligonucleotide
aacccuggucuggguaua

SEQ ID NO: 13105 - RNA, 18 nt, Artificial Sequence
  Description of Artificial Sequence: Synthetic oligonucleotide
uccccaacccuggucugg

SEQ ID NO: 13106 - RNA, 18 nt, Artificial Sequence
  Description of Artificial Sequence: Synthetic oligonucleotide
cccccuccccaacccugg

SEQ ID NO: 13107 - RNA, 18 nt, Artificial Sequence
  Description of Artificial Sequence: Synthetic oligonucleotide
cccaccccccuccccaac

SEQ ID NO: 13108 - RNA, 18 nt, Artificial Sequence
  Description of Artificial Sequence: Synthetic oligonucleotide
cugcacccaccccccucc

SEQ ID NO: 13109 - RNA, 18 nt, Artificial Sequence
  Description of Artificial Sequence: Synthetic oligonucleotide
cagaucugcacccacccc

SEQ ID NO: 13110 - RNA, 18 nt, Artificial Sequence
  Description of Artificial Sequence: Synthetic oligonucleotide
auucccagaucugcaccc

SEQ ID NO: 13111 - RNA, 18 nt, Artificial Sequence
  Description of Artificial Sequence: Synthetic oligonucleotide
ucucgauucccagaucug

SEQ ID NO: 13112 - RNA, 18 nt, Artificial Sequence
  Description of Artificial Sequence: Synthetic oligonucleotide
gcgcuucucgauucccag

SEQ ID NO: 13113 - RNA, 18 nt, Artificial Sequence
  Description of Artificial Sequence: Synthetic oligonucleotide
uuccugcgcuucucgauu

SEQ ID NO: 13114 - RNA, 18 nt, Artificial Sequence
  Description of Artificial Sequence: Synthetic oligonucleotide
uuccuuuccugcgcuucu

SEQ ID NO: 13115 - RNA, 18 nt, Artificial Sequence
  Description of Artificial Sequence: Synthetic oligonucleotide
aacacuuccuuuccugcg

SEQ ID NO: 13116 - RNA, 18 nt, Artificial Sequence
  Description of Artificial Sequence: Synthetic oligonucleotide
uuuccaacacuuccuuuc

SEQ ID NO: 13117 - RNA, 18 nt, Artificial Sequence
  Description of Artificial Sequence: Synthetic oligonucleotide
ucugguuuccaacacuuc

SEQ ID NO: 13118 - RNA, 18 nt, Artificial Sequence
  Description of Artificial Sequence: Synthetic oligonucleotide
ccaguucugguuuccaac

SEQ ID NO: 13119 - RNA, 18 nt, Artificial Sequence
  Description of Artificial Sequence: Synthetic oligonucleotide
gcuugccaguucugguuu

SEQ ID NO: 13120 - RNA, 18 nt, Artificial Sequence
  Description of Artificial Sequence: Synthetic oligonucleotide
agugagcuugccaguucu

SEQ ID NO: 13121 - RNA, 18 nt, Artificial Sequence
  Description of Artificial Sequence: Synthetic oligonucleotide
aagacagugagcuugcca

SEQ ID NO: 13122 - RNA, 18 nt, Artificial Sequence
  Description of Artificial Sequence: Synthetic oligonucleotide
gugaggauguguguggau

SEQ ID NO: 13123 - RNA, 18 nt, Artificial Sequence
  Description of Artificial Sequence: Synthetic oligonucleotide
gggugaggaugugugugg

SEQ ID NO: 13124 - RNA, 18 nt, Artificial Sequence
  Description of Artificial Sequence: Synthetic oligonucleotide
uccagcaguuucuguggg

SEQ ID NO: 13125 - RNA, 18 nt, Artificial Sequence
  Description of Artificial Sequence: Synthetic oligonucleotide
guguguccagcaguuucu

SEQ ID NO: 13126 - RNA, 18 nt, Artificial Sequence
  Description of Artificial Sequence: Synthetic oligonucleotide
cuucaguguguccagcag

SEQ ID NO: 13127 - RNA, 18 nt, Artificial Sequence
  Description of Artificial Sequence: Synthetic oligonucleotide
aguuucuucagugugucc

SEQ ID NO: 13128 - RNA, 18 nt, Artificial Sequence
  Description of Artificial Sequence: Synthetic oligonucleotide
uauucaguuucuucagug

SEQ ID NO: 13129 - RNA, 18 nt, Artificial Sequence
  Description of Artificial Sequence: Synthetic oligonucleotide
uguuuuauucaguuucuu

SEQ ID NO: 13130 - RNA, 18 nt, Artificial Sequence
  Description of Artificial Sequence: Synthetic oligonucleotide
ucaucuguuuuauucagu

SEQ ID NO: 13131 - RNA, 18 nt, Artificial Sequence
  Description of Artificial Sequence: Synthetic oligonucleotide
uuucuucaucuguuuuau

SEQ ID NO: 13132 - RNA, 18 nt, Artificial Sequence
  Description of Artificial Sequence: Synthetic oligonucleotide
gcuuauuucuucaucugu

SEQ ID NO: 13133 - RNA, 18 nt, Artificial Sequence
  Description of Artificial Sequence: Synthetic oligonucleotide
uaacugcuuauuucuuca

SEQ ID NO: 13134 - RNA, 18 nt, Artificial Sequence
  Description of Artificial Sequence: Synthetic oligonucleotide
uuuuuuaacugcuuauuu

SEQ ID NO: 13135 - RNA, 18 nt, Artificial Sequence
  Description of Artificial Sequence: Synthetic oligonucleotide
cuuauuuuuuuaacugcu

SEQ ID NO: 13136 - RNA, 18 nt, Artificial Sequence
  Description of Artificial Sequence: Synthetic oligonucleotide
ggcgacuuauuuuuuuaa

SEQ ID NO: 13137 - RNA, 18 nt, Artificial Sequence
  Description of Artificial Sequence: Synthetic oligonucleotide
gggcgacuuauuuuuuua

SEQ ID NO: 13138 - RNA, 18 nt, Artificial Sequence
  Description of Artificial Sequence: Synthetic oligonucleotide
ggagcgcugugggauggg

SEQ ID NO: 13139 - RNA, 18 nt, Artificial Sequence
  Description of Artificial Sequence: Synthetic oligonucleotide
gcugcggagcgcuguggg

SEQ ID NO: 13140 - RNA, 18 nt, Artificial Sequence
  Description of Artificial Sequence: Synthetic oligonucleotide
gggaagcugcggagcgcu

SEQ ID NO: 13141 - RNA, 18 nt, Artificial Sequence
  Description of Artificial Sequence: Synthetic oligonucleotide
guggugggaagcugcgga

SEQ ID NO: 13142 - RNA, 18 nt, Artificial Sequence
  Description of Artificial Sequence: Synthetic oligonucleotide
gggcgguggugggaagcu

SEQ ID NO: 13143 - RNA, 18 nt, Artificial Sequence
  Description of Artificial Sequence: Synthetic oligonucleotide
gaggcgggcggugguggg

SEQ ID NO: 13144 - RNA, 18 nt, Artificial Sequence
  Description of Artificial Sequence: Synthetic oligonucleotide
gaacugaggcgggcggug

SEQ ID NO: 13145 - RNA, 18 nt, Artificial Sequence
  Description of Artificial Sequence: Synthetic oligonucleotide
caaaggaacugaggcggg

SEQ ID NO: 13146 - RNA, 18 nt, Artificial Sequence
  Description of Artificial Sequence: Synthetic oligonucleotide
agacgcaaaggaacugag

SEQ ID NO: 13147 - RNA, 18 nt, Artificial Sequence
  Description of Artificial Sequence: Synthetic oligonucleotide
gcaacagacgcaaaggaa

SEQ ID NO: 13148 - RNA, 18 nt, Artificial Sequence
  Description of Artificial Sequence: Synthetic oligonucleotide
gggaggcaacagacgcaa

SEQ ID NO: 13149 - RNA, 18 nt, Artificial Sequence
  Description of Artificial Sequence: Synthetic oligonucleotide
agccagggcgugcagggc

SEQ ID NO: 13150 - RNA, 18 nt, Artificial Sequence
  Description of Artificial Sequence: Synthetic oligonucleotide
gugccagccagggcgugc

SEQ ID NO: 13151 - RNA, 18 nt, Artificial Sequence
  Description of Artificial Sequence: Synthetic oligonucleotide
caacagugccagccaggg

SEQ ID NO: 13152 - RNA, 18 nt, Artificial Sequence
  Description of Artificial Sequence: Synthetic oligonucleotide
agcggcaacagugccagc

SEQ ID NO: 13153 - RNA, 18 nt, Artificial Sequence
  Description of Artificial Sequence: Synthetic oligonucleotide
aaugcagcggcaacagug

SEQ ID NO: 13154 - RNA, 18 nt, Artificial Sequence
  Description of Artificial Sequence: Synthetic oligonucleotide
acgagaaugcagcggcaa

SEQ ID NO: 13155 - RNA, 18 nt, Artificial Sequence
  Description of Artificial Sequence: Synthetic oligonucleotide
ugaacacgagaaugcagc

SEQ ID NO: 13156 - RNA, 18 nt, Artificial Sequence
  Description of Artificial Sequence: Synthetic oligonucleotide
aucacugaacacgagaau

SEQ ID NO: 13157 - RNA, 18 nt, Artificial Sequence
  Description of Artificial Sequence: Synthetic oligonucleotide
agggcaucacugaacacg

SEQ ID NO: 13158 - RNA, 18 nt, Artificial Sequence
  Description of Artificial Sequence: Synthetic oligonucleotide
agaagagggcaucacuga

SEQ ID NO: 13159 - RNA, 18 nt, Artificial Sequence
  Description of Artificial Sequence: Synthetic oligonucleotide
aaacaagaagagggcauc

SEQ ID NO: 13160 - RNA, 18 nt, Artificial Sequence
  Description of Artificial Sequence: Synthetic oligonucleotide
guuucaaacaagaagagg

SEQ ID NO: 13161 - RNA, 18 nt, Artificial Sequence
  Description of Artificial Sequence: Synthetic oligonucleotide
cuuuuguuucaaacaaga

SEQ ID NO: 13162 - RNA, 18 nt, Artificial Sequence
  Description of Artificial Sequence: Synthetic oligonucleotide
auuuucuuuuguuucaaa

SEQ ID NO: 13163 - RNA, 18 nt, Artificial Sequence
  Description of Artificial Sequence: Synthetic oligonucleotide
gcauuauuuucuuuuguu

SEQ ID NO: 13164 - RNA, 18 nt, Artificial Sequence
  Description of Artificial Sequence: Synthetic oligonucleotide
acaaugcauuauuuucuu

SEQ ID NO: 13165 - RNA, 18 nt, Artificial Sequence
  Description of Artificial Sequence: Synthetic oligonucleotide
aaaacacaaugcauuauu

SEQ ID NO: 13166 - RNA, 18 nt, Artificial Sequence
  Description of Artificial Sequence: Synthetic oligonucleotide
uuuaaaaaacacaaugca

SEQ ID NO: 13167 - RNA, 18 nt, Artificial Sequence
  Description of Artificial Sequence: Synthetic oligonucleotide
cucuuuuuaaaaaacaca

SEQ ID NO: 13168 - RNA, 18 nt, Artificial Sequence
  Description of Artificial Sequence: Synthetic oligonucleotide
agauacucuuuuuaaaaa

SEQ ID NO: 13169 - RNA, 18 nt, Artificial Sequence
  Description of Artificial Sequence: Synthetic oligonucleotide
guauaagauacucuuuuu

SEQ ID NO: 13170 - RNA, 18 nt, Artificial Sequence
  Description of Artificial Sequence: Synthetic oligonucleotide
uacauguauaagauacuc

SEQ ID NO: 13171 - RNA, 18 nt, Artificial Sequence
  Description of Artificial Sequence: Synthetic oligonucleotide
uaggauacauguauaaga

SEQ ID NO: 13172 - RNA, 18 nt, Artificial Sequence
  Description of Artificial Sequence: Synthetic oligonucleotide
cuuuuuaggauacaugua

SEQ ID NO: 13173 - RNA, 18 nt, Artificial Sequence
  Description of Artificial Sequence: Synthetic oligonucleotide
cuucucuuuuuaggauac

SEQ ID NO: 13174 - RNA, 18 nt, Artificial Sequence
  Description of Artificial Sequence: Synthetic oligonucleotide
augagcuucucuuuuuag

SEQ ID NO: 13175 - RNA, 18 nt, Artificial Sequence
  Description of Artificial Sequence: Synthetic oligonucleotide
ugcacaugagcuucucuu

SEQ ID NO: 13176 - RNA, 18 nt, Artificial Sequence
  Description of Artificial Sequence: Synthetic oligonucleotide
ccaauugcacaugagcuu

SEQ ID NO: 13177 - RNA, 18 nt, Artificial Sequence
  Description of Artificial Sequence: Synthetic oligonucleotide
gugcaccaauugcacaug

SEQ ID NO: 13178 - RNA, 18 nt, Artificial Sequence
  Description of Artificial Sequence: Synthetic oligonucleotide
cugcugugcaccaauugc

SEQ ID NO: 13179 - RNA, 18 nt, Artificial Sequence
  Description of Artificial Sequence: Synthetic oligonucleotide
uucuccugcugugcacca

SEQ ID NO: 13180 - RNA, 18 nt, Artificial Sequence
  Description of Artificial Sequence: Synthetic oligonucleotide
gaaauuucuccugcugug

SEQ ID NO: 13181 - RNA, 18 nt, Artificial Sequence
  Description of Artificial Sequence: Synthetic oligonucleotide
guccagaaauuucuccug

SEQ ID NO: 13182 - RNA, 18 nt, Artificial Sequence
  Description of Artificial Sequence: Synthetic oligonucleotide
uaacaguccagaaauuuc

SEQ ID NO: 13183 - RNA, 18 nt, Artificial Sequence
  Description of Artificial Sequence: Synthetic oligonucleotide
cauccuaacaguccagaa

SEQ ID NO: 13184 - RNA, 18 nt, Artificial Sequence
  Description of Artificial Sequence: Synthetic oligonucleotide
ccauucauccuaacaguc

SEQ ID NO: 13185 - RNA, 18 nt, Artificial Sequence
  Description of Artificial Sequence: Synthetic oligonucleotide
ggcguccauucauccuaa

SEQ ID NO: 13186 - RNA, 18 nt, Artificial Sequence
  Description of Artificial Sequence: Synthetic oligonucleotide
gagaaggcguccauucau

SEQ ID NO: 13187 - RNA, 18 nt, Artificial Sequence
  Description of Artificial Sequence: Synthetic oligonucleotide
gggagaaggcguccauuc

SEQ ID NO: 13188 - RNA, 18 nt, Artificial Sequence
  Description of Artificial Sequence: Synthetic oligonucleotide
caaaucuuaaauaacggg

SEQ ID NO: 13189 - RNA, 18 nt, Artificial Sequence
  Description of Artificial Sequence: Synthetic oligonucleotide
ggucacaaaucuuaaaua

SEQ ID NO: 13190 - RNA, 18 nt, Artificial Sequence
  Description of Artificial Sequence: Synthetic oligonucleotide
uacaaggucacaaaucuu

SEQ ID NO: 13191 - RNA, 18 nt, Artificial Sequence
  Description of Artificial Sequence: Synthetic oligonucleotide
uuauguacaaggucacaa

SEQ ID NO: 13192 - RNA, 18 nt, Artificial Sequence
  Description of Artificial Sequence: Synthetic oligonucleotide
caggguuauguacaaggu

SEQ ID NO: 13193 - RNA, 18 nt, Artificial Sequence
  Description of Artificial Sequence: Synthetic oligonucleotide
ucacccaggguuauguac

SEQ ID NO: 13194 - RNA, 18 nt, Artificial Sequence
  Description of Artificial Sequence: Synthetic oligonucleotide
gcacgucacccaggguua

SEQ ID NO: 13195 - RNA, 18 nt, Artificial Sequence
  Description of Artificial Sequence: Synthetic oligonucleotide
aaugugcacgucacccag

SEQ ID NO: 13196 - RNA, 18 nt, Artificial Sequence
  Description of Artificial Sequence: Synthetic oligonucleotide
caagcaaugugcacguca

SEQ ID NO: 13197 - RNA, 18 nt, Artificial Sequence
  Description of Artificial Sequence: Synthetic oligonucleotide
auacccaagcaaugugca

SEQ ID NO: 13198 - RNA, 18 nt, Artificial Sequence
  Description of Artificial Sequence: Synthetic oligonucleotide
guuccauacccaagcaau

SEQ ID NO: 13199 - RNA, 18 nt, Artificial Sequence
  Description of Artificial Sequence: Synthetic oligonucleotide
cuaccguuccauacccaa

SEQ ID NO: 13200 - RNA, 18 nt, Artificial Sequence
  Description of Artificial Sequence: Synthetic oligonucleotide
aauuucuaccguuccaua

SEQ ID NO: 13201 - RNA, 18 nt, Artificial Sequence
  Description of Artificial Sequence: Synthetic oligonucleotide
acccaaauuucuaccguu

SEQ ID NO: 13202 - RNA, 18 nt, Artificial Sequence
  Description of Artificial Sequence: Synthetic oligonucleotide
aaaacacccaaauuucua

SEQ ID NO: 13203 - RNA, 18 nt, Artificial Sequence
  Description of Artificial Sequence: Synthetic oligonucleotide
uuuuaaaaacacccaaau

SEQ ID NO: 13204 - RNA, 18 nt, Artificial Sequence
  Description of Artificial Sequence: Synthetic oligonucleotide
caagguuuuaaaaacacc

SEQ ID NO: 13205 - RNA, 18 nt, Artificial Sequence
  Description of Artificial Sequence: Synthetic oligonucleotide
ccaaacaagguuuuaaaa

SEQ ID NO: 13206 - RNA, 18 nt, Artificial Sequence
  Description of Artificial Sequence: Synthetic oligonucleotide
caaccccaaacaagguuu

SEQ ID NO: 13207 - RNA, 18 nt, Artificial Sequence
  Description of Artificial Sequence: Synthetic oligonucleotide
aggaacaaccccaaacaa

SEQ ID NO: 13208 - RNA, 18 nt, Artificial Sequence
  Description of Artificial Sequence: Synthetic oligonucleotide
aggacaggaacaacccca

SEQ ID NO: 13209 - RNA, 18 nt, Artificial Sequence
  Description of Artificial Sequence: Synthetic oligonucleotide
caacaaggacaggaacaa

SEQ ID NO: 13210 - RNA, 18 nt, Artificial Sequence
  Description of Artificial Sequence: Synthetic oligonucleotide
auucucaacaaggacagg

SEQ ID NO: 13211 - RNA, 18 nt, Artificial Sequence
  Description of Artificial Sequence: Synthetic oligonucleotide
cuaugauucucaacaagg

SEQ ID NO: 13212 - RNA, 18 nt, Artificial Sequence
  Description of Artificial Sequence: Synthetic oligonucleotide
caucucuaugauucucaa

SEQ ID NO: 13213 - RNA, 18 nt, Artificial Sequence
  Description of Artificial Sequence: Synthetic oligonucleotide
acagacaucucuaugauu

SEQ ID NO: 13214 - RNA, 18 nt, Artificial Sequence
  Description of Artificial Sequence: Synthetic oligonucleotide
agaacacagacaucucua

SEQ ID NO: 13215 - RNA, 18 nt, Artificial Sequence
  Description of Artificial Sequence: Synthetic oligonucleotide
cuccaagaacacagacau

SEQ ID NO: 13216 - RNA, 18 nt, Artificial Sequence
  Description of Artificial Sequence: Synthetic oligonucleotide
aaauacuccaagaacaca

SEQ ID NO: 13217 - RNA, 18 nt, Artificial Sequence
  Description of Artificial Sequence: Synthetic oligonucleotide
gugugaaauacuccaaga

SEQ ID NO: 13218 - RNA, 18 nt, Artificial Sequence
  Description of Artificial Sequence: Synthetic oligonucleotide
ccucagugugaaauacuc

SEQ ID NO: 13219 - RNA, 18 nt, Artificial Sequence
  Description of Artificial Sequence: Synthetic oligonucleotide
uuaguccucagugugaaa

SEQ ID NO: 13220 - RNA, 18 nt, Artificial Sequence
  Description of Artificial Sequence: Synthetic oligonucleotide
gcagauuaguccucagug

SEQ ID NO: 13221 - RNA, 18 nt, Artificial Sequence
  Description of Artificial Sequence: Synthetic oligonucleotide
agauagcagauuaguccu

SEQ ID NO: 13222 - RNA, 18 nt, Artificial Sequence
  Description of Artificial Sequence: Synthetic oligonucleotide
aaugaagauagcagauua

SEQ ID NO: 13223 - RNA, 18 nt, Artificial Sequence
  Description of Artificial Sequence: Synthetic oligonucleotide
acuggaaugaagauagca

SEQ ID NO: 13224 - RNA, 18 nt, Artificial Sequence
  Description of Artificial Sequence: Synthetic oligonucleotide
uagggacuggaaugaaga

SEQ ID NO: 13225 - RNA, 18 nt, Artificial Sequence
  Description of Artificial Sequence: Synthetic oligonucleotide
ggguagggacuggaauga

SEQ ID NO: 13226 - RNA, 18 nt, Artificial Sequence
  Description of Artificial Sequence: Synthetic oligonucleotide
gagagcaggcacugaggg

SEQ ID NO: 13227 - RNA, 18 nt, Artificial Sequence
  Description of Artificial Sequence: Synthetic oligonucleotide
uggaugagagcaggcacu

SEQ ID NO: 13228 - RNA, 18 nt, Artificial Sequence
  Description of Artificial Sequence: Synthetic oligonucleotide
uuauuuggaugagagcag

SEQ ID NO: 13229 - RNA, 18 nt, Artificial Sequence
  Description of Artificial Sequence: Synthetic oligonucleotide
ccagguuauuuggaugag

SEQ ID NO: 13230 - RNA, 18 nt, Artificial Sequence
  Description of Artificial Sequence: Synthetic oligonucleotide
accucccagguuauuugg

SEQ ID NO: 13231 - RNA, 18 nt, Artificial Sequence
  Description of Artificial Sequence: Synthetic oligonucleotide
uugucaccucccagguua

SEQ ID NO: 13232 - RNA, 18 nt, Artificial Sequence
  Description of Artificial Sequence: Synthetic oligonucleotide
ccugauugucaccuccca

SEQ ID NO: 13233 - RNA, 18 nt, Artificial Sequence
  Description of Artificial Sequence: Synthetic oligonucleotide
gauauccugauugucacc

SEQ ID NO: 13234 - RNA, 18 nt, Artificial Sequence
  Description of Artificial Sequence: Synthetic oligonucleotide
ccugagauauccugauug

SEQ ID NO: 13235 - RNA, 18 nt, Artificial Sequence
  Description of Artificial Sequence: Synthetic oligonucleotide
gaccuccugagauauccu

SEQ ID NO: 13236 - RNA, 18 nt, Artificial Sequence
  Description of Artificial Sequence: Synthetic oligonucleotide
ccuuggaccuccugagau

SEQ ID NO: 13237 - RNA, 18 nt, Artificial Sequence
  Description of Artificial Sequence: Synthetic oligonucleotide
uuccaccuuggaccuccu

SEQ ID NO: 13238 - RNA, 18 nt, Artificial Sequence
  Description of Artificial Sequence: Synthetic oligonucleotide
gucuguuccaccuuggac

SEQ ID NO: 13239 - RNA, 18 nt, Artificial Sequence
  Description of Artificial Sequence: Synthetic oligonucleotide
aagaggucuguuccaccu

SEQ ID NO: 13240 - RNA, 18 nt, Artificial Sequence
  Description of Artificial Sequence: Synthetic oligonucleotide
aggcaaagaggucuguuc

SEQ ID NO: 13241 - RNA, 18 nt, Artificial Sequence
  Description of Artificial Sequence: Synthetic oligonucleotide
gggaaaggcaaagagguc

SEQ ID NO: 13242 - RNA, 18 nt, Artificial Sequence
  Description of Artificial Sequence: Synthetic oligonucleotide
acgcugggaaaggcaaag

SEQ ID NO: 13243 - RNA, 18 nt, Artificial Sequence
  Description of Artificial Sequence: Synthetic oligonucleotide
augagacgcugggaaagg

SEQ ID NO: 13244 - RNA, 18 nt, Artificial Sequence
  Description of Artificial Sequence: Synthetic oligonucleotide
ggguaugagacgcuggga

SEQ ID NO: 13245 - RNA, 18 nt, Artificial Sequence
  Description of Artificial Sequence: Synthetic oligonucleotide
cacagcugcacuaccggg

SEQ ID NO: 13246 - RNA, 18 nt, Artificial Sequence
  Description of Artificial Sequence: Synthetic oligonucleotide
ccacccacagcugcacua

SEQ ID NO: 13247 - RNA, 18 nt, Artificial Sequence
  Description of Artificial Sequence: Synthetic oligonucleotide
agccuccacccacagcug

SEQ ID NO: 13248 - RNA, 18 nt, Artificial Sequence
  Description of Artificial Sequence: Synthetic oligonucleotide
accccagccuccacccac

SEQ ID NO: 13249 - RNA, 18 nt, Artificial Sequence
  Description of Artificial Sequence: Synthetic oligonucleotide
cagacaccccagccucca

SEQ ID NO: 13250 - RNA, 18 nt, Artificial Sequence
  Description of Artificial Sequence: Synthetic oligonucleotide
ucgugcagacaccccagc

SEQ ID NO: 13251 - RNA, 18 nt, Artificial Sequence
  Description of Artificial Sequence: Synthetic oligonucleotide
ugacuucgugcagacacc

SEQ ID NO: 13252 - RNA, 18 nt, Artificial Sequence
  Description of Artificial Sequence: Synthetic oligonucleotide
uggccugacuucgugcag

SEQ ID NO: 13253 - RNA, 18 nt, Artificial Sequence
  Description of Artificial Sequence: Synthetic oligonucleotide
gacgcuggccugacuucg

SEQ ID NO: 13254 - RNA, 18 nt, Artificial Sequence
  Description of Artificial Sequence: Synthetic oligonucleotide
aggaggacgcuggccuga

SEQ ID NO: 13255 - RNA, 18 nt, Artificial Sequence
  Description of Artificial Sequence: Synthetic oligonucleotide
uguggaggaggacgcugg

SEQ ID NO: 13256 - RNA, 18 nt, Artificial Sequence
  Description of Artificial Sequence: Synthetic oligonucleotide
caggcuguggaggaggac

SEQ ID NO: 13257 - RNA, 18 nt, Artificial Sequence
  Description of Artificial Sequence: Synthetic oligonucleotide
agugacaggcuguggagg

SEQ ID NO: 13258 - RNA, 18 nt, Artificial Sequence
  Description of Artificial Sequence: Synthetic oligonucleotide
gggcagugacaggcugug

SEQ ID NO: 13259 - RNA, 18 nt, Artificial Sequence
  Description of Artificial Sequence: Synthetic oligonucleotide
cuguggacacaggcuggg

SEQ ID NO: 13260 - RNA, 18 nt, Artificial Sequence
  Description of Artificial Sequence: Synthetic oligonucleotide
cagcacuguggacacagg

SEQ ID NO: 13261 - RNA, 18 nt, Artificial Sequence
  Description of Artificial Sequence: Synthetic oligonucleotide
gaucacagcacuguggac

SEQ ID NO: 13262 - RNA, 18 nt, Artificial Sequence
  Description of Artificial Sequence: Synthetic oligonucleotide
cucgggaucacagcacug

SEQ ID NO: 13263 - RNA, 18 nt, Artificial Sequence
  Description of Artificial Sequence: Synthetic oligonucleotide
cuucccucgggaucacag

SEQ ID NO: 13264 - RNA, 18 nt, Artificial Sequence
  Description of Artificial Sequence: Synthetic oligonucleotide
gaggacuucccucgggau

SEQ ID NO: 13265 - RNA, 18 nt, Artificial Sequence
  Description of Artificial Sequence: Synthetic oligonucleotide
gacuggaggacuucccuc

SEQ ID NO: 13266 - RNA, 18 nt, Artificial Sequence
  Description of Artificial Sequence: Synthetic oligonucleotide
acuuagacuggaggacuu

SEQ ID NO: 13267 - RNA, 18 nt, Artificial Sequence
  Description of Artificial Sequence: Synthetic oligonucleotide
cugugacuuagacuggag

SEQ ID NO: 13268 - RNA, 18 nt, Artificial Sequence
  Description of Artificial Sequence: Synthetic oligonucleotide
gggcacugugacuuagac

SEQ ID NO: 13269 - RNA, 18 nt, Artificial Sequence
  Description of Artificial Sequence: Synthetic oligonucleotide
ugucagggcacugugacu

SEQ ID NO: 13270 - RNA, 18 nt, Artificial Sequence
  Description of Artificial Sequence: Synthetic oligonucleotide
ucaccugucagggcacug

SEQ ID NO: 13271 - RNA, 18 nt, Artificial Sequence
  Description of Artificial Sequence: Synthetic oligonucleotide
gcuucucaccugucaggg

SEQ ID NO: 13272 - RNA, 18 nt, Artificial Sequence
  Description of Artificial Sequence: Synthetic oligonucleotide
aguuugcuucucaccugu

SEQ ID NO: 13273 - RNA, 18 nt, Artificial Sequence
  Description of Artificial Sequence: Synthetic oligonucleotide
gcgggaguuugcuucuca

SEQ ID NO: 13274 - RNA, 18 nt, Artificial Sequence
  Description of Artificial Sequence: Synthetic oligonucleotide
uuccagcgggaguuugcu

SEQ ID NO: 13275 - RNA, 18 nt, Artificial Sequence
  Description of Artificial Sequence: Synthetic oligonucleotide
gaggcuuccagcgggagu

SEQ ID NO: 13276 - RNA, 18 nt, Artificial Sequence
  Description of Artificial Sequence: Synthetic oligonucleotide
agauggaggcuuccagcg

SEQ ID NO: 13277 - RNA, 18 nt, Artificial Sequence
  Description of Artificial Sequence: Synthetic oligonucleotide
caaagagauggaggcuuc

SEQ ID NO: 13278 - RNA, 18 nt, Artificial Sequence
  Description of Artificial Sequence: Synthetic oligonucleotide
uuuuccaaagagauggag

SEQ ID NO: 13279 - RNA, 18 nt, Artificial Sequence
  Description of Artificial Sequence: Synthetic oligonucleotide
acuguuuuuccaaagaga

SEQ ID NO: 13280 - RNA, 18 nt, Artificial Sequence
  Description of Artificial Sequence: Synthetic oligonucleotide
gacuaacuguuuuuccaa

SEQ ID NO: 13281 - RNA, 18 nt, Artificial Sequence
  Description of Artificial Sequence: Synthetic oligonucleotide
cuccagacuaacuguuuu

SEQ ID NO: 13282 - RNA, 18 nt, Artificial Sequence
  Description of Artificial Sequence: Synthetic oligonucleotide
acaggcuccagacuaacu

SEQ ID NO: 13283 - RNA, 18 nt, Artificial Sequence
  Description of Artificial Sequence: Synthetic oligonucleotide
gggccacaggcuccagac

SEQ ID NO: 13284 - RNA, 18 nt, Artificial Sequence
  Description of Artificial Sequence: Synthetic oligonucleotide
ggccugggccacaggcuc

SEQ ID NO: 13285 - RNA, 18 nt, Artificial Sequence
  Description of Artificial Sequence: Synthetic oligonucleotide
agaagggccugggccaca

SEQ ID NO: 13286 - RNA, 18 nt, Artificial Sequence
  Description of Artificial Sequence: Synthetic oligonucleotide
gggacagaagggccuggg

SEQ ID NO: 13287 - RNA, 18 nt, Artificial Sequence
  Description of Artificial Sequence: Synthetic oligonucleotide
agcuguugggaugaugcc

SEQ ID NO: 13288 - RNA, 18 nt, Artificial Sequence
  Description of Artificial Sequence: Synthetic oligonucleotide
aaaugagcuguugggaug

SEQ ID NO: 13289 - RNA, 18 nt, Artificial Sequence
  Description of Artificial Sequence: Synthetic oligonucleotide
agggaaaaugagcuguug

SEQ ID NO: 13290 - RNA, 18 nt, Artificial Sequence
  Description of Artificial Sequence: Synthetic oligonucleotide
ggacuagggaaaaugagc

SEQ ID NO: 13291 - RNA, 18 nt, Artificial Sequence
  Description of Artificial Sequence: Synthetic oligonucleotide
aaggcggacuagggaaaa

SEQ ID NO: 13292 - RNA, 18 nt, Artificial Sequence
  Description of Artificial Sequence: Synthetic oligonucleotide
gaacgaaggcggacuagg

SEQ ID NO: 13293 - RNA, 18 nt, Artificial Sequence
  Description of Artificial Sequence: Synthetic oligonucleotide
cccuugaacgaaggcgga

SEQ ID NO: 13294 - RNA, 18 nt, Artificial Sequence
  Description of Artificial Sequence: Synthetic oligonucleotide
ccugacccuugaacgaag

SEQ ID NO: 13295 - RNA, 18 nt, Artificial Sequence
  Description of Artificial Sequence: Synthetic oligonucleotide
ccauuccugacccuugaa

SEQ ID NO: 13296 - RNA, 18 nt, Artificial Sequence
  Description of Artificial Sequence: Synthetic oligonucleotide
cugguccauuccugaccc

SEQ ID NO: 13297 - RNA, 18 nt, Artificial Sequence
  Description of Artificial Sequence: Synthetic oligonucleotide
cuguucugguccauuccu

SEQ ID NO: 13298 - RNA, 18 nt, Artificial Sequence
  Description of Artificial Sequence: Synthetic oligonucleotide
cccaucuguucuggucca

SEQ ID NO: 13299 - RNA, 18 nt, Artificial Sequence
  Description of Artificial Sequence: Synthetic oligonucleotide
cagaacccaucuguucug

SEQ ID NO: 13300 - RNA, 18 nt, Artificial Sequence
  Description of Artificial Sequence: Synthetic oligonucleotide
gccuccagaacccaucug

SEQ ID NO: 13301 - RNA, 18 nt, Artificial Sequence
  Description of Artificial Sequence: Synthetic oligonucleotide
gggccuccagaacccauc

SEQ ID NO: 13302 - RNA, 18 nt, Artificial Sequence
  Description of Artificial Sequence: Synthetic oligonucleotide
auagcccucuguucaggg

SEQ ID NO: 13303 - RNA, 18 nt, Artificial Sequence
  Description of Artificial Sequence: Synthetic oligonucleotide
cagccauagcccucuguu

SEQ ID NO: 13304 - RNA, 18 nt, Artificial Sequence
  Description of Artificial Sequence: Synthetic oligonucleotide
cuccacagccauagcccu

SEQ ID NO: 13305 - RNA, 18 nt, Artificial Sequence
  Description of Artificial Sequence: Synthetic oligonucleotide
accuucuccacagccaua

SEQ ID NO: 13306 - RNA, 18 nt, Artificial Sequence
  Description of Artificial Sequence: Synthetic oligonucleotide
caagaaccuucuccacag

SEQ ID NO: 13307 - RNA, 18 nt, Artificial Sequence
  Description of Artificial Sequence: Synthetic oligonucleotide
cgggccaagaaccuucuc

SEQ ID NO: 13308 - RNA, 18 nt, Artificial Sequence
  Description of Artificial Sequence: Synthetic oligonucleotide
uccaacgggccaagaacc

SEQ ID NO: 13309 - RNA, 18 nt, Artificial Sequence
  Description of Artificial Sequence: Synthetic oligonucleotide
gugaguccaacgggccaa

SEQ ID NO: 13310 - RNA, 18 nt, Artificial Sequence
  Description of Artificial Sequence: Synthetic oligonucleotide
ucugugugaguccaacgg

SEQ ID NO: 13311 - RNA, 18 nt, Artificial Sequence
  Description of Artificial Sequence: Synthetic oligonucleotide
cagggucugugugagucc

SEQ ID NO: 13312 - RNA, 18 nt, Artificial Sequence
  Description of Artificial Sequence: Synthetic oligonucleotide
ggguacagggucugugug

SEQ ID NO: 13313 - RNA, 18 nt, Artificial Sequence
  Description of Artificial Sequence: Synthetic oligonucleotide
cgagaggguacagggucu

SEQ ID NO: 13314 - RNA, 18 nt, Artificial Sequence
  Description of Artificial Sequence: Synthetic oligonucleotide
cuugccgagaggguacag

SEQ ID NO: 13315 - RNA, 18 nt, Artificial Sequence
  Description of Artificial Sequence: Synthetic oligonucleotide
agaugcuugccgagaggg

SEQ ID NO: 13316 - RNA, 18 nt, Artificial Sequence
  Description of Artificial Sequence: Synthetic oligonucleotide
acugaagaugcuugccga

SEQ ID NO: 13317 - RNA, 18 nt, Artificial Sequence
  Description of Artificial Sequence: Synthetic oligonucleotide
aucugacugaagaugcuu

SEQ ID NO: 13318 - RNA, 18 nt, Artificial Sequence
  Description of Artificial Sequence: Synthetic oligonucleotide
ggauaaucugacugaaga

SEQ ID NO: 13319 - RNA, 18 nt, Artificial Sequence
  Description of Artificial Sequence: Synthetic oligonucleotide
acugaggauaaucugacu

SEQ ID NO: 13320 - RNA, 18 nt, Artificial Sequence
  Description of Artificial Sequence: Synthetic oligonucleotide
cugaaacugaggauaauc

SEQ ID NO: 13321 - RNA, 18 nt, Artificial Sequence
  Description of Artificial Sequence: Synthetic oligonucleotide
aguaucugaaacugagga

SEQ ID NO: 13322 - RNA, 18 nt, Artificial Sequence
  Description of Artificial Sequence: Synthetic oligonucleotide
uaugaaguaucugaaacu

SEQ ID NO: 13323 - RNA, 18 nt, Artificial Sequence
  Description of Artificial Sequence: Synthetic oligonucleotide
gguauuaugaaguaucug

SEQ ID NO: 13324 - RNA, 18 nt, Artificial Sequence
  Description of Artificial Sequence: Synthetic oligonucleotide
cacaagguauuaugaagu

SEQ ID NO: 13325 - RNA, 18 nt, Artificial Sequence
  Description of Artificial Sequence: Synthetic oligonucleotide
cacaacacaagguauuau

SEQ ID NO: 13326 - RNA, 18 nt, Artificial Sequence
  Description of Artificial Sequence: Synthetic oligonucleotide
ccccacacaacacaaggu

SEQ ID NO: 13327 - RNA, 18 nt, Artificial Sequence
  Description of Artificial Sequence: Synthetic oligonucleotide
uaugaccccacacaacac

SEQ ID NO: 13328 - RNA, 18 nt, Artificial Sequence
  Description of Artificial Sequence: Synthetic oligonucleotide
ugauguaugaccccacac

SEQ ID NO: 13329 - RNA, 18 nt, Artificial Sequence
  Description of Artificial Sequence: Synthetic oligonucleotide
cacgaugauguaugaccc

SEQ ID NO: 13330 - RNA, 18 nt, Artificial Sequence
  Description of Artificial Sequence: Synthetic oligonucleotide
acaaacacgaugauguau

SEQ ID NO: 13331 - RNA, 18 nt, Artificial Sequence
  Description of Artificial Sequence: Synthetic oligonucleotide
cucuuacaaacacgauga

SEQ ID NO: 13332 - RNA, 18 nt, Artificial Sequence
  Description of Artificial Sequence: Synthetic oligonucleotide
aucuucucuuacaaacac

SEQ ID NO: 13333 - RNA, 18 nt, Artificial Sequence
  Description of Artificial Sequence: Synthetic oligonucleotide
ugaccaucuucucuuaca

SEQ ID NO: 13334 - RNA, 18 nt, Artificial Sequence
  Description of Artificial Sequence: Synthetic oligonucleotide
uaaaaugaccaucuucuc

SEQ ID NO: 13335 - RNA, 18 nt, Artificial Sequence
  Description of Artificial Sequence: Synthetic oligonucleotide
gagaauaaaaugaccauc

SEQ ID NO: 13336 - RNA, 18 nt, Artificial Sequence
  Description of Artificial Sequence: Synthetic oligonucleotide
auacagagaauaaaauga

SEQ ID NO: 13337 - RNA, 18 nt, Artificial Sequence
  Description of Artificial Sequence: Synthetic oligonucleotide
guuuuauacagagaauaa

SEQ ID NO: 13338 - RNA, 18 nt, Artificial Sequence
  Description of Artificial Sequence: Synthetic oligonucleotide
gcuaaguuuuauacagag

SEQ ID NO: 13339 - RNA, 18 nt, Artificial Sequence
  Description of Artificial Sequence: Synthetic oligonucleotide
uuagagcuaaguuuuaua

SEQ ID NO: 13340 - RNA, 18 nt, Artificial Sequence
  Description of Artificial Sequence: Synthetic oligonucleotide
cugcuuuagagcuaaguu

SEQ ID NO: 13341 - RNA, 18 nt, Artificial Sequence
  Description of Artificial Sequence: Synthetic oligonucleotide
aguuucugcuuuagagcu

SEQ ID NO: 13342 - RNA, 18 nt, Artificial Sequence
  Description of Artificial Sequence: Synthetic oligonucleotide
gcuuuaguuucugcuuua

SEQ ID NO: 13343 - RNA, 18 nt, Artificial Sequence
  Description of Artificial Sequence: Synthetic oligonucleotide
uugcugcuuuaguuucug

SEQ ID NO: 13344 - RNA, 18 nt, Artificial Sequence
  Description of Artificial Sequence: Synthetic oligonucleotide
ugcauuugcugcuuuagu

SEQ ID NO: 13345 - RNA, 18 nt, Artificial Sequence
  Description of Artificial Sequence: Synthetic oligonucleotide
cuuccugcauuugcugcu

SEQ ID NO: 13346 - RNA, 18 nt, Artificial Sequence
  Description of Artificial Sequence: Synthetic oligonucleotide
acagccuuccugcauuug

SEQ ID NO: 13347 - RNA, 18 nt, Artificial Sequence
  Description of Artificial Sequence: Synthetic oligonucleotide
gcgagacagccuuccugc

SEQ ID NO: 13348 - RNA, 18 nt, Artificial Sequence
  Description of Artificial Sequence: Synthetic oligonucleotide
ggauggcgagacagccuu

SEQ ID NO: 13349 - RNA, 18 nt, Artificial Sequence
  Description of Artificial Sequence: Synthetic oligonucleotide
cuugaggauggcgagaca

SEQ ID NO: 13350 - RNA, 18 nt, Artificial Sequence
  Description of Artificial Sequence: Synthetic oligonucleotide
ugagucuugaggauggcg

SEQ ID NO: 13351 - RNA, 18 nt, Artificial Sequence
  Description of Artificial Sequence: Synthetic oligonucleotide
gcugcugagucuugagga

SEQ ID NO: 13352 - RNA, 18 nt, Artificial Sequence
  Description of Artificial Sequence: Synthetic oligonucleotide
ugagagcugcugagucuu

SEQ ID NO: 13353 - RNA, 18 nt, Artificial Sequence
  Description of Artificial Sequence: Synthetic oligonucleotide
gagaaugagagcugcuga

SEQ ID NO: 13354 - RNA, 18 nt, Artificial Sequence
  Description of Artificial Sequence: Synthetic oligonucleotide
cacuggagaaugagagcu

SEQ ID NO: 13355 - RNA, 18 nt, Artificial Sequence
  Description of Artificial Sequence: Synthetic oligonucleotide
cucaccacuggagaauga

SEQ ID NO: 13356 - RNA, 18 nt, Artificial Sequence
  Description of Artificial Sequence: Synthetic oligonucleotide
gugugcucaccacuggag

SEQ ID NO: 13357 - RNA, 18 nt, Artificial Sequence
  Description of Artificial Sequence: Synthetic oligonucleotide
aaauggugugcucaccac

SEQ ID NO: 13358 - RNA, 18 nt, Artificial Sequence
  Description of Artificial Sequence: Synthetic oligonucleotide
agcacaaauggugugcuc

SEQ ID NO: 13359 - RNA, 18 nt, Artificial Sequence
  Description of Artificial Sequence: Synthetic oligonucleotide
gcagcagcacaaauggug

SEQ ID NO: 13360 - RNA, 18 nt, Artificial Sequence
  Description of Artificial Sequence: Synthetic oligonucleotide
caacagcagcagcacaaa

SEQ ID NO: 13361 - RNA, 18 nt, Artificial Sequence
  Description of Artificial Sequence: Synthetic oligonucleotide
cacgacaacagcagcagc

SEQ ID NO: 13362 - RNA, 18 nt, Artificial Sequence
  Description of Artificial Sequence: Synthetic oligonucleotide
uauuucacgacaacagca

SEQ ID NO: 13363 - RNA, 18 nt, Artificial Sequence
  Description of Artificial Sequence: Synthetic oligonucleotide
uauuauauuucacgacaa

SEQ ID NO: 13364 - RNA, 18 nt, Artificial Sequence
  Description of Artificial Sequence: Synthetic oligonucleotide
acuguuauuauauuucac

SEQ ID NO: 13365 - RNA, 18 nt, Artificial Sequence
  Description of Artificial Sequence: Synthetic oligonucleotide
cuuccacuguuauuauau

SEQ ID NO: 13366 - RNA, 18 nt, Artificial Sequence
  Description of Artificial Sequence: Synthetic oligonucleotide
ugugacuuccacuguuau

SEQ ID NO: 13367 - RNA, 18 nt, Artificial Sequence
  Description of Artificial Sequence: Synthetic oligonucleotide
auuuuugugacuuccacu

SEQ ID NO: 13368 - RNA, 18 nt, Artificial Sequence
  Description of Artificial Sequence: Synthetic oligonucleotide
gggacauuuuugugacuu

SEQ ID NO: 13369 - RNA, 18 nt, Artificial Sequence
  Description of Artificial Sequence: Synthetic oligonucleotide
gaggucaagggcggcgag

SEQ ID NO: 13370 - RNA, 18 nt, Artificial Sequence
  Description of Artificial Sequence: Synthetic oligonucleotide
ugcaggaggucaagggcg

SEQ ID NO: 13371 - RNA, 18 nt, Artificial Sequence
  Description of Artificial Sequence: Synthetic oligonucleotide
uggccugcaggaggucaa

SEQ ID NO: 13372 - RNA, 18 nt, Artificial Sequence
  Description of Artificial Sequence: Synthetic oligonucleotide
acacauggccugcaggag

SEQ ID NO: 13373 - RNA, 18 nt, Artificial Sequence
  Description of Artificial Sequence: Synthetic oligonucleotide
aauacacacauggccugc

SEQ ID NO: 13374 - RNA, 18 nt, Artificial Sequence
  Description of Artificial Sequence: Synthetic oligonucleotide
caaguaauacacacaugg

SEQ ID NO: 13375 - RNA, 18 nt, Artificial Sequence
  Description of Artificial Sequence: Synthetic oligonucleotide
cuagacaaguaauacaca

SEQ ID NO: 13376 - RNA, 18 nt, Artificial Sequence
  Description of Artificial Sequence: Synthetic oligonucleotide
caucacuagacaaguaau

SEQ ID NO: 13377 - RNA, 18 nt, Artificial Sequence
  Description of Artificial Sequence: Synthetic oligonucleotide
gaggacaucacuagacaa

SEQ ID NO: 13378 - RNA, 18 nt, Artificial Sequence
  Description of Artificial Sequence: Synthetic oligonucleotide
uuugagaggacaucacua

SEQ ID NO: 13379 - RNA, 18 nt, Artificial Sequence
  Description of Artificial Sequence: Synthetic oligonucleotide
agcacuuugagaggacau

SEQ ID NO: 13380 - RNA, 18 nt, Artificial Sequence
  Description of Artificial Sequence: Synthetic oligonucleotide
cguacagcacuuugagag

SEQ ID NO: 13381 - RNA, 18 nt, Artificial Sequence
  Description of Artificial Sequence: Synthetic oligonucleotide
gcucgcguacagcacuuu

SEQ ID NO: 13382 - RNA, 18 nt, Artificial Sequence
  Description of Artificial Sequence: Synthetic oligonucleotide
gccgagcucgcguacagc

SEQ ID NO: 13383 - RNA, 18 nt, Artificial Sequence
  Description of Artificial Sequence: Synthetic oligonucleotide
guggcgccgagcucgcgu

SEQ ID NO: 13384 - RNA, 18 nt, Artificial Sequence
  Description of Artificial Sequence: Synthetic oligonucleotide
cggagguggcgccgagcu

SEQ ID NO: 13385 - RNA, 18 nt, Artificial Sequence
  Description of Artificial Sequence: Synthetic oligonucleotide
ggaggcggagguggcgcc

SEQ ID NO: 13386 - RNA, 18 nt, Artificial Sequence
  Description of Artificial Sequence: Synthetic oligonucleotide
gaaagggaggcggaggug

SEQ ID NO: 13387 - RNA, 18 nt, Artificial Sequence
  Description of Artificial Sequence: Synthetic oligonucleotide
gcucugaaagggaggcgg

SEQ ID NO: 13388 - RNA, 18 nt, Artificial Sequence
  Description of Artificial Sequence: Synthetic oligonucleotide
agcaggcucugaaaggga

SEQ ID NO: 13389 - RNA, 18 nt, Artificial Sequence
  Description of Artificial Sequence: Synthetic oligonucleotide
gggagcaggcucugaaag

SEQ ID NO: 13390 - RNA, 18 nt, Artificial Sequence
  Description of Artificial Sequence: Synthetic oligonucleotide
gcgagcagagagggcggg

SEQ ID NO: 13391 - RNA, 18 nt, Artificial Sequence
  Description of Artificial Sequence: Synthetic oligonucleotide
augcagcgagcagagagg

SEQ ID NO: 13392 - RNA, 18 nt, Artificial Sequence
  Description of Artificial Sequence: Synthetic oligonucleotide
ccacaaugcagcgagcag

SEQ ID NO: 13393 - RNA, 18 nt, Artificial Sequence
  Description of Artificial Sequence: Synthetic oligonucleotide
gaacaccacaaugcagcg

SEQ ID NO: 13394 - RNA, 18 nt, Artificial Sequence
  Description of Artificial Sequence: Synthetic oligonucleotide
gaagagaacaccacaaug

SEQ ID NO: 13395 - RNA, 18 nt, Artificial Sequence
  Description of Artificial Sequence: Synthetic oligonucleotide
cuugagaagagaacacca

SEQ ID NO: 13396 - RNA, 18 nt, Artificial Sequence
  Description of Artificial Sequence: Synthetic oligonucleotide
aaagccuugagaagagaa

SEQ ID NO: 13397 - RNA, 18 nt, Artificial Sequence
  Description of Artificial Sequence: Synthetic oligonucleotide
auuucaaagccuugagaa

SEQ ID NO: 13398 - RNA, 18 nt, Artificial Sequence
  Description of Artificial Sequence: Synthetic oligonucleotide
gggagauuucaaagccuu

SEQ ID NO: 13399 - RNA, 18 nt, Artificial Sequence
  Description of Artificial Sequence: Synthetic oligonucleotide
acgacuaaucucagugca

SEQ ID NO: 13400 - RNA, 18 nt, Artificial Sequence
  Description of Artificial Sequence: Synthetic oligonucleotide
aucugacgacuaaucuca

SEQ ID NO: 13401 - RNA, 18 nt, Artificial Sequence
  Description of Artificial Sequence: Synthetic oligonucleotide
gagagaucugacgacuaa

SEQ ID NO: 13402 - RNA, 18 nt, Artificial Sequence
  Description of Artificial Sequence: Synthetic oligonucleotide
gggagagaucugacgacu

SEQ ID NO: 13403 - RNA, 18 nt, Artificial Sequence
  Description of Artificial Sequence: Synthetic oligonucleotide
aguugggagggagacggg

SEQ ID NO: 13404 - RNA, 18 nt, Artificial Sequence
  Description of Artificial Sequence: Synthetic oligonucleotide
guauaaguugggagggag

SEQ ID NO: 13405 - RNA, 18 nt, Artificial Sequence
  Description of Artificial Sequence: Synthetic oligonucleotide
aggucguauaaguuggga

SEQ ID NO: 13406 - RNA, 18 nt, Artificial Sequence
  Description of Artificial Sequence: Synthetic oligonucleotide
aaaucaggucguauaagu

SEQ ID NO: 13407 - RNA, 18 nt, Artificial Sequence
  Description of Artificial Sequence: Synthetic oligonucleotide
uaaggaaaucaggucgua

SEQ ID NO: 13408 - RNA, 18 nt, Artificial Sequence
  Description of Artificial Sequence: Synthetic oligonucleotide
cguccuaaggaaaucagg

SEQ ID NO: 13409 - RNA, 18 nt, Artificial Sequence
  Description of Artificial Sequence: Synthetic oligonucleotide
gguuccguccuaaggaaa

SEQ ID NO: 13410 - RNA, 18 nt, Artificial Sequence
  Description of Artificial Sequence: Synthetic oligonucleotide
ccugcgguuccguccuaa

SEQ ID NO: 13411 - RNA, 18 nt, Artificial Sequence
  Description of Artificial Sequence: Synthetic oligonucleotide
aggugccugcgguuccgu

SEQ ID NO: 13412 - RNA, 18 nt, Artificial Sequence
  Description of Artificial Sequence: Synthetic oligonucleotide
ggcgcaggugccugcggu

SEQ ID NO: 13413 - RNA, 18 nt, Artificial Sequence
  Description of Artificial Sequence: Synthetic oligonucleotide
cgcccggcgcaggugccu

SEQ ID NO: 13414 - RNA, 18 nt, Artificial Sequence
  Description of Artificial Sequence: Synthetic oligonucleotide
uaagacgcccggcgcagg

SEQ ID NO: 13415 - RNA, 18 nt, Artificial Sequence
  Description of Artificial Sequence: Synthetic oligonucleotide
gggaguaagacgcccggc

SEQ ID NO: 13416 - RNA, 18 nt, Artificial Sequence
  Description of Artificial Sequence: Synthetic oligonucleotide
gcagcgggaguaagacgc

SEQ ID NO: 13417 - RNA, 18 nt, Artificial Sequence
  Description of Artificial Sequence: Synthetic oligonucleotide
aacaagcagcgggaguaa

SEQ ID NO: 13418 - RNA, 18 nt, Artificial Sequence
  Description of Artificial Sequence: Synthetic oligonucleotide
gacagaacaagcagcggg

SEQ ID NO: 13419 - RNA, 18 nt, Artificial Sequence
  Description of Artificial Sequence: Synthetic oligonucleotide
gggacagaacaagcagcg

SEQ ID NO: 13420 - RNA, 18 nt, Artificial Sequence
  Description of Artificial Sequence: Synthetic oligonucleotide
guuugguccgagggaggg

SEQ ID NO: 13421 - RNA, 18 nt, Artificial Sequence
  Description of Artificial Sequence: Synthetic oligonucleotide
gcacuguuugguccgagg

SEQ ID NO: 13422 - RNA, 18 nt, Artificial Sequence
  Description of Artificial Sequence: Synthetic oligonucleotide
caugagcacuguuugguc

SEQ ID NO: 13423 - RNA, 18 nt, Artificial Sequence
  Description of Artificial Sequence: Synthetic oligonucleotide
ugaagcaugagcacuguu

SEQ ID NO: 13424 - RNA, 18 nt, Artificial Sequence
  Description of Artificial Sequence: Synthetic oligonucleotide
gguccugaagcaugagca

SEQ ID NO: 13425 - RNA, 18 nt, Artificial Sequence
  Description of Artificial Sequence: Synthetic oligonucleotide
aacaagguccugaagcau

SEQ ID NO: 13426 - RNA, 18 nt, Artificial Sequence
  Description of Artificial Sequence: Synthetic oligonucleotide
cgacaaacaagguccuga

SEQ ID NO: 13427 - RNA, 18 nt, Artificial Sequence
  Description of Artificial Sequence: Synthetic oligonucleotide
aucuucgacaaacaaggu

SEQ ID NO: 13428 - RNA, 18 nt, Artificial Sequence
  Description of Artificial Sequence: Synthetic oligonucleotide
ccaacaucuucgacaaac

SEQ ID NO: 13429 - RNA, 18 nt, Artificial Sequence
  Description of Artificial Sequence: Synthetic oligonucleotide
ggaaaccaacaucuucga

SEQ ID NO: 13430 - RNA, 18 nt, Artificial Sequence
  Description of Artificial Sequence: Synthetic oligonucleotide
gaaagggaaaccaacauc

SEQ ID NO: 13431 - RNA, 18 nt, Artificial Sequence
  Description of Artificial Sequence: Synthetic oligonucleotide
acagagaaagggaaacca

SEQ ID NO: 13432 - RNA, 18 nt, Artificial Sequence
  Description of Artificial Sequence: Synthetic oligonucleotide
aaauaacagagaaaggga

SEQ ID NO: 13433 - RNA, 18 nt, Artificial Sequence
  Description of Artificial Sequence: Synthetic oligonucleotide
uauauaaauaacagagaa

SEQ ID NO: 13434 - RNA, 18 nt, Artificial Sequence
  Description of Artificial Sequence: Synthetic oligonucleotide
auuuuuauauaaauaaca

SEQ ID NO: 13435 - RNA, 18 nt, Artificial Sequence
  Description of Artificial Sequence: Synthetic oligonucleotide
aaauuauuuuuauauaaa

SEQ ID NO: 13436 - RNA, 18 nt, Artificial Sequence
  Description of Artificial Sequence: Synthetic oligonucleotide
uugauaaauuauuuuuau

SEQ ID NO: 13437 - RNA, 18 nt, Artificial Sequence
  Description of Artificial Sequence: Synthetic oligonucleotide
uccuuuugauaaauuauu

SEQ ID NO: 13438 - RNA, 18 nt, Artificial Sequence
  Description of Artificial Sequence: Synthetic oligonucleotide
aaauauccuuuugauaaa

SEQ ID NO: 13439 - RNA, 18 nt, Artificial Sequence
  Description of Artificial Sequence: Synthetic oligonucleotide
uuuuaaaauauccuuuug

SEQ ID NO: 13440 - RNA, 18 nt, Artificial Sequence
  Description of Artificial Sequence: Synthetic oligonucleotide
agcuuuuuuaaaauaucc

SEQ ID NO: 13441 - RNA, 18 nt, Artificial Sequence
  Description of Artificial Sequence: Synthetic oligonucleotide
agacuagcuuuuuuaaaa

SEQ ID NO: 13442 - RNA, 18 nt, Artificial Sequence
  Description of Artificial Sequence: Synthetic oligonucleotide
aagacagacuagcuuuuu

SEQ ID NO: 13443 - RNA, 18 nt, Artificial Sequence
  Description of Artificial Sequence: Synthetic oligonucleotide
guuucaagacagacuagc

SEQ ID NO: 13444 - RNA, 18 nt, Artificial Sequence
  Description of Artificial Sequence: Synthetic oligonucleotide
aacaaguuucaagacaga

SEQ ID NO: 13445 - RNA, 18 nt, Artificial Sequence
  Description of Artificial Sequence: Synthetic oligonucleotide
agguaaacaaguuucaag

SEQ ID NO: 13446 - RNA, 18 nt, Artificial Sequence
  Description of Artificial Sequence: Synthetic oligonucleotide
uuuuaagguaaacaaguu

SEQ ID NO: 13447 - RNA, 18 nt, Artificial Sequence
  Description of Artificial Sequence: Synthetic oligonucleotide
gauaauuuuaagguaaac

SEQ ID NO: 13448 - RNA, 18 nt, Artificial Sequence
  Description of Artificial Sequence: Synthetic oligonucleotide
auucugauaauuuuaagg

SEQ ID NO: 13449 - RNA, 18 nt, Artificial Sequence
  Description of Artificial Sequence: Synthetic oligonucleotide
cugagauucugauaauuu

SEQ ID NO: 13450 - RNA, 18 nt, Artificial Sequence
  Description of Artificial Sequence: Synthetic oligonucleotide
aaacacugagauucugau

SEQ ID NO: 13451 - RNA, 18 nt, Artificial Sequence
  Description of Artificial Sequence: Synthetic oligonucleotide
cuuucaaacacugagauu

SEQ ID NO: 13452 - RNA, 18 nt, Artificial Sequence
  Description of Artificial Sequence: Synthetic oligonucleotide
caguacuuucaaacacug

SEQ ID NO: 13453 - RNA, 18 nt, Artificial Sequence
  Description of Artificial Sequence: Synthetic oligonucleotide
ugcuucaguacuuucaaa

SEQ ID NO: 13454 - RNA, 18 nt, Artificial Sequence
  Description of Artificial Sequence: Synthetic oligonucleotide
guuugugcuucaguacuu

SEQ ID NO: 13455 - RNA, 18 nt, Artificial Sequence
  Description of Artificial Sequence: Synthetic oligonucleotide
uauauguuugugcuucag

SEQ ID NO: 13456 - RNA, 18 nt, Artificial Sequence
  Description of Artificial Sequence: Synthetic oligonucleotide
gaugauauauguuugugc

SEQ ID NO: 13457 - RNA, 18 nt, Artificial Sequence
  Description of Artificial Sequence: Synthetic oligonucleotide
acagagaugauauauguu

SEQ ID NO: 13458 - RNA, 18 nt, Artificial Sequence
  Description of Artificial Sequence: Synthetic oligonucleotide
augguacagagaugauau

SEQ ID NO: 13459 - RNA, 18 nt, Artificial Sequence
  Description of Artificial Sequence: Synthetic oligonucleotide
acagaaugguacagagau

SEQ ID NO: 13460 - RNA, 18 nt, Artificial Sequence
  Description of Artificial Sequence: Synthetic oligonucleotide
uuaguacagaaugguaca

SEQ ID NO: 13461 - RNA, 18 nt, Artificial Sequence
  Description of Artificial Sequence: Synthetic oligonucleotide
gugcuuuaguacagaaug

SEQ ID NO: 13462 - RNA, 18 nt, Artificial Sequence
  Description of Artificial Sequence: Synthetic oligonucleotide
cucaagugcuuuaguaca

SEQ ID NO: 13463 - RNA, 18 nt, Artificial Sequence
  Description of Artificial Sequence: Synthetic oligonucleotide
uuagacucaagugcuuua

SEQ ID NO: 13464 - RNA, 18 nt, Artificial Sequence
  Description of Artificial Sequence: Synthetic oligonucleotide
auuuauuagacucaagug

SEQ ID NO: 13465 - RNA, 18 nt, Artificial Sequence
  Description of Artificial Sequence: Synthetic oligonucleotide
ucuuuauuuauuagacuc

SEQ ID NO: 13466 - RNA, 18 nt, Artificial Sequence
  Description of Artificial Sequence: Synthetic oligonucleotide
ugauuucuuuauuuauua

SEQ ID NO: 13467 - RNA, 18 nt, Artificial Sequence
  Description of Artificial Sequence: Synthetic oligonucleotide
ggugcugauuucuuuauu

SEQ ID NO: 13468 - RNA, 18 nt, Artificial Sequence
  Description of Artificial Sequence: Synthetic oligonucleotide
gggugcugauuucuuuau

SEQ ID NO: 13469 - RNA, 18 nt, Artificial Sequence
  Description of Artificial Sequence: Synthetic oligonucleotide
ccuggacaccgggaaggg

SEQ ID NO: 13470 - RNA, 18 nt, Artificial Sequence
  Description of Artificial Sequence: Synthetic oligonucleotide
gccagugcccauagcggg

SEQ ID NO: 13471 - RNA, 18 nt, Artificial Sequence
  Description of Artificial Sequence: Synthetic oligonucleotide
cuuaugccagugcccaua

SEQ ID NO: 13472 - RNA, 18 nt, Artificial Sequence
  Description of Artificial Sequence: Synthetic oligonucleotide
uuguucuuaugccagugc

SEQ ID NO: 13473 - RNA, 18 nt, Artificial Sequence
  Description of Artificial Sequence: Synthetic oligonucleotide
gggccuuguucuuaugcc

SEQ ID NO: 13474 - RNA, 18 nt, Artificial Sequence
  Description of Artificial Sequence: Synthetic oligonucleotide
cugcgguacucgccuggg

SEQ ID NO: 13475 - RNA, 18 nt, Artificial Sequence
  Description of Artificial Sequence: Synthetic oligonucleotide
acugcgguacucgccugg

SEQ ID NO: 13476 - RNA, 18 nt, Artificial Sequence
  Description of Artificial Sequence: Synthetic oligonucleotide
gggccacugcgguacucg

SEQ ID NO: 13477 - RNA, 18 nt, Artificial Sequence
  Description of Artificial Sequence: Synthetic oligonucleotide
ugaaaaugaugaggcggg

SEQ ID NO: 13478 - RNA, 18 nt, Artificial Sequence
  Description of Artificial Sequence: Synthetic oligonucleotide
ggaugaaaaugaugaggc

SEQ ID NO: 13479 - RNA, 18 nt, Artificial Sequence
  Description of Artificial Sequence: Synthetic oligonucleotide
cccaaggaugaaaaugau

SEQ ID NO: 13480 - RNA, 18 nt, Artificial Sequence
  Description of Artificial Sequence: Synthetic oligonucleotide
acacccccaaggaugaaa

SEQ ID NO: 13481 - RNA, 18 nt, Artificial Sequence
  Description of Artificial Sequence: Synthetic oligonucleotide
ggcucacacccccaagga

SEQ ID NO: 13482 - RNA, 18 nt, Artificial Sequence
  Description of Artificial Sequence: Synthetic oligonucleotide
auucaggcucacaccccc

SEQ ID NO: 13483 - RNA, 18 nt, Artificial Sequence
  Description of Artificial Sequence: Synthetic oligonucleotide
aucucauucaggcucaca

SEQ ID NO: 13484 - RNA, 18 nt, Artificial Sequence
  Description of Artificial Sequence: Synthetic oligonucleotide
agcgcaucucauucaggc

SEQ ID NO: 13485 - RNA, 18 nt, Artificial Sequence
  Description of Artificial Sequence: Synthetic oligonucleotide
ggcgcagcgcaucucauu

SEQ ID NO: 13486 - RNA, 18 nt, Artificial Sequence
  Description of Artificial Sequence: Synthetic oligonucleotide
ucguaggcgcagcgcauc

SEQ ID NO: 13487 - RNA, 18 nt, Artificial Sequence
  Description of Artificial Sequence: Synthetic oligonucleotide
ucaccucguaggcgcagc

SEQ ID NO: 13488 - RNA, 18 nt, Artificial Sequence
  Description of Artificial Sequence: Synthetic oligonucleotide
cugggucaccucguaggc

SEQ ID NO: 13489 - RNA, 18 nt, Artificial Sequence
  Description of Artificial Sequence: Synthetic oligonucleotide
uuggccugggucaccucg

SEQ ID NO: 13490 - RNA, 18 nt, Artificial Sequence
  Description of Artificial Sequence: Synthetic oligonucleotide
uuccguuggccuggguca

SEQ ID NO: 13491 - RNA, 18 nt, Artificial Sequence
  Description of Artificial Sequence: Synthetic oligonucleotide
ccacuuuccguuggccug

SEQ ID NO: 13492 - RNA, 18 nt, Artificial Sequence
  Description of Artificial Sequence: Synthetic oligonucleotide
accucccacuuuccguug

SEQ ID NO: 13493 - RNA, 18 nt, Artificial Sequence
  Description of Artificial Sequence: Synthetic oligonucleotide
ucagcaccucccacuuuc

SEQ ID NO: 13494 - RNA, 18 nt, Artificial Sequence
  Description of Artificial Sequence: Synthetic oligonucleotide
ccgcuggaagcacggcca

SEQ ID NO: 13495 - RNA, 18 nt, Artificial Sequence
  Description of Artificial Sequence: Synthetic oligonucleotide
gccuuccgcuggaagcac

SEQ ID NO: 13496 - RNA, 18 nt, Artificial Sequence
  Description of Artificial Sequence: Synthetic oligonucleotide
gcggcgccuuccgcugga

SEQ ID NO: 13497 - RNA, 18 nt, Artificial Sequence
  Description of Artificial Sequence: Synthetic oligonucleotide
augcggcggcgccuuccg

SEQ ID NO: 13498 - RNA, 18 nt, Artificial Sequence
  Description of Artificial Sequence: Synthetic oligonucleotide
gugcgaugcggcggcgcc

SEQ ID NO: 13499 - RNA, 18 nt, Artificial Sequence
  Description of Artificial Sequence: Synthetic oligonucleotide
uugaggugcgaugcggcg

SEQ ID NO: 13500 - RNA, 18 nt, Artificial Sequence
  Description of Artificial Sequence: Synthetic oligonucleotide
uggaguugaggugcgaug

SEQ ID NO: 13501 - RNA, 18 nt, Artificial Sequence
  Description of Artificial Sequence: Synthetic oligonucleotide
uggaauggaguugaggug

SEQ ID NO: 13502 - RNA, 18 nt, Artificial Sequence
  Description of Artificial Sequence: Synthetic oligonucleotide
aagcguggaauggaguug

SEQ ID NO: 13503 - RNA, 18 nt, Artificial Sequence
  Description of Artificial Sequence: Synthetic oligonucleotide
caccaaagcguggaaugg

SEQ ID NO: 13504 - RNA, 18 nt, Artificial Sequence
  Description of Artificial Sequence: Synthetic oligonucleotide
ugcgacaccaaagcgugg

SEQ ID NO: 13505 - RNA, 18 nt, Artificial Sequence
  Description of Artificial Sequence: Synthetic oligonucleotide
cagaaugcgacaccaaag

SEQ ID NO: 13506 - RNA, 18 nt, Artificial Sequence
  Description of Artificial Sequence: Synthetic oligonucleotide
uaugacagaaugcgacac

SEQ ID NO: 13507 - RNA, 18 nt, Artificial Sequence
  Description of Artificial Sequence: Synthetic oligonucleotide
gagucuaugacagaaugc

SEQ ID NO: 13508 - RNA, 18 nt, Artificial Sequence
  Description of Artificial Sequence: Synthetic oligonucleotide
caagggagucuaugacag

SEQ ID NO: 13509 - RNA, 18 nt, Artificial Sequence
  Description of Artificial Sequence: Synthetic oligonucleotide
ugggucaagggagucuau

SEQ ID NO: 13510 - RNA, 18 nt, Artificial Sequence
  Description of Artificial Sequence: Synthetic oligonucleotide
uuuugugggucaagggag

SEQ ID NO: 13511 - RNA, 18 nt, Artificial Sequence
  Description of Artificial Sequence: Synthetic oligonucleotide
cuaaguuuugugggucaa

SEQ ID NO: 13512 - RNA, 18 nt, Artificial Sequence
  Description of Artificial Sequence: Synthetic oligonucleotide
aaagacuaaguuuugugg

SEQ ID NO: 13513 - RNA, 18 nt, Artificial Sequence
  Description of Artificial Sequence: Synthetic oligonucleotide
uaccuaaagacuaaguuu

SEQ ID NO: 13514 - RNA, 18 nt, Artificial Sequence
  Description of Artificial Sequence: Synthetic oligonucleotide
acaguuaccuaaagacua

SEQ ID NO: 13515 - RNA, 18 nt, Artificial Sequence
  Description of Artificial Sequence: Synthetic oligonucleotide
uguccacaguuaccuaaa

SEQ ID NO: 13516 - RNA, 18 nt, Artificial Sequence
  Description of Artificial Sequence: Synthetic oligonucleotide
ucugcuguccacaguuac

SEQ ID NO: 13517 - RNA, 18 nt, Artificial Sequence
  Description of Artificial Sequence: Synthetic oligonucleotide
uagcuucugcuguccaca

SEQ ID NO: 13518 - RNA, 18 nt, Artificial Sequence
  Description of Artificial Sequence: Synthetic oligonucleotide
gccccuagcuucugcugu

SEQ ID NO: 13519 - RNA, 18 nt, Artificial Sequence
  Description of Artificial Sequence: Synthetic oligonucleotide
ccuuugccccuagcuucu

SEQ ID NO: 13520 - RNA, 18 nt, Artificial Sequence
  Description of Artificial Sequence: Synthetic oligonucleotide
ggaacccuuugccccuag

SEQ ID NO: 13521 - RNA, 18 nt, Artificial Sequence
  Description of Artificial Sequence: Synthetic oligonucleotide
aggagggaacccuuugcc

SEQ ID NO: 13522 - RNA, 18 nt, Artificial Sequence
  Description of Artificial Sequence: Synthetic oligonucleotide
gaccaaggagggaacccu

SEQ ID NO: 13523 - RNA, 18 nt, Artificial Sequence
  Description of Artificial Sequence: Synthetic oligonucleotide
gggcagaccaaggaggga

SEQ ID NO: 13524 - RNA, 18 nt, Artificial Sequence
  Description of Artificial Sequence: Synthetic oligonucleotide
cagcagggcagaccaagg

SEQ ID NO: 13525 - RNA, 18 nt, Artificial Sequence
  Description of Artificial Sequence: Synthetic oligonucleotide
agaugcagcagggcagac

SEQ ID NO: 13526 - RNA, 18 nt, Artificial Sequence
  Description of Artificial Sequence: Synthetic oligonucleotide
uugagagaugcagcaggg

SEQ ID NO: 13527 - RNA, 18 nt, Artificial Sequence
  Description of Artificial Sequence: Synthetic oligonucleotide
uuccauugagagaugcag

SEQ ID NO: 13528 - RNA, 18 nt, Artificial Sequence
  Description of Artificial Sequence: Synthetic oligonucleotide
cugccuuccauugagaga

SEQ ID NO: 13529 - RNA, 18 nt, Artificial Sequence
  Description of Artificial Sequence: Synthetic oligonucleotide
ugaggcugccuuccauug

SEQ ID NO: 13530 - RNA, 18 nt, Artificial Sequence
  Description of Artificial Sequence: Synthetic oligonucleotide
ccucaugaggcugccuuc

SEQ ID NO: 13531 - RNA, 18 nt, Artificial Sequence
  Description of Artificial Sequence: Synthetic oligonucleotide
uccuaccucaugaggcug

SEQ ID NO: 13532 - RNA, 18 nt, Artificial Sequence
  Description of Artificial Sequence: Synthetic oligonucleotide
gcacuuccuaccucauga

SEQ ID NO: 13533 - RNA, 18 nt, Artificial Sequence
  Description of Artificial Sequence: Synthetic oligonucleotide
aucaggcacuuccuaccu

SEQ ID NO: 13534 - RNA, 18 nt, Artificial Sequence
  Description of Artificial Sequence: Synthetic oligonucleotide
cugggaucaggcacuucc

SEQ ID NO: 13535 - RNA, 18 nt, Artificial Sequence
  Description of Artificial Sequence: Synthetic oligonucleotide
ggacccugggaucaggca

SEQ ID NO: 13536 - RNA, 18 nt, Artificial Sequence
  Description of Artificial Sequence: Synthetic oligonucleotide
cugccggacccugggauc

SEQ ID NO: 13537 - RNA, 18 nt, Artificial Sequence
  Description of Artificial Sequence: Synthetic oligonucleotide
ugagucugccggacccug

SEQ ID NO: 13538 - RNA, 18 nt, Artificial Sequence
  Description of Artificial Sequence: Synthetic oligonucleotide
gagccugagucugccgga

SEQ ID NO: 13539 - RNA, 18 nt, Artificial Sequence
  Description of Artificial Sequence: Synthetic oligonucleotide
aaucugagccugagucug

SEQ ID NO: 13540 - RNA, 18 nt, Artificial Sequence
  Description of Artificial Sequence: Synthetic oligonucleotide
gcaggaaucugagccuga

SEQ ID NO: 13541 - RNA, 18 nt, Artificial Sequence
  Description of Artificial Sequence: Synthetic oligonucleotide
gcagagcaggaaucugag

SEQ ID NO: 13542 - RNA, 18 nt, Artificial Sequence
  Description of Artificial Sequence: Synthetic oligonucleotide
aguuugcagagcaggaau

SEQ ID NO: 13543 - RNA, 18 nt, Artificial Sequence
  Description of Artificial Sequence: Synthetic oligonucleotide
cuugcaguuugcagagca

SEQ ID NO: 13544 - RNA, 18 nt, Artificial Sequence
  Description of Artificial Sequence: Synthetic oligonucleotide
ccccacuugcaguuugca

SEQ ID NO: 13545 - RNA, 18 nt, Artificial Sequence
  Description of Artificial Sequence: Synthetic oligonucleotide
aggucccccacuugcagu

SEQ ID NO: 13546 - RNA, 18 nt, Artificial Sequence
  Description of Artificial Sequence: Synthetic oligonucleotide
gcucaaggucccccacuu

SEQ ID NO: 13547 - RNA, 18 nt, Artificial Sequence
  Description of Artificial Sequence: Synthetic oligonucleotide
cacuugcucaaggucccc

SEQ ID NO: 13548 - RNA, 18 nt, Artificial Sequence
  Description of Artificial Sequence: Synthetic oligonucleotide
cgaaccacuugcucaagg

SEQ ID NO: 13549 - RNA, 18 nt, Artificial Sequence
  Description of Artificial Sequence: Synthetic oligonucleotide
gagcucgaaccacuugcu

SEQ ID NO: 13550 - RNA, 18 nt, Artificial Sequence
  Description of Artificial Sequence: Synthetic oligonucleotide
uuggagagcucgaaccac

SEQ ID NO: 13551 - RNA, 18 nt, Artificial Sequence
  Description of Artificial Sequence: Synthetic oligonucleotide
aaugguuggagagcucga

SEQ ID NO: 13552 - RNA, 18 nt, Artificial Sequence
  Description of Artificial Sequence: Synthetic oligonucleotide
aaggaaaugguuggagag

SEQ ID NO: 13553 - RNA, 18 nt, Artificial Sequence
  Description of Artificial Sequence: Synthetic oligonucleotide
ugaguaaggaaaugguug

SEQ ID NO: 13554 - RNA, 18 nt, Artificial Sequence
  Description of Artificial Sequence: Synthetic oligonucleotide
uuugcugaguaaggaaau

SEQ ID NO: 13555 - RNA, 18 nt, Artificial Sequence
  Description of Artificial Sequence: Synthetic oligonucleotide
ccuguuuugcugaguaag

SEQ ID NO: 13556 - RNA, 18 nt, Artificial Sequence
  Description of Artificial Sequence: Synthetic oligonucleotide
cugauccuguuuugcuga

SEQ ID NO: 13557 - RNA, 18 nt, Artificial Sequence
  Description of Artificial Sequence: Synthetic oligonucleotide
uaugacugauccuguuuu

SEQ ID NO: 13558 - RNA, 18 nt, Artificial Sequence
  Description of Artificial Sequence: Synthetic oligonucleotide
augaguaugacugauccu

SEQ ID NO: 13559 - RNA, 18 nt, Artificial Sequence
  Description of Artificial Sequence: Synthetic oligonucleotide
ugugaaugaguaugacug

SEQ ID NO: 13560 - RNA, 18 nt, Artificial Sequence
  Description of Artificial Sequence: Synthetic oligonucleotide
aaggcugugaaugaguau

SEQ ID NO: 13561 - RNA, 18 nt, Artificial Sequence
  Description of Artificial Sequence: Synthetic oligonucleotide
aguucaaggcugugaaug

SEQ ID NO: 13562 - RNA, 18 nt, Artificial Sequence
  Description of Artificial Sequence: Synthetic oligonucleotide
ggccuaguucaaggcugu

SEQ ID NO: 13563 - RNA, 18 nt, Artificial Sequence
  Description of Artificial Sequence: Synthetic oligonucleotide
ucuugggccuaguucaag

SEQ ID NO: 13564 - RNA, 18 nt, Artificial Sequence
  Description of Artificial Sequence: Synthetic oligonucleotide
ccucaucuugggccuagu

SEQ ID NO: 13565 - RNA, 18 nt, Artificial Sequence
  Description of Artificial Sequence: Synthetic oligonucleotide
acagaccucaucuugggc

SEQ ID NO: 13566 - RNA, 18 nt, Artificial Sequence
  Description of Artificial Sequence: Synthetic oligonucleotide
gacugacagaccucaucu

SEQ ID NO: 13567 - RNA, 18 nt, Artificial Sequence
  Description of Artificial Sequence: Synthetic oligonucleotide
caggagacugacagaccu

SEQ ID NO: 13568 - RNA, 18 nt, Artificial Sequence
  Description of Artificial Sequence: Synthetic oligonucleotide
aaugccaggagacugaca

SEQ ID NO: 13569 - RNA, 18 nt, Artificial Sequence
  Description of Artificial Sequence: Synthetic oligonucleotide
aggccaaugccaggagac

SEQ ID NO: 13570 - RNA, 18 nt, Artificial Sequence
  Description of Artificial Sequence: Synthetic oligonucleotide
gcaugaggccaaugccag

SEQ ID NO: 13571 - RNA, 18 nt, Artificial Sequence
  Description of Artificial Sequence: Synthetic oligonucleotide
ccugggcaugaggccaau

SEQ ID NO: 13572 - RNA, 18 nt, Artificial Sequence
  Description of Artificial Sequence: Synthetic oligonucleotide
uccugccugggcaugagg

SEQ ID NO: 13573 - RNA, 18 nt, Artificial Sequence
  Description of Artificial Sequence: Synthetic oligonucleotide
cccauuccugccugggca

SEQ ID NO: 13574 - RNA, 18 nt, Artificial Sequence
  Description of Artificial Sequence: Synthetic oligonucleotide
cacugcccauuccugccu

SEQ ID NO: 13575 - RNA, 18 nt, Artificial Sequence
  Description of Artificial Sequence: Synthetic oligonucleotide
ccauucacugcccauucc

SEQ ID NO: 13576 - RNA, 18 nt, Artificial Sequence
  Description of Artificial Sequence: Synthetic oligonucleotide
gacugccauucacugccc

SEQ ID NO: 13577 - RNA, 18 nt, Artificial Sequence
  Description of Artificial Sequence: Synthetic oligonucleotide
cgauugacugccauucac

SEQ ID NO: 13578 - RNA, 18 nt, Artificial Sequence
  Description of Artificial Sequence: Synthetic oligonucleotide
ggcagcgauugacugcca

SEQ ID NO: 13579 - RNA, 18 nt, Artificial Sequence
  Description of Artificial Sequence: Synthetic oligonucleotide
gacagggcagcgauugac

SEQ ID NO: 13580 - RNA, 18 nt, Artificial Sequence
  Description of Artificial Sequence: Synthetic oligonucleotide
caccugacagggcagcga

SEQ ID NO: 13581 - RNA, 18 nt, Artificial Sequence
  Description of Artificial Sequence: Synthetic oligonucleotide
aucuccaccugacagggc

SEQ ID NO: 13582 - RNA, 18 nt, Artificial Sequence
  Description of Artificial Sequence: Synthetic oligonucleotide
uguccaucuccaccugac

SEQ ID NO: 13583 - RNA, 18 nt, Artificial Sequence
  Description of Artificial Sequence: Synthetic oligonucleotide
cugucuguccaucuccac

SEQ ID NO: 13584 - RNA, 18 nt, Artificial Sequence
  Description of Artificial Sequence: Synthetic oligonucleotide
cacagcugucuguccauc

SEQ ID NO: 13585 - RNA, 18 nt, Artificial Sequence
  Description of Artificial Sequence: Synthetic oligonucleotide
cugcucacagcugucugu

SEQ ID NO: 13586 - RNA, 18 nt, Artificial Sequence
  Description of Artificial Sequence: Synthetic oligonucleotide
agcaccugcucacagcug

SEQ ID NO: 13587 - RNA, 18 nt, Artificial Sequence
  Description of Artificial Sequence: Synthetic oligonucleotide
caggcagcaccugcucac

SEQ ID NO: 13588 - RNA, 18 nt, Artificial Sequence
  Description of Artificial Sequence: Synthetic oligonucleotide
aguuucaggcagcaccug

SEQ ID NO: 13589 - RNA, 18 nt, Artificial Sequence
  Description of Artificial Sequence: Synthetic oligonucleotide
gcaguaguuucaggcagc

SEQ ID NO: 13590 - RNA, 18 nt, Artificial Sequence
  Description of Artificial Sequence: Synthetic oligonucleotide
gucaggcaguaguuucag

SEQ ID NO: 13591 - RNA, 18 nt, Artificial Sequence
  Description of Artificial Sequence: Synthetic oligonucleotide
cagcggucaggcaguagu

SEQ ID NO: 13592 - RNA, 18 nt, Artificial Sequence
  Description of Artificial Sequence: Synthetic oligonucleotide
gaguccagcggucaggca

SEQ ID NO: 13593 - RNA, 18 nt, Artificial Sequence
  Description of Artificial Sequence: Synthetic oligonucleotide
cccuggugggugggaccu

SEQ ID NO: 13594 - RNA, 18 nt, Artificial Sequence
  Description of Artificial Sequence: Synthetic oligonucleotide
uacugcccuggugggugg

SEQ ID NO: 13595 - RNA, 18 nt, Artificial Sequence
  Description of Artificial Sequence: Synthetic oligonucleotide
guugguacugcccuggug

SEQ ID NO: 13596 - RNA, 18 nt, Artificial Sequence
  Description of Artificial Sequence: Synthetic oligonucleotide
agccaguugguacugccc

SEQ ID NO: 13597 - RNA, 18 nt, Artificial Sequence
  Description of Artificial Sequence: Synthetic oligonucleotide
gagccagccaguugguac

SEQ ID NO: 13598 - RNA, 18 nt, Artificial Sequence
  Description of Artificial Sequence: Synthetic oligonucleotide
ucugggagccagccaguu

SEQ ID NO: 13599 - RNA, 18 nt, Artificial Sequence
  Description of Artificial Sequence: Synthetic oligonucleotide
ugaccucugggagccagc

SEQ ID NO: 13600 - RNA, 18 nt, Artificial Sequence
  Description of Artificial Sequence: Synthetic oligonucleotide
uccacugaccucugggag

SEQ ID NO: 13601 - RNA, 18 nt, Artificial Sequence
  Description of Artificial Sequence: Synthetic oligonucleotide
gagaauccacugaccucu

SEQ ID NO: 13602 - RNA, 18 nt, Artificial Sequence
  Description of Artificial Sequence: Synthetic oligonucleotide
ccugggagaauccacuga

SEQ ID NO: 13603 - RNA, 18 nt, Artificial Sequence
  Description of Artificial Sequence: Synthetic oligonucleotide
agcccccugggagaaucc

SEQ ID NO: 13604 - RNA, 18 nt, Artificial Sequence
  Description of Artificial Sequence: Synthetic oligonucleotide
ggcaaagcccccugggag

SEQ ID NO: 13605 - RNA, 18 nt, Artificial Sequence
  Description of Artificial Sequence: Synthetic oligonucleotide
ugauaggcaaagcccccu

SEQ ID NO: 13606 - RNA, 18 nt, Artificial Sequence
  Description of Artificial Sequence: Synthetic oligonucleotide
gaaguugauaggcaaagc

SEQ ID NO: 13607 - RNA, 18 nt, Artificial Sequence
  Description of Artificial Sequence: Synthetic oligonucleotide
gagaggaaguugauaggc

SEQ ID NO: 13608 - RNA, 18 nt, Artificial Sequence
  Description of Artificial Sequence: Synthetic oligonucleotide
ccugggagaggaaguuga

SEQ ID NO: 13609 - RNA, 18 nt, Artificial Sequence
  Description of Artificial Sequence: Synthetic oligonucleotide
uggugccugggagaggaa

SEQ ID NO: 13610 - RNA, 18 nt, Artificial Sequence
  Description of Artificial Sequence: Synthetic oligonucleotide
aagcauggugccugggag

SEQ ID NO: 13611 - RNA, 18 nt, Artificial Sequence
  Description of Artificial Sequence: Synthetic oligonucleotide
guggaaagcauggugccu

SEQ ID NO: 13612 - RNA, 18 nt, Artificial Sequence
  Description of Artificial Sequence: Synthetic oligonucleotide
cauguguggaaagcaugg

SEQ ID NO: 13613 - RNA, 18 nt, Artificial Sequence
  Description of Artificial Sequence: Synthetic oligonucleotide
gggaccauguguggaaag

SEQ ID NO: 13614 - RNA, 18 nt, Artificial Sequence
  Description of Artificial Sequence: Synthetic oligonucleotide
gggccagaguugguaggg

SEQ ID NO: 13615 - RNA, 18 nt, Artificial Sequence
  Description of Artificial Sequence: Synthetic oligonucleotide
ggaaaggcugaaaauggg

SEQ ID NO: 13616 - RNA, 18 nt, Artificial Sequence
  Description of Artificial Sequence: Synthetic oligonucleotide
ggcagggaaaggcugaaa

SEQ ID NO: 13617 - RNA, 18 nt, Artificial Sequence
  Description of Artificial Sequence: Synthetic oligonucleotide
ggcaaggcagggaaaggc

SEQ ID NO: 13618 - RNA, 18 nt, Artificial Sequence
  Description of Artificial Sequence: Synthetic oligonucleotide
aacauggcaaggcaggga

SEQ ID NO: 13619 - RNA, 18 nt, Artificial Sequence
  Description of Artificial Sequence: Synthetic oligonucleotide
uuccaaacauggcaaggc

SEQ ID NO: 13620 - RNA, 18 nt, Artificial Sequence
  Description of Artificial Sequence: Synthetic oligonucleotide
agaaauuccaaacauggc

SEQ ID NO: 13621 - RNA, 18 nt, Artificial Sequence
  Description of Artificial Sequence: Synthetic oligonucleotide
gggagagaaauuccaaac

SEQ ID NO: 13622 - RNA, 18 nt, Artificial Sequence
  Description of Artificial Sequence: Synthetic oligonucleotide
agccagggagagaaauuc

SEQ ID NO: 13623 - RNA, 18 nt, Artificial Sequence
  Description of Artificial Sequence: Synthetic oligonucleotide
ggugaagccagggagaga

SEQ ID NO: 13624 - RNA, 18 nt, Artificial Sequence
  Description of Artificial Sequence: Synthetic oligonucleotide
cuccaggugaagccaggg

SEQ ID NO: 13625 - RNA, 18 nt, Artificial Sequence
  Description of Artificial Sequence: Synthetic oligonucleotide
uuaaacuccaggugaagc

SEQ ID NO: 13626 - RNA, 18 nt, Artificial Sequence
  Description of Artificial Sequence: Synthetic oligonucleotide
cacucuuaaacuccaggu

SEQ ID NO: 13627 - RNA, 18 nt, Artificial Sequence
  Description of Artificial Sequence: Synthetic oligonucleotide
uaauucacucuuaaacuc

SEQ ID NO: 13628 - RNA, 18 nt, Artificial Sequence
  Description of Artificial Sequence: Synthetic oligonucleotide
guuucuaauucacucuua

SEQ ID NO: 13629 - RNA, 18 nt, Artificial Sequence
  Description of Artificial Sequence: Synthetic oligonucleotide
gcugcguuucuaauucac

SEQ ID NO: 13630 - RNA, 18 nt, Artificial Sequence
  Description of Artificial Sequence: Synthetic oligonucleotide
gggcagcugcguuucuaa

SEQ ID NO: 13631 - RNA, 18 nt, Artificial Sequence
  Description of Artificial Sequence: Synthetic oligonucleotide
gugaugggcagcugcguu

SEQ ID NO: 13632 - RNA, 18 nt, Artificial Sequence
  Description of Artificial Sequence: Synthetic oligonucleotide
ugcaggugaugggcagcu

SEQ ID NO: 13633 - RNA, 18 nt, Artificial Sequence
  Description of Artificial Sequence: Synthetic oligonucleotide
ccaucugcaggugauggg

SEQ ID NO: 13634 - RNA, 18 nt, Artificial Sequence
  Description of Artificial Sequence: Synthetic oligonucleotide
cagagccaucugcaggug

SEQ ID NO: 13635 - RNA, 18 nt, Artificial Sequence
  Description of Artificial Sequence: Synthetic oligonucleotide
gggugcagagccaucugc

SEQ ID NO: 13636 - RNA, 18 nt, Artificial Sequence
  Description of Artificial Sequence: Synthetic oligonucleotide
caucagggugcagagcca

SEQ ID NO: 13637 - RNA, 18 nt, Artificial Sequence
  Description of Artificial Sequence: Synthetic oligonucleotide
cucaccaucagggugcag

SEQ ID NO: 13638 - RNA, 18 nt, Artificial Sequence
  Description of Artificial Sequence: Synthetic oligonucleotide
gcugccucaccaucaggg

SEQ ID NO: 13639 - RNA, 18 nt, Artificial Sequence
  Description of Artificial Sequence: Synthetic oligonucleotide
aacgagcugccucaccau

SEQ ID NO: 13640 - RNA, 18 nt, Artificial Sequence
  Description of Artificial Sequence: Synthetic oligonucleotide
caaggaacgagcugccuc

SEQ ID NO: 13641 - RNA, 18 nt, Artificial Sequence
  Description of Artificial Sequence: Synthetic oligonucleotide
ugcaccaaggaacgagcu

SEQ ID NO: 13642 - RNA, 18 nt, Artificial Sequence
  Description of Artificial Sequence: Synthetic oligonucleotide
caggcugcaccaaggaac

SEQ ID NO: 13643 - RNA, 18 nt, Artificial Sequence
  Description of Artificial Sequence: Synthetic oligonucleotide
ggucccaggcugcaccaa

SEQ ID NO: 13644 - RNA, 18 nt, Artificial Sequence
  Description of Artificial Sequence: Synthetic oligonucleotide
ggcagggucccaggcugc

SEQ ID NO: 13645 - RNA, 18 nt, Artificial Sequence
  Description of Artificial Sequence: Synthetic oligonucleotide
gcucaggcagggucccag

SEQ ID NO: 13646 - RNA, 18 nt, Artificial Sequence
  Description of Artificial Sequence: Synthetic oligonucleotide
cucuggcucaggcagggu

SEQ ID NO: 13647 - RNA, 18 nt, Artificial Sequence
  Description of Artificial Sequence: Synthetic oligonucleotide
acauccucuggcucaggc

SEQ ID NO: 13648 - RNA, 18 nt, Artificial Sequence
  Description of Artificial Sequence: Synthetic oligonucleotide
aaaacacauccucuggcu

SEQ ID NO: 13649 - RNA, 18 nt, Artificial Sequence
  Description of Artificial Sequence: Synthetic oligonucleotide
uaaacaaaacacauccuc

SEQ ID NO: 13650 - RNA, 18 nt, Artificial Sequence
  Description of Artificial Sequence: Synthetic oligonucleotide
guggauaaacaaaacaca

SEQ ID NO: 13651 - RNA, 18 nt, Artificial Sequence
  Description of Artificial Sequence: Synthetic oligonucleotide
gggcuguggauaaacaaa

SEQ ID NO: 13652 - RNA, 18 nt, Artificial Sequence
  Description of Artificial Sequence: Synthetic oligonucleotide
gccugggagauauuuggg

SEQ ID NO: 13653 - RNA, 18 nt, Artificial Sequence
  Description of Artificial Sequence: Synthetic oligonucleotide
aggccugggagauauuug

SEQ ID NO: 13654 - RNA, 18 nt, Artificial Sequence
  Description of Artificial Sequence: Synthetic oligonucleotide
gcaauaggccugggagau

SEQ ID NO: 13655 - RNA, 18 nt, Artificial Sequence
  Description of Artificial Sequence: Synthetic oligonucleotide
ccgucgcaauaggccugg

SEQ ID NO: 13656 - RNA, 18 nt, Artificial Sequence
  Description of Artificial Sequence: Synthetic oligonucleotide
gggucccgucgcaauagg

SEQ ID NO: 13657 - RNA, 18 nt, Artificial Sequence
  Description of Artificial Sequence: Synthetic oligonucleotide
uaguggaagcagggaggg

SEQ ID NO: 13658 - RNA, 18 nt, Artificial Sequence
  Description of Artificial Sequence: Synthetic oligonucleotide
auaguggaagcagggagg

SEQ ID NO: 13659 - RNA, 18 nt, Artificial Sequence
  Description of Artificial Sequence: Synthetic oligonucleotide
uggguauaguggaagcag

SEQ ID NO: 13660 - RNA, 18 nt, Artificial Sequence
  Description of Artificial Sequence: Synthetic oligonucleotide
uggucuggguauagugga

SEQ ID NO: 13661 - RNA, 18 nt, Artificial Sequence
  Description of Artificial Sequence: Synthetic oligonucleotide
aacccuggucuggguaua

SEQ ID NO: 13662 - RNA, 18 nt, Artificial Sequence
  Description of Artificial Sequence: Synthetic oligonucleotide
uccccaacccuggucugg

SEQ ID NO: 13663 - RNA, 18 nt, Artificial Sequence
  Description of Artificial Sequence: Synthetic oligonucleotide
cccccuccccaacccugg

SEQ ID NO: 13664 - RNA, 18 nt, Artificial Sequence
  Description of Artificial Sequence: Synthetic oligonucleotide
cccaccccccuccccaac

SEQ ID NO: 13665 - RNA, 18 nt, Artificial Sequence
  Description of Artificial Sequence: Synthetic oligonucleotide
cugcacccaccccccucc

SEQ ID NO: 13666 - RNA, 18 nt, Artificial Sequence
  Description of Artificial Sequence: Synthetic oligonucleotide
cagaucugcacccacccc

SEQ ID NO: 13667 - RNA, 18 nt, Artificial Sequence
  Description of Artificial Sequence: Synthetic oligonucleotide
auucccagaucugcaccc

SEQ ID NO: 13668 - RNA, 18 nt, Artificial Sequence
  Description of Artificial Sequence: Synthetic oligonucleotide
ucucgauucccagaucug

SEQ ID NO: 13669 - RNA, 18 nt, Artificial Sequence
  Description of Artificial Sequence: Synthetic oligonucleotide
gcgcuucucgauucccag

SEQ ID NO: 13670 - RNA, 18 nt, Artificial Sequence
  Description of Artificial Sequence: Synthetic oligonucleotide
uuccugcgcuucucgauu

SEQ ID NO: 13671 - RNA, 18 nt, Artificial Sequence
  Description of Artificial Sequence: Synthetic oligonucleotide
uuccuuuccugcgcuucu

SEQ ID NO: 13672 - RNA, 18 nt, Artificial Sequence
  Description of Artificial Sequence: Synthetic oligonucleotide
aacacuuccuuuccugcg

SEQ ID NO: 13673 - RNA, 18 nt, Artificial Sequence
  Description of Artificial Sequence: Synthetic oligonucleotide
uuuccaacacuuccuuuc

SEQ ID NO: 13674 - RNA, 18 nt, Artificial Sequence
  Description of Artificial Sequence: Synthetic oligonucleotide
ucugguuuccaacacuuc

SEQ ID NO: 13675 - RNA, 18 nt, Artificial Sequence
  Description of Artificial Sequence: Synthetic oligonucleotide
ccaguucugguuuccaac

SEQ ID NO: 13676 - RNA, 18 nt, Artificial Sequence
  Description of Artificial Sequence: Synthetic oligonucleotide
gcuugccaguucugguuu

SEQ ID NO: 13677 - RNA, 18 nt, Artificial Sequence
  Description of Artificial Sequence: Synthetic oligonucleotide
agugagcuugccaguucu

SEQ ID NO: 13678 - RNA, 18 nt, Artificial Sequence
  Description of Artificial Sequence: Synthetic oligonucleotide
aagacagugagcuugcca

SEQ ID NO: 13679 - RNA, 18 nt, Artificial Sequence
  Description of Artificial Sequence: Synthetic oligonucleotide
gugaggauguguguggau

SEQ ID NO: 13680 - RNA, 18 nt, Artificial Sequence
  Description of Artificial Sequence: Synthetic oligonucleotide
gggugaggaugugugugg

SEQ ID NO: 13681 - RNA, 18 nt, Artificial Sequence
  Description of Artificial Sequence: Synthetic oligonucleotide
uccagcaguuucuguggg

SEQ ID NO: 13682 - RNA, 18 nt, Artificial Sequence
  Description of Artificial Sequence: Synthetic oligonucleotide
guguguccagcaguuucu

SEQ ID NO: 13683 - RNA, 18 nt, Artificial Sequence
  Description of Artificial Sequence: Synthetic oligonucleotide
cuucaguguguccagcag

SEQ ID NO: 13684 - RNA, 18 nt, Artificial Sequence
  Description of Artificial Sequence: Synthetic oligonucleotide
aguuucuucagugugucc

SEQ ID NO: 13685 - RNA, 18 nt, Artificial Sequence
  Description of Artificial Sequence: Synthetic oligonucleotide
uauucaguuucuucagug

SEQ ID NO: 13686 - RNA, 18 nt, Artificial Sequence
  Description of Artificial Sequence: Synthetic oligonucleotide
uguuuuauucaguuucuu

SEQ ID NO: 13687 - RNA, 18 nt, Artificial Sequence
  Description of Artificial Sequence: Synthetic oligonucleotide
ucaucuguuuuauucagu

SEQ ID NO: 13688 - RNA, 18 nt, Artificial Sequence
  Description of Artificial Sequence: Synthetic oligonucleotide
uuucuucaucuguuuuau

SEQ ID NO: 13689 - RNA, 18 nt, Artificial Sequence
  Description of Artificial Sequence: Synthetic oligonucleotide
gcuuauuucuucaucugu

SEQ ID NO: 13690 - RNA, 18 nt, Artificial Sequence
  Description of Artificial Sequence: Synthetic oligonucleotide
uaacugcuuauuucuuca

SEQ ID NO: 13691 - RNA, 18 nt, Artificial Sequence
  Description of Artificial Sequence: Synthetic oligonucleotide
uuuuuuaacugcuuauuu

SEQ ID NO: 13692 - RNA, 18 nt, Artificial Sequence
  Description of Artificial Sequence: Synthetic oligonucleotide
cuuauuuuuuuaacugcu

SEQ ID NO: 13693 - RNA, 18 nt, Artificial Sequence
  Description of Artificial Sequence: Synthetic oligonucleotide
ggcgacuuauuuuuuuaa

SEQ ID NO: 13694 - RNA, 18 nt, Artificial Sequence
  Description of Artificial Sequence: Synthetic oligonucleotide
gggcgacuuauuuuuuua

SEQ ID NO: 13695 - RNA, 18 nt, Artificial Sequence
  Description of Artificial Sequence: Synthetic oligonucleotide
ggagcgcugugggauggg

SEQ ID NO: 13696 - RNA, 18 nt, Artificial Sequence
  Description of Artificial Sequence: Synthetic oligonucleotide
gcugcggagcgcuguggg

SEQ ID NO: 13697 - RNA, 18 nt, Artificial Sequence
  Description of Artificial Sequence: Synthetic oligonucleotide
gggaagcugcggagcgcu

SEQ ID NO: 13698 - RNA, 18 nt, Artificial Sequence
  Description of Artificial Sequence: Synthetic oligonucleotide
guggugggaagcugcgga

SEQ ID NO: 13699 - RNA, 18 nt, Artificial Sequence
  Description of Artificial Sequence: Synthetic oligonucleotide
gggcgguggugggaagcu

SEQ ID NO: 13700 - RNA, 18 nt, Artificial Sequence
  Description of Artificial Sequence: Synthetic oligonucleotide
gaggcgggcggugguggg

SEQ ID NO: 13701 - RNA, 18 nt, Artificial Sequence
  Description of Artificial Sequence: Synthetic oligonucleotide
gaacugaggcgggcggug

SEQ ID NO: 13702 - RNA, 18 nt, Artificial Sequence
  Description of Artificial Sequence: Synthetic oligonucleotide
caaaggaacugaggcggg

SEQ ID NO: 13703 - RNA, 18 nt, Artificial Sequence
  Description of Artificial Sequence: Synthetic oligonucleotide
agacgcaaaggaacugag

SEQ ID NO: 13704 - RNA, 18 nt, Artificial Sequence
  Description of Artificial Sequence: Synthetic oligonucleotide
gcaacagacgcaaaggaa

SEQ ID NO: 13705 - RNA, 18 nt, Artificial Sequence
  Description of Artificial Sequence: Synthetic oligonucleotide
gggaggcaacagacgcaa

SEQ ID NO: 13706 - RNA, 18 nt, Artificial Sequence
  Description of Artificial Sequence: Synthetic oligonucleotide
agccagggcgugcagggc

SEQ ID NO: 13707 - RNA, 18 nt, Artificial Sequence
  Description of Artificial Sequence: Synthetic oligonucleotide
gugccagccagggcgugc

SEQ ID NO: 13708 - RNA, 18 nt, Artificial Sequence
  Description of Artificial Sequence: Synthetic oligonucleotide
caacagugccagccaggg

SEQ ID NO: 13709 - RNA, 18 nt, Artificial Sequence
  Description of Artificial Sequence: Synthetic oligonucleotide
agcggcaacagugccagc

SEQ ID NO: 13710 - RNA, 18 nt, Artificial Sequence
  Description of Artificial Sequence: Synthetic oligonucleotide
aaugcagcggcaacagug

SEQ ID NO: 13711 - RNA, 18 nt, Artificial Sequence
  Description of Artificial Sequence: Synthetic oligonucleotide
acgagaaugcagcggcaa

SEQ ID NO: 13712 - RNA, 18 nt, Artificial Sequence
  Description of Artificial Sequence: Synthetic oligonucleotide
ugaacacgagaaugcagc

SEQ ID NO: 13713 - RNA, 18 nt, Artificial Sequence
  Description of Artificial Sequence: Synthetic oligonucleotide
aucacugaacacgagaau

SEQ ID NO: 13714 - RNA, 18 nt, Artificial Sequence
  Description of Artificial Sequence: Synthetic oligonucleotide
agggcaucacugaacacg

SEQ ID NO: 13715 - RNA, 18 nt, Artificial Sequence
  Description of Artificial Sequence: Synthetic oligonucleotide
agaagagggcaucacuga

SEQ ID NO: 13716 - RNA, 18 nt, Artificial Sequence
  Description of Artificial Sequence: Synthetic oligonucleotide
aaacaagaagagggcauc

SEQ ID NO: 13717 - RNA, 18 nt, Artificial Sequence
  Description of Artificial Sequence: Synthetic oligonucleotide
guuucaaacaagaagagg

SEQ ID NO: 13718 - RNA, 18 nt, Artificial Sequence
  Description of Artificial Sequence: Synthetic oligonucleotide
cuuuuguuucaaacaaga

SEQ ID NO: 13719 - RNA, 18 nt, Artificial Sequence
  Description of Artificial Sequence: Synthetic oligonucleotide
auuuucuuuuguuucaaa

SEQ ID NO: 13720 - RNA, 18 nt, Artificial Sequence
  Description of Artificial Sequence: Synthetic oligonucleotide
gcauuauuuucuuuuguu

SEQ ID NO: 13721 - RNA, 18 nt, Artificial Sequence
  Description of Artificial Sequence: Synthetic oligonucleotide
acaaugcauuauuuucuu

SEQ ID NO: 13722 - RNA, 18 nt, Artificial Sequence
  Description of Artificial Sequence: Synthetic oligonucleotide
aaaacacaaugcauuauu

SEQ ID NO: 13723 - RNA, 18 nt, Artificial Sequence
  Description of Artificial Sequence: Synthetic oligonucleotide
uuuaaaaaacacaaugca

SEQ ID NO: 13724 - RNA, 18 nt, Artificial Sequence
  Description of Artificial Sequence: Synthetic oligonucleotide
cucuuuuuaaaaaacaca

SEQ ID NO: 13725 - RNA, 18 nt, Artificial Sequence
  Description of Artificial Sequence: Synthetic oligonucleotide
agauacucuuuuuaaaaa

SEQ ID NO: 13726 - RNA, 18 nt, Artificial Sequence
  Description of Artificial Sequence: Synthetic oligonucleotide
guauaagauacucuuuuu

SEQ ID NO: 13727 - RNA, 18 nt, Artificial Sequence
  Description of Artificial Sequence: Synthetic oligonucleotide
uacauguauaagauacuc

SEQ ID NO: 13728 - RNA, 18 nt, Artificial Sequence
  Description of Artificial Sequence: Synthetic oligonucleotide
uaggauacauguauaaga

SEQ ID NO: 13729 - RNA, 18 nt, Artificial Sequence
  Description of Artificial Sequence: Synthetic oligonucleotide
cuuuuuaggauacaugua

SEQ ID NO: 13730 - RNA, 18 nt, Artificial Sequence
  Description of Artificial Sequence: Synthetic oligonucleotide
cuucucuuuuuaggauac

SEQ ID NO: 13731 - RNA, 18 nt, Artificial Sequence
  Description of Artificial Sequence: Synthetic oligonucleotide
augagcuucucuuuuuag

SEQ ID NO: 13732 - RNA, 18 nt, Artificial Sequence
  Description of Artificial Sequence: Synthetic oligonucleotide
ugcacaugagcuucucuu

SEQ ID NO: 13733 - RNA, 18 nt, Artificial Sequence
  Description of Artificial Sequence: Synthetic oligonucleotide
ccaauugcacaugagcuu

SEQ ID NO: 13734 - RNA, 18 nt, Artificial Sequence
  Description of Artificial Sequence: Synthetic oligonucleotide
gugcaccaauugcacaug

SEQ ID NO: 13735 - RNA, 18 nt, Artificial Sequence
  Description of Artificial Sequence: Synthetic oligonucleotide
cugcugugcaccaauugc

SEQ ID NO: 13736 - RNA, 18 nt, Artificial Sequence
  Description of Artificial Sequence: Synthetic oligonucleotide
uucuccugcugugcacca

SEQ ID NO: 13737 - RNA, 18 nt, Artificial Sequence
  Description of Artificial Sequence: Synthetic oligonucleotide
gaaauuucuccugcugug

SEQ ID NO: 13738 - RNA, 18 nt, Artificial Sequence
  Description of Artificial Sequence: Synthetic oligonucleotide
guccagaaauuucuccug

SEQ ID NO: 13739 - RNA, 18 nt, Artificial Sequence
  Description of Artificial Sequence: Synthetic oligonucleotide
uaacaguccagaaauuuc

SEQ ID NO: 13740 - RNA, 18 nt, Artificial Sequence
  Description of Artificial Sequence: Synthetic oligonucleotide
cauccuaacaguccagaa

SEQ ID NO: 13741 - RNA, 18 nt, Artificial Sequence
  Description of Artificial Sequence: Synthetic oligonucleotide
ccauucauccuaacaguc

SEQ ID NO: 13742 - RNA, 18 nt, Artificial Sequence
  Description of Artificial Sequence: Synthetic oligonucleotide
ggcguccauucauccuaa

SEQ ID NO: 13743 - RNA, 18 nt, Artificial Sequence
  Description of Artificial Sequence: Synthetic oligonucleotide
gagaaggcguccauucau

SEQ ID NO: 13744 - RNA, 18 nt, Artificial Sequence
  Description of Artificial Sequence: Synthetic oligonucleotide
gggagaaggcguccauuc

SEQ ID NO: 13745 - RNA, 18 nt, Artificial Sequence
  Description of Artificial Sequence: Synthetic oligonucleotide
caaaucuuaaauaacggg

SEQ ID NO: 13746 - RNA, 18 nt, Artificial Sequence
  Description of Artificial Sequence: Synthetic oligonucleotide
ggucacaaaucuuaaaua

SEQ ID NO: 13747 - RNA, 18 nt, Artificial Sequence
  Description of Artificial Sequence: Synthetic oligonucleotide
uacaaggucacaaaucuu

SEQ ID NO: 13748 - RNA, 18 nt, Artificial Sequence
  Description of Artificial Sequence: Synthetic oligonucleotide
uuauguacaaggucacaa

SEQ ID NO: 13749 - RNA, 18 nt, Artificial Sequence
  Description of Artificial Sequence: Synthetic oligonucleotide
caggguuauguacaaggu

SEQ ID NO: 13750 - RNA, 18 nt, Artificial Sequence
  Description of Artificial Sequence: Synthetic oligonucleotide
ucacccaggguuauguac

SEQ ID NO: 13751 - RNA, 18 nt, Artificial Sequence
  Description of Artificial Sequence: Synthetic oligonucleotide
gcacgucacccaggguua

SEQ ID NO: 13752 - RNA, 18 nt, Artificial Sequence
  Description of Artificial Sequence: Synthetic oligonucleotide
aaugugcacgucacccag

SEQ ID NO: 13753 - RNA, 18 nt, Artificial Sequence
  Description of Artificial Sequence: Synthetic oligonucleotide
caagcaaugugcacguca

SEQ ID NO: 13754 - RNA, 18 nt, Artificial Sequence
  Description of Artificial Sequence: Synthetic oligonucleotide
auacccaagcaaugugca

SEQ ID NO: 13755 - RNA, 18 nt, Artificial Sequence
  Description of Artificial Sequence: Synthetic oligonucleotide
guuccauacccaagcaau

SEQ ID NO: 13756 - RNA, 18 nt, Artificial Sequence
  Description of Artificial Sequence: Synthetic oligonucleotide
cuaccguuccauacccaa

SEQ ID NO: 13757 - RNA, 18 nt, Artificial Sequence
  Description of Artificial Sequence: Synthetic oligonucleotide
aauuucuaccguuccaua

SEQ ID NO: 13758 - RNA, 18 nt, Artificial Sequence
  Description of Artificial Sequence: Synthetic oligonucleotide
acccaaauuucuaccguu

SEQ ID NO: 13759 - RNA, 18 nt, Artificial Sequence
  Description of Artificial Sequence: Synthetic oligonucleotide
aaaacacccaaauuucua

SEQ ID NO: 13760 - RNA, 18 nt, Artificial Sequence
  Description of Artificial Sequence: Synthetic oligonucleotide
uuuuaaaaacacccaaau

SEQ ID NO: 13761 - RNA, 18 nt, Artificial Sequence
  Description of Artificial Sequence: Synthetic oligonucleotide
caagguuuuaaaaacacc

SEQ ID NO: 13762 - RNA, 18 nt, Artificial Sequence
  Description of Artificial Sequence: Synthetic oligonucleotide
ccaaacaagguuuuaaaa

SEQ ID NO: 13763 - RNA, 18 nt, Artificial Sequence
  Description of Artificial Sequence: Synthetic oligonucleotide
caaccccaaacaagguuu

SEQ ID NO: 13764 - RNA, 18 nt, Artificial Sequence
  Description of Artificial Sequence: Synthetic oligonucleotide
aggaacaaccccaaacaa

SEQ ID NO: 13765 - RNA, 18 nt, Artificial Sequence
  Description of Artificial Sequence: Synthetic oligonucleotide
aggacaggaacaacccca

SEQ ID NO: 13766 - RNA, 18 nt, Artificial Sequence
  Description of Artificial Sequence: Synthetic oligonucleotide
caacaaggacaggaacaa

SEQ ID NO: 13767 - RNA, 18 nt, Artificial Sequence
  Description of Artificial Sequence: Synthetic oligonucleotide
auucucaacaaggacagg

SEQ ID NO: 13768 - RNA, 18 nt, Artificial Sequence
  Description of Artificial Sequence: Synthetic oligonucleotide
cuaugauucucaacaagg

SEQ ID NO: 13769 - RNA, 18 nt, Artificial Sequence
  Description of Artificial Sequence: Synthetic oligonucleotide
caucucuaugauucucaa

SEQ ID NO: 13770 - RNA, 18 nt, Artificial Sequence
  Description of Artificial Sequence: Synthetic oligonucleotide
acagacaucucuaugauu

SEQ ID NO: 13771 - RNA, 18 nt, Artificial Sequence
  Description of Artificial Sequence: Synthetic oligonucleotide
agaacacagacaucucua

SEQ ID NO: 13772 - RNA, 18 nt, Artificial Sequence
  Description of Artificial Sequence: Synthetic oligonucleotide
cuccaagaacacagacau

SEQ ID NO: 13773 - RNA, 18 nt, Artificial Sequence
  Description of Artificial Sequence: Synthetic oligonucleotide
aaauacuccaagaacaca

SEQ ID NO: 13774 - RNA, 18 nt, Artificial Sequence
  Description of Artificial Sequence: Synthetic oligonucleotide
gugugaaauacuccaaga

SEQ ID NO: 13775 - RNA, 18 nt, Artificial Sequence
  Description of Artificial Sequence: Synthetic oligonucleotide
ccucagugugaaauacuc

SEQ ID NO: 13776 - RNA, 18 nt, Artificial Sequence
  Description of Artificial Sequence: Synthetic oligonucleotide
uuaguccucagugugaaa

SEQ ID NO: 13777 - RNA, 18 nt, Artificial Sequence
  Description of Artificial Sequence: Synthetic oligonucleotide
gcagauuaguccucagug

SEQ ID NO: 13778 - RNA, 18 nt, Artificial Sequence
  Description of Artificial Sequence: Synthetic oligonucleotide
agauagcagauuaguccu

SEQ ID NO: 13779 - RNA, 18 nt, Artificial Sequence
  Description of Artificial Sequence: Synthetic oligonucleotide
aaugaagauagcagauua

SEQ ID NO: 13780 - RNA, 18 nt, Artificial Sequence
  Description of Artificial Sequence: Synthetic oligonucleotide
acuggaaugaagauagca

SEQ ID NO: 13781 - RNA, 18 nt, Artificial Sequence
  Description of Artificial Sequence: Synthetic oligonucleotide
uagggacuggaaugaaga

SEQ ID NO: 13782 - RNA, 18 nt, Artificial Sequence
  Description of Artificial Sequence: Synthetic oligonucleotide
ggguagggacuggaauga

SEQ ID NO: 13783 - RNA, 18 nt, Artificial Sequence
  Description of Artificial Sequence: Synthetic oligonucleotide
gagagcaggcacugaggg

SEQ ID NO: 13784 - RNA, 18 nt, Artificial Sequence
  Description of Artificial Sequence: Synthetic oligonucleotide
uggaugagagcaggcacu

SEQ ID NO: 13785 - RNA, 18 nt, Artificial Sequence
  Description of Artificial Sequence: Synthetic oligonucleotide
uuauuuggaugagagcag

SEQ ID NO: 13786 - RNA, 18 nt, Artificial Sequence
  Description of Artificial Sequence: Synthetic oligonucleotide
ccagguuauuuggaugag

SEQ ID NO: 13787 - RNA, 18 nt, Artificial Sequence
  Description of Artificial Sequence: Synthetic oligonucleotide
accucccagguuauuugg

SEQ ID NO: 13788 - RNA, 18 nt, Artificial Sequence
  Description of Artificial Sequence: Synthetic oligonucleotide
uugucaccucccagguua

SEQ ID NO: 13789 - RNA, 18 nt, Artificial Sequence
  Description of Artificial Sequence: Synthetic oligonucleotide
ccugauugucaccuccca

SEQ ID NO: 13790 - RNA, 18 nt, Artificial Sequence
  Description of Artificial Sequence: Synthetic oligonucleotide
gauauccugauugucacc

SEQ ID NO: 13791 - RNA, 18 nt, Artificial Sequence
  Description of Artificial Sequence: Synthetic oligonucleotide
ccugagauauccugauug

SEQ ID NO: 13792 - RNA, 18 nt, Artificial Sequence
  Description of Artificial Sequence: Synthetic oligonucleotide
gaccuccugagauauccu

SEQ ID NO: 13793 - RNA, 18 nt, Artificial Sequence
  Description of Artificial Sequence: Synthetic oligonucleotide
ccuuggaccuccugagau

SEQ ID NO: 13794 - RNA, 18 nt, Artificial Sequence
  Description of Artificial Sequence: Synthetic oligonucleotide
uuccaccuuggaccuccu

SEQ ID NO: 13795 - RNA, 18 nt, Artificial Sequence
  Description of Artificial Sequence: Synthetic oligonucleotide
gucuguuccaccuuggac

SEQ ID NO: 13796 - RNA, 18 nt, Artificial Sequence
  Description of Artificial Sequence: Synthetic oligonucleotide
aagaggucuguuccaccu

SEQ ID NO: 13797 - RNA, 18 nt, Artificial Sequence
  Description of Artificial Sequence: Synthetic oligonucleotide
aggcaaagaggucuguuc

SEQ ID NO: 13798 - RNA, 18 nt, Artificial Sequence
  Description of Artificial Sequence: Synthetic oligonucleotide
gggaaaggcaaagagguc

SEQ ID NO: 13799 - RNA, 18 nt, Artificial Sequence
  Description of Artificial Sequence: Synthetic oligonucleotide
acgcugggaaaggcaaag

SEQ ID NO: 13800 - RNA, 18 nt, Artificial Sequence
  Description of Artificial Sequence: Synthetic oligonucleotide
augagacgcugggaaagg

SEQ ID NO: 13801 - RNA, 18 nt, Artificial Sequence
  Description of Artificial Sequence: Synthetic oligonucleotide
ggguaugagacgcuggga

SEQ ID NO: 13802 - RNA, 18 nt, Artificial Sequence
  Description of Artificial Sequence: Synthetic oligonucleotide
cacagcugcacuaccggg

SEQ ID NO: 13803 - RNA, 18 nt, Artificial Sequence
  Description of Artificial Sequence: Synthetic oligonucleotide
ccacccacagcugcacua

SEQ ID NO: 13804 - RNA, 18 nt, Artificial Sequence
  Description of Artificial Sequence: Synthetic oligonucleotide
agccuccacccacagcug

SEQ ID NO: 13805 - RNA, 18 nt, Artificial Sequence
  Description of Artificial Sequence: Synthetic oligonucleotide
accccagccuccacccac

SEQ ID NO: 13806 - RNA, 18 nt, Artificial Sequence
  Description of Artificial Sequence: Synthetic oligonucleotide
cagacaccccagccucca

SEQ ID NO: 13807 - RNA, 18 nt, Artificial Sequence
  Description of Artificial Sequence: Synthetic oligonucleotide
ucgugcagacaccccagc

SEQ ID NO: 13808 - RNA, 18 nt, Artificial Sequence
  Description of Artificial Sequence: Synthetic oligonucleotide
ugacuucgugcagacacc

SEQ ID NO: 13809 - RNA, 18 nt, Artificial Sequence
  Description of Artificial Sequence: Synthetic oligonucleotide
uggccugacuucgugcag

SEQ ID NO: 13810 - RNA, 18 nt, Artificial Sequence
  Description of Artificial Sequence: Synthetic oligonucleotide
gacgcuggccugacuucg

SEQ ID NO: 13811 - RNA, 18 nt, Artificial Sequence
  Description of Artificial Sequence: Synthetic oligonucleotide
aggaggacgcuggccuga

SEQ ID NO: 13812 - RNA, 18 nt, Artificial Sequence
  Description of Artificial Sequence: Synthetic oligonucleotide
uguggaggaggacgcugg

SEQ ID NO: 13813 - RNA, 18 nt, Artificial Sequence
  Description of Artificial Sequence: Synthetic oligonucleotide
caggcuguggaggaggac

SEQ ID NO: 13814 - RNA, 18 nt, Artificial Sequence
  Description of Artificial Sequence: Synthetic oligonucleotide
agugacaggcuguggagg

SEQ ID NO: 13815 - RNA, 18 nt, Artificial Sequence
  Description of Artificial Sequence: Synthetic oligonucleotide
gggcagugacaggcugug

SEQ ID NO: 13816 - RNA, 18 nt, Artificial Sequence
  Description of Artificial Sequence: Synthetic oligonucleotide
cuguggacacaggcuggg

SEQ ID NO: 13817 - RNA, 18 nt, Artificial Sequence
  Description of Artificial Sequence: Synthetic oligonucleotide
cagcacuguggacacagg

SEQ ID NO: 13818 - RNA, 18 nt, Artificial Sequence
  Description of Artificial Sequence: Synthetic oligonucleotide
gaucacagcacuguggac

SEQ ID NO: 13819 - RNA, 18 nt, Artificial Sequence
  Description of Artificial Sequence: Synthetic oligonucleotide
cucgggaucacagcacug

SEQ ID NO: 13820 - RNA, 18 nt, Artificial Sequence
  Description of Artificial Sequence: Synthetic oligonucleotide
cuucccucgggaucacag

SEQ ID NO: 13821 - RNA, 18 nt, Artificial Sequence
  Description of Artificial Sequence: Synthetic oligonucleotide
gaggacuucccucgggau

SEQ ID NO: 13822 - RNA, 18 nt, Artificial Sequence
  Description of Artificial Sequence: Synthetic oligonucleotide
gacuggaggacuucccuc

SEQ ID NO: 13823 - RNA, 18 nt, Artificial Sequence
  Description of Artificial Sequence: Synthetic oligonucleotide
acuuagacuggaggacuu

SEQ ID NO: 13824 - RNA, 18 nt, Artificial Sequence
  Description of Artificial Sequence: Synthetic oligonucleotide
cugugacuuagacuggag

SEQ ID NO: 13825 - RNA, 18 nt, Artificial Sequence
  Description of Artificial Sequence: Synthetic oligonucleotide
gggcacugugacuuagac

SEQ ID NO: 13826 - RNA, 18 nt, Artificial Sequence
  Description of Artificial Sequence: Synthetic oligonucleotide
ugucagggcacugugacu

SEQ ID NO: 13827 - RNA, 18 nt, Artificial Sequence
  Description of Artificial Sequence: Synthetic oligonucleotide
ucaccugucagggcacug

SEQ ID NO: 13828 - RNA, 18 nt, Artificial Sequence
  Description of Artificial Sequence: Synthetic oligonucleotide
gcuucucaccugucaggg

SEQ ID NO: 13829 - RNA, 18 nt, Artificial Sequence
  Description of Artificial Sequence: Synthetic oligonucleotide
aguuugcuucucaccugu

SEQ ID NO: 13830 - RNA, 18 nt, Artificial Sequence
  Description of Artificial Sequence: Synthetic oligonucleotide
gcgggaguuugcuucuca

SEQ ID NO: 13831 - RNA, 18 nt, Artificial Sequence
  Description of Artificial Sequence: Synthetic oligonucleotide
uuccagcgggaguuugcu

SEQ ID NO: 13832 - RNA, 18 nt, Artificial Sequence
  Description of Artificial Sequence: Synthetic oligonucleotide
gaggcuuccagcgggagu

SEQ ID NO: 13833 - RNA, 18 nt, Artificial Sequence
  Description of Artificial Sequence: Synthetic oligonucleotide
agauggaggcuuccagcg

SEQ ID NO: 13834 - RNA, 18 nt, Artificial Sequence
  Description of Artificial Sequence: Synthetic oligonucleotide
caaagagauggaggcuuc

SEQ ID NO: 13835 - RNA, 18 nt, Artificial Sequence
  Description of Artificial Sequence: Synthetic oligonucleotide
uuuuccaaagagauggag

SEQ ID NO: 13836 - RNA, 18 nt, Artificial Sequence
  Description of Artificial Sequence: Synthetic oligonucleotide
acuguuuuuccaaagaga

SEQ ID NO: 13837 - RNA, 18 nt, Artificial Sequence
  Description of Artificial Sequence: Synthetic oligonucleotide
gacuaacuguuuuuccaa

SEQ ID NO: 13838 - RNA, 18 nt, Artificial Sequence
  Description of Artificial Sequence: Synthetic oligonucleotide
cuccagacuaacuguuuu

SEQ ID NO: 13839 - RNA, 18 nt, Artificial Sequence
  Description of Artificial Sequence: Synthetic oligonucleotide
acaggcuccagacuaacu

SEQ ID NO: 13840 - RNA, 18 nt, Artificial Sequence
  Description of Artificial Sequence: Synthetic oligonucleotide
gggccacaggcuccagac

SEQ ID NO: 13841 - RNA, 18 nt, Artificial Sequence
  Description of Artificial Sequence: Synthetic oligonucleotide
ggccugggccacaggcuc

SEQ ID NO: 13842 - RNA, 18 nt, Artificial Sequence
  Description of Artificial Sequence: Synthetic oligonucleotide
agaagggccugggccaca

SEQ ID NO: 13843 - RNA, 18 nt, Artificial Sequence
  Description of Artificial Sequence: Synthetic oligonucleotide
gggacagaagggccuggg

SEQ ID NO: 13844 - RNA, 18 nt, Artificial Sequence
  Description of Artificial Sequence: Synthetic oligonucleotide
agcuguugggaugaugcc

SEQ ID NO: 13845 - RNA, 18 nt, Artificial Sequence
  Description of Artificial Sequence: Synthetic oligonucleotide
aaaugagcuguugggaug

SEQ ID NO: 13846 - RNA, 18 nt, Artificial Sequence
  Description of Artificial Sequence: Synthetic oligonucleotide
agggaaaaugagcuguug

SEQ ID NO: 13847 - RNA, 18 nt, Artificial Sequence
  Description of Artificial Sequence: Synthetic oligonucleotide
ggacuagggaaaaugagc

SEQ ID NO: 13848 - RNA, 18 nt, Artificial Sequence
  Description of Artificial Sequence: Synthetic oligonucleotide
aaggcggacuagggaaaa

SEQ ID NO: 13849 - RNA, 18 nt, Artificial Sequence
  Description of Artificial Sequence: Synthetic oligonucleotide
gaacgaaggcggacuagg

SEQ ID NO: 13850 - RNA, 18 nt, Artificial Sequence
  Description of Artificial Sequence: Synthetic oligonucleotide
cccuugaacgaaggcgga

SEQ ID NO: 13851 - RNA, 18 nt, Artificial Sequence
  Description of Artificial Sequence: Synthetic oligonucleotide
ccugacccuugaacgaag

SEQ ID NO: 13852 - RNA, 18 nt, Artificial Sequence
  Description of Artificial Sequence: Synthetic oligonucleotide
ccauuccugacccuugaa

SEQ ID NO: 13853 - RNA, 18 nt, Artificial Sequence
  Description of Artificial Sequence: Synthetic oligonucleotide
cugguccauuccugaccc

SEQ ID NO: 13854 - RNA, 18 nt, Artificial Sequence
  Description of Artificial Sequence: Synthetic oligonucleotide
cuguucugguccauuccu

SEQ ID NO: 13855 - RNA, 18 nt, Artificial Sequence
  Description of Artificial Sequence: Synthetic oligonucleotide
cccaucuguucuggucca

SEQ ID NO: 13856 - RNA, 18 nt, Artificial Sequence
  Description of Artificial Sequence: Synthetic oligonucleotide
cagaacccaucuguucug

SEQ ID NO: 13857 - RNA, 18 nt, Artificial Sequence
  Description of Artificial Sequence: Synthetic oligonucleotide
gccuccagaacccaucug

SEQ ID NO: 13858 - RNA, 18 nt, Artificial Sequence
  Description of Artificial Sequence: Synthetic oligonucleotide
gggccuccagaacccauc

SEQ ID NO: 13859 - RNA, 18 nt, Artificial Sequence
  Description of Artificial Sequence: Synthetic oligonucleotide
auagcccucuguucaggg

SEQ ID NO: 13860 - RNA, 18 nt, Artificial Sequence
  Description of Artificial Sequence: Synthetic oligonucleotide
cagccauagcccucuguu

SEQ ID NO: 13861 - RNA, 18 nt, Artificial Sequence
  Description of Artificial Sequence: Synthetic oligonucleotide
cuccacagccauagcccu

SEQ ID NO: 13862 - RNA, 18 nt, Artificial Sequence
  Description of Artificial Sequence: Synthetic oligonucleotide
accuucuccacagccaua

SEQ ID NO: 13863 - RNA, 18 nt, Artificial Sequence
  Description of Artificial Sequence: Synthetic oligonucleotide
caagaaccuucuccacag

SEQ ID NO: 13864 - RNA, 18 nt, Artificial Sequence
  Description of Artificial Sequence: Synthetic oligonucleotide
cgggccaagaaccuucuc

SEQ ID NO: 13865 - RNA, 18 nt, Artificial Sequence
  Description of Artificial Sequence: Synthetic oligonucleotide
uccaacgggccaagaacc

SEQ ID NO: 13866 - RNA, 18 nt, Artificial Sequence
  Description of Artificial Sequence: Synthetic oligonucleotide
gugaguccaacgggccaa

SEQ ID NO: 13867 - RNA, 18 nt, Artificial Sequence
  Description of Artificial Sequence: Synthetic oligonucleotide
ucugugugaguccaacgg

SEQ ID NO: 13868 - RNA, 18 nt, Artificial Sequence
  Description of Artificial Sequence: Synthetic oligonucleotide
cagggucugugugagucc

SEQ ID NO: 13869 - RNA, 18 nt, Artificial Sequence
  Description of Artificial Sequence: Synthetic oligonucleotide
ggguacagggucugugug

SEQ ID NO: 13870 - RNA, 18 nt, Artificial Sequence
  Description of Artificial Sequence: Synthetic oligonucleotide
cgagaggguacagggucu

SEQ ID NO: 13871 - RNA, 18 nt, Artificial Sequence
  Description of Artificial Sequence: Synthetic oligonucleotide
cuugccgagaggguacag

SEQ ID NO: 13872 - RNA, 18 nt, Artificial Sequence
  Description of Artificial Sequence: Synthetic oligonucleotide
agaugcuugccgagaggg

SEQ ID NO: 13873 - RNA, 18 nt, Artificial Sequence
  Description of Artificial Sequence: Synthetic oligonucleotide
acugaagaugcuugccga

SEQ ID NO: 13874 - RNA, 18 nt, Artificial Sequence
  Description of Artificial Sequence: Synthetic oligonucleotide
aucugacugaagaugcuu

SEQ ID NO: 13875 - RNA, 18 nt, Artificial Sequence
  Description of Artificial Sequence: Synthetic oligonucleotide
ggauaaucugacugaaga

SEQ ID NO: 13876 - RNA, 18 nt, Artificial Sequence
  Description of Artificial Sequence: Synthetic oligonucleotide
acugaggauaaucugacu

SEQ ID NO: 13877 - RNA, 18 nt, Artificial Sequence
  Description of Artificial Sequence: Synthetic oligonucleotide
cugaaacugaggauaauc

SEQ ID NO: 13878 - RNA, 18 nt, Artificial Sequence
  Description of Artificial Sequence: Synthetic oligonucleotide
aguaucugaaacugagga

SEQ ID NO: 13879 - RNA, 18 nt, Artificial Sequence
  Description of Artificial Sequence: Synthetic oligonucleotide
uaugaaguaucugaaacu

SEQ ID NO: 13880 - RNA, 18 nt, Artificial Sequence
  Description of Artificial Sequence: Synthetic oligonucleotide
gguauuaugaaguaucug

SEQ ID NO: 13881 - RNA, 18 nt, Artificial Sequence
  Description of Artificial Sequence: Synthetic oligonucleotide
cacaagguauuaugaagu

SEQ ID NO: 13882 - RNA, 18 nt, Artificial Sequence
  Description of Artificial Sequence: Synthetic oligonucleotide
cacaacacaagguauuau

SEQ ID NO: 13883 - RNA, 18 nt, Artificial Sequence
  Description of Artificial Sequence: Synthetic oligonucleotide
ccccacacaacacaaggu

SEQ ID NO: 13884 - RNA, 18 nt, Artificial Sequence
  Description of Artificial Sequence: Synthetic oligonucleotide
uaugaccccacacaacac

SEQ ID NO: 13885 - RNA, 18 nt, Artificial Sequence
  Description of Artificial Sequence: Synthetic oligonucleotide
ugauguaugaccccacac

SEQ ID NO: 13886 - RNA, 18 nt, Artificial Sequence
  Description of Artificial Sequence: Synthetic oligonucleotide
cacgaugauguaugaccc

SEQ ID NO: 13887 - RNA, 18 nt, Artificial Sequence
  Description of Artificial Sequence: Synthetic oligonucleotide
acaaacacgaugauguau

SEQ ID NO: 13888 - RNA, 18 nt, Artificial Sequence
  Description of Artificial Sequence: Synthetic oligonucleotide
cucuuacaaacacgauga

SEQ ID NO: 13889 - RNA, 18 nt, Artificial Sequence
  Description of Artificial Sequence: Synthetic oligonucleotide
aucuucucuuacaaacac

SEQ ID NO: 13890 - RNA, 18 nt, Artificial Sequence
  Description of Artificial Sequence: Synthetic oligonucleotide
ugaccaucuucucuuaca

SEQ ID NO: 13891 - RNA, 18 nt, Artificial Sequence
  Description of Artificial Sequence: Synthetic oligonucleotide
uaaaaugaccaucuucuc

SEQ ID NO: 13892 - RNA, 18 nt, Artificial Sequence
  Description of Artificial Sequence: Synthetic oligonucleotide
gagaauaaaaugaccauc

SEQ ID NO: 13893 - RNA, 18 nt, Artificial Sequence
  Description of Artificial Sequence: Synthetic oligonucleotide
auacagagaauaaaauga

SEQ ID NO: 13894 - RNA, 18 nt, Artificial Sequence
  Description of Artificial Sequence: Synthetic oligonucleotide
guuuuauacagagaauaa

SEQ ID NO: 13895 - RNA, 18 nt, Artificial Sequence
  Description of Artificial Sequence: Synthetic oligonucleotide
gcuaaguuuuauacagag

SEQ ID NO: 13896 - RNA, 18 nt, Artificial Sequence
  Description of Artificial Sequence: Synthetic oligonucleotide
uuagagcuaaguuuuaua

SEQ ID NO: 13897 - RNA, 18 nt, Artificial Sequence
  Description of Artificial Sequence: Synthetic oligonucleotide
cugcuuuagagcuaaguu

SEQ ID NO: 13898 - RNA, 18 nt, Artificial Sequence
  Description of Artificial Sequence: Synthetic oligonucleotide
aguuucugcuuuagagcu

SEQ ID NO: 13899 - RNA, 18 nt, Artificial Sequence
  Description of Artificial Sequence: Synthetic oligonucleotide
gcuuuaguuucugcuuua

SEQ ID NO: 13900 - RNA, 18 nt, Artificial Sequence
  Description of Artificial Sequence: Synthetic oligonucleotide
uugcugcuuuaguuucug

SEQ ID NO: 13901 - RNA, 18 nt, Artificial Sequence
  Description of Artificial Sequence: Synthetic oligonucleotide
ugcauuugcugcuuuagu

SEQ ID NO: 13902 - RNA, 18 nt, Artificial Sequence
  Description of Artificial Sequence: Synthetic oligonucleotide
cuuccugcauuugcugcu

SEQ ID NO: 13903 - RNA, 18 nt, Artificial Sequence
  Description of Artificial Sequence: Synthetic oligonucleotide
acagccuuccugcauuug

SEQ ID NO: 13904 - RNA, 18 nt, Artificial Sequence
  Description of Artificial Sequence: Synthetic oligonucleotide
gcgagacagccuuccugc

SEQ ID NO: 13905 - RNA, 18 nt, Artificial Sequence
  Description of Artificial Sequence: Synthetic oligonucleotide
ggauggcgagacagccuu

SEQ ID NO: 13906 - RNA, 18 nt, Artificial Sequence
  Description of Artificial Sequence: Synthetic oligonucleotide
cuugaggauggcgagaca

SEQ ID NO: 13907 - RNA, 18 nt, Artificial Sequence
  Description of Artificial Sequence: Synthetic oligonucleotide
ugagucuugaggauggcg

SEQ ID NO: 13908 - RNA, 18 nt, Artificial Sequence
  Description of Artificial Sequence: Synthetic oligonucleotide
gcugcugagucuugagga

SEQ ID NO: 13909 - RNA, 18 nt, Artificial Sequence
  Description of Artificial Sequence: Synthetic oligonucleotide
ugagagcugcugagucuu

SEQ ID NO: 13910 - RNA, 18 nt, Artificial Sequence
  Description of Artificial Sequence: Synthetic oligonucleotide
gagaaugagagcugcuga

SEQ ID NO: 13911 - RNA, 18 nt, Artificial Sequence
  Description of Artificial Sequence: Synthetic oligonucleotide
cacuggagaaugagagcu

SEQ ID NO: 13912 - RNA, 18 nt, Artificial Sequence
  Description of Artificial Sequence: Synthetic oligonucleotide
cucaccacuggagaauga

SEQ ID NO: 13913 - RNA, 18 nt, Artificial Sequence
  Description of Artificial Sequence: Synthetic oligonucleotide
gugugcucaccacuggag

SEQ ID NO: 13914 - RNA, 18 nt, Artificial Sequence
  Description of Artificial Sequence: Synthetic oligonucleotide
aaauggugugcucaccac

SEQ ID NO: 13915 - RNA, 18 nt, Artificial Sequence
  Description of Artificial Sequence: Synthetic oligonucleotide
agcacaaauggugugcuc

SEQ ID NO: 13916 - RNA, 18 nt, Artificial Sequence
  Description of Artificial Sequence: Synthetic oligonucleotide
gcagcagcacaaauggug

SEQ ID NO: 13917 - RNA, 18 nt, Artificial Sequence
  Description of Artificial Sequence: Synthetic oligonucleotide
caacagcagcagcacaaa

SEQ ID NO: 13918 - RNA, 18 nt, Artificial Sequence
  Description of Artificial Sequence: Synthetic oligonucleotide
cacgacaacagcagcagc

SEQ ID NO: 13919 - RNA, 18 nt, Artificial Sequence
  Description of Artificial Sequence: Synthetic oligonucleotide
uauuucacgacaacagca

SEQ ID NO: 13920 - RNA, 18 nt, Artificial Sequence
  Description of Artificial Sequence: Synthetic oligonucleotide
uauuauauuucacgacaa

SEQ ID NO: 13921 - RNA, 18 nt, Artificial Sequence
  Description of Artificial Sequence: Synthetic oligonucleotide
acuguuauuauauuucac

SEQ ID NO: 13922 - RNA, 18 nt, Artificial Sequence
  Description of Artificial Sequence: Synthetic oligonucleotide
cuuccacuguuauuauau

SEQ ID NO: 13923 - RNA, 18 nt, Artificial Sequence
  Description of Artificial Sequence: Synthetic oligonucleotide
ugugacuuccacuguuau

SEQ ID NO: 13924 - RNA, 18 nt, Artificial Sequence
  Description of Artificial Sequence: Synthetic oligonucleotide
auuuuugugacuuccacu

SEQ ID NO: 13925 - RNA, 18 nt, Artificial Sequence
  Description of Artificial Sequence: Synthetic oligonucleotide
gggacauuuuugugacuu

SEQ ID NO: 13926 - RNA, 18 nt, Artificial Sequence
  Description of Artificial Sequence: Synthetic oligonucleotide
gaggucaagggcggcgag

SEQ ID NO: 13927 - RNA, 18 nt, Artificial Sequence
  Description of Artificial Sequence: Synthetic oligonucleotide
ugcaggaggucaagggcg

SEQ ID NO: 13928 - RNA, 18 nt, Artificial Sequence
  Description of Artificial Sequence: Synthetic oligonucleotide
uggccugcaggaggucaa

SEQ ID NO: 13929 - RNA, 18 nt, Artificial Sequence
  Description of Artificial Sequence: Synthetic oligonucleotide
acacauggccugcaggag

SEQ ID NO: 13930 - RNA, 18 nt, Artificial Sequence
  Description of Artificial Sequence: Synthetic oligonucleotide
aauacacacauggccugc

SEQ ID NO: 13931 - RNA, 18 nt, Artificial Sequence
  Description of Artificial Sequence: Synthetic oligonucleotide
caaguaauacacacaugg

SEQ ID NO: 13932 - RNA, 18 nt, Artificial Sequence
  Description of Artificial Sequence: Synthetic oligonucleotide
cuagacaaguaauacaca

SEQ ID NO: 13933 - RNA, 18 nt, Artificial Sequence
  Description of Artificial Sequence: Synthetic oligonucleotide
caucacuagacaaguaau

SEQ ID NO: 13934 - RNA, 18 nt, Artificial Sequence
  Description of Artificial Sequence: Synthetic oligonucleotide
gaggacaucacuagacaa

SEQ ID NO: 13935 - RNA, 18 nt, Artificial Sequence
  Description of Artificial Sequence: Synthetic oligonucleotide
uuugagaggacaucacua

SEQ ID NO: 13936 - RNA, 18 nt, Artificial Sequence
  Description of Artificial Sequence: Synthetic oligonucleotide
agcacuuugagaggacau

SEQ ID NO: 13937 - RNA, 18 nt, Artificial Sequence
  Description of Artificial Sequence: Synthetic oligonucleotide
cguacagcacuuugagag

SEQ ID NO: 13938 - RNA, 18 nt, Artificial Sequence
  Description of Artificial Sequence: Synthetic oligonucleotide
gcucgcguacagcacuuu

SEQ ID NO: 13939 - RNA, 18 nt, Artificial Sequence
  Description of Artificial Sequence: Synthetic oligonucleotide
gccgagcucgcguacagc

SEQ ID NO: 13940 - RNA, 18 nt, Artificial Sequence
  Description of Artificial Sequence: Synthetic oligonucleotide
guggcgccgagcucgcgu

SEQ ID NO: 13941 - RNA, 18 nt, Artificial Sequence
  Description of Artificial Sequence: Synthetic oligonucleotide
cggagguggcgccgagcu

SEQ ID NO: 13942 - RNA, 18 nt, Artificial Sequence
  Description of Artificial Sequence: Synthetic oligonucleotide
ggaggcggagguggcgcc

SEQ ID NO: 13943 - RNA, 18 nt, Artificial Sequence
  Description of Artificial Sequence: Synthetic oligonucleotide
gaaagggaggcggaggug

SEQ ID NO: 13944 - RNA, 18 nt, Artificial Sequence
  Description of Artificial Sequence: Synthetic oligonucleotide
gcucugaaagggaggcgg

SEQ ID NO: 13945 - RNA, 18 nt, Artificial Sequence
  Description of Artificial Sequence: Synthetic oligonucleotide
agcaggcucugaaaggga

SEQ ID NO: 13946 - RNA, 18 nt, Artificial Sequence
  Description of Artificial Sequence: Synthetic oligonucleotide
gggagcaggcucugaaag

SEQ ID NO: 13947 - RNA, 18 nt, Artificial Sequence
  Description of Artificial Sequence: Synthetic oligonucleotide
gcgagcagagagggcggg

SEQ ID NO: 13948 - RNA, 18 nt, Artificial Sequence
  Description of Artificial Sequence: Synthetic oligonucleotide
augcagcgagcagagagg

SEQ ID NO: 13949 - RNA, 18 nt, Artificial Sequence
  Description of Artificial Sequence: Synthetic oligonucleotide
ccacaaugcagcgagcag

SEQ ID NO: 13950 - RNA, 18 nt, Artificial Sequence
  Description of Artificial Sequence: Synthetic oligonucleotide
gaacaccacaaugcagcg

SEQ ID NO: 13951 - RNA, 18 nt, Artificial Sequence
  Description of Artificial Sequence: Synthetic oligonucleotide
gaagagaacaccacaaug

SEQ ID NO: 13952 - RNA, 18 nt, Artificial Sequence
  Description of Artificial Sequence: Synthetic oligonucleotide
cuugagaagagaacacca

SEQ ID NO: 13953 - RNA, 18 nt, Artificial Sequence
  Description of Artificial Sequence: Synthetic oligonucleotide
aaagccuugagaagagaa

SEQ ID NO: 13954 - RNA, 18 nt, Artificial Sequence
  Description of Artificial Sequence: Synthetic oligonucleotide
auuucaaagccuugagaa

SEQ ID NO: 13955 - RNA, 18 nt, Artificial Sequence
  Description of Artificial Sequence: Synthetic oligonucleotide
gggagauuucaaagccuu

SEQ ID NO: 13956 - RNA, 18 nt, Artificial Sequence
  Description of Artificial Sequence: Synthetic oligonucleotide
acgacuaaucucagugca

SEQ ID NO: 13957 - RNA, 18 nt, Artificial Sequence
  Description of Artificial Sequence: Synthetic oligonucleotide
aucugacgacuaaucuca

SEQ ID NO: 13958 - RNA, 18 nt, Artificial Sequence
  Description of Artificial Sequence: Synthetic oligonucleotide
gagagaucugacgacuaa

SEQ ID NO: 13959 - RNA, 18 nt, Artificial Sequence
  Description of Artificial Sequence: Synthetic oligonucleotide
gggagagaucugacgacu

SEQ ID NO: 13960 - RNA, 18 nt, Artificial Sequence
  Description of Artificial Sequence: Synthetic oligonucleotide
aguugggagggagacggg

SEQ ID NO: 13961 - RNA, 18 nt, Artificial Sequence
  Description of Artificial Sequence: Synthetic oligonucleotide
guauaaguugggagggag

SEQ ID NO: 13962 - RNA, 18 nt, Artificial Sequence
  Description of Artificial Sequence: Synthetic oligonucleotide
aggucguauaaguuggga

SEQ ID NO: 13963 - RNA, 18 nt, Artificial Sequence
  Description of Artificial Sequence: Synthetic oligonucleotide
aaaucaggucguauaagu

SEQ ID NO: 13964 - RNA, 18 nt, Artificial Sequence
  Description of Artificial Sequence: Synthetic oligonucleotide
uaaggaaaucaggucgua

SEQ ID NO: 13965 - RNA, 18 nt, Artificial Sequence
  Description of Artificial Sequence: Synthetic oligonucleotide
cguccuaaggaaaucagg

SEQ ID NO: 13966 - RNA, 18 nt, Artificial Sequence
  Description of Artificial Sequence: Synthetic oligonucleotide
gguuccguccuaaggaaa

SEQ ID NO: 13967 - RNA, 18 nt, Artificial Sequence
  Description of Artificial Sequence: Synthetic oligonucleotide
ccugcgguuccguccuaa

SEQ ID NO: 13968 - RNA, 18 nt, Artificial Sequence
  Description of Artificial Sequence: Synthetic oligonucleotide
aggugccugcgguuccgu

SEQ ID NO: 13969 - RNA, 18 nt, Artificial Sequence
  Description of Artificial Sequence: Synthetic oligonucleotide
ggcgcaggugccugcggu

SEQ ID NO: 13970 - RNA, 18 nt, Artificial Sequence
  Description of Artificial Sequence: Synthetic oligonucleotide
cgcccggcgcaggugccu

SEQ ID NO: 13971 - RNA, 18 nt, Artificial Sequence
  Description of Artificial Sequence: Synthetic oligonucleotide
uaagacgcccggcgcagg

SEQ ID NO: 13972 - RNA, 18 nt, Artificial Sequence
  Description of Artificial Sequence: Synthetic oligonucleotide
gggaguaagacgcccggc

SEQ ID NO: 13973 - RNA, 18 nt, Artificial Sequence
  Description of Artificial Sequence: Synthetic oligonucleotide
gcagcgggaguaagacgc

SEQ ID NO: 13974 - RNA, 18 nt, Artificial Sequence
  Description of Artificial Sequence: Synthetic oligonucleotide
aacaagcagcgggaguaa

SEQ ID NO: 13975 - RNA, 18 nt, Artificial Sequence
  Description of Artificial Sequence: Synthetic oligonucleotide
gacagaacaagcagcggg

SEQ ID NO: 13976 - RNA, 18 nt, Artificial Sequence
  Description of Artificial Sequence: Synthetic oligonucleotide
gggacagaacaagcagcg

SEQ ID NO: 13977 - RNA, 18 nt, Artificial Sequence
  Description of Artificial Sequence: Synthetic oligonucleotide
guuugguccgagggaggg

SEQ ID NO: 13978 - RNA, 18 nt, Artificial Sequence
  Description of Artificial Sequence: Synthetic oligonucleotide
gcacuguuugguccgagg

SEQ ID NO: 13979 - RNA, 18 nt, Artificial Sequence
  Description of Artificial Sequence: Synthetic oligonucleotide
caugagcacuguuugguc

SEQ ID NO: 13980 - RNA, 18 nt, Artificial Sequence
  Description of Artificial Sequence: Synthetic oligonucleotide
ugaagcaugagcacuguu

SEQ ID NO: 13981 - RNA, 18 nt, Artificial Sequence
  Description of Artificial Sequence: Synthetic oligonucleotide
gguccugaagcaugagca

SEQ ID NO: 13982 - RNA, 18 nt, Artificial Sequence
  Description of Artificial Sequence: Synthetic oligonucleotide
aacaagguccugaagcau

SEQ ID NO: 13983 - RNA, 18 nt, Artificial Sequence
  Description of Artificial Sequence: Synthetic oligonucleotide
cgacaaacaagguccuga

SEQ ID NO: 13984 - RNA, 18 nt, Artificial Sequence
  Description of Artificial Sequence: Synthetic oligonucleotide
aucuucgacaaacaaggu

SEQ ID NO: 13985 - RNA, 18 nt, Artificial Sequence
  Description of Artificial Sequence: Synthetic oligonucleotide
ccaacaucuucgacaaac

SEQ ID NO: 13986 - RNA, 18 nt, Artificial Sequence
  Description of Artificial Sequence: Synthetic oligonucleotide
ggaaaccaacaucuucga

SEQ ID NO: 13987 - RNA, 18 nt, Artificial Sequence
  Description of Artificial Sequence: Synthetic oligonucleotide
gaaagggaaaccaacauc

SEQ ID NO: 13988 - RNA, 18 nt, Artificial Sequence
  Description of Artificial Sequence: Synthetic oligonucleotide
acagagaaagggaaacca

SEQ ID NO: 13989 - RNA, 18 nt, Artificial Sequence
  Description of Artificial Sequence: Synthetic oligonucleotide
aaauaacagagaaaggga

SEQ ID NO: 13990 - RNA, 18 nt, Artificial Sequence
  Description of Artificial Sequence: Synthetic oligonucleotide
uauauaaauaacagagaa

SEQ ID NO: 13991 - RNA, 18 nt, Artificial Sequence
  Description of Artificial Sequence: Synthetic oligonucleotide
auuuuuauauaaauaaca

SEQ ID NO: 13992 - RNA, 18 nt, Artificial Sequence
  Description of Artificial Sequence: Synthetic oligonucleotide
aaauuauuuuuauauaaa

SEQ ID NO: 13993 - RNA, 18 nt, Artificial Sequence
  Description of Artificial Sequence: Synthetic oligonucleotide
uugauaaauuauuuuuau

SEQ ID NO: 13994 - RNA, 18 nt, Artificial Sequence
  Description of Artificial Sequence: Synthetic oligonucleotide
uccuuuugauaaauuauu

SEQ ID NO: 13995 - RNA, 18 nt, Artificial Sequence
  Description of Artificial Sequence: Synthetic oligonucleotide
aaauauccuuuugauaaa

SEQ ID NO: 13996 - RNA, 18 nt, Artificial Sequence
  Description of Artificial Sequence: Synthetic oligonucleotide
uuuuaaaauauccuuuug

SEQ ID NO: 13997 - RNA, 18 nt, Artificial Sequence
  Description of Artificial Sequence: Synthetic oligonucleotide
agcuuuuuuaaaauaucc

SEQ ID NO: 13998 - RNA, 18 nt, Artificial Sequence
  Description of Artificial Sequence: Synthetic oligonucleotide
agacuagcuuuuuuaaaa

SEQ ID NO: 13999 - RNA, 18 nt, Artificial Sequence
  Description of Artificial Sequence: Synthetic oligonucleotide
aagacagacuagcuuuuu

SEQ ID NO: 14000 - RNA, 18 nt, Artificial Sequence
  Description of Artificial Sequence: Synthetic oligonucleotide
guuucaagacagacuagc

SEQ ID NO: 14001 - RNA, 18 nt, Artificial Sequence
  Description of Artificial Sequence: Synthetic oligonucleotide
aacaaguuucaagacaga

SEQ ID NO: 14002 - RNA, 18 nt, Artificial Sequence
  Description of Artificial Sequence: Synthetic oligonucleotide
agguaaacaaguuucaag

SEQ ID NO: 14003 - RNA, 18 nt, Artificial Sequence
  Description of Artificial Sequence: Synthetic oligonucleotide
uuuuaagguaaacaaguu

SEQ ID NO: 14004 - RNA, 18 nt, Artificial Sequence
  Description of Artificial Sequence: Synthetic oligonucleotide
gauaauuuuaagguaaac

SEQ ID NO: 14005 - RNA, 18 nt, Artificial Sequence
  Description of Artificial Sequence: Synthetic oligonucleotide
auucugauaauuuuaagg

SEQ ID NO: 14006 - RNA, 18 nt, Artificial Sequence
  Description of Artificial Sequence: Synthetic oligonucleotide
cugagauucugauaauuu

SEQ ID NO: 14007 - RNA, 18 nt, Artificial Sequence
  Description of Artificial Sequence: Synthetic oligonucleotide
aaacacugagauucugau

SEQ ID NO: 14008 - RNA, 18 nt, Artificial Sequence
  Description of Artificial Sequence: Synthetic oligonucleotide
cuuucaaacacugagauu

SEQ ID NO: 14009 - RNA, 18 nt, Artificial Sequence
  Description of Artificial Sequence: Synthetic oligonucleotide
caguacuuucaaacacug

SEQ ID NO: 14010 - RNA, 18 nt, Artificial Sequence
  Description of Artificial Sequence: Synthetic oligonucleotide
ugcuucaguacuuucaaa

SEQ ID NO: 14011 - RNA, 18 nt, Artificial Sequence
  Description of Artificial Sequence: Synthetic oligonucleotide
guuugugcuucaguacuu

SEQ ID NO: 14012 - RNA, 18 nt, Artificial Sequence
  Description of Artificial Sequence: Synthetic oligonucleotide
uauauguuugugcuucag

SEQ ID NO: 14013 - RNA, 18 nt, Artificial Sequence
  Description of Artificial Sequence: Synthetic oligonucleotide
gaugauauauguuugugc

SEQ ID NO: 14014 - RNA, 18 nt, Artificial Sequence
  Description of Artificial Sequence: Synthetic oligonucleotide
acagagaugauauauguu

SEQ ID NO: 14015 - RNA, 18 nt, Artificial Sequence
  Description of Artificial Sequence: Synthetic oligonucleotide
augguacagagaugauau

SEQ ID NO: 14016 - RNA, 18 nt, Artificial Sequence
  Description of Artificial Sequence: Synthetic oligonucleotide
acagaaugguacagagau

SEQ ID NO: 14017 - RNA, 18 nt, Artificial Sequence
  Description of Artificial Sequence: Synthetic oligonucleotide
uuaguacagaaugguaca

SEQ ID NO: 14018 - RNA, 18 nt, Artificial Sequence
  Description of Artificial Sequence: Synthetic oligonucleotide
gugcuuuaguacagaaug

SEQ ID NO: 14019 - RNA, 18 nt, Artificial Sequence
  Description of Artificial Sequence: Synthetic oligonucleotide
cucaagugcuuuaguaca

SEQ ID NO: 14020 - RNA, 18 nt, Artificial Sequence
  Description of Artificial Sequence: Synthetic oligonucleotide
uuagacucaagugcuuua

SEQ ID NO: 14021 - RNA, 18 nt, Artificial Sequence
  Description of Artificial Sequence: Synthetic oligonucleotide
auuuauuagacucaagug

SEQ ID NO: 14022 - RNA, 18 nt, Artificial Sequence
  Description of Artificial Sequence: Synthetic oligonucleotide
ucuuuauuuauuagacuc

SEQ ID NO: 14023 - RNA, 18 nt, Artificial Sequence
  Description of Artificial Sequence: Synthetic oligonucleotide
ugauuucuuuauuuauua

SEQ ID NO: 14024 - RNA, 18 nt, Artificial Sequence
  Description of Artificial Sequence: Synthetic oligonucleotide
ggugcugauuucuuuauu

SEQ ID NO: 14025 - RNA, 18 nt, Artificial Sequence
  Description of Artificial Sequence: Synthetic oligonucleotide
gggugcugauuucuuuau

SEQ ID NO: 14026 - RNA, 18 nt, Artificial Sequence
  Description of Artificial Sequence: Synthetic oligonucleotide
ccuggacaccgggaaggg

SEQ ID NO: 14027 - RNA, 18 nt, Artificial Sequence
  Description of Artificial Sequence: Synthetic oligonucleotide
agggcuuuggccauuuuc

SEQ ID NO: 14028 - RNA, 18 nt, Artificial Sequence
  Description of Artificial Sequence: Synthetic oligonucleotide
ggcagagggcuuuggcca

SEQ ID NO: 14029 - RNA, 18 nt, Artificial Sequence
  Description of Artificial Sequence: Synthetic oligonucleotide
gagguggcagagggcuuu

SEQ ID NO: 14030 - RNA, 18 nt, Artificial Sequence
  Description of Artificial Sequence: Synthetic oligonucleotide
acguugagguggcagagg

SEQ ID NO: 14031 - RNA, 18 nt, Artificial Sequence
  Description of Artificial Sequence: Synthetic oligonucleotide
cagggacguugagguggc

SEQ ID NO: 14032 - RNA, 18 nt, Artificial Sequence
  Description of Artificial Sequence: Synthetic oligonucleotide
agugacagggacguugag

SEQ ID NO: 14033 - RNA, 18 nt, Artificial Sequence
  Description of Artificial Sequence: Synthetic oligonucleotide
accacagugacagggacg

SEQ ID NO: 14034 - RNA, 18 nt, Artificial Sequence
  Description of Artificial Sequence: Synthetic oligonucleotide
cuagcaccacagugacag

SEQ ID NO: 14035 - RNA, 18 nt, Artificial Sequence
  Description of Artificial Sequence: Synthetic oligonucleotide
agcaucuagcaccacagu

SEQ ID NO: 14036 - RNA, 18 nt, Artificial Sequence
  Description of Artificial Sequence: Synthetic oligonucleotide
acagcagcaucuagcacc

SEQ ID NO: 14037 - RNA, 18 nt, Artificial Sequence
  Description of Artificial Sequence: Synthetic oligonucleotide
gggaggugauuauggcug

SEQ ID NO: 14038 - RNA, 18 nt, Artificial Sequence
  Description of Artificial Sequence: Synthetic oligonucleotide
gcuguaagccagcauggg

SEQ ID NO: 14039 - RNA, 18 nt, Artificial Sequence
  Description of Artificial Sequence: Synthetic oligonucleotide
aacuugcuguaagccagc

SEQ ID NO: 14040 - RNA, 18 nt, Artificial Sequence
  Description of Artificial Sequence: Synthetic oligonucleotide
cugaaaacuugcuguaag

SEQ ID NO: 14041 - RNA, 18 nt, Artificial Sequence
  Description of Artificial Sequence: Synthetic oligonucleotide
ucaaucugaaaacuugcu

SEQ ID NO: 14042 - RNA, 18 nt, Artificial Sequence
  Description of Artificial Sequence: Synthetic oligonucleotide
aacuuucaaucugaaaac

SEQ ID NO: 14043 - RNA, 18 nt, Artificial Sequence
  Description of Artificial Sequence: Synthetic oligonucleotide
acucaaacuuucaaucug

SEQ ID NO: 14044 - RNA, 18 nt, Artificial Sequence
  Description of Artificial Sequence: Synthetic oligonucleotide
acgggacucaaacuuuca

SEQ ID NO: 14045 - RNA, 18 nt, Artificial Sequence
  Description of Artificial Sequence: Synthetic oligonucleotide
uaugaacgggacucaaac

SEQ ID NO: 14046 - RNA, 18 nt, Artificial Sequence
  Description of Artificial Sequence: Synthetic oligonucleotide
ggcuuuaugaacgggacu

SEQ ID NO: 14047 - RNA, 18 nt, Artificial Sequence
  Description of Artificial Sequence: Synthetic oligonucleotide
gguguggcuuuaugaacg

SEQ ID NO: 14048 - RNA, 18 nt, Artificial Sequence
  Description of Artificial Sequence: Synthetic oligonucleotide
uaccugguguggcuuuau

SEQ ID NO: 14049 - RNA, 18 nt, Artificial Sequence
  Description of Artificial Sequence: Synthetic oligonucleotide
gacgcuaccugguguggc

SEQ ID NO: 14050 - RNA, 18 nt, Artificial Sequence
  Description of Artificial Sequence: Synthetic oligonucleotide
aguaggacgcuaccuggu

SEQ ID NO: 14051 - RNA, 18 nt, Artificial Sequence
  Description of Artificial Sequence: Synthetic oligonucleotide
uaagaaguaggacgcuac

SEQ ID NO: 14052 - RNA, 18 nt, Artificial Sequence
  Description of Artificial Sequence: Synthetic oligonucleotide
uuaauuaagaaguaggac

SEQ ID NO: 14053 - RNA, 18 nt, Artificial Sequence
  Description of Artificial Sequence: Synthetic oligonucleotide
agcuauuaauuaagaagu

SEQ ID NO: 14054 - RNA, 18 nt, Artificial Sequence
  Description of Artificial Sequence: Synthetic oligonucleotide
agggcagcuauuaauuaa

SEQ ID NO: 14055 - RNA, 18 nt, Artificial Sequence
  Description of Artificial Sequence: Synthetic oligonucleotide
gguuuagggcagcuauua

SEQ ID NO: 14056 - RNA, 18 nt, Artificial Sequence
  Description of Artificial Sequence: Synthetic oligonucleotide
uugcugguuuagggcagc

SEQ ID NO: 14057 - RNA, 18 nt, Artificial Sequence
  Description of Artificial Sequence: Synthetic oligonucleotide
caagcuugcugguuuagg

SEQ ID NO: 14058 - RNA, 18 nt, Artificial Sequence
  Description of Artificial Sequence: Synthetic oligonucleotide
cauaacaagcuugcuggu

SEQ ID NO: 14059 - RNA, 18 nt, Artificial Sequence
  Description of Artificial Sequence: Synthetic oligonucleotide
aaccucauaacaagcuug

SEQ ID NO: 14060 - RNA, 18 nt, Artificial Sequence
  Description of Artificial Sequence: Synthetic oligonucleotide
aucacaaccucauaacaa

SEQ ID NO: 14061 - RNA, 18 nt, Artificial Sequence
  Description of Artificial Sequence: Synthetic oligonucleotide
augcuaucacaaccucau

SEQ ID NO: 14062 - RNA, 18 nt, Artificial Sequence
  Description of Artificial Sequence: Synthetic oligonucleotide
uuuguaugcuaucacaac

SEQ ID NO: 14063 - RNA, 18 nt, Artificial Sequence
  Description of Artificial Sequence: Synthetic oligonucleotide
ucuucuuuguaugcuauc

SEQ ID NO: 14064 - RNA, 18 nt, Artificial Sequence
  Description of Artificial Sequence: Synthetic oligonucleotide
cucugucuucuuuguaug

SEQ ID NO: 14065 - RNA, 18 nt, Artificial Sequence
  Description of Artificial Sequence: Synthetic oligonucleotide
uacagcucugucuucuuu

SEQ ID NO: 14066 - RNA, 18 nt, Artificial Sequence
  Description of Artificial Sequence: Synthetic oligonucleotide
cauccuacagcucugucu

SEQ ID NO: 14067 - RNA, 18 nt, Artificial Sequence
  Description of Artificial Sequence: Synthetic oligonucleotide
cccaacauccuacagcuc

SEQ ID NO: 14068 - RNA, 18 nt, Artificial Sequence
  Description of Artificial Sequence: Synthetic oligonucleotide
cucuccccaacauccuac

SEQ ID NO: 14069 - RNA, 18 nt, Artificial Sequence
  Description of Artificial Sequence: Synthetic oligonucleotide
ucccacucuccccaacau

SEQ ID NO: 14070 - RNA, 18 nt, Artificial Sequence
  Description of Artificial Sequence: Synthetic oligonucleotide
acaacucccacucucccc

SEQ ID NO: 14071 - RNA, 18 nt, Artificial Sequence
  Description of Artificial Sequence: Synthetic oligonucleotide
uagacacaacucccacuc

SEQ ID NO: 14072 - RNA, 18 nt, Artificial Sequence
  Description of Artificial Sequence: Synthetic oligonucleotide
agcuauagacacaacucc

SEQ ID NO: 14073 - RNA, 18 nt, Artificial Sequence
  Description of Artificial Sequence: Synthetic oligonucleotide
cauaaagcuauagacaca

SEQ ID NO: 14074 - RNA, 18 nt, Artificial Sequence
  Description of Artificial Sequence: Synthetic oligonucleotide
acagccauaaagcuauag

SEQ ID NO: 14075 - RNA, 18 nt, Artificial Sequence
  Description of Artificial Sequence: Synthetic oligonucleotide
cacuuacagccauaaagc

SEQ ID NO: 14076 - RNA, 18 nt, Artificial Sequence
  Description of Artificial Sequence: Synthetic oligonucleotide
cucaacacuuacagccau

SEQ ID NO: 14077 - RNA, 18 nt, Artificial Sequence
  Description of Artificial Sequence: Synthetic oligonucleotide
acaaacucaacacuuaca

SEQ ID NO: 14078 - RNA, 18 nt, Artificial Sequence
  Description of Artificial Sequence: Synthetic oligonucleotide
caacaacaaacucaacac

SEQ ID NO: 14079 - RNA, 18 nt, Artificial Sequence
  Description of Artificial Sequence: Synthetic oligonucleotide
aacaacaacaacaaacuc

SEQ ID NO: 14080 - RNA, 18 nt, Artificial Sequence
  Description of Artificial Sequence: Synthetic oligonucleotide
aaaacaacaacaacaaca

SEQ ID NO: 14081 - RNA, 18 nt, Artificial Sequence
  Description of Artificial Sequence: Synthetic oligonucleotide
aaacaaaaacaacaacaa

SEQ ID NO: 14082 - RNA, 18 nt, Artificial Sequence
  Description of Artificial Sequence: Synthetic oligonucleotide
caaacaaacaaaaacaac

SEQ ID NO: 14083 - RNA, 18 nt, Artificial Sequence
  Description of Artificial Sequence: Synthetic oligonucleotide
aaaaacaaacaaacaaaa

SEQ ID NO: 14084 - RNA, 18 nt, Artificial Sequence
  Description of Artificial Sequence: Synthetic oligonucleotide
aaacaaaaaacaaacaaa

SEQ ID NO: 14085 - RNA, 18 nt, Artificial Sequence
  Description of Artificial Sequence: Synthetic oligonucleotide
caaaaaaacaaaaaacaa

SEQ ID NO: 14086 - RNA, 18 nt, Artificial Sequence
  Description of Artificial Sequence: Synthetic oligonucleotide
caucucaaaaaaacaaaa

SEQ ID NO: 14087 - RNA, 18 nt, Artificial Sequence
  Description of Artificial Sequence: Synthetic oligonucleotide
gacuccaucucaaaaaaa

SEQ ID NO: 14088 - RNA, 18 nt, Artificial Sequence
  Description of Artificial Sequence: Synthetic oligonucleotide
ggcaagacuccaucucaa

SEQ ID NO: 14089 - RNA, 18 nt, Artificial Sequence
  Description of Artificial Sequence: Synthetic oligonucleotide
aacagggcaagacuccau

SEQ ID NO: 14090 - RNA, 18 nt, Artificial Sequence
  Description of Artificial Sequence: Synthetic oligonucleotide
ugggcaacagggcaagac

SEQ ID NO: 14091 - RNA, 18 nt, Artificial Sequence
  Description of Artificial Sequence: Synthetic oligonucleotide
cagccugggcaacagggc

SEQ ID NO: 14092 - RNA, 18 nt, Artificial Sequence
  Description of Artificial Sequence: Synthetic oligonucleotide
cacuccagccugggcaac

SEQ ID NO: 14093 - RNA, 18 nt, Artificial Sequence
  Description of Artificial Sequence: Synthetic oligonucleotide
cauugcacuccagccugg

SEQ ID NO: 14094 - RNA, 18 nt, Artificial Sequence
  Description of Artificial Sequence: Synthetic oligonucleotide
caugccauugcacuccag

SEQ ID NO: 14095 - RNA, 18 nt, Artificial Sequence
  Description of Artificial Sequence: Synthetic oligonucleotide
aagaucaugccauugcac

SEQ ID NO: 14096 - RNA, 18 nt, Artificial Sequence
  Description of Artificial Sequence: Synthetic oligonucleotide
gaaccaagaucaugccau

SEQ ID NO: 14097 - RNA, 18 nt, Artificial Sequence
  Description of Artificial Sequence: Synthetic oligonucleotide
gcagugaaccaagaucau

SEQ ID NO: 14098 - RNA, 18 nt, Artificial Sequence
  Description of Artificial Sequence: Synthetic oligonucleotide
agauugcagugaaccaag

SEQ ID NO: 14099 - RNA, 18 nt, Artificial Sequence
  Description of Artificial Sequence: Synthetic oligonucleotide
gguggagauugcagugaa

SEQ ID NO: 14100 - RNA, 18 nt, Artificial Sequence
  Description of Artificial Sequence: Synthetic oligonucleotide
ugggagguggagauugca

SEQ ID NO: 14101 - RNA, 18 nt, Artificial Sequence
  Description of Artificial Sequence: Synthetic oligonucleotide
gaaccugggagguggaga

SEQ ID NO: 14102 - RNA, 18 nt, Artificial Sequence
  Description of Artificial Sequence: Synthetic oligonucleotide
cgcuugaaccugggaggu

SEQ ID NO: 14103 - RNA, 18 nt, Artificial Sequence
  Description of Artificial Sequence: Synthetic oligonucleotide
agaaucgcuugaaccugg

SEQ ID NO: 14104 - RNA, 18 nt, Artificial Sequence
  Description of Artificial Sequence: Synthetic oligonucleotide
gcaggagaaucgcuugaa

SEQ ID NO: 14105 - RNA, 18 nt, Artificial Sequence
  Description of Artificial Sequence: Synthetic oligonucleotide
cugaggcaggagaaucgc

SEQ ID NO: 14106 - RNA, 18 nt, Artificial Sequence
  Description of Artificial Sequence: Synthetic oligonucleotide
ggaggcugaggcaggaga

SEQ ID NO: 14107 - RNA, 18 nt, Artificial Sequence
  Description of Artificial Sequence: Synthetic oligonucleotide
acuuaggaggcugaggca

SEQ ID NO: 14108 - RNA, 18 nt, Artificial Sequence
  Description of Artificial Sequence: Synthetic oligonucleotide
cagcuacuuaggaggcug

SEQ ID NO: 14109 - RNA, 18 nt, Artificial Sequence
  Description of Artificial Sequence: Synthetic oligonucleotide
aaucccagcuacuuagga

SEQ ID NO: 14110 - RNA, 18 nt, Artificial Sequence
  Description of Artificial Sequence: Synthetic oligonucleotide
ccgguaaucccagcuacu

SEQ ID NO: 14111 - RNA, 18 nt, Artificial Sequence
  Description of Artificial Sequence: Synthetic oligonucleotide
augcgccgguaaucccag

SEQ ID NO: 14112 - RNA, 18 nt, Artificial Sequence
  Description of Artificial Sequence: Synthetic oligonucleotide
guggcaugcgccgguaau

SEQ ID NO: 14113 - RNA, 18 nt, Artificial Sequence
  Description of Artificial Sequence: Synthetic oligonucleotide
gcaugguggcaugcgccg

SEQ ID NO: 14114 - RNA, 18 nt, Artificial Sequence
  Description of Artificial Sequence: Synthetic oligonucleotide
acguggcaugguggcaug

SEQ ID NO: 14115 - RNA, 18 nt, Artificial Sequence
  Description of Artificial Sequence: Synthetic oligonucleotide
aauuaacguggcauggug

SEQ ID NO: 14116 - RNA, 18 nt, Artificial Sequence
  Description of Artificial Sequence: Synthetic oligonucleotide
aaaagaauuaacguggca

SEQ ID NO: 14117 - RNA, 18 nt, Artificial Sequence
  Description of Artificial Sequence: Synthetic oligonucleotide
aauauaaaagaauuaacg

SEQ ID NO: 14118 - RNA, 18 nt, Artificial Sequence
  Description of Artificial Sequence: Synthetic oligonucleotide
cuaaaaauauaaaagaau

SEQ ID NO: 14119 - RNA, 18 nt, Artificial Sequence
  Description of Artificial Sequence: Synthetic oligonucleotide
cucuacuaaaaauauaaa

SEQ ID NO: 14120 - RNA, 18 nt, Artificial Sequence
  Description of Artificial Sequence: Synthetic oligonucleotide
cccaucucuacuaaaaau

SEQ ID NO: 14121 - RNA, 18 nt, Artificial Sequence
  Description of Artificial Sequence: Synthetic oligonucleotide
gaaaccccaucucuacua

SEQ ID NO: 14122 - RNA, 18 nt, Artificial Sequence
  Description of Artificial Sequence: Synthetic oligonucleotide
auggugaaaccccaucuc

SEQ ID NO: 14123 - RNA, 18 nt, Artificial Sequence
  Description of Artificial Sequence: Synthetic oligonucleotide
ccaacauggugaaacccc

SEQ ID NO: 14124 - RNA, 18 nt, Artificial Sequence
  Description of Artificial Sequence: Synthetic oligonucleotide
ccuggccaacauggugaa

SEQ ID NO: 14125 - RNA, 18 nt, Artificial Sequence
  Description of Artificial Sequence: Synthetic oligonucleotide
accagccuggccaacaug

SEQ ID NO: 14126 - RNA, 18 nt, Artificial Sequence
  Description of Artificial Sequence: Synthetic oligonucleotide
ucgagaccagccuggcca

SEQ ID NO: 14127 - RNA, 18 nt, Artificial Sequence
  Description of Artificial Sequence: Synthetic oligonucleotide
ggaguucgagaccagccu

SEQ ID NO: 14128 - RNA, 18 nt, Artificial Sequence
  Description of Artificial Sequence: Synthetic oligonucleotide
guucaggaguucgagacc

SEQ ID NO: 14129 - RNA, 18 nt, Artificial Sequence
  Description of Artificial Sequence: Synthetic oligonucleotide
ccugaguucaggaguucg

SEQ ID NO: 14130 - RNA, 18 nt, Artificial Sequence
  Description of Artificial Sequence: Synthetic oligonucleotide
ucccauuucagccuccca

SEQ ID NO: 14131 - RNA, 18 nt, Artificial Sequence
  Description of Artificial Sequence: Synthetic oligonucleotide
gauccucccauuucagcc

SEQ ID NO: 14132 - RNA, 18 nt, Artificial Sequence
  Description of Artificial Sequence: Synthetic oligonucleotide
caagcgauccucccauuu

SEQ ID NO: 14133 - RNA, 18 nt, Artificial Sequence
  Description of Artificial Sequence: Synthetic oligonucleotide
aggcucaagcgauccucc

SEQ ID NO: 14134 - RNA, 18 nt, Artificial Sequence
  Description of Artificial Sequence: Synthetic oligonucleotide
cucuuaggcucaagcgau

SEQ ID NO: 14135 - RNA, 18 nt, Artificial Sequence
  Description of Artificial Sequence: Synthetic oligonucleotide
ucuaccucuuaggcucaa

SEQ ID NO: 14136 - RNA, 18 nt, Artificial Sequence
  Description of Artificial Sequence: Synthetic oligonucleotide
aaaccucuaccucuuagg

SEQ ID NO: 14137 - RNA, 18 nt, Artificial Sequence
  Description of Artificial Sequence: Synthetic oligonucleotide
agcccaaaccucuaccuc

SEQ ID NO: 14138 - RNA, 18 nt, Artificial Sequence
  Description of Artificial Sequence: Synthetic oligonucleotide
aucucagcccaaaccucu

SEQ ID NO: 14139 - RNA, 18 nt, Artificial Sequence
  Description of Artificial Sequence: Synthetic oligonucleotide
gcaugaucucagcccaaa

SEQ ID NO: 14140 - RNA, 18 nt, Artificial Sequence
  Description of Artificial Sequence: Synthetic oligonucleotide
caguggcaugaucucagc

SEQ ID NO: 14141 - RNA, 18 nt, Artificial Sequence
  Description of Artificial Sequence: Synthetic oligonucleotide
gagugcaguggcaugauc

SEQ ID NO: 14142 - RNA, 18 nt, Artificial Sequence
  Description of Artificial Sequence: Synthetic oligonucleotide
ggcuagagugcaguggca

SEQ ID NO: 14143 - RNA, 18 nt, Artificial Sequence
  Description of Artificial Sequence: Synthetic oligonucleotide
gcccaggcuagagugcag

SEQ ID NO: 14144 - RNA, 18 nt, Artificial Sequence
  Description of Artificial Sequence: Synthetic oligonucleotide
cuguugcccaggcuagag

SEQ ID NO: 14145 - RNA, 18 nt, Artificial Sequence
  Description of Artificial Sequence: Synthetic oligonucleotide
ucacucuguugcccaggc

SEQ ID NO: 14146 - RNA, 18 nt, Artificial Sequence
  Description of Artificial Sequence: Synthetic oligonucleotide
agaucucacucuguugcc

SEQ ID NO: 14147 - RNA, 18 nt, Artificial Sequence
  Description of Artificial Sequence: Synthetic oligonucleotide
agaccagaucucacucug

SEQ ID NO: 14148 - RNA, 18 nt, Artificial Sequence
  Description of Artificial Sequence: Synthetic oligonucleotide
uuuugagaccagaucuca

SEQ ID NO: 14149 - RNA, 18 nt, Artificial Sequence
  Description of Artificial Sequence: Synthetic oligonucleotide
uuuuuuuuugagaccaga

SEQ ID NO: 14150 - RNA, 18 nt, Artificial Sequence
  Description of Artificial Sequence: Synthetic oligonucleotide
uucuuuuuuuuuuugaga

SEQ ID NO: 14151 - RNA, 18 nt, Artificial Sequence
  Description of Artificial Sequence: Synthetic oligonucleotide
aaucuuucuuuuuuuuuu

SEQ ID NO: 14152 - RNA, 18 nt, Artificial Sequence
  Description of Artificial Sequence: Synthetic oligonucleotide
uuaaaaaucuuucuuuuu

SEQ ID NO: 14153 - RNA, 18 nt, Artificial Sequence
  Description of Artificial Sequence: Synthetic oligonucleotide
caguuuuaaaaaucuuuc

SEQ ID NO: 14154 - RNA, 18 nt, Artificial Sequence
  Description of Artificial Sequence: Synthetic oligonucleotide
uuaugcaguuuuaaaaau

SEQ ID NO: 14155 - RNA, 18 nt, Artificial Sequence
  Description of Artificial Sequence: Synthetic oligonucleotide
aaguguuaugcaguuuua

SEQ ID NO: 14156 - RNA, 18 nt, Artificial Sequence
  Description of Artificial Sequence: Synthetic oligonucleotide
gacaaaaguguuaugcag

SEQ ID NO: 14157 - RNA, 18 nt, Artificial Sequence
  Description of Artificial Sequence: Synthetic oligonucleotide
aguuggacaaaaguguua

SEQ ID NO: 14158 - RNA, 18 nt, Artificial Sequence
  Description of Artificial Sequence: Synthetic oligonucleotide
ucugaaguuggacaaaag

SEQ ID NO: 14159 - RNA, 18 nt, Artificial Sequence
  Description of Artificial Sequence: Synthetic oligonucleotide
ugagaucugaaguuggac

SEQ ID NO: 14160 - RNA, 18 nt, Artificial Sequence
  Description of Artificial Sequence: Synthetic oligonucleotide
ucugaugagaucugaagu

SEQ ID NO: 14161 - RNA, 18 nt, Artificial Sequence
  Description of Artificial Sequence: Synthetic oligonucleotide
uaaaaucugaugagaucu

SEQ ID NO: 14162 - RNA, 18 nt, Artificial Sequence
  Description of Artificial Sequence: Synthetic oligonucleotide
aauuuuaaaaucugauga

SEQ ID NO: 14163 - RNA, 18 nt, Artificial Sequence
  Description of Artificial Sequence: Synthetic oligonucleotide
aacaaaauuuuaaaaucu

SEQ ID NO: 14164 - RNA, 18 nt, Artificial Sequence
  Description of Artificial Sequence: Synthetic oligonucleotide
aaccaaacaaaauuuuaa

SEQ ID NO: 14165 - RNA, 18 nt, Artificial Sequence
  Description of Artificial Sequence: Synthetic oligonucleotide
gcacaaaccaaacaaaau

SEQ ID NO: 14166 - RNA, 18 nt, Artificial Sequence
  Description of Artificial Sequence: Synthetic oligonucleotide
cuucagcacaaaccaaac

SEQ ID NO: 14167 - RNA, 18 nt, Artificial Sequence
  Description of Artificial Sequence: Synthetic oligonucleotide
uucuacuucagcacaaac

SEQ ID NO: 14168 - RNA, 18 nt, Artificial Sequence
  Description of Artificial Sequence: Synthetic oligonucleotide
uucuuuucuacuucagca

SEQ ID NO: 14169 - RNA, 18 nt, Artificial Sequence
  Description of Artificial Sequence: Synthetic oligonucleotide
cuacuuucuuuucuacuu

SEQ ID NO: 14170 - RNA, 18 nt, Artificial Sequence
  Description of Artificial Sequence: Synthetic oligonucleotide
auccucuacuuucuuuuc

SEQ ID NO: 14171 - RNA, 18 nt, Artificial Sequence
  Description of Artificial Sequence: Synthetic oligonucleotide
gugguauccucuacuuuc

SEQ ID NO: 14172 - RNA, 18 nt, Artificial Sequence
  Description of Artificial Sequence: Synthetic oligonucleotide
caagugugguauccucua

SEQ ID NO: 14173 - RNA, 18 nt, Artificial Sequence
  Description of Artificial Sequence: Synthetic oligonucleotide
ccuuccaagugugguauc

SEQ ID NO: 14174 - RNA, 18 nt, Artificial Sequence
  Description of Artificial Sequence: Synthetic oligonucleotide
gucuuccuuccaagugug

SEQ ID NO: 14175 - RNA, 18 nt, Artificial Sequence
  Description of Artificial Sequence: Synthetic oligonucleotide
cagcagucuuccuuccaa

SEQ ID NO: 14176 - RNA, 18 nt, Artificial Sequence
  Description of Artificial Sequence: Synthetic oligonucleotide
ugacacagcagucuuccu

SEQ ID NO: 14177 - RNA, 18 nt, Artificial Sequence
  Description of Artificial Sequence: Synthetic oligonucleotide
uguccugacacagcaguc

SEQ ID NO: 14178 - RNA, 18 nt, Artificial Sequence
  Description of Artificial Sequence: Synthetic oligonucleotide
aagaauguccugacacag

SEQ ID NO: 14179 - RNA, 18 nt, Artificial Sequence
  Description of Artificial Sequence: Synthetic oligonucleotide
gaagcaagaauguccuga

SEQ ID NO: 14180 - RNA, 18 nt, Artificial Sequence
  Description of Artificial Sequence: Synthetic oligonucleotide
uaagugaagcaagaaugu

SEQ ID NO: 14181 - RNA, 18 nt, Artificial Sequence
  Description of Artificial Sequence: Synthetic oligonucleotide
guguguaagugaagcaag

SEQ ID NO: 14182 - RNA, 18 nt, Artificial Sequence
  Description of Artificial Sequence: Synthetic oligonucleotide
cauauguguguaagugaa

SEQ ID NO: 14183 - RNA, 18 nt, Artificial Sequence
  Description of Artificial Sequence: Synthetic oligonucleotide
acguacauauguguguaa

SEQ ID NO: 14184 - RNA, 18 nt, Artificial Sequence
  Description of Artificial Sequence: Synthetic oligonucleotide
ugcacacguacauaugug

SEQ ID NO: 14185 - RNA, 18 nt, Artificial Sequence
  Description of Artificial Sequence: Synthetic oligonucleotide
gcgcaugcacacguacau

SEQ ID NO: 14186 - RNA, 18 nt, Artificial Sequence
  Description of Artificial Sequence: Synthetic oligonucleotide
gcccggcgcaugcacacg

SEQ ID NO: 14187 - RNA, 18 nt, Artificial Sequence
  Description of Artificial Sequence: Synthetic oligonucleotide
cugccgcccggcgcaugc

SEQ ID NO: 14188 - RNA, 18 nt, Artificial Sequence
  Description of Artificial Sequence: Synthetic oligonucleotide
ucacacugccgcccggcg

SEQ ID NO: 14189 - RNA, 18 nt, Artificial Sequence
  Description of Artificial Sequence: Synthetic oligonucleotide
acacuucacacugccgcc

SEQ ID NO: 14190 - RNA, 18 nt, Artificial Sequence
  Description of Artificial Sequence: Synthetic oligonucleotide
gacauacacuucacacug

SEQ ID NO: 14191 - RNA, 18 nt, Artificial Sequence
  Description of Artificial Sequence: Synthetic oligonucleotide
aaugagacauacacuuca

SEQ ID NO: 14192 - RNA, 18 nt, Artificial Sequence
  Description of Artificial Sequence: Synthetic oligonucleotide
ccuacaaugagacauaca

SEQ ID NO: 14193 - RNA, 18 nt, Artificial Sequence
  Description of Artificial Sequence: Synthetic oligonucleotide
augacccuacaaugagac

SEQ ID NO: 14194 - RNA, 18 nt, Artificial Sequence
  Description of Artificial Sequence: Synthetic oligonucleotide
uggucaugacccuacaau

SEQ ID NO: 14195 - RNA, 18 nt, Artificial Sequence
  Description of Artificial Sequence: Synthetic oligonucleotide
uuuucuggucaugacccu

SEQ ID NO: 14196 - RNA, 18 nt, Artificial Sequence
  Description of Artificial Sequence: Synthetic oligonucleotide
ggguguuuucuggucaug

SEQ ID NO: 14197 - RNA, 18 nt, Artificial Sequence
  Description of Artificial Sequence: Synthetic oligonucleotide
cuggcauuguuaccaggg

SEQ ID NO: 14198 - RNA, 18 nt, Artificial Sequence
  Description of Artificial Sequence: Synthetic oligonucleotide
ccuggcauuguuaccagg

SEQ ID NO: 14199 - RNA, 18 nt, Artificial Sequence
  Description of Artificial Sequence: Synthetic oligonucleotide
agaccccuggcauuguua

SEQ ID NO: 14200 - RNA, 18 nt, Artificial Sequence
  Description of Artificial Sequence: Synthetic oligonucleotide
gcgauagaccccuggcau

SEQ ID NO: 14201 - RNA, 18 nt, Artificial Sequence
  Description of Artificial Sequence: Synthetic oligonucleotide
aacacgcgauagaccccu

SEQ ID NO: 14202 - RNA, 18 nt, Artificial Sequence
  Description of Artificial Sequence: Synthetic oligonucleotide
cacuuaacacgcgauaga

SEQ ID NO: 14203 - RNA, 18 nt, Artificial Sequence
  Description of Artificial Sequence: Synthetic oligonucleotide
aagcgcacuuaacacgcg

SEQ ID NO: 14204 - RNA, 18 nt, Artificial Sequence
  Description of Artificial Sequence: Synthetic oligonucleotide
uuuuaaagcgcacuuaac

SEQ ID NO: 14205 - RNA, 18 nt, Artificial Sequence
  Description of Artificial Sequence: Synthetic oligonucleotide
guuuuuuuuaaagcgcac

SEQ ID NO: 14206 - RNA, 18 nt, Artificial Sequence
  Description of Artificial Sequence: Synthetic oligonucleotide
uaccuguuuuuuuuaaag

SEQ ID NO: 14207 - RNA, 18 nt, Artificial Sequence
  Description of Artificial Sequence: Synthetic oligonucleotide
auaacuaccuguuuuuuu

SEQ ID NO: 14208 - RNA, 18 nt, Artificial Sequence
  Description of Artificial Sequence: Synthetic oligonucleotide
cucccauaacuaccuguu

SEQ ID NO: 14209 - RNA, 18 nt, Artificial Sequence
  Description of Artificial Sequence: Synthetic oligonucleotide
aguuccucccauaacuac

SEQ ID NO: 14210 - RNA, 18 nt, Artificial Sequence
  Description of Artificial Sequence: Synthetic oligonucleotide
agguaaguuccucccaua

SEQ ID NO: 14211 - RNA, 18 nt, Artificial Sequence
  Description of Artificial Sequence: Synthetic oligonucleotide
uaucaagguaaguuccuc

SEQ ID NO: 14212 - RNA, 18 nt, Artificial Sequence
  Description of Artificial Sequence: Synthetic oligonucleotide
auuucuaucaagguaagu

SEQ ID NO: 14213 - RNA, 18 nt, Artificial Sequence
  Description of Artificial Sequence: Synthetic oligonucleotide
auuccauuucuaucaagg

SEQ ID NO: 14214 - RNA, 18 nt, Artificial Sequence
  Description of Artificial Sequence: Synthetic oligonucleotide
ucaauauuccauuucuau

SEQ ID NO: 14215 - RNA, 18 nt, Artificial Sequence
  Description of Artificial Sequence: Synthetic oligonucleotide
aaagaucaauauuccauu

SEQ ID NO: 14216 - RNA, 18 nt, Artificial Sequence
  Description of Artificial Sequence: Synthetic oligonucleotide
ucugcaaagaucaauauu

SEQ ID NO: 14217 - RNA, 18 nt, Artificial Sequence
  Description of Artificial Sequence: Synthetic oligonucleotide
caucaucugcaaagauca

SEQ ID NO: 14218 - RNA, 18 nt, Artificial Sequence
  Description of Artificial Sequence: Synthetic oligonucleotide
agcaucaucaucugcaaa

SEQ ID NO: 14219 - RNA, 18 nt, Artificial Sequence
  Description of Artificial Sequence: Synthetic oligonucleotide
cgaguagcaucaucaucu

SEQ ID NO: 14220 - RNA, 18 nt, Artificial Sequence
  Description of Artificial Sequence: Synthetic oligonucleotide
ucuaacgaguagcaucau

SEQ ID NO: 14221 - RNA, 18 nt, Artificial Sequence
  Description of Artificial Sequence: Synthetic oligonucleotide
uuggcucuaacgaguagc

SEQ ID NO: 14222 - RNA, 18 nt, Artificial Sequence
  Description of Artificial Sequence: Synthetic oligonucleotide
uuuucuuggcucuaacga

SEQ ID NO: 14223 - RNA, 18 nt, Artificial Sequence
  Description of Artificial Sequence: Synthetic oligonucleotide
cuuuauuuucuuggcucu

SEQ ID NO: 14224 - RNA, 18 nt, Artificial Sequence
  Description of Artificial Sequence: Synthetic oligonucleotide
ucaugcuuuauuuucuug

SEQ ID NO: 14225 - RNA, 18 nt, Artificial Sequence
  Description of Artificial Sequence: Synthetic oligonucleotide
gcuuuucaugcuuuauuu

SEQ ID NO: 14226 - RNA, 18 nt, Artificial Sequence
  Description of Artificial Sequence: Synthetic oligonucleotide
ugcuuucuccaugaugua

SEQ ID NO: 14227 - RNA, 18 nt, Artificial Sequence
  Description of Artificial Sequence: Synthetic oligonucleotide
agaucugcuuucuccaug

SEQ ID NO: 14228 - RNA, 18 nt, Artificial Sequence
  Description of Artificial Sequence: Synthetic oligonucleotide
ugacaagaucugcuuucu

SEQ ID NO: 14229 - RNA, 18 nt, Artificial Sequence
  Description of Artificial Sequence: Synthetic oligonucleotide
aacuaugacaagaucugc

SEQ ID NO: 14230 - RNA, 18 nt, Artificial Sequence
  Description of Artificial Sequence: Synthetic oligonucleotide
gcaccaacuaugacaaga

SEQ ID NO: 14231 - RNA, 18 nt, Artificial Sequence
  Description of Artificial Sequence: Synthetic oligonucleotide
cuucagcaccaacuauga

SEQ ID NO: 14232 - RNA, 18 nt, Artificial Sequence
  Description of Artificial Sequence: Synthetic oligonucleotide
aacuccuucagcaccaac

SEQ ID NO: 14233 - RNA, 18 nt, Artificial Sequence
  Description of Artificial Sequence: Synthetic oligonucleotide
ucaacaacuccuucagca

SEQ ID NO: 14234 - RNA, 18 nt, Artificial Sequence
  Description of Artificial Sequence: Synthetic oligonucleotide
cguuuucaacaacuccuu

SEQ ID NO: 14235 - RNA, 18 nt, Artificial Sequence
  Description of Artificial Sequence: Synthetic oligonucleotide
uccuccguuuucaacaac

SEQ ID NO: 14236 - RNA, 18 nt, Artificial Sequence
  Description of Artificial Sequence: Synthetic oligonucleotide
auaauuccuccguuuuca

SEQ ID NO: 14237 - RNA, 18 nt, Artificial Sequence
  Description of Artificial Sequence: Synthetic oligonucleotide
uguuaauaauuccuccgu

SEQ ID NO: 14238 - RNA, 18 nt, Artificial Sequence
  Description of Artificial Sequence: Synthetic oligonucleotide
acaguuugcacuuccggg

SEQ ID NO: 14239 - RNA, 18 nt, Artificial Sequence
  Description of Artificial Sequence: Synthetic oligonucleotide
accacacaguuugcacuu

SEQ ID NO: 14240 - RNA, 18 nt, Artificial Sequence
  Description of Artificial Sequence: Synthetic oligonucleotide
gccagaccacacaguuug

SEQ ID NO: 14241 - RNA, 18 nt, Artificial Sequence
  Description of Artificial Sequence: Synthetic oligonucleotide
caccugccagaccacaca

SEQ ID NO: 14242 - RNA, 18 nt, Artificial Sequence
  Description of Artificial Sequence: Synthetic oligonucleotide
auccacaccugccagacc

SEQ ID NO: 14243 - RNA, 18 nt, Artificial Sequence
  Description of Artificial Sequence: Synthetic oligonucleotide
gcggaauccacaccugcc

SEQ ID NO: 14244 - RNA, 18 nt, Artificial Sequence
  Description of Artificial Sequence: Synthetic oligonucleotide
caccggcggaauccacac

SEQ ID NO: 14245 - RNA, 18 nt, Artificial Sequence
  Description of Artificial Sequence: Synthetic oligonucleotide
gccuucaccggcggaauc

SEQ ID NO: 14246 - RNA, 18 nt, Artificial Sequence
  Description of Artificial Sequence: Synthetic oligonucleotide
cuucagccuucaccggcg

SEQ ID NO: 14247 - RNA, 18 nt, Artificial Sequence
  Description of Artificial Sequence: Synthetic oligonucleotide
gcugccuucagccuucac

SEQ ID NO: 14248 - RNA, 18 nt, Artificial Sequence
  Description of Artificial Sequence: Synthetic oligonucleotide
agguagcugccuucagcc

SEQ ID NO: 14249 - RNA, 18 nt, Artificial Sequence
  Description of Artificial Sequence: Synthetic oligonucleotide
cuuuaagguagcugccuu

SEQ ID NO: 14250 - RNA, 18 nt, Artificial Sequence
  Description of Artificial Sequence: Synthetic oligonucleotide
ggcaucuuuaagguagcu

SEQ ID NO: 14251 - RNA, 18 nt, Artificial Sequence
  Description of Artificial Sequence: Synthetic oligonucleotide
aucccggcaucuuuaagg

SEQ ID NO: 14252 - RNA, 18 nt, Artificial Sequence
  Description of Artificial Sequence: Synthetic oligonucleotide
ugcggaucccggcaucuu

SEQ ID NO: 14253 - RNA, 18 nt, Artificial Sequence
  Description of Artificial Sequence: Synthetic oligonucleotide
uucgcugcggaucccggc

SEQ ID NO: 14254 - RNA, 18 nt, Artificial Sequence
  Description of Artificial Sequence: Synthetic oligonucleotide
agcccuucgcugcggauc

SEQ ID NO: 14255 - RNA, 18 nt, Artificial Sequence
  Description of Artificial Sequence: Synthetic oligonucleotide
cuccgagcccuucgcugc

SEQ ID NO: 14256 - RNA, 18 nt, Artificial Sequence
  Description of Artificial Sequence: Synthetic oligonucleotide
gacaacuccgagcccuuc

SEQ ID NO: 14257 - RNA, 18 nt, Artificial Sequence
  Description of Artificial Sequence: Synthetic oligonucleotide
ucucugacaacuccgagc

SEQ ID NO: 14258 - RNA, 18 nt, Artificial Sequence
  Description of Artificial Sequence: Synthetic oligonucleotide
gauccucucugacaacuc

SEQ ID NO: 14259 - RNA, 18 nt, Artificial Sequence
  Description of Artificial Sequence: Synthetic oligonucleotide
cucucgauccucucugac

SEQ ID NO: 14260 - RNA, 18 nt, Artificial Sequence
  Description of Artificial Sequence: Synthetic oligonucleotide
cgaagcucucgauccucu

SEQ ID NO: 14261 - RNA, 18 nt, Artificial Sequence
  Description of Artificial Sequence: Synthetic oligonucleotide
cuccacgaagcucucgau

SEQ ID NO: 14262 - RNA, 18 nt, Artificial Sequence
  Description of Artificial Sequence: Synthetic oligonucleotide
agggucuccacgaagcuc

SEQ ID NO: 14263 - RNA, 18 nt, Artificial Sequence
  Description of Artificial Sequence: Synthetic oligonucleotide
gcuucagggucuccacga

SEQ ID NO: 14264 - RNA, 18 nt, Artificial Sequence
  Description of Artificial Sequence: Synthetic oligonucleotide
accccgcuucagggucuc

SEQ ID NO: 14265 - RNA, 18 nt, Artificial Sequence
  Description of Artificial Sequence: Synthetic oligonucleotide
ccaccaccccgcuucagg

SEQ ID NO: 14266 - RNA, 18 nt, Artificial Sequence
  Description of Artificial Sequence: Synthetic oligonucleotide
gcggcccaccaccccgcu

SEQ ID NO: 14267 - RNA, 18 nt, Artificial Sequence
  Description of Artificial Sequence: Synthetic oligonucleotide
gcugcgcggcccaccacc

SEQ ID NO: 14268 - RNA, 18 nt, Artificial Sequence
  Description of Artificial Sequence: Synthetic oligonucleotide
ucggagcugcgcggccca

SEQ ID NO: 14269 - RNA, 18 nt, Artificial Sequence
  Description of Artificial Sequence: Synthetic oligonucleotide
uuuccucggagcugcgcg

SEQ ID NO: 14270 - RNA, 18 nt, Artificial Sequence
  Description of Artificial Sequence: Synthetic oligonucleotide
agccauuuccucggagcu

SEQ ID NO: 14271 - RNA, 18 nt, Artificial Sequence
  Description of Artificial Sequence: Synthetic oligonucleotide
ucccgagccauuuccucg

SEQ ID NO: 14272 - RNA, 18 nt, Artificial Sequence
  Description of Artificial Sequence: Synthetic oligonucleotide
gggucucccgagccauuu

SEQ ID NO: 14273 - RNA, 18 nt, Artificial Sequence
  Description of Artificial Sequence: Synthetic oligonucleotide
cccuagggucucccgagc

SEQ ID NO: 14274 - RNA, 18 nt, Artificial Sequence
  Description of Artificial Sequence: Synthetic oligonucleotide
agcaacccuagggucucc

SEQ ID NO: 14275 - RNA, 18 nt, Artificial Sequence
  Description of Artificial Sequence: Synthetic oligonucleotide
ggcgcagcaacccuaggg

SEQ ID NO: 14276 - RNA, 18 nt, Artificial Sequence
  Description of Artificial Sequence: Synthetic oligonucleotide
gaucuggcgcagcaaccc

SEQ ID NO: 14277 - RNA, 18 nt, Artificial Sequence
  Description of Artificial Sequence: Synthetic oligonucleotide
gugaugaucuggcgcagc

SEQ ID NO: 14278 - RNA, 18 nt, Artificial Sequence
  Description of Artificial Sequence: Synthetic oligonucleotide
gguccgugaugaucuggc

SEQ ID NO: 14279 - RNA, 18 nt, Artificial Sequence
  Description of Artificial Sequence: Synthetic oligonucleotide
gcggugguccgugaugau

SEQ ID NO: 14280 - RNA, 18 nt, Artificial Sequence
  Description of Artificial Sequence: Synthetic oligonucleotide
cuccagcggugguccgug

SEQ ID NO: 14281 - RNA, 18 nt, Artificial Sequence
  Description of Artificial Sequence: Synthetic oligonucleotide
cguugcuccagcgguggu

SEQ ID NO: 14282 - RNA, 18 nt, Artificial Sequence
  Description of Artificial Sequence: Synthetic oligonucleotide
cggcggaggcaggccggc

SEQ ID NO: 14283 - RNA, 18 nt, Artificial Sequence
  Description of Artificial Sequence: Synthetic oligonucleotide
uucgccggcggaggcagg

SEQ ID NO: 14284 - RNA, 18 nt, Artificial Sequence
  Description of Artificial Sequence: Synthetic oligonucleotide
ccagguucgccggcggag

SEQ ID NO: 14285 - RNA, 18 nt, Artificial Sequence
  Description of Artificial Sequence: Synthetic oligonucleotide
gggccagguucgccggcg

SEQ ID NO: 14286 - RNA, 18 nt, Artificial Sequence
  Description of Artificial Sequence: Synthetic oligonucleotide
gaucgggaacagacaggg

SEQ ID NO: 14287 - RNA, 18 nt, Artificial Sequence
  Description of Artificial Sequence: Synthetic oligonucleotide
ccugggaucgggaacaga

SEQ ID NO: 14288 - RNA, 18 nt, Artificial Sequence
  Description of Artificial Sequence: Synthetic oligonucleotide
ucagcccugggaucggga

SEQ ID NO: 14289 - RNA, 18 nt, Artificial Sequence
  Description of Artificial Sequence: Synthetic oligonucleotide
aauuuucagcccugggau

SEQ ID NO: 14290 - RNA, 18 nt, Artificial Sequence
  Description of Artificial Sequence: Synthetic oligonucleotide
ugggaaauuuucagcccu

SEQ ID NO: 14291 - RNA, 18 nt, Artificial Sequence
  Description of Artificial Sequence: Synthetic oligonucleotide
aggccugggaaauuuuca

SEQ ID NO: 14292 - RNA, 18 nt, Artificial Sequence
  Description of Artificial Sequence: Synthetic oligonucleotide
aagugaggccugggaaau

SEQ ID NO: 14293 - RNA, 18 nt, Artificial Sequence
  Description of Artificial Sequence: Synthetic oligonucleotide
acgcgaagugaggccugg

SEQ ID NO: 14294 - RNA, 18 nt, Artificial Sequence
  Description of Artificial Sequence: Synthetic oligonucleotide
gaucgggaacagacaggg

SEQ ID NO: 14295 - RNA, 18 nt, Artificial Sequence
  Description of Artificial Sequence: Synthetic oligonucleotide
cugggaucgggaacagac

SEQ ID NO: 14296 - RNA, 18 nt, Artificial Sequence
  Description of Artificial Sequence: Synthetic oligonucleotide
cagcccugggaucgggaa

SEQ ID NO: 14297 - RNA, 18 nt, Artificial Sequence
  Description of Artificial Sequence: Synthetic oligonucleotide
auuuucagcccugggauc

SEQ ID NO: 14298 - RNA, 18 nt, Artificial Sequence
  Description of Artificial Sequence: Synthetic oligonucleotide
gggaaauuuucagcccug

SEQ ID NO: 14299 - RNA, 18 nt, Artificial Sequence
  Description of Artificial Sequence: Synthetic oligonucleotide
ggccugggaaauuuucag

SEQ ID NO: 14300 - RNA, 18 nt, Artificial Sequence
  Description of Artificial Sequence: Synthetic oligonucleotide
agugaggccugggaaauu

SEQ ID NO: 14301 - RNA, 18 nt, Artificial Sequence
  Description of Artificial Sequence: Synthetic oligonucleotide
cgcgaagugaggccuggg

SEQ ID NO: 14302 - RNA, 18 nt, Artificial Sequence
  Description of Artificial Sequence: Synthetic oligonucleotide
gccaacgcgaagugaggc

SEQ ID NO: 14303 - RNA, 18 nt, Artificial Sequence
  Description of Artificial Sequence: Synthetic oligonucleotide
gaggagccaacgcgaagu

SEQ ID NO: 14304 - RNA, 18 nt, Artificial Sequence
  Description of Artificial Sequence: Synthetic oligonucleotide
gauaagaggagccaacgc

SEQ ID NO: 14305 - RNA, 18 nt, Artificial Sequence
  Description of Artificial Sequence: Synthetic oligonucleotide
gagaggauaagaggagcc

SEQ ID NO: 14306 - RNA, 18 nt, Artificial Sequence
  Description of Artificial Sequence: Synthetic oligonucleotide
aucagcuccaucagcucc

SEQ ID NO: 14307 - RNA, 18 nt, Artificial Sequence
  Description of Artificial Sequence: Synthetic oligonucleotide
ugcggaucagcuccauca

SEQ ID NO: 14308 - RNA, 18 nt, Artificial Sequence
  Description of Artificial Sequence: Synthetic oligonucleotide
cucucugcggaucagcuc

SEQ ID NO: 14309 - RNA, 18 nt, Artificial Sequence
  Description of Artificial Sequence: Synthetic oligonucleotide
cugcccucucugcggauc

SEQ ID NO: 14310 - RNA, 18 nt, Artificial Sequence
  Description of Artificial Sequence: Synthetic oligonucleotide
uccuccugcccucucugc

SEQ ID NO: 14311 - RNA, 18 nt, Artificial Sequence
  Description of Artificial Sequence: Synthetic oligonucleotide
cgucauccuccugcccuc

SEQ ID NO: 14312 - RNA, 18 nt, Artificial Sequence
  Description of Artificial Sequence: Synthetic oligonucleotide
gcggccgucauccuccug

SEQ ID NO: 14313 - RNA, 18 nt, Artificial Sequence
  Description of Artificial Sequence: Synthetic oligonucleotide
gcugagcggccgucaucc

SEQ ID NO: 14314 - RNA, 18 nt, Artificial Sequence
  Description of Artificial Sequence: Synthetic oligonucleotide
ggagggcugagcggccgu

SEQ ID NO: 14315 - RNA, 18 nt, Artificial Sequence
  Description of Artificial Sequence: Synthetic oligonucleotide
gucucggagggcugagcg

SEQ ID NO: 14316 - RNA, 18 nt, Artificial Sequence
  Description of Artificial Sequence: Synthetic oligonucleotide
cgguggucucggagggcu

SEQ ID NO: 14317 - RNA, 18 nt, Artificial Sequence
  Description of Artificial Sequence: Synthetic oligonucleotide
gcccacgguggucucgga

SEQ ID NO: 14318 - RNA, 18 nt, Artificial Sequence
  Description of Artificial Sequence: Synthetic oligonucleotide
auguugcccacggugguc

SEQ ID NO: 14319 - RNA, 18 nt, Artificial Sequence
  Description of Artificial Sequence: Synthetic oligonucleotide
gcaccauguugcccacgg

SEQ ID NO: 14320 - RNA, 18 nt, Artificial Sequence
  Description of Artificial Sequence: Synthetic oligonucleotide
ucuccgcaccauguugcc

SEQ ID NO: 14321 - RNA, 18 nt, Artificial Sequence
  Description of Artificial Sequence: Synthetic oligonucleotide
agcacucuccgcaccaug

SEQ ID NO: 14322 - RNA, 18 nt, Artificial Sequence
  Description of Artificial Sequence: Synthetic oligonucleotide
ucuugagcacucuccgca

SEQ ID NO: 14323 - RNA, 18 nt, Artificial Sequence
  Description of Artificial Sequence: Synthetic oligonucleotide
gauaaucuugagcacucu

SEQ ID NO: 14324 - RNA, 18 nt, Artificial Sequence
  Description of Artificial Sequence: Synthetic oligonucleotide
ucccggauaaucuugagc

SEQ ID NO: 14325 - RNA, 18 nt, Artificial Sequence
  Description of Artificial Sequence: Synthetic oligonucleotide
acuccucccggauaaucu

SEQ ID NO: 14326 - RNA, 18 nt, Artificial Sequence
  Description of Artificial Sequence: Synthetic oligonucleotide
gccauacuccucccggau

SEQ ID NO: 14327 - RNA, 18 nt, Artificial Sequence
  Description of Artificial Sequence: Synthetic oligonucleotide
cccaagggagccacgcgu

SEQ ID NO: 14328 - RNA, 18 nt, Artificial Sequence
  Description of Artificial Sequence: Synthetic oligonucleotide
gccagcccaagggagcca

SEQ ID NO: 14329 - RNA, 18 nt, Artificial Sequence
  Description of Artificial Sequence: Synthetic oligonucleotide
cucccgccagcccaaggg

SEQ ID NO: 14330 - RNA, 18 nt, Artificial Sequence
  Description of Artificial Sequence: Synthetic oligonucleotide
ggccccucccgccagccc

SEQ ID NO: 14331 - RNA, 18 nt, Artificial Sequence
  Description of Artificial Sequence: Synthetic oligonucleotide
ccuccggccccucccgcc

SEQ ID NO: 14332 - RNA, 18 nt, Artificial Sequence
  Description of Artificial Sequence: Synthetic oligonucleotide
gcgagccuccggccccuc

SEQ ID NO: 14333 - RNA, 18 nt, Artificial Sequence
  Description of Artificial Sequence: Synthetic oligonucleotide
cccucgcgagccuccggc

SEQ ID NO: 14334 - RNA, 18 nt, Artificial Sequence
  Description of Artificial Sequence: Synthetic oligonucleotide
cccgccccucgcgagccu

SEQ ID NO: 14335 - RNA, 18 nt, Artificial Sequence
  Description of Artificial Sequence: Synthetic oligonucleotide
ccgcccccgccccucgcg

SEQ ID NO: 14336 - RNA, 18 nt, Artificial Sequence
  Description of Artificial Sequence: Synthetic oligonucleotide
cgucgccgcccccgcccc

SEQ ID NO: 14337 - RNA, 18 nt, Artificial Sequence
  Description of Artificial Sequence: Synthetic oligonucleotide
gccgccgucgccgccccc

SEQ ID NO: 14338 - RNA, 18 nt, Artificial Sequence
  Description of Artificial Sequence: Synthetic oligonucleotide
gcuccgccgccgucgccg

SEQ ID NO: 14339 - RNA, 18 nt, Artificial Sequence
  Description of Artificial Sequence: Synthetic oligonucleotide
ccuacgcuccgccgccgu

SEQ ID NO: 14340 - RNA, 18 nt, Artificial Sequence
  Description of Artificial Sequence: Synthetic oligonucleotide
ccuccccuacgcuccgcc

SEQ ID NO: 14341 - RNA, 18 nt, Artificial Sequence
  Description of Artificial Sequence: Synthetic oligonucleotide
gguccccuccccuacgcu

SEQ ID NO: 14342 - RNA, 18 nt, Artificial Sequence
  Description of Artificial Sequence: Synthetic oligonucleotide
ucuccgguccccuccccu

SEQ ID NO: 14343 - RNA, 18 nt, Artificial Sequence
  Description of Artificial Sequence: Synthetic oligonucleotide
ccuccucuccgguccccu

SEQ ID NO: 14344 - RNA, 18 nt, Artificial Sequence
  Description of Artificial Sequence: Synthetic oligonucleotide
cauccccuccucuccggu

SEQ ID NO: 14345 - RNA, 18 nt, Artificial Sequence
  Description of Artificial Sequence: Synthetic oligonucleotide
gugcucauccccuccucu

SEQ ID NO: 14346 - RNA, 18 nt, Artificial Sequence
  Description of Artificial Sequence: Synthetic oligonucleotide
cccgugugcucauccccu

SEQ ID NO: 14347 - RNA, 18 nt, Artificial Sequence
  Description of Artificial Sequence: Synthetic oligonucleotide
ccucucccgugugcucau

SEQ ID NO: 14348 - RNA, 18 nt, Artificial Sequence
  Description of Artificial Sequence: Synthetic oligonucleotide
cuucuccucucccgugug

SEQ ID NO: 14349 - RNA, 18 nt, Artificial Sequence
  Description of Artificial Sequence: Synthetic oligonucleotide
ucccucuucuccucuccc

SEQ ID NO: 14350 - RNA, 18 nt, Artificial Sequence
  Description of Artificial Sequence: Synthetic oligonucleotide
gggucucccucuucuccu

SEQ ID NO: 14351 - RNA, 18 nt, Artificial Sequence
  Description of Artificial Sequence: Synthetic oligonucleotide
gcggcgggucucccucuu

SEQ ID NO: 14352 - RNA, 18 nt, Artificial Sequence
  Description of Artificial Sequence: Synthetic oligonucleotide
gggaggcggcgggucucc

SEQ ID NO: 14353 - RNA, 18 nt, Artificial Sequence
  Description of Artificial Sequence: Synthetic oligonucleotide
agggagggaggcggcggg

SEQ ID NO: 14354 - RNA, 18 nt, Artificial Sequence
  Description of Artificial Sequence: Synthetic oligonucleotide
uagggagggagggaggcg

SEQ ID NO: 14355 - RNA, 18 nt, Artificial Sequence
  Description of Artificial Sequence: Synthetic oligonucleotide
ucagcuagggagggaggg

SEQ ID NO: 14356 - RNA, 18 nt, Artificial Sequence
  Description of Artificial Sequence: Synthetic oligonucleotide
gcaagucagcuagggagg

SEQ ID NO: 14357 - RNA, 18 nt, Artificial Sequence
  Description of Artificial Sequence: Synthetic oligonucleotide
agggagcaagucagcuag

SEQ ID NO: 14358 - RNA, 18 nt, Artificial Sequence
  Description of Artificial Sequence: Synthetic oligonucleotide
ccgggagggagcaaguca

SEQ ID NO: 14359 - RNA, 18 nt, Artificial Sequence
  Description of Artificial Sequence: Synthetic oligonucleotide
gcagcccgggagggagca

SEQ ID NO: 14360 - RNA, 18 nt, Artificial Sequence
  Description of Artificial Sequence: Synthetic oligonucleotide
cagccgcagcccgggagg

SEQ ID NO: 14361 - RNA, 18 nt, Artificial Sequence
  Description of Artificial Sequence: Synthetic oligonucleotide
ugcagcagccgcagcccg

SEQ ID NO: 14362 - RNA, 18 nt, Artificial Sequence
  Description of Artificial Sequence: Synthetic oligonucleotide
gcuuuugcagcagccgca

SEQ ID NO: 14363 - RNA, 18 nt, Artificial Sequence
  Description of Artificial Sequence: Synthetic oligonucleotide
ugcuggcuuuugcagcag

SEQ ID NO: 14364 - RNA, 18 nt, Artificial Sequence
  Description of Artificial Sequence: Synthetic oligonucleotide
gccgcugcuggcuuuugc

SEQ ID NO: 14365 - RNA, 18 nt, Artificial Sequence
  Description of Artificial Sequence: Synthetic oligonucleotide
ccgcugccgcugcuggcu

SEQ ID NO: 14366 - RNA, 18 nt, Artificial Sequence
  Description of Artificial Sequence: Synthetic oligonucleotide
agcucccgcugccgcugc

SEQ ID NO: 14367 - RNA, 18 nt, Artificial Sequence
  Description of Artificial Sequence: Synthetic oligonucleotide
cggacagcucccgcugcc

SEQ ID NO: 14368 - RNA, 18 nt, Artificial Sequence
  Description of Artificial Sequence: Synthetic oligonucleotide
gccuccggacagcucccg

SEQ ID NO: 14369 - RNA, 18 nt, Artificial Sequence
  Description of Artificial Sequence: Synthetic oligonucleotide
cgccggccuccggacagc

SEQ ID NO: 14370 - RNA, 18 nt, Artificial Sequence
  Description of Artificial Sequence: Synthetic oligonucleotide
cucgacgccggccuccgg

SEQ ID NO: 14371 - RNA, 18 nt, Artificial Sequence
  Description of Artificial Sequence: Synthetic oligonucleotide
cucaccucgacgccggcc

SEQ ID NO: 14372 - RNA, 18 nt, Artificial Sequence
  Description of Artificial Sequence: Synthetic oligonucleotide
cgggucucaccucgacgc

SEQ ID NO: 14373 - RNA, 18 nt, Artificial Sequence
  Description of Artificial Sequence: Synthetic oligonucleotide
cugcccgggucucaccuc

SEQ ID NO: 14374 - RNA, 18 nt, Artificial Sequence
  Description of Artificial Sequence: Synthetic oligonucleotide
ucagucugcccgggucuc

SEQ ID NO: 14375 - RNA, 18 nt, Artificial Sequence
  Description of Artificial Sequence: Synthetic oligonucleotide
cagccucagucugcccgg

SEQ ID NO: 14376 - RNA, 18 nt, Artificial Sequence
  Description of Artificial Sequence: Synthetic oligonucleotide
gccgucggucgguccacu

SEQ ID NO: 14377 - RNA, 18 nt, Artificial Sequence
  Description of Artificial Sequence: Synthetic oligonucleotide
cgucagccgucggucggu

SEQ ID NO: 14378 - RNA, 18 nt, Artificial Sequence
  Description of Artificial Sequence: Synthetic oligonucleotide
cccggcgucagccgucgg

SEQ ID NO: 14379 - RNA, 18 nt, Artificial Sequence
  Description of Artificial Sequence: Synthetic oligonucleotide
guccgcccggcgucagcc

SEQ ID NO: 14380 - RNA, 18 nt, Artificial Sequence
  Description of Artificial Sequence: Synthetic oligonucleotide
gugcaguccgcccggcgu

SEQ ID NO: 14381 - RNA, 18 nt, Artificial Sequence
  Description of Artificial Sequence: Synthetic oligonucleotide
uucccgugcaguccgccc

SEQ ID NO: 14382 - RNA, 18 nt, Artificial Sequence
  Description of Artificial Sequence: Synthetic oligonucleotide
ccgcauucccgugcaguc

SEQ ID NO: 14383 - RNA, 18 nt, Artificial Sequence
  Description of Artificial Sequence: Synthetic oligonucleotide
gacacccgcauucccgug

SEQ ID NO: 14384 - RNA, 18 nt, Artificial Sequence
  Description of Artificial Sequence: Synthetic oligonucleotide
cuccagacacccgcauuc

SEQ ID NO: 14385 - RNA, 18 nt, Artificial Sequence
  Description of Artificial Sequence: Synthetic oligonucleotide
cagcccuccagacacccg

SEQ ID NO: 14386 - RNA, 18 nt, Artificial Sequence
  Description of Artificial Sequence: Synthetic oligonucleotide
accaccagcccuccagac

SEQ ID NO: 14387 - RNA, 18 nt, Artificial Sequence
  Description of Artificial Sequence: Synthetic oligonucleotide
gcaccaccaccagcccuc

SEQ ID NO: 14388 - RNA, 18 nt, Artificial Sequence
  Description of Artificial Sequence: Synthetic oligonucleotide
gcccagcaccaccaccag

SEQ ID NO: 14389 - RNA, 18 nt, Artificial Sequence
  Description of Artificial Sequence: Synthetic oligonucleotide
agcccgcccagcaccacc

SEQ ID NO: 14390 - RNA, 18 nt, Artificial Sequence
  Description of Artificial Sequence: Synthetic oligonucleotide
gguucagcccgcccagca

SEQ ID NO: 14391 - RNA, 18 nt, Artificial Sequence
  Description of Artificial Sequence: Synthetic oligonucleotide
ccgaugguucagcccgcc

SEQ ID NO: 14392 - RNA, 18 nt, Artificial Sequence
  Description of Artificial Sequence: Synthetic oligonucleotide
uccucccgaugguucagc

SEQ ID NO: 14393 - RNA, 18 nt, Artificial Sequence
  Description of Artificial Sequence: Synthetic oligonucleotide
gcgccuccucccgauggu

SEQ ID NO: 14394 - RNA, 18 nt, Artificial Sequence
  Description of Artificial Sequence: Synthetic oligonucleotide
ggcuggcgccuccucccg

SEQ ID NO: 14395 - RNA, 18 nt, Artificial Sequence
  Description of Artificial Sequence: Synthetic oligonucleotide
cggugggcuggcgccucc

SEQ ID NO: 14396 - RNA, 18 nt, Artificial Sequence
  Description of Artificial Sequence: Synthetic oligonucleotide
gccuucggugggcuggcg

SEQ ID NO: 14397 - RNA, 18 nt, Artificial Sequence
  Description of Artificial Sequence: Synthetic oligonucleotide
cccucgccuucggugggc

SEQ ID NO: 14398 - RNA, 18 nt, Artificial Sequence
  Description of Artificial Sequence: Synthetic oligonucleotide
ggcuucccucgccuucgg

SEQ ID NO: 14399 - RNA, 18 nt, Artificial Sequence
  Description of Artificial Sequence: Synthetic oligonucleotide
gggcuucccucgccuucg

SEQ ID NO: 14400 - RNA, 18 nt, Artificial Sequence
  Description of Artificial Sequence: Synthetic oligonucleotide
gucagccccucucccggg

SEQ ID NO: 14401 - RNA, 18 nt, Artificial Sequence
  Description of Artificial Sequence: Synthetic oligonucleotide
ccccugucagccccucuc

SEQ ID NO: 14402 - RNA, 18 nt, Artificial Sequence
  Description of Artificial Sequence: Synthetic oligonucleotide
ucgauccccugucagccc

SEQ ID NO: 14403 - RNA, 18 nt, Artificial Sequence
  Description of Artificial Sequence: Synthetic oligonucleotide
cuccuucgauccccuguc

SEQ ID NO: 14404 - RNA, 18 nt, Artificial Sequence
  Description of Artificial Sequence: Synthetic oligonucleotide
guuaucuccuucgauccc

SEQ ID NO: 14405 - RNA, 18 nt, Artificial Sequence
  Description of Artificial Sequence: Synthetic oligonucleotide
accugguuaucuccuucg

SEQ ID NO: 14406 - RNA, 18 nt, Artificial Sequence
  Description of Artificial Sequence: Synthetic oligonucleotide
gggaccugguuaucuccu

SEQ ID NO: 14407 - RNA, 18 nt, Artificial Sequence
  Description of Artificial Sequence: Synthetic oligonucleotide
cucccgccccuuucuggg

SEQ ID NO: 14408 - RNA, 18 nt, Artificial Sequence
  Description of Artificial Sequence: Synthetic oligonucleotide
ggacgcucccgccccuuu

SEQ ID NO: 14409 - RNA, 18 nt, Artificial Sequence
  Description of Artificial Sequence: Synthetic oligonucleotide
ggcgaggacgcucccgcc

SEQ ID NO: 14410 - RNA, 18 nt, Artificial Sequence
  Description of Artificial Sequence: Synthetic oligonucleotide
uuuagggcgaggacgcuc

SEQ ID NO: 14411 - RNA, 18 nt, Artificial Sequence
  Description of Artificial Sequence: Synthetic oligonucleotide
gcgcguuuagggcgagga

SEQ ID NO: 14412 - RNA, 18 nt, Artificial Sequence
  Description of Artificial Sequence: Synthetic oligonucleotide
uugcugcgcguuuagggc

SEQ ID NO: 14413 - RNA, 18 nt, Artificial Sequence
  Description of Artificial Sequence: Synthetic oligonucleotide
uuuucuugcugcgcguuu

SEQ ID NO: 14414 - RNA, 18 nt, Artificial Sequence
  Description of Artificial Sequence: Synthetic oligonucleotide
gcggguuuucuugcugcg

SEQ ID NO: 14415 - RNA, 18 nt, Artificial Sequence
  Description of Artificial Sequence: Synthetic oligonucleotide
gcggugcggguuuucuug

SEQ ID NO: 14416 - RNA, 18 nt, Artificial Sequence
  Description of Artificial Sequence: Synthetic oligonucleotide
cccaggcggugcggguuu

SEQ ID NO: 14417 - RNA, 18 nt, Artificial Sequence
  Description of Artificial Sequence: Synthetic oligonucleotide
gggcucccaggcggugcg

SEQ ID NO: 14418 - RNA, 18 nt, Artificial Sequence
  Description of Artificial Sequence: Synthetic oligonucleotide
ucccugggcucccaggcg

SEQ ID NO: 14419 - RNA, 18 nt, Artificial Sequence
  Description of Artificial Sequence: Synthetic oligonucleotide
ccuccucccugggcuccc

SEQ ID NO: 14420 - RNA, 18 nt, Artificial Sequence
  Description of Artificial Sequence: Synthetic oligonucleotide
ccuccccuccucccuggg

SEQ ID NO: 14421 - RNA, 18 nt, Artificial Sequence
  Description of Artificial Sequence: Synthetic oligonucleotide
ugcauccuccccuccucc

SEQ ID NO: 14422 - RNA, 18 nt, Artificial Sequence
  Description of Artificial Sequence: Synthetic oligonucleotide
cccucugcauccuccccu

SEQ ID NO: 14423 - RNA, 18 nt, Artificial Sequence
  Description of Artificial Sequence: Synthetic oligonucleotide
ccacucccucugcauccu

SEQ ID NO: 14424 - RNA, 18 nt, Artificial Sequence
  Description of Artificial Sequence: Synthetic oligonucleotide
gcauuccacucccucugc

SEQ ID NO: 14425 - RNA, 18 nt, Artificial Sequence
  Description of Artificial Sequence: Synthetic oligonucleotide
cauucgcauuccacuccc

SEQ ID NO: 14426 - RNA, 18 nt, Artificial Sequence
  Description of Artificial Sequence: Synthetic oligonucleotide
cccgacauucgcauucca

SEQ ID NO: 14427 - RNA, 18 nt, Artificial Sequence
  Description of Artificial Sequence: Synthetic oligonucleotide
gaggacccgacauucgca

SEQ ID NO: 14428 - RNA, 18 nt, Artificial Sequence
  Description of Artificial Sequence: Synthetic oligonucleotide
gggcagaggacccgacau

SEQ ID NO: 14429 - RNA, 18 nt, Artificial Sequence
  Description of Artificial Sequence: Synthetic oligonucleotide
cgacugggcagaggaccc

SEQ ID NO: 14430 - RNA, 18 nt, Artificial Sequence
  Description of Artificial Sequence: Synthetic oligonucleotide
caggccgacugggcagag

SEQ ID NO: 14431 - RNA, 18 nt, Artificial Sequence
  Description of Artificial Sequence: Synthetic oligonucleotide
uccgacaggccgacuggg

SEQ ID NO: 14432 - RNA, 18 nt, Artificial Sequence
  Description of Artificial Sequence: Synthetic oligonucleotide
agcacuccgacaggccga

SEQ ID NO: 14433 - RNA, 18 nt, Artificial Sequence
  Description of Artificial Sequence: Synthetic oligonucleotide
caaauagcacuccgacag

SEQ ID NO: 14434 - RNA, 18 nt, Artificial Sequence
  Description of Artificial Sequence: Synthetic oligonucleotide
cugugcaaauagcacucc

SEQ ID NO: 14435 - RNA, 18 nt, Artificial Sequence
  Description of Artificial Sequence: Synthetic oligonucleotide
acgagcugugcaaauagc

SEQ ID NO: 14436 - RNA, 18 nt, Artificial Sequence
  Description of Artificial Sequence: Synthetic oligonucleotide
aaucaacgagcugugcaa

SEQ ID NO: 14437 - RNA, 18 nt, Artificial Sequence
  Description of Artificial Sequence: Synthetic oligonucleotide
cccaaaaucaacgagcug

SEQ ID NO: 14438 - RNA, 18 nt, Artificial Sequence
  Description of Artificial Sequence: Synthetic oligonucleotide
agcaccccaaaaucaacg

SEQ ID NO: 14439 - RNA, 18 nt, Artificial Sequence
  Description of Artificial Sequence: Synthetic oligonucleotide
aggccgacugggcagagg

SEQ ID NO: 14440 - RNA, 18 nt, Artificial Sequence
  Description of Artificial Sequence: Synthetic oligonucleotide
ccgacaggccgacugggc

SEQ ID NO: 14441 - RNA, 18 nt, Artificial Sequence
  Description of Artificial Sequence: Synthetic oligonucleotide
gcacuccgacaggccgac

SEQ ID NO: 14442 - RNA, 18 nt, Artificial Sequence
  Description of Artificial Sequence: Synthetic oligonucleotide
aaauagcacuccgacagg

SEQ ID NO: 14443 - RNA, 18 nt, Artificial Sequence
  Description of Artificial Sequence: Synthetic oligonucleotide
ugugcaaauagcacuccg

SEQ ID NO: 14444 - RNA, 18 nt, Artificial Sequence
  Description of Artificial Sequence: Synthetic oligonucleotide
cgagcugugcaaauagca

SEQ ID NO: 14445 - RNA, 18 nt, Artificial Sequence
  Description of Artificial Sequence: Synthetic oligonucleotide
aucaacgagcugugcaaa

SEQ ID NO: 14446 - RNA, 18 nt, Artificial Sequence
  Description of Artificial Sequence: Synthetic oligonucleotide
ccaaaaucaacgagcugu

SEQ ID NO: 14447 - RNA, 18 nt, Artificial Sequence
  Description of Artificial Sequence: Synthetic oligonucleotide
gcaccccaaaaucaacga

SEQ ID NO: 14448 - RNA, 18 nt, Artificial Sequence
  Description of Artificial Sequence: Synthetic oligonucleotide
ucccagcaccccaaaauc

SEQ ID NO: 14449 - RNA, 18 nt, Artificial Sequence
  Description of Artificial Sequence: Synthetic oligonucleotide
ucagaucccagcacccca

SEQ ID NO: 14450 - RNA, 18 nt, Artificial Sequence
  Description of Artificial Sequence: Synthetic oligonucleotide
gacucucagaucccagca

SEQ ID NO: 14451 - RNA, 18 nt, Artificial Sequence
  Description of Artificial Sequence: Synthetic oligonucleotide
auccagacucucagaucc

SEQ ID NO: 14452 - RNA, 18 nt, Artificial Sequence
  Description of Artificial Sequence: Synthetic oligonucleotide
acaagauccagacucuca

SEQ ID NO: 14453 - RNA, 18 nt, Artificial Sequence
  Description of Artificial Sequence: Synthetic oligonucleotide
auccaacaagauccagac

SEQ ID NO: 14454 - RNA, 18 nt, Artificial Sequence
  Description of Artificial Sequence: Synthetic oligonucleotide
gguccauccaacaagauc

SEQ ID NO: 14455 - RNA, 18 nt, Artificial Sequence
  Description of Artificial Sequence: Synthetic oligonucleotide
cccuggguccauccaaca

SEQ ID NO: 14456 - RNA, 18 nt, Artificial Sequence
  Description of Artificial Sequence: Synthetic oligonucleotide
ucucucccuggguccauc

SEQ ID NO: 14457 - RNA, 18 nt, Artificial Sequence
  Description of Artificial Sequence: Synthetic oligonucleotide
cagggucucucccugggu

SEQ ID NO: 14458 - RNA, 18 nt, Artificial Sequence
  Description of Artificial Sequence: Synthetic oligonucleotide
uucuccagggucucuccc

SEQ ID NO: 14459 - RNA, 18 nt, Artificial Sequence
  Description of Artificial Sequence: Synthetic oligonucleotide
ggaccuucuccagggucu

SEQ ID NO: 14460 - RNA, 18 nt, Artificial Sequence
  Description of Artificial Sequence: Synthetic oligonucleotide
aaacaggaccuucuccag

SEQ ID NO: 14461 - RNA, 18 nt, Artificial Sequence
  Description of Artificial Sequence: Synthetic oligonucleotide
uuuguaaacaggaccuuc

SEQ ID NO: 14462 - RNA, 18 nt, Artificial Sequence
  Description of Artificial Sequence: Synthetic oligonucleotide
acccuuuuguaaacagga

SEQ ID NO: 14463 - RNA, 18 nt, Artificial Sequence
  Description of Artificial Sequence: Synthetic oligonucleotide
gauuaacccuuuuguaaa

SEQ ID NO: 14464 - RNA, 18 nt, Artificial Sequence
  Description of Artificial Sequence: Synthetic oligonucleotide
gggaagauuaacccuuuu

SEQ ID NO: 14465 - RNA, 18 nt, Artificial Sequence
  Description of Artificial Sequence: Synthetic oligonucleotide
ugcuuggagagcccuggg

SEQ ID NO: 14466 - RNA, 18 nt, Artificial Sequence
  Description of Artificial Sequence: Synthetic oligonucleotide
cugcuuggagagcccugg

SEQ ID NO: 14467 - RNA, 18 nt, Artificial Sequence
  Description of Artificial Sequence: Synthetic oligonucleotide
gucuucugcuuggagagc

SEQ ID NO: 14468 - RNA, 18 nt, Artificial Sequence
  Description of Artificial Sequence: Synthetic oligonucleotide
ucaaagucuucugcuugg

SEQ ID NO: 14469 - RNA, 18 nt, Artificial Sequence
  Description of Artificial Sequence: Synthetic oligonucleotide
ucuacucaaagucuucug

SEQ ID NO: 14470 - RNA, 18 nt, Artificial Sequence
  Description of Artificial Sequence: Synthetic oligonucleotide
agugcucuacucaaaguc

SEQ ID NO: 14471 - RNA, 18 nt, Artificial Sequence
  Description of Artificial Sequence: Synthetic oligonucleotide
ggaggagugcucuacuca

SEQ ID NO: 14472 - RNA, 18 nt, Artificial Sequence
  Description of Artificial Sequence: Synthetic oligonucleotide
cugcgggaggagugcucu

SEQ ID NO: 14473 - RNA, 18 nt, Artificial Sequence
  Description of Artificial Sequence: Synthetic oligonucleotide
caucccugcgggaggagu

SEQ ID NO: 14474 - RNA, 18 nt, Artificial Sequence
  Description of Artificial Sequence: Synthetic oligonucleotide
ugggacaucccugcggga

SEQ ID NO: 14475 - RNA, 18 nt, Artificial Sequence
  Description of Artificial Sequence: Synthetic oligonucleotide
uagggugggacaucccug

SEQ ID NO: 14476 - RNA, 18 nt, Artificial Sequence
  Description of Artificial Sequence: Synthetic oligonucleotide
ugccuuagggugggacau

SEQ ID NO: 14477 - RNA, 18 nt, Artificial Sequence
  Description of Artificial Sequence: Synthetic oligonucleotide
uccuuugccuuagggugg

SEQ ID NO: 14478 - RNA, 18 nt, Artificial Sequence
  Description of Artificial Sequence: Synthetic oligonucleotide
ggguuuccuuugccuuag

SEQ ID NO: 14479 - RNA, 18 nt, Artificial Sequence
  Description of Artificial Sequence: Synthetic oligonucleotide
agaggaagaaaaguuggg

SEQ ID NO: 14480 - RNA, 18 nt, Artificial Sequence
  Description of Artificial Sequence: Synthetic oligonucleotide
gagaggaagaaaaguugg

SEQ ID NO: 14481 - RNA, 18 nt, Artificial Sequence
  Description of Artificial Sequence: Synthetic oligonucleotide
cuagggagaggaagaaaa

SEQ ID NO: 14482 - RNA, 18 nt, Artificial Sequence
  Description of Artificial Sequence: Synthetic oligonucleotide
ugccucuagggagaggaa

SEQ ID NO: 14483 - RNA, 18 nt, Artificial Sequence
  Description of Artificial Sequence: Synthetic oligonucleotide
ugcacugccucuagggag

SEQ ID NO: 14484 - RNA, 18 nt, Artificial Sequence
  Description of Artificial Sequence: Synthetic oligonucleotide
agccuugcacugccucua

SEQ ID NO: 14485 - RNA, 18 nt, Artificial Sequence
  Description of Artificial Sequence: Synthetic oligonucleotide
gggccagccuugcacugc

SEQ ID NO: 14486 - RNA, 18 nt, Artificial Sequence
  Description of Artificial Sequence: Synthetic oligonucleotide
ucucagggccagccuugc

SEQ ID NO: 14487 - RNA, 18 nt, Artificial Sequence
  Description of Artificial Sequence: Synthetic oligonucleotide
uccugucucagggccagc

SEQ ID NO: 14488 - RNA, 18 nt, Artificial Sequence
  Description of Artificial Sequence: Synthetic oligonucleotide
cacauuccugucucaggg

SEQ ID NO: 14489 - RNA, 18 nt, Artificial Sequence
  Description of Artificial Sequence: Synthetic oligonucleotide
ugggccacauuccugucu

SEQ ID NO: 14490 - RNA, 18 nt, Artificial Sequence
  Description of Artificial Sequence: Synthetic oligonucleotide
ccaauugggccacauucc

SEQ ID NO: 14491 - RNA, 18 nt, Artificial Sequence
  Description of Artificial Sequence: Synthetic oligonucleotide
caggcccaauugggccac

SEQ ID NO: 14492 - RNA, 18 nt, Artificial Sequence
  Description of Artificial Sequence: Synthetic oligonucleotide
cacugcaggcccaauugg

SEQ ID NO: 14493 - RNA, 18 nt, Artificial Sequence
  Description of Artificial Sequence: Synthetic oligonucleotide
cucagcacugcaggccca

SEQ ID NO: 14494 - RNA, 18 nt, Artificial Sequence
  Description of Artificial Sequence: Synthetic oligonucleotide
gggcgcucagcacugcag

SEQ ID NO: 14495 - RNA, 18 nt, Artificial Sequence
  Description of Artificial Sequence: Synthetic oligonucleotide
gaagagggcgcucagcac

SEQ ID NO: 14496 - RNA, 18 nt, Artificial Sequence
  Description of Artificial Sequence: Synthetic oligonucleotide
ggagggaagagggcgcuc

SEQ ID NO: 14497 - RNA, 18 nt, Artificial Sequence
  Description of Artificial Sequence: Synthetic oligonucleotide
ggugaggagggaagaggg

SEQ ID NO: 14498 - RNA, 18 nt, Artificial Sequence
  Description of Artificial Sequence: Synthetic oligonucleotide
gcagagacagcggcaaac

SEQ ID NO: 14499 - RNA, 18 nt, Artificial Sequence
  Description of Artificial Sequence: Synthetic oligonucleotide
gaauagcagagacagcgg

SEQ ID NO: 14500 - RNA, 18 nt, Artificial Sequence
  Description of Artificial Sequence: Synthetic oligonucleotide
ggauggaauagcagagac

SEQ ID NO: 14501 - RNA, 18 nt, Artificial Sequence
  Description of Artificial Sequence: Synthetic oligonucleotide
gggaggauggaauagcag

SEQ ID NO: 14502 - RNA, 18 nt, Artificial Sequence
  Description of Artificial Sequence: Synthetic oligonucleotide
ggagagagccccuauggg

SEQ ID NO: 14503 - RNA, 18 nt, Artificial Sequence
  Description of Artificial Sequence: Synthetic oligonucleotide
gggagagagccccuaugg

SEQ ID NO: 14504 - RNA, 18 nt, Artificial Sequence
  Description of Artificial Sequence: Synthetic oligonucleotide
ucuugagaugggagaggg

SEQ ID NO: 14505 - RNA, 18 nt, Artificial Sequence
  Description of Artificial Sequence: Synthetic oligonucleotide
ugccaucuugagauggga

SEQ ID NO: 14506 - RNA, 18 nt, Artificial Sequence
  Description of Artificial Sequence: Synthetic oligonucleotide
cuggcugccaucuugaga

SEQ ID NO: 14507 - RNA, 18 nt, Artificial Sequence
  Description of Artificial Sequence: Synthetic oligonucleotide
agcugcuggcugccaucu

SEQ ID NO: 14508 - RNA, 18 nt, Artificial Sequence
  Description of Artificial Sequence: Synthetic oligonucleotide
cucagagcugcuggcugc

SEQ ID NO: 14509 - RNA, 18 nt, Artificial Sequence
  Description of Artificial Sequence: Synthetic oligonucleotide
gagaucucagagcugcug

SEQ ID NO: 14510 - RNA, 18 nt, Artificial Sequence
  Description of Artificial Sequence: Synthetic oligonucleotide
ucucagagaucucagagc

SEQ ID NO: 14511 - RNA, 18 nt, Artificial Sequence
  Description of Artificial Sequence: Synthetic oligonucleotide
cuucaucucagagaucuc

SEQ ID NO: 14512 - RNA, 18 nt, Artificial Sequence
  Description of Artificial Sequence: Synthetic oligonucleotide
acccccuucaucucagag

SEQ ID NO: 14513 - RNA, 18 nt, Artificial Sequence
  Description of Artificial Sequence: Synthetic oligonucleotide
ccucaacccccuucaucu

SEQ ID NO: 14514 - RNA, 18 nt, Artificial Sequence
  Description of Artificial Sequence: Synthetic oligonucleotide
acucuccucaacccccuu

SEQ ID NO: 14515 - RNA, 18 nt, Artificial Sequence
  Description of Artificial Sequence: Synthetic oligonucleotide
uugggacucuccucaacc

SEQ ID NO: 14516 - RNA, 18 nt, Artificial Sequence
  Description of Artificial Sequence: Synthetic oligonucleotide
gaaccuugggacucuccu

SEQ ID NO: 14517 - RNA, 18 nt, Artificial Sequence
  Description of Artificial Sequence: Synthetic oligonucleotide
gccuggaaccuugggacu

SEQ ID NO: 14518 - RNA, 18 nt, Artificial Sequence
  Description of Artificial Sequence: Synthetic oligonucleotide
ccuucgccuggaaccuug

SEQ ID NO: 14519 - RNA, 18 nt, Artificial Sequence
  Description of Artificial Sequence: Synthetic oligonucleotide
caggcccuucgccuggaa

SEQ ID NO: 14520 - RNA, 18 nt, Artificial Sequence
  Description of Artificial Sequence: Synthetic oligonucleotide
auggccaggcccuucgcc

SEQ ID NO: 14521 - RNA, 18 nt, Artificial Sequence
  Description of Artificial Sequence: Synthetic oligonucleotide
ucagaauggccaggcccu

SEQ ID NO: 14522 - RNA, 18 nt, Artificial Sequence
  Description of Artificial Sequence: Synthetic oligonucleotide
cagcuucagaauggccag

SEQ ID NO: 14523 - RNA, 18 nt, Artificial Sequence
  Description of Artificial Sequence: Synthetic oligonucleotide
aguuucagcuucagaaug

SEQ ID NO: 14524 - RNA, 18 nt, Artificial Sequence
  Description of Artificial Sequence: Synthetic oligonucleotide
gggccaguuucagcuuca

SEQ ID NO: 14525 - RNA, 18 nt, Artificial Sequence
  Description of Artificial Sequence: Synthetic oligonucleotide
gggagggccaguuucagc

SEQ ID NO: 14526 - RNA, 18 nt, Artificial Sequence
  Description of Artificial Sequence: Synthetic oligonucleotide
ccccugcuaggaccuggg

SEQ ID NO: 14527 - RNA, 18 nt, Artificial Sequence
  Description of Artificial Sequence: Synthetic oligonucleotide
ugguaccccugcuaggac

SEQ ID NO: 14528 - RNA, 18 nt, Artificial Sequence
  Description of Artificial Sequence: Synthetic oligonucleotide
uggucugguaccccugcu

SEQ ID NO: 14529 - RNA, 18 nt, Artificial Sequence
  Description of Artificial Sequence: Synthetic oligonucleotide
cuggcuggucugguaccc

SEQ ID NO: 14530 - RNA, 18 nt, Artificial Sequence
  Description of Artificial Sequence: Synthetic oligonucleotide
ggccucuggcuggucugg

SEQ ID NO: 14531 - RNA, 18 nt, Artificial Sequence
  Description of Artificial Sequence: Synthetic oligonucleotide
gggccucuggcuggucug

SEQ ID NO: 14532 - RNA, 18 nt, Artificial Sequence
  Description of Artificial Sequence: Synthetic oligonucleotide
uuuggaccuggcugcggg

SEQ ID NO: 14533 - RNA, 18 nt, Artificial Sequence
  Description of Artificial Sequence: Synthetic oligonucleotide
ugguguuuggaccuggcu

SEQ ID NO: 14534 - RNA, 18 nt, Artificial Sequence
  Description of Artificial Sequence: Synthetic oligonucleotide
cgcagugguguuuggacc

SEQ ID NO: 14535 - RNA, 18 nt, Artificial Sequence
  Description of Artificial Sequence: Synthetic oligonucleotide
gggccgcagugguguuug

SEQ ID NO: 14536 - RNA, 18 nt, Artificial Sequence
  Description of Artificial Sequence: Synthetic oligonucleotide
ggcccugaguccacaggg

SEQ ID NO: 14537 - RNA, 18 nt, Artificial Sequence
  Description of Artificial Sequence: Synthetic oligonucleotide
ccuugggcccugagucca

SEQ ID NO: 14538 - RNA, 18 nt, Artificial Sequence
  Description of Artificial Sequence: Synthetic oligonucleotide
cccagccuugggcccuga

SEQ ID NO: 14539 - RNA, 18 nt, Artificial Sequence
  Description of Artificial Sequence: Synthetic oligonucleotide
gccagcccagccuugggc

SEQ ID NO: 14540 - RNA, 18 nt, Artificial Sequence
  Description of Artificial Sequence: Synthetic oligonucleotide
cuggagccagcccagccu

SEQ ID NO: 14541 - RNA, 18 nt, Artificial Sequence
  Description of Artificial Sequence: Synthetic oligonucleotide
gguuucuggagccagccc

SEQ ID NO: 14542 - RNA, 18 nt, Artificial Sequence
  Description of Artificial Sequence: Synthetic oligonucleotide
ucugugguuucuggagcc

SEQ ID NO: 14543 - RNA, 18 nt, Artificial Sequence
  Description of Artificial Sequence: Synthetic oligonucleotide
gggucucugugguuucug

SEQ ID NO: 14544 - RNA, 18 nt, Artificial Sequence
  Description of Artificial Sequence: Synthetic oligonucleotide
uguuucugaggccccagc

SEQ ID NO: 14545 - RNA, 18 nt, Artificial Sequence
  Description of Artificial Sequence: Synthetic oligonucleotide
ugggcuguuucugaggcc

SEQ ID NO: 14546 - RNA, 18 nt, Artificial Sequence
  Description of Artificial Sequence: Synthetic oligonucleotide
uggccugggcuguuucug

SEQ ID NO: 14547 - RNA, 18 nt, Artificial Sequence
  Description of Artificial Sequence: Synthetic oligonucleotide
gucuguggccugggcugu

SEQ ID NO: 14548 - RNA, 18 nt, Artificial Sequence
  Description of Artificial Sequence: Synthetic oligonucleotide
cugaggucuguggccugg

SEQ ID NO: 14549 - RNA, 18 nt, Artificial Sequence
  Description of Artificial Sequence: Synthetic oligonucleotide
uuaagcugaggucugugg

SEQ ID NO: 14550 - RNA, 18 nt, Artificial Sequence
  Description of Artificial Sequence: Synthetic oligonucleotide
ugggcuuaagcugagguc

SEQ ID NO: 14551 - RNA, 18 nt, Artificial Sequence
  Description of Artificial Sequence: Synthetic oligonucleotide
ccuccugggcuuaagcug

SEQ ID NO: 14552 - RNA, 18 nt, Artificial Sequence
  Description of Artificial Sequence: Synthetic oligonucleotide
auuccccuccugggcuua

SEQ ID NO: 14553 - RNA, 18 nt, Artificial Sequence
  Description of Artificial Sequence: Synthetic oligonucleotide
cuuugauuccccuccugg

SEQ ID NO: 14554 - RNA, 18 nt, Artificial Sequence
  Description of Artificial Sequence: Synthetic oligonucleotide
uuggccuuugauuccccu

SEQ ID NO: 14555 - RNA, 18 nt, Artificial Sequence
  Description of Artificial Sequence: Synthetic oligonucleotide
ugcaguuggccuuugauu

SEQ ID NO: 14556 - RNA, 18 nt, Artificial Sequence
  Description of Artificial Sequence: Synthetic oligonucleotide
gggcugcaguuggccuuu

SEQ ID NO: 14557 - RNA, 18 nt, Artificial Sequence
  Description of Artificial Sequence: Synthetic oligonucleotide
uuggcaugggucuucggg

SEQ ID NO: 14558 - RNA, 18 nt, Artificial Sequence
  Description of Artificial Sequence: Synthetic oligonucleotide
guuucuuggcaugggucu

SEQ ID NO: 14559 - RNA, 18 nt, Artificial Sequence
  Description of Artificial Sequence: Synthetic oligonucleotide
acacuguuucuuggcaug

SEQ ID NO: 14560 - RNA, 18 nt, Artificial Sequence
  Description of Artificial Sequence: Synthetic oligonucleotide
uuuggacacuguuucuug

SEQ ID NO: 14561 - RNA, 18 nt, Artificial Sequence
  Description of Artificial Sequence: Synthetic oligonucleotide
ucugguuuggacacuguu

SEQ ID NO: 14562 - RNA, 18 nt, Artificial Sequence
  Description of Artificial Sequence: Synthetic oligonucleotide
ucacuucugguuuggaca

SEQ ID NO: 14563 - RNA, 18 nt, Artificial Sequence
  Description of Artificial Sequence: Synthetic oligonucleotide
uuugcucacuucugguuu

SEQ ID NO: 14564 - RNA, 18 nt, Artificial Sequence
  Description of Artificial Sequence: Synthetic oligonucleotide
gccucuuugcucacuucu

SEQ ID NO: 14565 - RNA, 18 nt, Artificial Sequence
  Description of Artificial Sequence: Synthetic oligonucleotide
caguggccucuuugcuca

SEQ ID NO: 14566 - RNA, 18 nt, Artificial Sequence
  Description of Artificial Sequence: Synthetic oligonucleotide
gucugcaguggccucuuu

SEQ ID NO: 14567 - RNA, 18 nt, Artificial Sequence
  Description of Artificial Sequence: Synthetic oligonucleotide
cccuggucugcaguggcc

SEQ ID NO: 14568 - RNA, 18 nt, Artificial Sequence
  Description of Artificial Sequence: Synthetic oligonucleotide
uggaccccuggucugcag

SEQ ID NO: 14569 - RNA, 18 nt, Artificial Sequence
  Description of Artificial Sequence: Synthetic oligonucleotide
cagccuggaccccugguc

SEQ ID NO: 14570 - RNA, 18 nt, Artificial Sequence
  Description of Artificial Sequence: Synthetic oligonucleotide
gacuccagccuggacccc

SEQ ID NO: 14571 - RNA, 18 nt, Artificial Sequence
  Description of Artificial Sequence: Synthetic oligonucleotide
cugcagacuccagccugg

SEQ ID NO: 14572 - RNA, 18 nt, Artificial Sequence
  Description of Artificial Sequence: Synthetic oligonucleotide
gggcugcagacuccagcc

SEQ ID NO: 14573 - RNA, 18 nt, Artificial Sequence
  Description of Artificial Sequence: Synthetic oligonucleotide
gcugggaaucuggccggg

SEQ ID NO: 14574 - RNA, 18 nt, Artificial Sequence
  Description of Artificial Sequence: Synthetic oligonucleotide
gguaggcugggaaucugg

SEQ ID NO: 14575 - RNA, 18 nt, Artificial Sequence
  Description of Artificial Sequence: Synthetic oligonucleotide
ggguaggcugggaaucug

SEQ ID NO: 14576 - RNA, 18 nt, Artificial Sequence
  Description of Artificial Sequence: Synthetic oligonucleotide
uugaagggcuggcuuggg

SEQ ID NO: 14577 - RNA, 18 nt, Artificial Sequence
  Description of Artificial Sequence: Synthetic oligonucleotide
ucugguugaagggcuggc

SEQ ID NO: 14578 - RNA, 18 nt, Artificial Sequence
  Description of Artificial Sequence: Synthetic oligonucleotide
ggagcucugguugaaggg

SEQ ID NO: 14579 - RNA, 18 nt, Artificial Sequence
  Description of Artificial Sequence: Synthetic oligonucleotide
gguagggagcucugguug

SEQ ID NO: 14580 - RNA, 18 nt, Artificial Sequence
  Description of Artificial Sequence: Synthetic oligonucleotide
uccuggguagggagcucu

SEQ ID NO: 14581 - RNA, 18 nt, Artificial Sequence
  Description of Artificial Sequence: Synthetic oligonucleotide
gguccuccuggguaggga

SEQ ID NO: 14582 - RNA, 18 nt, Artificial Sequence
  Description of Artificial Sequence: Synthetic oligonucleotide
ggguccuccuggguaggg

SEQ ID NO: 14583 - RNA, 18 nt, Artificial Sequence
  Description of Artificial Sequence: Synthetic oligonucleotide
ucagacagaaucucaggg

SEQ ID NO: 14584 - RNA, 18 nt, Artificial Sequence
  Description of Artificial Sequence: Synthetic oligonucleotide
cacucucagacagaaucu

SEQ ID NO: 14585 - RNA, 18 nt, Artificial Sequence
  Description of Artificial Sequence: Synthetic oligonucleotide
cccuacacucucagacag

SEQ ID NO: 14586 - RNA, 18 nt, Artificial Sequence
  Description of Artificial Sequence: Synthetic oligonucleotide
uuuuccccuacacucuca

SEQ ID NO: 14587 - RNA, 18 nt, Artificial Sequence
  Description of Artificial Sequence: Synthetic oligonucleotide
cuugcuuuuccccuacac

SEQ ID NO: 14588 - RNA, 18 nt, Artificial Sequence
  Description of Artificial Sequence: Synthetic oligonucleotide
auucucuugcuuuucccc

SEQ ID NO: 14589 - RNA, 18 nt, Artificial Sequence
  Description of Artificial Sequence: Synthetic oligonucleotide
gccccauucucuugcuuu

SEQ ID NO: 14590 - RNA, 18 nt, Artificial Sequence
  Description of Artificial Sequence: Synthetic oligonucleotide
ccacugccccauucucuu

SEQ ID NO: 14591 - RNA, 18 nt, Artificial Sequence
  Description of Artificial Sequence: Synthetic oligonucleotide
gggcaccacugccccauu

SEQ ID NO: 14592 - RNA, 18 nt, Artificial Sequence
  Description of Artificial Sequence: Synthetic oligonucleotide
uccccaucaccagccugc

SEQ ID NO: 14593 - RNA, 18 nt, Artificial Sequence
  Description of Artificial Sequence: Synthetic oligonucleotide
ccucuuccccaucaccag

SEQ ID NO: 14594 - RNA, 18 nt, Artificial Sequence
  Description of Artificial Sequence: Synthetic oligonucleotide
ugggcccucuuccccauc

SEQ ID NO: 14595 - RNA, 18 nt, Artificial Sequence
  Description of Artificial Sequence: Synthetic oligonucleotide
gggcugggcccucuuccc

SEQ ID NO: 14596 - RNA, 18 nt, Artificial Sequence
  Description of Artificial Sequence: Synthetic oligonucleotide
ggugagugaggcucaggg

SEQ ID NO: 14597 - RNA, 18 nt, Artificial Sequence
  Description of Artificial Sequence: Synthetic oligonucleotide
aggguggugagugaggcu

SEQ ID NO: 14598 - RNA, 18 nt, Artificial Sequence
  Description of Artificial Sequence: Synthetic oligonucleotide
uuuugaggguggugagug

SEQ ID NO: 14599 - RNA, 18 nt, Artificial Sequence
  Description of Artificial Sequence: Synthetic oligonucleotide
gauuuuuuugaggguggu

SEQ ID NO: 14600 - RNA, 18 nt, Artificial Sequence
  Description of Artificial Sequence: Synthetic oligonucleotide
gggauuuuuuugagggug

SEQ ID NO: 14601 - RNA, 18 nt, Artificial Sequence
  Description of Artificial Sequence: Synthetic oligonucleotide
gcugcugcagcacucggg

SEQ ID NO: 14602 - RNA, 18 nt, Artificial Sequence
  Description of Artificial Sequence: Synthetic oligonucleotide
aaccagcugcugcagcac

SEQ ID NO: 14603 - RNA, 18 nt, Artificial Sequence
  Description of Artificial Sequence: Synthetic oligonucleotide
uccucaaccagcugcugc

SEQ ID NO: 14604 - RNA, 18 nt, Artificial Sequence
  Description of Artificial Sequence: Synthetic oligonucleotide
gauccuccucaaccagcu

SEQ ID NO: 14605 - RNA, 18 nt, Artificial Sequence
  Description of Artificial Sequence: Synthetic oligonucleotide
cauucgauccuccucaac

SEQ ID NO: 14606 - RNA, 18 nt, Artificial Sequence
  Description of Artificial Sequence: Synthetic oligonucleotide
cuucucauucgauccucc

SEQ ID NO: 14607 - RNA, 18 nt, Artificial Sequence
  Description of Artificial Sequence: Synthetic oligonucleotide
gugcccuucucauucgau

SEQ ID NO: 14608 - RNA, 18 nt, Artificial Sequence
  Description of Artificial Sequence: Synthetic oligonucleotide
acugugugcccuucucau

SEQ ID NO: 14609 - RNA, 18 nt, Artificial Sequence
  Description of Artificial Sequence: Synthetic oligonucleotide
ugcccacugugugcccuu

SEQ ID NO: 14610 - RNA, 18 nt, Artificial Sequence
  Description of Artificial Sequence: Synthetic oligonucleotide
cuggaugcccacugugug

SEQ ID NO: 14611 - RNA, 18 nt, Artificial Sequence
  Description of Artificial Sequence: Synthetic oligonucleotide
agauccuggaugcccacu

SEQ ID NO: 14612 - RNA, 18 nt, Artificial Sequence
  Description of Artificial Sequence: Synthetic oligonucleotide
gggagauccuggaugccc

SEQ ID NO: 14613 - RNA, 18 nt, Artificial Sequence
  Description of Artificial Sequence: Synthetic oligonucleotide
ggcucaggcuaccucggg

SEQ ID NO: 14614 - RNA, 18 nt, Artificial Sequence
  Description of Artificial Sequence: Synthetic oligonucleotide
guggcggcucaggcuacc

SEQ ID NO: 14615 - RNA, 18 nt, Artificial Sequence
  Description of Artificial Sequence: Synthetic oligonucleotide
ggguggcggcucaggcua

SEQ ID NO: 14616 - RNA, 18 nt, Artificial Sequence
  Description of Artificial Sequence: Synthetic oligonucleotide
ugccaacugggagcuggg

SEQ ID NO: 14617 - RNA, 18 nt, Artificial Sequence
  Description of Artificial Sequence: Synthetic oligonucleotide
ggaccugccaacugggag

SEQ ID NO: 14618 - RNA, 18 nt, Artificial Sequence
  Description of Artificial Sequence: Synthetic oligonucleotide
ccccaggaccugccaacu

SEQ ID NO: 14619 - RNA, 18 nt, Artificial Sequence
  Description of Artificial Sequence: Synthetic oligonucleotide
cuccaccccaggaccugc

SEQ ID NO: 14620 - RNA, 18 nt, Artificial Sequence
  Description of Artificial Sequence: Synthetic oligonucleotide
ccccccuccaccccagga

SEQ ID NO: 14621 - RNA, 18 nt, Artificial Sequence
  Description of Artificial Sequence: Synthetic oligonucleotide
cuucaccccccuccaccc

SEQ ID NO: 14622 - RNA, 18 nt, Artificial Sequence
  Description of Artificial Sequence: Synthetic oligonucleotide
ggugccuucaccccccuc

SEQ ID NO: 14623 - RNA, 18 nt, Artificial Sequence
  Description of Artificial Sequence: Synthetic oligonucleotide
uucugggugccuucaccc

SEQ ID NO: 14624 - RNA, 18 nt, Artificial Sequence
  Description of Artificial Sequence: Synthetic oligonucleotide
gagguuucugggugccuu

SEQ ID NO: 14625 - RNA, 18 nt, Artificial Sequence
  Description of Artificial Sequence: Synthetic oligonucleotide
gucccgagguuucugggu

SEQ ID NO: 14626 - RNA, 18 nt, Artificial Sequence
  Description of Artificial Sequence: Synthetic oligonucleotide
auguagucccgagguuuc

SEQ ID NO: 14627 - RNA, 18 nt, Artificial Sequence
  Description of Artificial Sequence: Synthetic oligonucleotide
ggaugauguagucccgag

SEQ ID NO: 14628 - RNA, 18 nt, Artificial Sequence
  Description of Artificial Sequence: Synthetic oligonucleotide
ggcaaggaugauguaguc

SEQ ID NO: 14629 - RNA, 18 nt, Artificial Sequence
  Description of Artificial Sequence: Synthetic oligonucleotide
aggauggcaaggaugaug

SEQ ID NO: 14630 - RNA, 18 nt, Artificial Sequence
  Description of Artificial Sequence: Synthetic oligonucleotide
aggacaggauggcaagga

SEQ ID NO: 14631 - RNA, 18 nt, Artificial Sequence
  Description of Artificial Sequence: Synthetic oligonucleotide
gaagcaggacaggauggc

SEQ ID NO: 14632 - RNA, 18 nt, Artificial Sequence
  Description of Artificial Sequence: Synthetic oligonucleotide
gggcagaagcaggacagg

SEQ ID NO: 14633 - RNA, 18 nt, Artificial Sequence
  Description of Artificial Sequence: Synthetic oligonucleotide
cgauguugacaggccaca

SEQ ID NO: 14634 - RNA, 18 nt, Artificial Sequence
  Description of Artificial Sequence: Synthetic oligonucleotide
ggccacgauguugacagg

SEQ ID NO: 14635 - RNA, 18 nt, Artificial Sequence
  Description of Artificial Sequence: Synthetic oligonucleotide
gcgaaggccacgauguug

SEQ ID NO: 14636 - RNA, 18 nt, Artificial Sequence
  Description of Artificial Sequence: Synthetic oligonucleotide
cauaagcgaaggccacga

SEQ ID NO: 14637 - RNA, 18 nt, Artificial Sequence
  Description of Artificial Sequence: Synthetic oligonucleotide
gacagcauaagcgaaggc

SEQ ID NO: 14638 - RNA, 18 nt, Artificial Sequence
  Description of Artificial Sequence: Synthetic oligonucleotide
accaugacagcauaagcg

SEQ ID NO: 14639 - RNA, 18 nt, Artificial Sequence
  Description of Artificial Sequence: Synthetic oligonucleotide
ggcucaccaugacagcau

SEQ ID NO: 14640 - RNA, 18 nt, Artificial Sequence
  Description of Artificial Sequence: Synthetic oligonucleotide
gggcucaccaugacagca

SEQ ID NO: 14641 - RNA, 18 nt, Artificial Sequence
  Description of Artificial Sequence: Synthetic oligonucleotide
gggcuagggucccauggg

SEQ ID NO: 14642 - RNA, 18 nt, Artificial Sequence
  Description of Artificial Sequence: Synthetic oligonucleotide
ggccugggcuaggguccc

SEQ ID NO: 14643 - RNA, 18 nt, Artificial Sequence
  Description of Artificial Sequence: Synthetic oligonucleotide
cagcaggccugggcuagg

SEQ ID NO: 14644 - RNA, 18 nt, Artificial Sequence
  Description of Artificial Sequence: Synthetic oligonucleotide
agccacagcaggccuggg

SEQ ID NO: 14645 - RNA, 18 nt, Artificial Sequence
  Description of Artificial Sequence: Synthetic oligonucleotide
cugggagccacagcaggc

SEQ ID NO: 14646 - RNA, 18 nt, Artificial Sequence
  Description of Artificial Sequence: Synthetic oligonucleotide
ggaagcugggagccacag

SEQ ID NO: 14647 - RNA, 18 nt, Artificial Sequence
  Description of Artificial Sequence: Synthetic oligonucleotide
uggcgggaagcugggagc

SEQ ID NO: 14648 - RNA, 18 nt, Artificial Sequence
  Description of Artificial Sequence: Synthetic oligonucleotide
agcgcuggcgggaagcug

SEQ ID NO: 14649 - RNA, 18 nt, Artificial Sequence
  Description of Artificial Sequence: Synthetic oligonucleotide
auugcagcgcuggcggga

SEQ ID NO: 14650 - RNA, 18 nt, Artificial Sequence
  Description of Artificial Sequence: Synthetic oligonucleotide
gcucuauugcagcgcugg

SEQ ID NO: 14651 - RNA, 18 nt, Artificial Sequence
  Description of Artificial Sequence: Synthetic oligonucleotide
cagaggcucuauugcagc

SEQ ID NO: 14652 - RNA, 18 nt, Artificial Sequence
  Description of Artificial Sequence: Synthetic oligonucleotide
uacuccagaggcucuauu

SEQ ID NO: 14653 - RNA, 18 nt, Artificial Sequence
  Description of Artificial Sequence: Synthetic oligonucleotide
augauuacuccagaggcu

SEQ ID NO: 14654 - RNA, 18 nt, Artificial Sequence
  Description of Artificial Sequence: Synthetic oligonucleotide
aaggcaugauuacuccag

SEQ ID NO: 14655 - RNA, 18 nt, Artificial Sequence
  Description of Artificial Sequence: Synthetic oligonucleotide
gaaggaaggcaugauuac

SEQ ID NO: 14656 - RNA, 18 nt, Artificial Sequence
  Description of Artificial Sequence: Synthetic oligonucleotide
gggaaggaaggcaugauu

SEQ ID NO: 14657 - RNA, 18 nt, Artificial Sequence
  Description of Artificial Sequence: Synthetic oligonucleotide
caugcagagaggagaggg

SEQ ID NO: 14658 - RNA, 18 nt, Artificial Sequence
  Description of Artificial Sequence: Synthetic oligonucleotide
ggauccaugcagagagga

SEQ ID NO: 14659 - RNA, 18 nt, Artificial Sequence
  Description of Artificial Sequence: Synthetic oligonucleotide
aggugggauccaugcaga

SEQ ID NO: 14660 - RNA, 18 nt, Artificial Sequence
  Description of Artificial Sequence: Synthetic oligonucleotide
gggaggugggauccaugc

SEQ ID NO: 14661 - RNA, 18 nt, Artificial Sequence
  Description of Artificial Sequence: Synthetic oligonucleotide
aaaggcccuggaauuggg

SEQ ID NO: 14662 - RNA, 18 nt, Artificial Sequence
  Description of Artificial Sequence: Synthetic oligonucleotide
caaacaaaggcccuggaa

SEQ ID NO: 14663 - RNA, 18 nt, Artificial Sequence
  Description of Artificial Sequence: Synthetic oligonucleotide
agaggcaaacaaaggccc

SEQ ID NO: 14664 - RNA, 18 nt, Artificial Sequence
  Description of Artificial Sequence: Synthetic oligonucleotide
uagggagaggcaaacaaa

SEQ ID NO: 14665 - RNA, 18 nt, Artificial Sequence
  Description of Artificial Sequence: Synthetic oligonucleotide
gguccuagggagaggcaa

SEQ ID NO: 14666 - RNA, 18 nt, Artificial Sequence
  Description of Artificial Sequence: Synthetic oligonucleotide
gguuagguccuagggaga

SEQ ID NO: 14667 - RNA, 18 nt, Artificial Sequence
  Description of Artificial Sequence: Synthetic oligonucleotide
cagaggguuagguccuag

SEQ ID NO: 14668 - RNA, 18 nt, Artificial Sequence
  Description of Artificial Sequence: Synthetic oligonucleotide
uggcucagaggguuaggu

SEQ ID NO: 14669 - RNA, 18 nt, Artificial Sequence
  Description of Artificial Sequence: Synthetic oligonucleotide
agugguggcucagagggu

SEQ ID NO: 14670 - RNA, 18 nt, Artificial Sequence
  Description of Artificial Sequence: Synthetic oligonucleotide
agggcagugguggcucag

SEQ ID NO: 14671 - RNA, 18 nt, Artificial Sequence
  Description of Artificial Sequence: Synthetic oligonucleotide
gggcagggcagugguggc

SEQ ID NO: 14672 - RNA, 18 nt, Artificial Sequence
  Description of Artificial Sequence: Synthetic oligonucleotide
ucccucccacccaaaggg

SEQ ID NO: 14673 - RNA, 18 nt, Artificial Sequence
  Description of Artificial Sequence: Synthetic oligonucleotide
ccauaucccucccaccca

SEQ ID NO: 14674 - RNA, 18 nt, Artificial Sequence
  Description of Artificial Sequence: Synthetic oligonucleotide
uguuuccauaucccuccc

SEQ ID NO: 14675 - RNA, 18 nt, Artificial Sequence
  Description of Artificial Sequence: Synthetic oligonucleotide
acacguguuuccauaucc

SEQ ID NO: 14676 - RNA, 18 nt, Artificial Sequence
  Description of Artificial Sequence: Synthetic oligonucleotide
gugugacacguguuucca

SEQ ID NO: 14677 - RNA, 18 nt, Artificial Sequence
  Description of Artificial Sequence: Synthetic oligonucleotide
aggcugugugacacgugu

SEQ ID NO: 14678 - RNA, 18 nt, Artificial Sequence
  Description of Artificial Sequence: Synthetic oligonucleotide
cagcgaggcugugugaca

SEQ ID NO: 14679 - RNA, 18 nt, Artificial Sequence
  Description of Artificial Sequence: Synthetic oligonucleotide
caggucagcgaggcugug

SEQ ID NO: 14680 - RNA, 18 nt, Artificial Sequence
  Description of Artificial Sequence: Synthetic oligonucleotide
gggcacaggucagcgagg

SEQ ID NO: 14681 - RNA, 18 nt, Artificial Sequence
  Description of Artificial Sequence: Synthetic oligonucleotide
gaggagggcacaggucag

SEQ ID NO: 14682 - RNA, 18 nt, Artificial Sequence
  Description of Artificial Sequence: Synthetic oligonucleotide
gggaggagggcacagguc

SEQ ID NO: 14683 - RNA, 18 nt, Artificial Sequence
  Description of Artificial Sequence: Synthetic oligonucleotide
ggaaggaggagugaaggg

SEQ ID NO: 14684 - RNA, 18 nt, Artificial Sequence
  Description of Artificial Sequence: Synthetic oligonucleotide
agggaggaaggaggagug

SEQ ID NO: 14685 - RNA, 18 nt, Artificial Sequence
  Description of Artificial Sequence: Synthetic oligonucleotide
ggguaagggaggaaggag

SEQ ID NO: 14686 - RNA, 18 nt, Artificial Sequence
  Description of Artificial Sequence: Synthetic oligonucleotide
auggcggguaagggagga

SEQ ID NO: 14687 - RNA, 18 nt, Artificial Sequence
  Description of Artificial Sequence: Synthetic oligonucleotide
cauagauggcggguaagg

SEQ ID NO: 14688 - RNA, 18 nt, Artificial Sequence
  Description of Artificial Sequence: Synthetic oligonucleotide
agccccauagauggcggg

SEQ ID NO: 14689 - RNA, 18 nt, Artificial Sequence
  Description of Artificial Sequence: Synthetic oligonucleotide
aggccagccccauagaug

SEQ ID NO: 14690 - RNA, 18 nt, Artificial Sequence
  Description of Artificial Sequence: Synthetic oligonucleotide
gagagaggccagccccau

SEQ ID NO: 14691 - RNA, 18 nt, Artificial Sequence
  Description of Artificial Sequence: Synthetic oligonucleotide
gaagagagagaggccagc

SEQ ID NO: 14692 - RNA, 18 nt, Artificial Sequence
  Description of Artificial Sequence: Synthetic oligonucleotide
auccagaagagagagagg

SEQ ID NO: 14693 - RNA, 18 nt, Artificial Sequence
  Description of Artificial Sequence: Synthetic oligonucleotide
aagucauccagaagagag

SEQ ID NO: 14694 - RNA, 18 nt, Artificial Sequence
  Description of Artificial Sequence: Synthetic oligonucleotide
uggaaaagucauccagaa

SEQ ID NO: 14695 - RNA, 18 nt, Artificial Sequence
  Description of Artificial Sequence: Synthetic oligonucleotide
ucagguggaaaagucauc

SEQ ID NO: 14696 - RNA, 18 nt, Artificial Sequence
  Description of Artificial Sequence: Synthetic oligonucleotide
agggaucagguggaaaag

SEQ ID NO: 14697 - RNA, 18 nt, Artificial Sequence
  Description of Artificial Sequence: Synthetic oligonucleotide
ccagaagggaucaggugg

SEQ ID NO: 14698 - RNA, 18 nt, Artificial Sequence
  Description of Artificial Sequence: Synthetic oligonucleotide
ccagcccagaagggauca

SEQ ID NO: 14699 - RNA, 18 nt, Artificial Sequence
  Description of Artificial Sequence: Synthetic oligonucleotide
agaagccagcccagaagg

SEQ ID NO: 14700 - RNA, 18 nt, Artificial Sequence
  Description of Artificial Sequence: Synthetic oligonucleotide
ucaggagaagccagccca

SEQ ID NO: 14701 - RNA, 18 nt, Artificial Sequence
  Description of Artificial Sequence: Synthetic oligonucleotide
gggucaggagaagccagc

SEQ ID NO: 14702 - RNA, 18 nt, Artificial Sequence
  Description of Artificial Sequence: Synthetic oligonucleotide
uggaggcacauagccggg

SEQ ID NO: 14703 - RNA, 18 nt, Artificial Sequence
  Description of Artificial Sequence: Synthetic oligonucleotide
ggguggaggcacauagcc

SEQ ID NO: 14704 - RNA, 18 nt, Artificial Sequence
  Description of Artificial Sequence: Synthetic oligonucleotide
ggcuguuccgggacuggg

SEQ ID NO: 14705 - RNA, 18 nt, Artificial Sequence
  Description of Artificial Sequence: Synthetic oligonucleotide
cugcaggcuguuccggga

SEQ ID NO: 14706 - RNA, 18 nt, Artificial Sequence
  Description of Artificial Sequence: Synthetic oligonucleotide
cccugcugcaggcuguuc

SEQ ID NO: 14707 - RNA, 18 nt, Artificial Sequence
  Description of Artificial Sequence: Synthetic oligonucleotide
cgucccccugcugcaggc

SEQ ID NO: 14708 - RNA, 18 nt, Artificial Sequence
  Description of Artificial Sequence: Synthetic oligonucleotide
guccacgucccccugcug

SEQ ID NO: 14709 - RNA, 18 nt, Artificial Sequence
  Description of Artificial Sequence: Synthetic oligonucleotide
gccccguccacguccccc

SEQ ID NO: 14710 - RNA, 18 nt, Artificial Sequence
  Description of Artificial Sequence: Synthetic oligonucleotide
gcugggccccguccacgu

SEQ ID NO: 14711 - RNA, 18 nt, Artificial Sequence
  Description of Artificial Sequence: Synthetic oligonucleotide
cagacgcugggccccguc

SEQ ID NO: 14712 - RNA, 18 nt, Artificial Sequence
  Description of Artificial Sequence: Synthetic oligonucleotide
cggcccagacgcugggcc

SEQ ID NO: 14713 - RNA, 18 nt, Artificial Sequence
  Description of Artificial Sequence: Synthetic oligonucleotide
cuacccggcccagacgcu

SEQ ID NO: 14714 - RNA, 18 nt, Artificial Sequence
  Description of Artificial Sequence: Synthetic oligonucleotide
cuuggcuacccggcccag

SEQ ID NO: 14715 - RNA, 18 nt, Artificial Sequence
  Description of Artificial Sequence: Synthetic oligonucleotide
aagagcuuggcuacccgg

SEQ ID NO: 14716 - RNA, 18 nt, Artificial Sequence
  Description of Artificial Sequence: Synthetic oligonucleotide
ugcuuaagagcuuggcua

SEQ ID NO: 14717 - RNA, 18 nt, Artificial Sequence
  Description of Artificial Sequence: Synthetic oligonucleotide
cacgaugcuuaagagcuu

SEQ ID NO: 14718 - RNA, 18 nt, Artificial Sequence
  Description of Artificial Sequence: Synthetic oligonucleotide
agcgccacgaugcuuaag

SEQ ID NO: 14719 - RNA, 18 nt, Artificial Sequence
  Description of Artificial Sequence: Synthetic oligonucleotide
ccaccagcgccacgaugc

SEQ ID NO: 14720 - RNA, 18 nt, Artificial Sequence
  Description of Artificial Sequence: Synthetic oligonucleotide
uccccccaccagcgccac

SEQ ID NO: 14721 - RNA, 18 nt, Artificial Sequence
  Description of Artificial Sequence: Synthetic oligonucleotide
aggacuccccccaccagc

SEQ ID NO: 14722 - RNA, 18 nt, Artificial Sequence
  Description of Artificial Sequence: Synthetic oligonucleotide
ugaugaggacucccccca

SEQ ID NO: 14723 - RNA, 18 nt, Artificial Sequence
  Description of Artificial Sequence: Synthetic oligonucleotide
gaugaugaugaggacucc

SEQ ID NO: 14724 - RNA, 18 nt, Artificial Sequence
  Description of Artificial Sequence: Synthetic oligonucleotide
gaggcgaugaugaugagg

SEQ ID NO: 14725 - RNA, 18 nt, Artificial Sequence
  Description of Artificial Sequence: Synthetic oligonucleotide
cgcaggaggcgaugauga

SEQ ID NO: 14726 - RNA, 18 nt, Artificial Sequence
  Description of Artificial Sequence: Synthetic oligonucleotide
gaugacgcaggaggcgau

SEQ ID NO: 14727 - RNA, 18 nt, Artificial Sequence
  Description of Artificial Sequence: Synthetic oligonucleotide
aaguugaugacgcaggag

SEQ ID NO: 14728 - RNA, 18 nt, Artificial Sequence
  Description of Artificial Sequence: Synthetic oligonucleotide
cgccuaaguugaugacgc

SEQ ID NO: 14729 - RNA, 18 nt, Artificial Sequence
  Description of Artificial Sequence: Synthetic oligonucleotide
cucaccgccuaaguugau

SEQ ID NO: 14730 - RNA, 18 nt, Artificial Sequence
  Description of Artificial Sequence: Synthetic oligonucleotide
ccccacucaccgccuaag

SEQ ID NO: 14731 - RNA, 18 nt, Artificial Sequence
  Description of Artificial Sequence: Synthetic oligonucleotide
caagcccccacucaccgc

SEQ ID NO: 14732 - RNA, 18 nt, Artificial Sequence
  Description of Artificial Sequence: Synthetic oligonucleotide
ugucccaagcccccacuc

SEQ ID NO: 14733 - RNA, 18 nt, Artificial Sequence
  Description of Artificial Sequence: Synthetic oligonucleotide
cugccugucccaagcccc

SEQ ID NO: 14734 - RNA, 18 nt, Artificial Sequence
  Description of Artificial Sequence: Synthetic oligonucleotide
cuccccugccugucccaa

SEQ ID NO: 14735 - RNA, 18 nt, Artificial Sequence
  Description of Artificial Sequence: Synthetic oligonucleotide
cauuccuccccugccugu

SEQ ID NO: 14736 - RNA, 18 nt, Artificial Sequence
  Description of Artificial Sequence: Synthetic oligonucleotide
ccuuccauuccuccccug

SEQ ID NO: 14737 - RNA, 18 nt, Artificial Sequence
  Description of Artificial Sequence: Synthetic oligonucleotide
ccaacccuuccauuccuc

SEQ ID NO: 14738 - RNA, 18 nt, Artificial Sequence
  Description of Artificial Sequence: Synthetic oligonucleotide
ccuugccaacccuuccau

SEQ ID NO: 14739 - RNA, 18 nt, Artificial Sequence
  Description of Artificial Sequence: Synthetic oligonucleotide
gcugcccuugccaacccu

SEQ ID NO: 14740 - RNA, 18 nt, Artificial Sequence
  Description of Artificial Sequence: Synthetic oligonucleotide
guaaagcugcccuugcca

SEQ ID NO: 14741 - RNA, 18 nt, Artificial Sequence
  Description of Artificial Sequence: Synthetic oligonucleotide
gguuaguaaagcugcccu

SEQ ID NO: 14742 - RNA, 18 nt, Artificial Sequence
  Description of Artificial Sequence: Synthetic oligonucleotide
ggguuaguaaagcugccc

SEQ ID NO: 14743 - RNA, 18 nt, Artificial Sequence
  Description of Artificial Sequence: Synthetic oligonucleotide
agacaggagagagcaggg

SEQ ID NO: 14744 - RNA, 18 nt, Artificial Sequence
  Description of Artificial Sequence: Synthetic oligonucleotide
aggacagacaggagagag

SEQ ID NO: 14745 - RNA, 18 nt, Artificial Sequence
  Description of Artificial Sequence: Synthetic oligonucleotide
uaaggaggacagacagga

SEQ ID NO: 14746 - RNA, 18 nt, Artificial Sequence
  Description of Artificial Sequence: Synthetic oligonucleotide
agagguaaggaggacaga

SEQ ID NO: 14747 - RNA, 18 nt, Artificial Sequence
  Description of Artificial Sequence: Synthetic oligonucleotide
aaaggagagguaaggagg

SEQ ID NO: 14748 - RNA, 18 nt, Artificial Sequence
  Description of Artificial Sequence: Synthetic oligonucleotide
gagacaaaggagagguaa

SEQ ID NO: 14749 - RNA, 18 nt, Artificial Sequence
  Description of Artificial Sequence: Synthetic oligonucleotide
aaggagagacaaaggaga

SEQ ID NO: 14750 - RNA, 18 nt, Artificial Sequence
  Description of Artificial Sequence: Synthetic oligonucleotide
gagacaaggagagacaaa

SEQ ID NO: 14751 - RNA, 18 nt, Artificial Sequence
  Description of Artificial Sequence: Synthetic oligonucleotide
gggagacaaggagagaca

SEQ ID NO: 14752 - RNA, 18 nt, Artificial Sequence
  Description of Artificial Sequence: Synthetic oligonucleotide
gagggaaggacagacggg

SEQ ID NO: 14753 - RNA, 18 nt, Artificial Sequence
  Description of Artificial Sequence: Synthetic oligonucleotide
gaggagagggaaggacag

SEQ ID NO: 14754 - RNA, 18 nt, Artificial Sequence
  Description of Artificial Sequence: Synthetic oligonucleotide
ugggagaggagagggaag

SEQ ID NO: 14755 - RNA, 18 nt, Artificial Sequence
  Description of Artificial Sequence: Synthetic oligonucleotide
cacugugggagaggagag

SEQ ID NO: 14756 - RNA, 18 nt, Artificial Sequence
  Description of Artificial Sequence: Synthetic oligonucleotide
uuauacacugugggagag

SEQ ID NO: 14757 - RNA, 18 nt, Artificial Sequence
  Description of Artificial Sequence: Synthetic oligonucleotide
cucacuuauacacugugg

SEQ ID NO: 14758 - RNA, 18 nt, Artificial Sequence
  Description of Artificial Sequence: Synthetic oligonucleotide
agccccucacuuauacac

SEQ ID NO: 14759 - RNA, 18 nt, Artificial Sequence
  Description of Artificial Sequence: Synthetic oligonucleotide
ggcagagccccucacuua

SEQ ID NO: 14760 - RNA, 18 nt, Artificial Sequence
  Description of Artificial Sequence: Synthetic oligonucleotide
gggcagagccccucacuu

SEQ ID NO: 14761 - RNA, 18 nt, Artificial Sequence
  Description of Artificial Sequence: Synthetic oligonucleotide
aaagucuugggaugcggg

SEQ ID NO: 14762 - RNA, 18 nt, Artificial Sequence
  Description of Artificial Sequence: Synthetic oligonucleotide
gaagaaaagucuugggau

SEQ ID NO: 14763 - RNA, 18 nt, Artificial Sequence
  Description of Artificial Sequence: Synthetic oligonucleotide
aacaggaagaaaagucuu

SEQ ID NO: 14764 - RNA, 18 nt, Artificial Sequence
  Description of Artificial Sequence: Synthetic oligonucleotide
cucccaacaggaagaaaa

SEQ ID NO: 14765 - RNA, 18 nt, Artificial Sequence
  Description of Artificial Sequence: Synthetic oligonucleotide
ggcagcucccaacaggaa

SEQ ID NO: 14766 - RNA, 18 nt, Artificial Sequence
  Description of Artificial Sequence: Synthetic oligonucleotide
cccaaggcagcucccaac

SEQ ID NO: 14767 - RNA, 18 nt, Artificial Sequence
  Description of Artificial Sequence: Synthetic oligonucleotide
augggcccaaggcagcuc

SEQ ID NO: 14768 - RNA, 18 nt, Artificial Sequence
  Description of Artificial Sequence: Synthetic oligonucleotide
gagggaugggcccaaggc

SEQ ID NO: 14769 - RNA, 18 nt, Artificial Sequence
  Description of Artificial Sequence: Synthetic oligonucleotide
gggagggaugggcccaag

SEQ ID NO: 14770 - RNA, 18 nt, Artificial Sequence
  Description of Artificial Sequence: Synthetic oligonucleotide
guugggcuccccccaggg

SEQ ID NO: 14771 - RNA, 18 nt, Artificial Sequence
  Description of Artificial Sequence: Synthetic oligonucleotide
caucaguugggcuccccc

SEQ ID NO: 14772 - RNA, 18 nt, Artificial Sequence
  Description of Artificial Sequence: Synthetic oligonucleotide
agggccaucaguugggcu

SEQ ID NO: 14773 - RNA, 18 nt, Artificial Sequence
  Description of Artificial Sequence: Synthetic oligonucleotide
gggccagggccaucaguu

SEQ ID NO: 14774 - RNA, 18 nt, Artificial Sequence
  Description of Artificial Sequence: Synthetic oligonucleotide
aggcucccuugguccuua

SEQ ID NO: 14775 - RNA, 18 nt, Artificial Sequence
  Description of Artificial Sequence: Synthetic oligonucleotide
cgcucaggcucccuuggu

SEQ ID NO: 14776 - RNA, 18 nt, Artificial Sequence
  Description of Artificial Sequence: Synthetic oligonucleotide
aaggccgcucaggcuccc

SEQ ID NO: 14777 - RNA, 18 nt, Artificial Sequence
  Description of Artificial Sequence: Synthetic oligonucleotide
uaaacaaggccgcucagg

SEQ ID NO: 14778 - RNA, 18 nt, Artificial Sequence
  Description of Artificial Sequence: Synthetic oligonucleotide
agcuguaaacaaggccgc

SEQ ID NO: 14779 - RNA, 18 nt, Artificial Sequence
  Description of Artificial Sequence: Synthetic oligonucleotide
acagaagcuguaaacaag

SEQ ID NO: 14780 - RNA, 18 nt, Artificial Sequence
  Description of Artificial Sequence: Synthetic oligonucleotide
gcaggacagaagcuguaa

SEQ ID NO: 14781 - RNA, 18 nt, Artificial Sequence
  Description of Artificial Sequence: Synthetic oligonucleotide
caggagcaggacagaagc

SEQ ID NO: 14782 - RNA, 18 nt, Artificial Sequence
  Description of Artificial Sequence: Synthetic oligonucleotide
agaugcaggagcaggaca

SEQ ID NO: 14783 - RNA, 18 nt, Artificial Sequence
  Description of Artificial Sequence: Synthetic oligonucleotide
uggcaagaugcaggagca

SEQ ID NO: 14784 - RNA, 18 nt, Artificial Sequence
  Description of Artificial Sequence: Synthetic oligonucleotide
gagccuggcaagaugcag

SEQ ID NO: 14785 - RNA, 18 nt, Artificial Sequence
  Description of Artificial Sequence: Synthetic oligonucleotide
cagaggagccuggcaaga

SEQ ID NO: 14786 - RNA, 18 nt, Artificial Sequence
  Description of Artificial Sequence: Synthetic oligonucleotide
guuggcagaggagccugg

SEQ ID NO: 14787 - RNA, 18 nt, Artificial Sequence
  Description of Artificial Sequence: Synthetic oligonucleotide
cuacaguuggcagaggag

SEQ ID NO: 14788 - RNA, 18 nt, Artificial Sequence
  Description of Artificial Sequence: Synthetic oligonucleotide
caggccuacaguuggcag

SEQ ID NO: 14789 - RNA, 18 nt, Artificial Sequence
  Description of Artificial Sequence: Synthetic oligonucleotide
ugaggcaggccuacaguu

SEQ ID NO: 14790 - RNA, 18 nt, Artificial Sequence
  Description of Artificial Sequence: Synthetic oligonucleotide
agggaugaggcaggccua

SEQ ID NO: 14791 - RNA, 18 nt, Artificial Sequence
  Description of Artificial Sequence: Synthetic oligonucleotide
agugcagggaugaggcag

SEQ ID NO: 14792 - RNA, 18 nt, Artificial Sequence
  Description of Artificial Sequence: Synthetic oligonucleotide
gaaccagugcagggauga

SEQ ID NO: 14793 - RNA, 18 nt, Artificial Sequence
  Description of Artificial Sequence: Synthetic oligonucleotide
gguuggaaccagugcagg

SEQ ID NO: 14794 - RNA, 18 nt, Artificial Sequence
  Description of Artificial Sequence: Synthetic oligonucleotide
agggagguuggaaccagu

SEQ ID NO: 14795 - RNA, 18 nt, Artificial Sequence
  Description of Artificial Sequence: Synthetic oligonucleotide
agugcagggagguuggaa

SEQ ID NO: 14796 - RNA, 18 nt, Artificial Sequence
  Description of Artificial Sequence: Synthetic oligonucleotide
gcauuagugcagggaggu

SEQ ID NO: 14797 - RNA, 18 nt, Artificial Sequence
  Description of Artificial Sequence: Synthetic oligonucleotide
ugcaggcauuagugcagg

SEQ ID NO: 14798 - RNA, 18 nt, Artificial Sequence
  Description of Artificial Sequence: Synthetic oligonucleotide
gggaugcaggcauuagug

SEQ ID NO: 14799 - RNA, 18 nt, Artificial Sequence
  Description of Artificial Sequence: Synthetic oligonucleotide
ggccaagaggccggaggg

SEQ ID NO: 14800 - RNA, 18 nt, Artificial Sequence
  Description of Artificial Sequence: Synthetic oligonucleotide
gggccaagaggccggagg

SEQ ID NO: 14801 - RNA, 18 nt, Artificial Sequence
  Description of Artificial Sequence: Synthetic oligonucleotide
agaagugcagggauaggg

SEQ ID NO: 14802 - RNA, 18 nt, Artificial Sequence
  Description of Artificial Sequence: Synthetic oligonucleotide
uuuccagaagugcaggga

SEQ ID NO: 14803 - RNA, 18 nt, Artificial Sequence
  Description of Artificial Sequence: Synthetic oligonucleotide
ggagguuuccagaagugc

SEQ ID NO: 14804 - RNA, 18 nt, Artificial Sequence
  Description of Artificial Sequence: Synthetic oligonucleotide
ugcagggagguuuccaga

SEQ ID NO: 14805 - RNA, 18 nt, Artificial Sequence
  Description of Artificial Sequence: Synthetic oligonucleotide
cagagugcagggagguuu

SEQ ID NO: 14806 - RNA, 18 nt, Artificial Sequence
  Description of Artificial Sequence: Synthetic oligonucleotide
guuuccagagugcaggga

SEQ ID NO: 14807 - RNA, 18 nt, Artificial Sequence
  Description of Artificial Sequence: Synthetic oligonucleotide
gggagguuuccagagugc

SEQ ID NO: 14808 - RNA, 18 nt, Artificial Sequence
  Description of Artificial Sequence: Synthetic oligonucleotide
guucagggagguuuccag

SEQ ID NO: 14809 - RNA, 18 nt, Artificial Sequence
  Description of Artificial Sequence: Synthetic oligonucleotide
gagguguucagggagguu

SEQ ID NO: 14810 - RNA, 18 nt, Artificial Sequence
  Description of Artificial Sequence: Synthetic oligonucleotide
gggagguguucagggagg

SEQ ID NO: 14811 - RNA, 18 nt, Artificial Sequence
  Description of Artificial Sequence: Synthetic oligonucleotide
ugagagcgcagaguuggg

SEQ ID NO: 14812 - RNA, 18 nt, Artificial Sequence
  Description of Artificial Sequence: Synthetic oligonucleotide
gaggcugagagcgcagag

SEQ ID NO: 14813 - RNA, 18 nt, Artificial Sequence
  Description of Artificial Sequence: Synthetic oligonucleotide
gcagggaggcugagagcg

SEQ ID NO: 14814 - RNA, 18 nt, Artificial Sequence
  Description of Artificial Sequence: Synthetic oligonucleotide
gagaugcagggaggcuga

SEQ ID NO: 14815 - RNA, 18 nt, Artificial Sequence
  Description of Artificial Sequence: Synthetic oligonucleotide
caggagagaugcagggag

SEQ ID NO: 14816 - RNA, 18 nt, Artificial Sequence
  Description of Artificial Sequence: Synthetic oligonucleotide
gaggccaggagagaugca

SEQ ID NO: 14817 - RNA, 18 nt, Artificial Sequence
  Description of Artificial Sequence: Synthetic oligonucleotide
gcagggaggccaggagag

SEQ ID NO: 14818 - RNA, 18 nt, Artificial Sequence
  Description of Artificial Sequence: Synthetic oligonucleotide
gaagugcagggaggccag

SEQ ID NO: 14819 - RNA, 18 nt, Artificial Sequence
  Description of Artificial Sequence: Synthetic oligonucleotide
uggaagaagugcagggag

SEQ ID NO: 14820 - RNA, 18 nt, Artificial Sequence
  Description of Artificial Sequence: Synthetic oligonucleotide
gggcuggaagaagugcag

SEQ ID NO: 14821 - RNA, 18 nt, Artificial Sequence
  Description of Artificial Sequence: Synthetic oligonucleotide
agguccagagaauuuggg

SEQ ID NO: 14822 - RNA, 18 nt, Artificial Sequence
  Description of Artificial Sequence: Synthetic oligonucleotide
gguggagguccagagaau

SEQ ID NO: 14823 - RNA, 18 nt, Artificial Sequence
  Description of Artificial Sequence: Synthetic oligonucleotide
gccaggguggagguccag

SEQ ID NO: 14824 - RNA, 18 nt, Artificial Sequence
  Description of Artificial Sequence: Synthetic oligonucleotide
aggcggccaggguggagg

SEQ ID NO: 14825 - RNA, 18 nt, Artificial Sequence
  Description of Artificial Sequence: Synthetic oligonucleotide
ggaggaggcggccagggu

SEQ ID NO: 14826 - RNA, 18 nt, Artificial Sequence
  Description of Artificial Sequence: Synthetic oligonucleotide
aguugggaggaggcggcc

SEQ ID NO: 14827 - RNA, 18 nt, Artificial Sequence
  Description of Artificial Sequence: Synthetic oligonucleotide
augaaaguugggaggagg

SEQ ID NO: 14828 - RNA, 18 nt, Artificial Sequence
  Description of Artificial Sequence: Synthetic oligonucleotide
agacaaugaaaguuggga

SEQ ID NO: 14829 - RNA, 18 nt, Artificial Sequence
  Description of Artificial Sequence: Synthetic oligonucleotide
ugccaagacaaugaaagu

SEQ ID NO: 14830 - RNA, 18 nt, Artificial Sequence
  Description of Artificial Sequence: Synthetic oligonucleotide
agagaugccaagacaaug

SEQ ID NO: 14831 - RNA, 18 nt, Artificial Sequence
  Description of Artificial Sequence: Synthetic oligonucleotide
gguugagagaugccaaga

SEQ ID NO: 14832 - RNA, 18 nt, Artificial Sequence
  Description of Artificial Sequence: Synthetic oligonucleotide
cugaggguugagagaugc

SEQ ID NO: 14833 - RNA, 18 nt, Artificial Sequence
  Description of Artificial Sequence: Synthetic oligonucleotide
gaggacugaggguugaga

SEQ ID NO: 14834 - RNA, 18 nt, Artificial Sequence
  Description of Artificial Sequence: Synthetic oligonucleotide
gaagagaggacugagggu

SEQ ID NO: 14835 - RNA, 18 nt, Artificial Sequence
  Description of Artificial Sequence: Synthetic oligonucleotide
ggaaggaagagaggacug

SEQ ID NO: 14836 - RNA, 18 nt, Artificial Sequence
  Description of Artificial Sequence: Synthetic oligonucleotide
agaagggaaggaagagag

SEQ ID NO: 14837 - RNA, 18 nt, Artificial Sequence
  Description of Artificial Sequence: Synthetic oligonucleotide
gauaaagaagggaaggaa

SEQ ID NO: 14838 - RNA, 18 nt, Artificial Sequence
  Description of Artificial Sequence: Synthetic oligonucleotide
gagaugauaaagaaggga

SEQ ID NO: 14839 - RNA, 18 nt, Artificial Sequence
  Description of Artificial Sequence: Synthetic oligonucleotide
gggagaugauaaagaagg

SEQ ID NO: 14840 - RNA, 18 nt, Artificial Sequence
  Description of Artificial Sequence: Synthetic oligonucleotide
gacguggagaggaaaggg

SEQ ID NO: 14841 - RNA, 18 nt, Artificial Sequence
  Description of Artificial Sequence: Synthetic oligonucleotide
ggcgggacguggagagga

SEQ ID NO: 14842 - RNA, 18 nt, Artificial Sequence
  Description of Artificial Sequence: Synthetic oligonucleotide
gggcgggacguggagagg

SEQ ID NO: 14843 - RNA, 18 nt, Artificial Sequence
  Description of Artificial Sequence: Synthetic oligonucleotide
aggcaggaagaggaaggg

SEQ ID NO: 14844 - RNA, 18 nt, Artificial Sequence
  Description of Artificial Sequence: Synthetic oligonucleotide
ugaggaggcaggaagagg

SEQ ID NO: 14845 - RNA, 18 nt, Artificial Sequence
  Description of Artificial Sequence: Synthetic oligonucleotide
ggagaugaggaggcagga

SEQ ID NO: 14846 - RNA, 18 nt, Artificial Sequence
  Description of Artificial Sequence: Synthetic oligonucleotide
uuaagggagaugaggagg

SEQ ID NO: 14847 - RNA, 18 nt, Artificial Sequence
  Description of Artificial Sequence: Synthetic oligonucleotide
gaugcuuaagggagauga

SEQ ID NO: 14848 - RNA, 18 nt, Artificial Sequence
  Description of Artificial Sequence: Synthetic oligonucleotide
aagaggaugcuuaaggga

SEQ ID NO: 14849 - RNA, 18 nt, Artificial Sequence
  Description of Artificial Sequence: Synthetic oligonucleotide
uggagaagaggaugcuua

SEQ ID NO: 14850 - RNA, 18 nt, Artificial Sequence
  Description of Artificial Sequence: Synthetic oligonucleotide
gagguuggagaagaggau

SEQ ID NO: 14851 - RNA, 18 nt, Artificial Sequence
  Description of Artificial Sequence: Synthetic oligonucleotide
gacgggagguuggagaag

SEQ ID NO: 14852 - RNA, 18 nt, Artificial Sequence
  Description of Artificial Sequence: Synthetic oligonucleotide
acggugacgggagguugg

SEQ ID NO: 14853 - RNA, 18 nt, Artificial Sequence
  Description of Artificial Sequence: Synthetic oligonucleotide
aguaaacggugacgggag

SEQ ID NO: 14854 - RNA, 18 nt, Artificial Sequence
  Description of Artificial Sequence: Synthetic oligonucleotide
ugcagaguaaacggugac

SEQ ID NO: 14855 - RNA, 18 nt, Artificial Sequence
  Description of Artificial Sequence: Synthetic oligonucleotide
aauuuugcagaguaaacg

SEQ ID NO: 14856 - RNA, 18 nt, Artificial Sequence
  Description of Artificial Sequence: Synthetic oligonucleotide
cugucaauuuugcagagu

SEQ ID NO: 14857 - RNA, 18 nt, Artificial Sequence
  Description of Artificial Sequence: Synthetic oligonucleotide
aagugcugucaauuuugc

SEQ ID NO: 14858 - RNA, 18 nt, Artificial Sequence
  Description of Artificial Sequence: Synthetic oligonucleotide
cgucuaagugcugucaau

SEQ ID NO: 14859 - RNA, 18 nt, Artificial Sequence
  Description of Artificial Sequence: Synthetic oligonucleotide
agccucgucuaagugcug

SEQ ID NO: 14860 - RNA, 18 nt, Artificial Sequence
  Description of Artificial Sequence: Synthetic oligonucleotide
ccccaagccucgucuaag

SEQ ID NO: 14861 - RNA, 18 nt, Artificial Sequence
  Description of Artificial Sequence: Synthetic oligonucleotide
ccugcccccaagccucgu

SEQ ID NO: 14862 - RNA, 18 nt, Artificial Sequence
  Description of Artificial Sequence: Synthetic oligonucleotide
ugcucccugcccccaagc

SEQ ID NO: 14863 - RNA, 18 nt, Artificial Sequence
  Description of Artificial Sequence: Synthetic oligonucleotide
aacacugcucccugcccc

SEQ ID NO: 14864 - RNA, 18 nt, Artificial Sequence
  Description of Artificial Sequence: Synthetic oligonucleotide
cucccaacacugcucccu

SEQ ID NO: 14865 - RNA, 18 nt, Artificial Sequence
  Description of Artificial Sequence: Synthetic oligonucleotide
gcccucucccaacacugc

SEQ ID NO: 14866 - RNA, 18 nt, Artificial Sequence
  Description of Artificial Sequence: Synthetic oligonucleotide
gggagcccucucccaaca

SEQ ID NO: 14867 - RNA, 18 nt, Artificial Sequence
  Description of Artificial Sequence: Synthetic oligonucleotide
gaacaguccgagccuggg

SEQ ID NO: 14868 - RNA, 18 nt, Artificial Sequence
  Description of Artificial Sequence: Synthetic oligonucleotide
gcagagaacaguccgagc

SEQ ID NO: 14869 - RNA, 18 nt, Artificial Sequence
  Description of Artificial Sequence: Synthetic oligonucleotide
ucccagcagagaacaguc

SEQ ID NO: 14870 - RNA, 18 nt, Artificial Sequence
  Description of Artificial Sequence: Synthetic oligonucleotide
gguggucccagcagagaa

SEQ ID NO: 14871 - RNA, 18 nt, Artificial Sequence
  Description of Artificial Sequence: Synthetic oligonucleotide
cccuggguggucccagca

SEQ ID NO: 14872 - RNA, 18 nt, Artificial Sequence
  Description of Artificial Sequence: Synthetic oligonucleotide
uccgacccuggguggucc

SEQ ID NO: 14873 - RNA, 18 nt, Artificial Sequence
  Description of Artificial Sequence: Synthetic oligonucleotide
ggguguccgacccugggu

SEQ ID NO: 14874 - RNA, 18 nt, Artificial Sequence
  Description of Artificial Sequence: Synthetic oligonucleotide
cccuuggguguccgaccc

SEQ ID NO: 14875 - RNA, 18 nt, Artificial Sequence
  Description of Artificial Sequence: Synthetic oligonucleotide
aggcacccuugggugucc

SEQ ID NO: 14876 - RNA, 18 nt, Artificial Sequence
  Description of Artificial Sequence: Synthetic oligonucleotide
cugccaggcacccuuggg

SEQ ID NO: 14877 - RNA, 18 nt, Artificial Sequence
  Description of Artificial Sequence: Synthetic oligonucleotide
gcgaccugccaggcaccc

SEQ ID NO: 14878 - RNA, 18 nt, Artificial Sequence
  Description of Artificial Sequence: Synthetic oligonucleotide
acucugcgaccugccagg

SEQ ID NO: 14879 - RNA, 18 nt, Artificial Sequence
  Description of Artificial Sequence: Synthetic oligonucleotide
ugccaacucugcgaccug

SEQ ID NO: 14880 - RNA, 18 nt, Artificial Sequence
  Description of Artificial Sequence: Synthetic oligonucleotide
cggcuugccaacucugcg

SEQ ID NO: 14881 - RNA, 18 nt, Artificial Sequence
  Description of Artificial Sequence: Synthetic oligonucleotide
aggcccggcuugccaacu

SEQ ID NO: 14882 - RNA, 18 nt, Artificial Sequence
  Description of Artificial Sequence: Synthetic oligonucleotide
auacgaggcccggcuugc

SEQ ID NO: 14883 - RNA, 18 nt, Artificial Sequence
  Description of Artificial Sequence: Synthetic oligonucleotide
uccccauacgaggcccgg

SEQ ID NO: 14884 - RNA, 18 nt, Artificial Sequence
  Description of Artificial Sequence: Synthetic oligonucleotide
ccgaguccccauacgagg

SEQ ID NO: 14885 - RNA, 18 nt, Artificial Sequence
  Description of Artificial Sequence: Synthetic oligonucleotide
cucacccgaguccccaua

SEQ ID NO: 14886 - RNA, 18 nt, Artificial Sequence
  Description of Artificial Sequence: Synthetic oligonucleotide
ccacccucacccgagucc

SEQ ID NO: 14887 - RNA, 18 nt, Artificial Sequence
  Description of Artificial Sequence: Synthetic oligonucleotide
acucgccacccucacccg

SEQ ID NO: 14888 - RNA, 18 nt, Artificial Sequence
  Description of Artificial Sequence: Synthetic oligonucleotide
ccaguacucgccacccuc

SEQ ID NO: 14889 - RNA, 18 nt, Artificial Sequence
  Description of Artificial Sequence: Synthetic oligonucleotide
cggaaccaguacucgcca

SEQ ID NO: 14890 - RNA, 18 nt, Artificial Sequence
  Description of Artificial Sequence: Synthetic oligonucleotide
gcguucggaaccaguacu

SEQ ID NO: 14891 - RNA, 18 nt, Artificial Sequence
  Description of Artificial Sequence: Synthetic oligonucleotide
ugcgugcguucggaacca

SEQ ID NO: 14892 - RNA, 18 nt, Artificial Sequence
  Description of Artificial Sequence: Synthetic oligonucleotide
uccccugcgugcguucgg

SEQ ID NO: 14893 - RNA, 18 nt, Artificial Sequence
  Description of Artificial Sequence: Synthetic oligonucleotide
ccuucuccccugcgugcg

SEQ ID NO: 14894 - RNA, 18 nt, Artificial Sequence
  Description of Artificial Sequence: Synthetic oligonucleotide
cccucccuucuccccugc

SEQ ID NO: 14895 - RNA, 18 nt, Artificial Sequence
  Description of Artificial Sequence: Synthetic oligonucleotide
cgcgucccucccuucucc

SEQ ID NO: 14896 - RNA, 18 nt, Artificial Sequence
  Description of Artificial Sequence: Synthetic oligonucleotide
agcgccgcgucccucccu

SEQ ID NO: 14897 - RNA, 18 nt, Artificial Sequence
  Description of Artificial Sequence: Synthetic oligonucleotide
gggucagcgccgcguccc

SEQ ID NO: 14898 - RNA, 18 nt, Artificial Sequence
  Description of Artificial Sequence: Synthetic oligonucleotide
uggaagggucagcgccgc

SEQ ID NO: 14899 - RNA, 18 nt, Artificial Sequence
  Description of Artificial Sequence: Synthetic oligonucleotide
ugaccuggaagggucagc

SEQ ID NO: 14900 - RNA, 18 nt, Artificial Sequence
  Description of Artificial Sequence: Synthetic oligonucleotide
ccagcugaccuggaaggg

SEQ ID NO: 14901 - RNA, 18 nt, Artificial Sequence
  Description of Artificial Sequence: Synthetic oligonucleotide
caacuccagcugaccugg

SEQ ID NO: 14902 - RNA, 18 nt, Artificial Sequence
  Description of Artificial Sequence: Synthetic oligonucleotide
cgggucaacuccagcuga

SEQ ID NO: 14903 - RNA, 18 nt, Artificial Sequence
  Description of Artificial Sequence: Synthetic oligonucleotide
gugggcgggucaacucca

SEQ ID NO: 14904 - RNA, 18 nt, Artificial Sequence
  Description of Artificial Sequence: Synthetic oligonucleotide
cccaggugggcgggucaa

SEQ ID NO: 14905 - RNA, 18 nt, Artificial Sequence
  Description of Artificial Sequence: Synthetic oligonucleotide
aaaagcccaggugggcgg

SEQ ID NO: 14906 - RNA, 18 nt, Artificial Sequence
  Description of Artificial Sequence: Synthetic oligonucleotide
gguugaaaagcccaggug

SEQ ID NO: 14907 - RNA, 18 nt, Artificial Sequence
  Description of Artificial Sequence: Synthetic oligonucleotide
ggguugaaaagcccaggu

SEQ ID NO: 14908 - RNA, 18 nt, Artificial Sequence
  Description of Artificial Sequence: Synthetic oligonucleotide
agaaacucgcggacuggg

SEQ ID NO: 14909 - RNA, 18 nt, Artificial Sequence
  Description of Artificial Sequence: Synthetic oligonucleotide
aagaaagaaacucgcgga

SEQ ID NO: 14910 - RNA, 18 nt, Artificial Sequence
  Description of Artificial Sequence: Synthetic oligonucleotide
ccuucaagaaagaaacuc

SEQ ID NO: 14911 - RNA, 18 nt, Artificial Sequence
  Description of Artificial Sequence: Synthetic oligonucleotide
ccacaccuucaagaaaga

SEQ ID NO: 14912 - RNA, 18 nt, Artificial Sequence
  Description of Artificial Sequence: Synthetic oligonucleotide
agcccccacaccuucaag

SEQ ID NO: 14913 - RNA, 18 nt, Artificial Sequence
  Description of Artificial Sequence: Synthetic oligonucleotide
aaucuagcccccacaccu

SEQ ID NO: 14914 - RNA, 18 nt, Artificial Sequence
  Description of Artificial Sequence: Synthetic oligonucleotide
gaaugaaucuagccccca

SEQ ID NO: 14915 - RNA, 18 nt, Artificial Sequence
  Description of Artificial Sequence: Synthetic oligonucleotide
cacgugaaugaaucuagc

SEQ ID NO: 14916 - RNA, 18 nt, Artificial Sequence
  Description of Artificial Sequence: Synthetic oligonucleotide
cgaagcacgugaaugaau

SEQ ID NO: 14917 - RNA, 18 nt, Artificial Sequence
  Description of Artificial Sequence: Synthetic oligonucleotide
cauuacgaagcacgugaa

SEQ ID NO: 14918 - RNA, 18 nt, Artificial Sequence
  Description of Artificial Sequence: Synthetic oligonucleotide
uauuucauuacgaagcac

SEQ ID NO: 14919 - RNA, 18 nt, Artificial Sequence
  Description of Artificial Sequence: Synthetic oligonucleotide
uggauuauuucauuacga

SEQ ID NO: 14920 - RNA, 18 nt, Artificial Sequence
  Description of Artificial Sequence: Synthetic oligonucleotide
uuuuuuggauuauuucau

SEQ ID NO: 14921 - RNA, 18 nt, Artificial Sequence
  Description of Artificial Sequence: Synthetic oligonucleotide
uccuauuuuuuggauuau

SEQ ID NO: 14922 - RNA, 18 nt, Artificial Sequence
  Description of Artificial Sequence: Synthetic oligonucleotide
uuugguccuauuuuuugg

SEQ ID NO: 14923 - RNA, 18 nt, Artificial Sequence
  Description of Artificial Sequence: Synthetic oligonucleotide
ggcgcuuugguccuauuu

SEQ ID NO: 14924 - RNA, 18 nt, Artificial Sequence
  Description of Artificial Sequence: Synthetic oligonucleotide
cagugggcgcuuuggucc

SEQ ID NO: 14925 - RNA, 18 nt, Artificial Sequence
  Description of Artificial Sequence: Synthetic oligonucleotide
ccugccagugggcgcuuu

SEQ ID NO: 14926 - RNA, 18 nt, Artificial Sequence
  Description of Artificial Sequence: Synthetic oligonucleotide
ucgcuccugccagugggc

SEQ ID NO: 14927 - RNA, 18 nt, Artificial Sequence
  Description of Artificial Sequence: Synthetic oligonucleotide
cgcccucgcuccugccag

SEQ ID NO: 14928 - RNA, 18 nt, Artificial Sequence
  Description of Artificial Sequence: Synthetic oligonucleotide
cgccccgcccucgcuccu

SEQ ID NO: 14929 - RNA, 18 nt, Artificial Sequence
  Description of Artificial Sequence: Synthetic oligonucleotide
cgcggcgccccgcccucg

SEQ ID NO: 14930 - RNA, 18 nt, Artificial Sequence
  Description of Artificial Sequence: Synthetic oligonucleotide
uagagcgcggcgccccgc

SEQ ID NO: 14931 - RNA, 18 nt, Artificial Sequence
  Description of Artificial Sequence: Synthetic oligonucleotide
aauuauagagcgcggcgc

SEQ ID NO: 14932 - RNA, 18 nt, Artificial Sequence
  Description of Artificial Sequence: Synthetic oligonucleotide
aaaauaauuauagagcgc

SEQ ID NO: 14933 - RNA, 18 nt, Artificial Sequence
  Description of Artificial Sequence: Synthetic oligonucleotide
cuuagaaaauaauuauag

SEQ ID NO: 14934 - RNA, 18 nt, Artificial Sequence
  Description of Artificial Sequence: Synthetic oligonucleotide
aucaucuuagaaaauaau

SEQ ID NO: 14935 - RNA, 18 nt, Artificial Sequence
  Description of Artificial Sequence: Synthetic oligonucleotide
cccccaucaucuuagaaa

SEQ ID NO: 14936 - RNA, 18 nt, Artificial Sequence
  Description of Artificial Sequence: Synthetic oligonucleotide
aaccucccccaucaucuu

SEQ ID NO: 14937 - RNA, 18 nt, Artificial Sequence
  Description of Artificial Sequence: Synthetic oligonucleotide
caacaaaccucccccauc

SEQ ID NO: 14938 - RNA, 18 nt, Artificial Sequence
  Description of Artificial Sequence: Synthetic oligonucleotide
gcgugcaacaaaccuccc

SEQ ID NO: 14939 - RNA, 18 nt, Artificial Sequence
  Description of Artificial Sequence: Synthetic oligonucleotide
cugucgcgugcaacaaac

SEQ ID NO: 14940 - RNA, 18 nt, Artificial Sequence
  Description of Artificial Sequence: Synthetic oligonucleotide
gcgggcugucgcgugcaa

SEQ ID NO: 14941 - RNA, 18 nt, Artificial Sequence
  Description of Artificial Sequence: Synthetic oligonucleotide
ccucagcgggcugucgcg

SEQ ID NO: 14942 - RNA, 18 nt, Artificial Sequence
  Description of Artificial Sequence: Synthetic oligonucleotide
cgccuccucagcgggcug

SEQ ID NO: 14943 - RNA, 18 nt, Artificial Sequence
  Description of Artificial Sequence: Synthetic oligonucleotide
guccccgccuccucagcg

SEQ ID NO: 14944 - RNA, 18 nt, Artificial Sequence
  Description of Artificial Sequence: Synthetic oligonucleotide
gcucgguccccgccuccu

SEQ ID NO: 14945 - RNA, 18 nt, Artificial Sequence
  Description of Artificial Sequence: Synthetic oligonucleotide
uuguagcucgguccccgc

SEQ ID NO: 14946 - RNA, 18 nt, Artificial Sequence
  Description of Artificial Sequence: Synthetic oligonucleotide
ccgcguuguagcucgguc

SEQ ID NO: 14947 - RNA, 18 nt, Artificial Sequence
  Description of Artificial Sequence: Synthetic oligonucleotide
ccgaaccgcguuguagcu

SEQ ID NO: 14948 - RNA, 18 nt, Artificial Sequence
  Description of Artificial Sequence: Synthetic oligonucleotide
caaauccgaaccgcguug

SEQ ID NO: 14949 - RNA, 18 nt, Artificial Sequence
  Description of Artificial Sequence: Synthetic oligonucleotide
cccgccaaauccgaaccg

SEQ ID NO: 14950 - RNA, 18 nt, Artificial Sequence
  Description of Artificial Sequence: Synthetic oligonucleotide
aaacccccgccaaauccg

SEQ ID NO: 14951 - RNA, 18 nt, Artificial Sequence
  Description of Artificial Sequence: Synthetic oligonucleotide
gaaaaaaacccccgccaa

SEQ ID NO: 14952 - RNA, 18 nt, Artificial Sequence
  Description of Artificial Sequence: Synthetic oligonucleotide
uuaaggaaaaaaaccccc

SEQ ID NO: 14953 - RNA, 18 nt, Artificial Sequence
  Description of Artificial Sequence: Synthetic oligonucleotide
uuuuuuuaaggaaaaaaa

SEQ ID NO: 14954 - RNA, 18 nt, Artificial Sequence
  Description of Artificial Sequence: Synthetic oligonucleotide
uuuuuuuuuuuuaaggaa

SEQ ID NO: 14955 - RNA, 18 nt, Artificial Sequence
  Description of Artificial Sequence: Synthetic oligonucleotide
uuuuuuuuuuuuuuuuua

SEQ ID NO: 14956 - RNA, 18 nt, Artificial Sequence
  Description of Artificial Sequence: Synthetic oligonucleotide
uuuuuuuuuuuuuuuuuu

SEQ ID NO: 14957 - RNA, 18 nt, Artificial Sequence
  Description of Artificial Sequence: Synthetic oligonucleotide
uuuuuuuuuuuuuuuuuu

SEQ ID NO: 14958 - RNA, 18 nt, Artificial Sequence
  Description of Artificial Sequence: Synthetic oligonucleotide
cagacuuuuuuuuuuuuu

SEQ ID NO: 14959 - RNA, 18 nt, Artificial Sequence
  Description of Artificial Sequence: Synthetic oligonucleotide
ucccccagacuuuuuuuu

SEQ ID NO: 14960 - RNA, 18 nt, Artificial Sequence
  Description of Artificial Sequence: Synthetic oligonucleotide
uuucuucccccagacuuu

SEQ ID NO: 14961 - RNA, 18 nt, Artificial Sequence
  Description of Artificial Sequence: Synthetic oligonucleotide
guuuuuuucuucccccag

SEQ ID NO: 14962 - RNA, 18 nt, Artificial Sequence
  Description of Artificial Sequence: Synthetic oligonucleotide
uuuuaguuuuuuucuucc

SEQ ID NO: 14963 - RNA, 18 nt, Artificial Sequence
  Description of Artificial Sequence: Synthetic oligonucleotide
aagaauuuuaguuuuuuu

SEQ ID NO: 14964 - RNA, 18 nt, Artificial Sequence
  Description of Artificial Sequence: Synthetic oligonucleotide
uuuuuaagaauuuuaguu

SEQ ID NO: 14965 - RNA, 18 nt, Artificial Sequence
  Description of Artificial Sequence: Synthetic oligonucleotide
uuuuuuuuuuaagaauuu

SEQ ID NO: 14966 - RNA, 18 nt, Artificial Sequence
  Description of Artificial Sequence: Synthetic oligonucleotide
uuuuuuuuuuuuuuuaag

SEQ ID NO: 14967 - RNA, 18 nt, Artificial Sequence
  Description of Artificial Sequence: Synthetic oligonucleotide
agccuuuuuuuuuuuuuu

SEQ ID NO: 14968 - RNA, 18 nt, Artificial Sequence
  Description of Artificial Sequence: Synthetic oligonucleotide
auaauagccuuuuuuuuu

SEQ ID NO: 14969 - RNA, 18 nt, Artificial Sequence
  Description of Artificial Sequence: Synthetic oligonucleotide
guuugauaauagccuuuu

SEQ ID NO: 14970 - RNA, 18 nt, Artificial Sequence
  Description of Artificial Sequence: Synthetic oligonucleotide
aaucaguuugauaauagc

SEQ ID NO: 14971 - RNA, 18 nt, Artificial Sequence
  Description of Artificial Sequence: Synthetic oligonucleotide
ggagaaaucaguuugaua

SEQ ID NO: 14972 - RNA, 18 nt, Artificial Sequence
  Description of Artificial Sequence: Synthetic oligonucleotide
aaaagggagaaaucaguu

SEQ ID NO: 14973 - RNA, 18 nt, Artificial Sequence
  Description of Artificial Sequence: Synthetic oligonucleotide
auacaaaaagggagaaau

SEQ ID NO: 14974 - RNA, 18 nt, Artificial Sequence
  Description of Artificial Sequence: Synthetic oligonucleotide
ccggcauacaaaaaggga

SEQ ID NO: 14975 - RNA, 18 nt, Artificial Sequence
  Description of Artificial Sequence: Synthetic oligonucleotide
agcauccggcauacaaaa

SEQ ID NO: 14976 - RNA, 18 nt, Artificial Sequence
  Description of Artificial Sequence: Synthetic oligonucleotide
caugcagcauccggcaua

SEQ ID NO: 14977 - RNA, 18 nt, Artificial Sequence
  Description of Artificial Sequence: Synthetic oligonucleotide
agacucaugcagcauccg

SEQ ID NO: 14978 - RNA, 18 nt, Artificial Sequence
  Description of Artificial Sequence: Synthetic oligonucleotide
guuucagacucaugcagc

SEQ ID NO: 14979 - RNA, 18 nt, Artificial Sequence
  Description of Artificial Sequence: Synthetic oligonucleotide
uugguguuucagacucau

SEQ ID NO: 14980 - RNA, 18 nt, Artificial Sequence
  Description of Artificial Sequence: Synthetic oligonucleotide
guuuauugguguuucaga

SEQ ID NO: 14981 - RNA, 18 nt, Artificial Sequence
  Description of Artificial Sequence: Synthetic oligonucleotide
ucuccguuuauugguguu

SEQ ID NO: 14982 - RNA, 18 nt, Artificial Sequence
  Description of Artificial Sequence: Synthetic oligonucleotide
ugcagucuccguuuauug

SEQ ID NO: 14983 - RNA, 18 nt, Artificial Sequence
  Description of Artificial Sequence: Synthetic oligonucleotide
ucucaugcagucuccguu

SEQ ID NO: 14984 - RNA, 18 nt, Artificial Sequence
  Description of Artificial Sequence: Synthetic oligonucleotide
aagggagccacgcguuac

SEQ ID NO: 14985 - RNA, 18 nt, Artificial Sequence
  Description of Artificial Sequence: Synthetic oligonucleotide
agcccaagggagccacgc

SEQ ID NO: 14986 - RNA, 18 nt, Artificial Sequence
  Description of Artificial Sequence: Synthetic oligonucleotide
ccgccagcccaagggagc

SEQ ID NO: 14987 - RNA, 18 nt, Artificial Sequence
  Description of Artificial Sequence: Synthetic oligonucleotide
cccucccgccagcccaag

SEQ ID NO: 14988 - RNA, 18 nt, Artificial Sequence
  Description of Artificial Sequence: Synthetic oligonucleotide
ccggccccucccgccagc

SEQ ID NO: 14989 - RNA, 18 nt, Artificial Sequence
  Description of Artificial Sequence: Synthetic oligonucleotide
agccuccggccccucccg

SEQ ID NO: 14990 - RNA, 18 nt, Artificial Sequence
  Description of Artificial Sequence: Synthetic oligonucleotide
ucgcgagccuccggcccc

SEQ ID NO: 14991 - RNA, 18 nt, Artificial Sequence
  Description of Artificial Sequence: Synthetic oligonucleotide
gccccucgcgagccuccg

SEQ ID NO: 14992 - RNA, 18 nt, Artificial Sequence
  Description of Artificial Sequence: Synthetic oligonucleotide
cccccgccccucgcgagc

SEQ ID NO: 14993 - RNA, 18 nt, Artificial Sequence
  Description of Artificial Sequence: Synthetic oligonucleotide
cgccgcccccgccccucg

SEQ ID NO: 14994 - RNA, 18 nt, Artificial Sequence
  Description of Artificial Sequence: Synthetic oligonucleotide
gccgucgccgcccccgcc

SEQ ID NO: 14995 - RNA, 18 nt, Artificial Sequence
  Description of Artificial Sequence: Synthetic oligonucleotide
ccgccgccgucgccgccc

SEQ ID NO: 14996 - RNA, 18 nt, Artificial Sequence
  Description of Artificial Sequence: Synthetic oligonucleotide
acgcuccgccgccgucgc

SEQ ID NO: 14997 - RNA, 18 nt, Artificial Sequence
  Description of Artificial Sequence: Synthetic oligonucleotide
ccccuacgcuccgccgcc

SEQ ID NO: 14998 - RNA, 18 nt, Artificial Sequence
  Description of Artificial Sequence: Synthetic oligonucleotide
ccccuccccuacgcuccg

SEQ ID NO: 14999 - RNA, 18 nt, Artificial Sequence
  Description of Artificial Sequence: Synthetic oligonucleotide
ccgguccccuccccuacg

SEQ ID NO: 15000 - RNA, 18 nt, Artificial Sequence
  Description of Artificial Sequence: Synthetic oligonucleotide
ccucuccgguccccuccc

SEQ ID NO: 15001 - RNA, 18 nt, Artificial Sequence
  Description of Artificial Sequence: Synthetic oligonucleotide
ccccuccucuccgguccc

SEQ ID NO: 15002 - RNA, 18 nt, Artificial Sequence
  Description of Artificial Sequence: Synthetic oligonucleotide
cucauccccuccucuccg

SEQ ID NO: 15003 - RNA, 18 nt, Artificial Sequence
  Description of Artificial Sequence: Synthetic oligonucleotide
gugugcucauccccuccu

SEQ ID NO: 15004 - RNA, 18 nt, Artificial Sequence
  Description of Artificial Sequence: Synthetic oligonucleotide
cucccgugugcucauccc

SEQ ID NO: 15005 - RNA, 18 nt, Artificial Sequence
  Description of Artificial Sequence: Synthetic oligonucleotide
cuccucucccgugugcuc

SEQ ID NO: 15006 - RNA, 18 nt, Artificial Sequence
  Description of Artificial Sequence: Synthetic oligonucleotide
cucuucuccucucccgug

SEQ ID NO: 15007 - RNA, 18 nt, Artificial Sequence
  Description of Artificial Sequence: Synthetic oligonucleotide
ucucccucuucuccucuc

SEQ ID NO: 15008 - RNA, 18 nt, Artificial Sequence
  Description of Artificial Sequence: Synthetic oligonucleotide
gcgggucucccucuucuc

SEQ ID NO: 15009 - RNA, 18 nt, Artificial Sequence
  Description of Artificial Sequence: Synthetic oligonucleotide
aggcggcgggucucccuc

SEQ ID NO: 15010 - RNA, 18 nt, Artificial Sequence
  Description of Artificial Sequence: Synthetic oligonucleotide
gagggaggcggcgggucu

SEQ ID NO: 15011 - RNA, 18 nt, Artificial Sequence
  Description of Artificial Sequence: Synthetic oligonucleotide
ggagggagggaggcggcg

SEQ ID NO: 15012 - RNA, 18 nt, Artificial Sequence
  Description of Artificial Sequence: Synthetic oligonucleotide
gcuagggagggagggagg

SEQ ID NO: 15013 - RNA, 18 nt, Artificial Sequence
  Description of Artificial Sequence: Synthetic oligonucleotide
agucagcuagggagggag

SEQ ID NO: 15014 - RNA, 18 nt, Artificial Sequence
  Description of Artificial Sequence: Synthetic oligonucleotide
gagcaagucagcuaggga

SEQ ID NO: 15015 - RNA, 18 nt, Artificial Sequence
  Description of Artificial Sequence: Synthetic oligonucleotide
ggagggagcaagucagcu

SEQ ID NO: 15016 - RNA, 18 nt, Artificial Sequence
  Description of Artificial Sequence: Synthetic oligonucleotide
gcccgggagggagcaagu

SEQ ID NO: 15017 - RNA, 18 nt, Artificial Sequence
  Description of Artificial Sequence: Synthetic oligonucleotide
ccgcagcccgggagggag

SEQ ID NO: 15018 - RNA, 18 nt, Artificial Sequence
  Description of Artificial Sequence: Synthetic oligonucleotide
agcagccgcagcccggga

SEQ ID NO: 15019 - RNA, 18 nt, Artificial Sequence
  Description of Artificial Sequence: Synthetic oligonucleotide
uuugcagcagccgcagcc

SEQ ID NO: 15020 - RNA, 18 nt, Artificial Sequence
  Description of Artificial Sequence: Synthetic oligonucleotide
uggcuuuugcagcagccg

SEQ ID NO: 15021 - RNA, 18 nt, Artificial Sequence
  Description of Artificial Sequence: Synthetic oligonucleotide
gcugcuggcuuuugcagc

SEQ ID NO: 15022 - RNA, 18 nt, Artificial Sequence
  Description of Artificial Sequence: Synthetic oligonucleotide
cugccgcugcuggcuuuu

SEQ ID NO: 15023 - RNA, 18 nt, Artificial Sequence
  Description of Artificial Sequence: Synthetic oligonucleotide
ucccgcugccgcugcugg

SEQ ID NO: 15024 - RNA, 18 nt, Artificial Sequence
  Description of Artificial Sequence: Synthetic oligonucleotide
acagcucccgcugccgcu

SEQ ID NO: 15025 - RNA, 18 nt, Artificial Sequence
  Description of Artificial Sequence: Synthetic oligonucleotide
uccggacagcucccgcug

SEQ ID NO: 15026 - RNA, 18 nt, Artificial Sequence
  Description of Artificial Sequence: Synthetic oligonucleotide
cggccuccggacagcucc

SEQ ID NO: 15027 - RNA, 18 nt, Artificial Sequence
  Description of Artificial Sequence: Synthetic oligonucleotide
gacgccggccuccggaca

SEQ ID NO: 15028 - RNA, 18 nt, Artificial Sequence
  Description of Artificial Sequence: Synthetic oligonucleotide
gccucagucugcccgggu

SEQ ID NO: 15029 - RNA, 18 nt, Artificial Sequence
  Description of Artificial Sequence: Synthetic oligonucleotide
ccgcagccucagucugcc

SEQ ID NO: 15030 - RNA, 18 nt, Artificial Sequence
  Description of Artificial Sequence: Synthetic oligonucleotide
ccuacccgcagccucagu

SEQ ID NO: 15031 - RNA, 18 nt, Artificial Sequence
  Description of Artificial Sequence: Synthetic oligonucleotide
ccacuccuacccgcagcc

SEQ ID NO: 15032 - RNA, 18 nt, Artificial Sequence
  Description of Artificial Sequence: Synthetic oligonucleotide
ucgguccacuccuacccg

SEQ ID NO: 15033 - RNA, 18 nt, Artificial Sequence
  Description of Artificial Sequence: Synthetic oligonucleotide
gucggucgguccacuccu

SEQ ID NO: 15034 - RNA, 18 nt, Artificial Sequence
  Description of Artificial Sequence: Synthetic oligonucleotide
cagccgucggucggucca

SEQ ID NO: 15035 - RNA, 18 nt, Artificial Sequence
  Description of Artificial Sequence: Synthetic oligonucleotide
ggcgucagccgucggucg

SEQ ID NO: 15036 - RNA, 18 nt, Artificial Sequence
  Description of Artificial Sequence: Synthetic oligonucleotide
cgcccggcgucagccguc

SEQ ID NO: 15037 - RNA, 18 nt, Artificial Sequence
  Description of Artificial Sequence: Synthetic oligonucleotide
caguccgcccggcgucag

SEQ ID NO: 15038 - RNA, 18 nt, Artificial Sequence
  Description of Artificial Sequence: Synthetic oligonucleotide
ccgugcaguccgcccggc

SEQ ID NO: 15039 - RNA, 18 nt, Artificial Sequence
  Description of Artificial Sequence: Synthetic oligonucleotide
cauucccgugcaguccgc

SEQ ID NO: 15040 - RNA, 18 nt, Artificial Sequence
  Description of Artificial Sequence: Synthetic oligonucleotide
acccgcauucccgugcag

SEQ ID NO: 15041 - RNA, 18 nt, Artificial Sequence
  Description of Artificial Sequence: Synthetic oligonucleotide
cagacacccgcauucccg

SEQ ID NO: 15042 - RNA, 18 nt, Artificial Sequence
  Description of Artificial Sequence: Synthetic oligonucleotide
cccuccagacacccgcau

SEQ ID NO: 15043 - RNA, 18 nt, Artificial Sequence
  Description of Artificial Sequence: Synthetic oligonucleotide
accagcccuccagacacc

SEQ ID NO: 15044 - RNA, 18 nt, Artificial Sequence
  Description of Artificial Sequence: Synthetic oligonucleotide
ccaccaccagcccuccag

SEQ ID NO: 15045 - RNA, 18 nt, Artificial Sequence
  Description of Artificial Sequence: Synthetic oligonucleotide
cagcaccaccaccagccc

SEQ ID NO: 15046 - RNA, 18 nt, Artificial Sequence
  Description of Artificial Sequence: Synthetic oligonucleotide
ccgcccagcaccaccacc

SEQ ID NO: 15047 - RNA, 18 nt, Artificial Sequence
  Description of Artificial Sequence: Synthetic oligonucleotide
ucagcccgcccagcacca

SEQ ID NO: 15048 - RNA, 18 nt, Artificial Sequence
  Description of Artificial Sequence: Synthetic oligonucleotide
augguucagcccgcccag

SEQ ID NO: 15049 - RNA, 18 nt, Artificial Sequence
  Description of Artificial Sequence: Synthetic oligonucleotide
ucccgaugguucagcccg

SEQ ID NO: 15050 - RNA, 18 nt, Artificial Sequence
  Description of Artificial Sequence: Synthetic oligonucleotide
ccuccucccgaugguuca

SEQ ID NO: 15051 - RNA, 18 nt, Artificial Sequence
  Description of Artificial Sequence: Synthetic oligonucleotide
uggcgccuccucccgaug

SEQ ID NO: 15052 - RNA, 18 nt, Artificial Sequence
  Description of Artificial Sequence: Synthetic oligonucleotide
ugggcuggcgccuccucc

SEQ ID NO: 15053 - RNA, 18 nt, Artificial Sequence
  Description of Artificial Sequence: Synthetic oligonucleotide
uucggugggcuggcgccu

SEQ ID NO: 15054 - RNA, 18 nt, Artificial Sequence
  Description of Artificial Sequence: Synthetic oligonucleotide
ucgccuucggugggcugg

SEQ ID NO: 15055 - RNA, 18 nt, Artificial Sequence
  Description of Artificial Sequence: Synthetic oligonucleotide
uucccucgccuucggugg

SEQ ID NO: 15056 - RNA, 18 nt, Artificial Sequence
  Description of Artificial Sequence: Synthetic oligonucleotide
gggcuucccucgccuucg

SEQ ID NO: 15057 - RNA, 18 nt, Artificial Sequence
  Description of Artificial Sequence: Synthetic oligonucleotide
gucagccccucucccggg

SEQ ID NO: 15058 - RNA, 18 nt, Artificial Sequence
  Description of Artificial Sequence: Synthetic oligonucleotide
ccccugucagccccucuc

SEQ ID NO: 15059 - RNA, 18 nt, Artificial Sequence
  Description of Artificial Sequence: Synthetic oligonucleotide
ucgauccccugucagccc

SEQ ID NO: 15060 - RNA, 18 nt, Artificial Sequence
  Description of Artificial Sequence: Synthetic oligonucleotide
cuccuucgauccccuguc

SEQ ID NO: 15061 - RNA, 18 nt, Artificial Sequence
  Description of Artificial Sequence: Synthetic oligonucleotide
guuaucuccuucgauccc

SEQ ID NO: 15062 - RNA, 18 nt, Artificial Sequence
  Description of Artificial Sequence: Synthetic oligonucleotide
accugguuaucuccuucg

SEQ ID NO: 15063 - RNA, 18 nt, Artificial Sequence
  Description of Artificial Sequence: Synthetic oligonucleotide
gggaccugguuaucuccu

SEQ ID NO: 15064 - RNA, 18 nt, Artificial Sequence
  Description of Artificial Sequence: Synthetic oligonucleotide
cucccgccccuuucuggg

SEQ ID NO: 15065 - RNA, 18 nt, Artificial Sequence
  Description of Artificial Sequence: Synthetic oligonucleotide
ggacgcucccgccccuuu

SEQ ID NO: 15066 - RNA, 18 nt, Artificial Sequence
  Description of Artificial Sequence: Synthetic oligonucleotide
ggcgaggacgcucccgcc

SEQ ID NO: 15067 - RNA, 18 nt, Artificial Sequence
  Description of Artificial Sequence: Synthetic oligonucleotide
uuuagggcgaggacgcuc

SEQ ID NO: 15068 - RNA, 18 nt, Artificial Sequence
  Description of Artificial Sequence: Synthetic oligonucleotide
gcgcguuuagggcgagga

SEQ ID NO: 15069 - RNA, 18 nt, Artificial Sequence
  Description of Artificial Sequence: Synthetic oligonucleotide
uugcugcgcguuuagggc

SEQ ID NO: 15070 - RNA, 18 nt, Artificial Sequence
  Description of Artificial Sequence: Synthetic oligonucleotide
uuuucuugcugcgcguuu

SEQ ID NO: 15071 - RNA, 18 nt, Artificial Sequence
  Description of Artificial Sequence: Synthetic oligonucleotide
gcggguuuucuugcugcg

SEQ ID NO: 15072 - RNA, 18 nt, Artificial Sequence
  Description of Artificial Sequence: Synthetic oligonucleotide
gcggugcggguuuucuug

SEQ ID NO: 15073 - RNA, 18 nt, Artificial Sequence
  Description of Artificial Sequence: Synthetic oligonucleotide
cccaggcggugcggguuu

SEQ ID NO: 15074 - RNA, 18 nt, Artificial Sequence
  Description of Artificial Sequence: Synthetic oligonucleotide
gggcucccaggcggugcg

SEQ ID NO: 15075 - RNA, 18 nt, Artificial Sequence
  Description of Artificial Sequence: Synthetic oligonucleotide
ucccugggcucccaggcg

SEQ ID NO: 15076 - RNA, 18 nt, Artificial Sequence
  Description of Artificial Sequence: Synthetic oligonucleotide
ccuccucccugggcuccc

SEQ ID NO: 15077 - RNA, 18 nt, Artificial Sequence
  Description of Artificial Sequence: Synthetic oligonucleotide
ccuccccuccucccuggg

SEQ ID NO: 15078 - RNA, 18 nt, Artificial Sequence
  Description of Artificial Sequence: Synthetic oligonucleotide
ugcauccuccccuccucc

SEQ ID NO: 15079 - RNA, 18 nt, Artificial Sequence
  Description of Artificial Sequence: Synthetic oligonucleotide
cccucugcauccuccccu

SEQ ID NO: 15080 - RNA, 18 nt, Artificial Sequence
  Description of Artificial Sequence: Synthetic oligonucleotide
ccacucccucugcauccu

SEQ ID NO: 15081 - RNA, 18 nt, Artificial Sequence
  Description of Artificial Sequence: Synthetic oligonucleotide
gcauuccacucccucugc

SEQ ID NO: 15082 - RNA, 18 nt, Artificial Sequence
  Description of Artificial Sequence: Synthetic oligonucleotide
cauucgcauuccacuccc

SEQ ID NO: 15083 - RNA, 18 nt, Artificial Sequence
  Description of Artificial Sequence: Synthetic oligonucleotide
cccgacauucgcauucca

SEQ ID NO: 15084 - RNA, 18 nt, Artificial Sequence
  Description of Artificial Sequence: Synthetic oligonucleotide
gaggacccgacauucgca

SEQ ID NO: 15085 - RNA, 18 nt, Artificial Sequence
  Description of Artificial Sequence: Synthetic oligonucleotide
gggcagaggacccgacau

SEQ ID NO: 15086 - RNA, 18 nt, Artificial Sequence
  Description of Artificial Sequence: Synthetic oligonucleotide
cgacugggcagaggaccc

SEQ ID NO: 15087 - RNA, 18 nt, Artificial Sequence
  Description of Artificial Sequence: Synthetic oligonucleotide
caggccgacugggcagag

SEQ ID NO: 15088 - RNA, 18 nt, Artificial Sequence
  Description of Artificial Sequence: Synthetic oligonucleotide
uccgacaggccgacuggg

SEQ ID NO: 15089 - RNA, 18 nt, Artificial Sequence
  Description of Artificial Sequence: Synthetic oligonucleotide
agcacuccgacaggccga

SEQ ID NO: 15090 - RNA, 18 nt, Artificial Sequence
  Description of Artificial Sequence: Synthetic oligonucleotide
caaauagcacuccgacag

SEQ ID NO: 15091 - RNA, 18 nt, Artificial Sequence
  Description of Artificial Sequence: Synthetic oligonucleotide
cugugcaaauagcacucc

SEQ ID NO: 15092 - RNA, 18 nt, Artificial Sequence
  Description of Artificial Sequence: Synthetic oligonucleotide
acgagcugugcaaauagc

SEQ ID NO: 15093 - RNA, 18 nt, Artificial Sequence
  Description of Artificial Sequence: Synthetic oligonucleotide
aggacccgacauucgcau

SEQ ID NO: 15094 - RNA, 18 nt, Artificial Sequence
  Description of Artificial Sequence: Synthetic oligonucleotide
ggcagaggacccgacauu

SEQ ID NO: 15095 - RNA, 18 nt, Artificial Sequence
  Description of Artificial Sequence: Synthetic oligonucleotide
gacugggcagaggacccg

SEQ ID NO: 15096 - RNA, 18 nt, Artificial Sequence
  Description of Artificial Sequence: Synthetic oligonucleotide
aggccgacugggcagagg

SEQ ID NO: 15097 - RNA, 18 nt, Artificial Sequence
  Description of Artificial Sequence: Synthetic oligonucleotide
ccgacaggccgacugggc

SEQ ID NO: 15098 - RNA, 18 nt, Artificial Sequence
  Description of Artificial Sequence: Synthetic oligonucleotide
gcacuccgacaggccgac

SEQ ID NO: 15099 - RNA, 18 nt, Artificial Sequence
  Description of Artificial Sequence: Synthetic oligonucleotide
aaauagcacuccgacagg

SEQ ID NO: 15100 - RNA, 18 nt, Artificial Sequence
  Description of Artificial Sequence: Synthetic oligonucleotide
ugugcaaauagcacuccg

SEQ ID NO: 15101 - RNA, 18 nt, Artificial Sequence
  Description of Artificial Sequence: Synthetic oligonucleotide
cgagcugugcaaauagca

SEQ ID NO: 15102 - RNA, 18 nt, Artificial Sequence
  Description of Artificial Sequence: Synthetic oligonucleotide
aucaacgagcugugcaaa

SEQ ID NO: 15103 - RNA, 18 nt, Artificial Sequence
  Description of Artificial Sequence: Synthetic oligonucleotide
ccaaaaucaacgagcugu

SEQ ID NO: 15104 - RNA, 18 nt, Artificial Sequence
  Description of Artificial Sequence: Synthetic oligonucleotide
gcaccccaaaaucaacga

SEQ ID NO: 15105 - RNA, 18 nt, Artificial Sequence
  Description of Artificial Sequence: Synthetic oligonucleotide
ucccagcaccccaaaauc

SEQ ID NO: 15106 - RNA, 18 nt, Artificial Sequence
  Description of Artificial Sequence: Synthetic oligonucleotide
ucagaucccagcacccca

SEQ ID NO: 15107 - RNA, 18 nt, Artificial Sequence
  Description of Artificial Sequence: Synthetic oligonucleotide
gacucucagaucccagca

SEQ ID NO: 15108 - RNA, 18 nt, Artificial Sequence
  Description of Artificial Sequence: Synthetic oligonucleotide
auccagacucucagaucc

SEQ ID NO: 15109 - RNA, 18 nt, Artificial Sequence
  Description of Artificial Sequence: Synthetic oligonucleotide
acaagauccagacucuca

SEQ ID NO: 15110 - RNA, 18 nt, Artificial Sequence
  Description of Artificial Sequence: Synthetic oligonucleotide
auccaacaagauccagac

SEQ ID NO: 15111 - RNA, 18 nt, Artificial Sequence
  Description of Artificial Sequence: Synthetic oligonucleotide
gguccauccaacaagauc

SEQ ID NO: 15112 - RNA, 18 nt, Artificial Sequence
  Description of Artificial Sequence: Synthetic oligonucleotide
cccuggguccauccaaca

SEQ ID NO: 15113 - RNA, 18 nt, Artificial Sequence
  Description of Artificial Sequence: Synthetic oligonucleotide
ucucucccuggguccauc

SEQ ID NO: 15114 - RNA, 18 nt, Artificial Sequence
  Description of Artificial Sequence: Synthetic oligonucleotide
cagggucucucccugggu

SEQ ID NO: 15115 - RNA, 18 nt, Artificial Sequence
  Description of Artificial Sequence: Synthetic oligonucleotide
uucuccagggucucuccc

SEQ ID NO: 15116 - RNA, 18 nt, Artificial Sequence
  Description of Artificial Sequence: Synthetic oligonucleotide
ggaccuucuccagggucu

SEQ ID NO: 15117 - RNA, 18 nt, Artificial Sequence
  Description of Artificial Sequence: Synthetic oligonucleotide
aaacaggaccuucuccag

SEQ ID NO: 15118 - RNA, 18 nt, Artificial Sequence
  Description of Artificial Sequence: Synthetic oligonucleotide
uuuguaaacaggaccuuc

SEQ ID NO: 15119 - RNA, 18 nt, Artificial Sequence
  Description of Artificial Sequence: Synthetic oligonucleotide
acccuuuuguaaacagga

SEQ ID NO: 15120 - RNA, 18 nt, Artificial Sequence
  Description of Artificial Sequence: Synthetic oligonucleotide
gauuaacccuuuuguaaa

SEQ ID NO: 15121 - RNA, 18 nt, Artificial Sequence
  Description of Artificial Sequence: Synthetic oligonucleotide
gggaagauuaacccuuuu

SEQ ID NO: 15122 - RNA, 18 nt, Artificial Sequence
  Description of Artificial Sequence: Synthetic oligonucleotide
ugcuuggagagcccuggg

SEQ ID NO: 15123 - RNA, 18 nt, Artificial Sequence
  Description of Artificial Sequence: Synthetic oligonucleotide
cugcuuggagagcccugg

SEQ ID NO: 15124 - RNA, 18 nt, Artificial Sequence
  Description of Artificial Sequence: Synthetic oligonucleotide
gucuucugcuuggagagc

SEQ ID NO: 15125 - RNA, 18 nt, Artificial Sequence
  Description of Artificial Sequence: Synthetic oligonucleotide
ucaaagucuucugcuugg

SEQ ID NO: 15126 - RNA, 18 nt, Artificial Sequence
  Description of Artificial Sequence: Synthetic oligonucleotide
ucuacucaaagucuucug

SEQ ID NO: 15127 - RNA, 18 nt, Artificial Sequence
  Description of Artificial Sequence: Synthetic oligonucleotide
agugcucuacucaaaguc

SEQ ID NO: 15128 - RNA, 18 nt, Artificial Sequence
  Description of Artificial Sequence: Synthetic oligonucleotide
ggaggagugcucuacuca

SEQ ID NO: 15129 - RNA, 18 nt, Artificial Sequence
  Description of Artificial Sequence: Synthetic oligonucleotide
cugcgggaggagugcucu

SEQ ID NO: 15130 - RNA, 18 nt, Artificial Sequence
  Description of Artificial Sequence: Synthetic oligonucleotide
caucccugcgggaggagu

SEQ ID NO: 15131 - RNA, 18 nt, Artificial Sequence
  Description of Artificial Sequence: Synthetic oligonucleotide
ugggacaucccugcggga

SEQ ID NO: 15132 - RNA, 18 nt, Artificial Sequence
  Description of Artificial Sequence: Synthetic oligonucleotide
uagggugggacaucccug

SEQ ID NO: 15133 - RNA, 18 nt, Artificial Sequence
  Description of Artificial Sequence: Synthetic oligonucleotide
ugccuuagggugggacau

SEQ ID NO: 15134 - RNA, 18 nt, Artificial Sequence
  Description of Artificial Sequence: Synthetic oligonucleotide
uccuuugccuuagggugg

SEQ ID NO: 15135 - RNA, 18 nt, Artificial Sequence
  Description of Artificial Sequence: Synthetic oligonucleotide
ggguuuccuuugccuuag

SEQ ID NO: 15136 - RNA, 18 nt, Artificial Sequence
  Description of Artificial Sequence: Synthetic oligonucleotide
agaggaagaaaaguuggg

SEQ ID NO: 15137 - RNA, 18 nt, Artificial Sequence
  Description of Artificial Sequence: Synthetic oligonucleotide
gagaggaagaaaaguugg

SEQ ID NO: 15138 - RNA, 18 nt, Artificial Sequence
  Description of Artificial Sequence: Synthetic oligonucleotide
cuagggagaggaagaaaa

SEQ ID NO: 15139 - RNA, 18 nt, Artificial Sequence
  Description of Artificial Sequence: Synthetic oligonucleotide
ugccucuagggagaggaa

SEQ ID NO: 15140 - RNA, 18 nt, Artificial Sequence
  Description of Artificial Sequence: Synthetic oligonucleotide
ugcacugccucuagggag

SEQ ID NO: 15141 - RNA, 18 nt, Artificial Sequence
  Description of Artificial Sequence: Synthetic oligonucleotide
agccuugcacugccucua

SEQ ID NO: 15142 - RNA, 18 nt, Artificial Sequence
  Description of Artificial Sequence: Synthetic oligonucleotide
gggccagccuugcacugc

SEQ ID NO: 15143 - RNA, 18 nt, Artificial Sequence
  Description of Artificial Sequence: Synthetic oligonucleotide
ucucagggccagccuugc

SEQ ID NO: 15144 - RNA, 18 nt, Artificial Sequence
  Description of Artificial Sequence: Synthetic oligonucleotide
uccugucucagggccagc

SEQ ID NO: 15145 - RNA, 18 nt, Artificial Sequence
  Description of Artificial Sequence: Synthetic oligonucleotide
cacauuccugucucaggg

SEQ ID NO: 15146 - RNA, 18 nt, Artificial Sequence
  Description of Artificial Sequence: Synthetic oligonucleotide
ugggccacauuccugucu

SEQ ID NO: 15147 - RNA, 18 nt, Artificial Sequence
  Description of Artificial Sequence: Synthetic oligonucleotide
ccaauugggccacauucc

SEQ ID NO: 15148 - RNA, 18 nt, Artificial Sequence
  Description of Artificial Sequence: Synthetic oligonucleotide
caggcccaauugggccac

SEQ ID NO: 15149 - RNA, 18 nt, Artificial Sequence
  Description of Artificial Sequence: Synthetic oligonucleotide
cacugcaggcccaauugg

SEQ ID NO: 15150 - RNA, 18 nt, Artificial Sequence
  Description of Artificial Sequence: Synthetic oligonucleotide
cucagcacugcaggccca

SEQ ID NO: 15151 - RNA, 18 nt, Artificial Sequence
  Description of Artificial Sequence: Synthetic oligonucleotide
gggcgcucagcacugcag

SEQ ID NO: 15152 - RNA, 18 nt, Artificial Sequence
  Description of Artificial Sequence: Synthetic oligonucleotide
gaagagggcgcucagcac

SEQ ID NO: 15153 - RNA, 18 nt, Artificial Sequence
  Description of Artificial Sequence: Synthetic oligonucleotide
ggagggaagagggcgcuc

SEQ ID NO: 15154 - RNA, 18 nt, Artificial Sequence
  Description of Artificial Sequence: Synthetic oligonucleotide
ggugaggagggaagaggg

SEQ ID NO: 15155 - RNA, 18 nt, Artificial Sequence
  Description of Artificial Sequence: Synthetic oligonucleotide
gcagagacagcggcaaac

SEQ ID NO: 15156 - RNA, 18 nt, Artificial Sequence
  Description of Artificial Sequence: Synthetic oligonucleotide
gaauagcagagacagcgg

SEQ ID NO: 15157 - RNA, 18 nt, Artificial Sequence
  Description of Artificial Sequence: Synthetic oligonucleotide
ggauggaauagcagagac

SEQ ID NO: 15158 - RNA, 18 nt, Artificial Sequence
  Description of Artificial Sequence: Synthetic oligonucleotide
gggaggauggaauagcag

SEQ ID NO: 15159 - RNA, 18 nt, Artificial Sequence
  Description of Artificial Sequence: Synthetic oligonucleotide
ggagagagccccuauggg

SEQ ID NO: 15160 - RNA, 18 nt, Artificial Sequence
  Description of Artificial Sequence: Synthetic oligonucleotide
gggagagagccccuaugg

SEQ ID NO: 15161 - RNA, 18 nt, Artificial Sequence
  Description of Artificial Sequence: Synthetic oligonucleotide
ucuugagaugggagaggg

SEQ ID NO: 15162 - RNA, 18 nt, Artificial Sequence
  Description of Artificial Sequence: Synthetic oligonucleotide
ugccaucuugagauggga

SEQ ID NO: 15163 - RNA, 18 nt, Artificial Sequence
  Description of Artificial Sequence: Synthetic oligonucleotide
cuggcugccaucuugaga

SEQ ID NO: 15164 - RNA, 18 nt, Artificial Sequence
  Description of Artificial Sequence: Synthetic oligonucleotide
agcugcuggcugccaucu

SEQ ID NO: 15165 - RNA, 18 nt, Artificial Sequence
  Description of Artificial Sequence: Synthetic oligonucleotide
cucagagcugcuggcugc

SEQ ID NO: 15166 - RNA, 18 nt, Artificial Sequence
  Description of Artificial Sequence: Synthetic oligonucleotide
gagaucucagagcugcug

SEQ ID NO: 15167 - RNA, 18 nt, Artificial Sequence
  Description of Artificial Sequence: Synthetic oligonucleotide
ucucagagaucucagagc

SEQ ID NO: 15168 - RNA, 18 nt, Artificial Sequence
  Description of Artificial Sequence: Synthetic oligonucleotide
cuucaucucagagaucuc

SEQ ID NO: 15169 - RNA, 18 nt, Artificial Sequence
  Description of Artificial Sequence: Synthetic oligonucleotide
acccccuucaucucagag

SEQ ID NO: 15170 - RNA, 18 nt, Artificial Sequence
  Description of Artificial Sequence: Synthetic oligonucleotide
ccucaacccccuucaucu

SEQ ID NO: 15171 - RNA, 18 nt, Artificial Sequence
  Description of Artificial Sequence: Synthetic oligonucleotide
acucuccucaacccccuu

SEQ ID NO: 15172 - RNA, 18 nt, Artificial Sequence
  Description of Artificial Sequence: Synthetic oligonucleotide
uugggacucuccucaacc

SEQ ID NO: 15173 - RNA, 18 nt, Artificial Sequence
  Description of Artificial Sequence: Synthetic oligonucleotide
gaaccuugggacucuccu

SEQ ID NO: 15174 - RNA, 18 nt, Artificial Sequence
  Description of Artificial Sequence: Synthetic oligonucleotide
gccuggaaccuugggacu

SEQ ID NO: 15175 - RNA, 18 nt, Artificial Sequence
  Description of Artificial Sequence: Synthetic oligonucleotide
ccuucgccuggaaccuug

SEQ ID NO: 15176 - RNA, 18 nt, Artificial Sequence
  Description of Artificial Sequence: Synthetic oligonucleotide
caggcccuucgccuggaa

SEQ ID NO: 15177 - RNA, 18 nt, Artificial Sequence
  Description of Artificial Sequence: Synthetic oligonucleotide
auggccaggcccuucgcc

SEQ ID NO: 15178 - RNA, 18 nt, Artificial Sequence
  Description of Artificial Sequence: Synthetic oligonucleotide
ucagaauggccaggcccu

SEQ ID NO: 15179 - RNA, 18 nt, Artificial Sequence
  Description of Artificial Sequence: Synthetic oligonucleotide
cagcuucagaauggccag

SEQ ID NO: 15180 - RNA, 18 nt, Artificial Sequence
  Description of Artificial Sequence: Synthetic oligonucleotide
aguuucagcuucagaaug

SEQ ID NO: 15181 - RNA, 18 nt, Artificial Sequence
  Description of Artificial Sequence: Synthetic oligonucleotide
gggccaguuucagcuuca

SEQ ID NO: 15182 - RNA, 18 nt, Artificial Sequence
  Description of Artificial Sequence: Synthetic oligonucleotide
gggagggccaguuucagc

SEQ ID NO: 15183 - RNA, 18 nt, Artificial Sequence
  Description of Artificial Sequence: Synthetic oligonucleotide
ccccugcuaggaccuggg

SEQ ID NO: 15184 - RNA, 18 nt, Artificial Sequence
  Description of Artificial Sequence: Synthetic oligonucleotide
ugguaccccugcuaggac

SEQ ID NO: 15185 - RNA, 18 nt, Artificial Sequence
  Description of Artificial Sequence: Synthetic oligonucleotide
uggucugguaccccugcu

SEQ ID NO: 15186 - RNA, 18 nt, Artificial Sequence
  Description of Artificial Sequence: Synthetic oligonucleotide
cuggcuggucugguaccc

SEQ ID NO: 15187 - RNA, 18 nt, Artificial Sequence
  Description of Artificial Sequence: Synthetic oligonucleotide
ggccucuggcuggucugg

SEQ ID NO: 15188 - RNA, 18 nt, Artificial Sequence
  Description of Artificial Sequence: Synthetic oligonucleotide
gggccucuggcuggucug

SEQ ID NO: 15189 - RNA, 18 nt, Artificial Sequence
  Description of Artificial Sequence: Synthetic oligonucleotide
uuuggaccuggcugcggg

SEQ ID NO: 15190 - RNA, 18 nt, Artificial Sequence
  Description of Artificial Sequence: Synthetic oligonucleotide
ugguguuuggaccuggcu

SEQ ID NO: 15191 - RNA, 18 nt, Artificial Sequence
  Description of Artificial Sequence: Synthetic oligonucleotide
cgcagugguguuuggacc

SEQ ID NO: 15192 - RNA, 18 nt, Artificial Sequence
  Description of Artificial Sequence: Synthetic oligonucleotide
gggccgcagugguguuug

SEQ ID NO: 15193 - RNA, 18 nt, Artificial Sequence
  Description of Artificial Sequence: Synthetic oligonucleotide
ggcccugaguccacaggg

SEQ ID NO: 15194 - RNA, 18 nt, Artificial Sequence
  Description of Artificial Sequence: Synthetic oligonucleotide
ccuugggcccugagucca

SEQ ID NO: 15195 - RNA, 18 nt, Artificial Sequence
  Description of Artificial Sequence: Synthetic oligonucleotide
cccagccuugggcccuga

SEQ ID NO: 15196 - RNA, 18 nt, Artificial Sequence
  Description of Artificial Sequence: Synthetic oligonucleotide
gccagcccagccuugggc

SEQ ID NO: 15197 - RNA, 18 nt, Artificial Sequence
  Description of Artificial Sequence: Synthetic oligonucleotide
cuggagccagcccagccu

SEQ ID NO: 15198 - RNA, 18 nt, Artificial Sequence
  Description of Artificial Sequence: Synthetic oligonucleotide
gguuucuggagccagccc

SEQ ID NO: 15199 - RNA, 18 nt, Artificial Sequence
  Description of Artificial Sequence: Synthetic oligonucleotide
ucugugguuucuggagcc

SEQ ID NO: 15200 - RNA, 18 nt, Artificial Sequence
  Description of Artificial Sequence: Synthetic oligonucleotide
gggucucugugguuucug

SEQ ID NO: 15201 - RNA, 18 nt, Artificial Sequence
  Description of Artificial Sequence: Synthetic oligonucleotide
uguuucugaggccccagc

SEQ ID NO: 15202 - RNA, 18 nt, Artificial Sequence
  Description of Artificial Sequence: Synthetic oligonucleotide
ugggcuguuucugaggcc

SEQ ID NO: 15203 - RNA, 18 nt, Artificial Sequence
  Description of Artificial Sequence: Synthetic oligonucleotide
uggccugggcuguuucug

SEQ ID NO: 15204 - RNA, 18 nt, Artificial Sequence
  Description of Artificial Sequence: Synthetic oligonucleotide
gucuguggccugggcugu

SEQ ID NO: 15205 - RNA, 18 nt, Artificial Sequence
  Description of Artificial Sequence: Synthetic oligonucleotide
cugaggucuguggccugg

SEQ ID NO: 15206 - RNA, 18 nt, Artificial Sequence
  Description of Artificial Sequence: Synthetic oligonucleotide
uuaagcugaggucugugg

SEQ ID NO: 15207 - RNA, 18 nt, Artificial Sequence
  Description of Artificial Sequence: Synthetic oligonucleotide
ugggcuuaagcugagguc

SEQ ID NO: 15208 - RNA, 18 nt, Artificial Sequence
  Description of Artificial Sequence: Synthetic oligonucleotide
ccuccugggcuuaagcug

SEQ ID NO: 15209 - RNA, 18 nt, Artificial Sequence
  Description of Artificial Sequence: Synthetic oligonucleotide
auuccccuccugggcuua

SEQ ID NO: 15210 - RNA, 18 nt, Artificial Sequence
  Description of Artificial Sequence: Synthetic oligonucleotide
cuuugauuccccuccugg

SEQ ID NO: 15211 - RNA, 18 nt, Artificial Sequence
  Description of Artificial Sequence: Synthetic oligonucleotide
uuggccuuugauuccccu

SEQ ID NO: 15212 - RNA, 18 nt, Artificial Sequence
  Description of Artificial Sequence: Synthetic oligonucleotide
ugcaguuggccuuugauu

SEQ ID NO: 15213 - RNA, 18 nt, Artificial Sequence
  Description of Artificial Sequence: Synthetic oligonucleotide
gggcugcaguuggccuuu

SEQ ID NO: 15214 - RNA, 18 nt, Artificial Sequence
  Description of Artificial Sequence: Synthetic oligonucleotide
uuggcaugggucuucggg

SEQ ID NO: 15215 - RNA, 18 nt, Artificial Sequence
  Description of Artificial Sequence: Synthetic oligonucleotide
guuucuuggcaugggucu

SEQ ID NO: 15216 - RNA, 18 nt, Artificial Sequence
  Description of Artificial Sequence: Synthetic oligonucleotide
acacuguuucuuggcaug

SEQ ID NO: 15217 - RNA, 18 nt, Artificial Sequence
  Description of Artificial Sequence: Synthetic oligonucleotide
uuuggacacuguuucuug

SEQ ID NO: 15218 - RNA, 18 nt, Artificial Sequence
  Description of Artificial Sequence: Synthetic oligonucleotide
ucugguuuggacacuguu

SEQ ID NO: 15219 - RNA, 18 nt, Artificial Sequence
  Description of Artificial Sequence: Synthetic oligonucleotide
ucacuucugguuuggaca

SEQ ID NO: 15220 - RNA, 18 nt, Artificial Sequence
  Description of Artificial Sequence: Synthetic oligonucleotide
uuugcucacuucugguuu

SEQ ID NO: 15221 - RNA, 18 nt, Artificial Sequence
  Description of Artificial Sequence: Synthetic oligonucleotide
gccucuuugcucacuucu

SEQ ID NO: 15222 - RNA, 18 nt, Artificial Sequence
  Description of Artificial Sequence: Synthetic oligonucleotide
caguggccucuuugcuca

SEQ ID NO: 15223 - RNA, 18 nt, Artificial Sequence
  Description of Artificial Sequence: Synthetic oligonucleotide
gucugcaguggccucuuu

SEQ ID NO: 15224 - RNA, 18 nt, Artificial Sequence
  Description of Artificial Sequence: Synthetic oligonucleotide
cccuggucugcaguggcc

SEQ ID NO: 15225 - RNA, 18 nt, Artificial Sequence
  Description of Artificial Sequence: Synthetic oligonucleotide
uggaccccuggucugcag

SEQ ID NO: 15226 - RNA, 18 nt, Artificial Sequence
  Description of Artificial Sequence: Synthetic oligonucleotide
cagccuggaccccugguc

SEQ ID NO: 15227 - RNA, 18 nt, Artificial Sequence
  Description of Artificial Sequence: Synthetic oligonucleotide
gacuccagccuggacccc

SEQ ID NO: 15228 - RNA, 18 nt, Artificial Sequence
  Description of Artificial Sequence: Synthetic oligonucleotide
cugcagacuccagccugg

SEQ ID NO: 15229 - RNA, 18 nt, Artificial Sequence
  Description of Artificial Sequence: Synthetic oligonucleotide
gggcugcagacuccagcc

SEQ ID NO: 15230 - RNA, 18 nt, Artificial Sequence
  Description of Artificial Sequence: Synthetic oligonucleotide
gcugggaaucuggccggg

SEQ ID NO: 15231 - RNA, 18 nt, Artificial Sequence
  Description of Artificial Sequence: Synthetic oligonucleotide
gguaggcugggaaucugg

SEQ ID NO: 15232 - RNA, 18 nt, Artificial Sequence
  Description of Artificial Sequence: Synthetic oligonucleotide
ggguaggcugggaaucug

SEQ ID NO: 15233 - RNA, 18 nt, Artificial Sequence
  Description of Artificial Sequence: Synthetic oligonucleotide
uugaagggcuggcuuggg

SEQ ID NO: 15234 - RNA, 18 nt, Artificial Sequence
  Description of Artificial Sequence: Synthetic oligonucleotide
ucugguugaagggcuggc

SEQ ID NO: 15235 - RNA, 18 nt, Artificial Sequence
  Description of Artificial Sequence: Synthetic oligonucleotide
ggagcucugguugaaggg

SEQ ID NO: 15236 - RNA, 18 nt, Artificial Sequence
  Description of Artificial Sequence: Synthetic oligonucleotide
gguagggagcucugguug

SEQ ID NO: 15237 - RNA, 18 nt, Artificial Sequence
  Description of Artificial Sequence: Synthetic oligonucleotide
uccuggguagggagcucu

SEQ ID NO: 15238 - RNA, 18 nt, Artificial Sequence
  Description of Artificial Sequence: Synthetic oligonucleotide
gguccuccuggguaggga

SEQ ID NO: 15239 - RNA, 18 nt, Artificial Sequence
  Description of Artificial Sequence: Synthetic oligonucleotide
ggguccuccuggguaggg

SEQ ID NO: 15240 - RNA, 18 nt, Artificial Sequence
  Description of Artificial Sequence: Synthetic oligonucleotide
ucagacagaaucucaggg

SEQ ID NO: 15241 - RNA, 18 nt, Artificial Sequence
  Description of Artificial Sequence: Synthetic oligonucleotide
cacucucagacagaaucu

SEQ ID NO: 15242 - RNA, 18 nt, Artificial Sequence
  Description of Artificial Sequence: Synthetic oligonucleotide
cccuacacucucagacag

SEQ ID NO: 15243 - RNA, 18 nt, Artificial Sequence
  Description of Artificial Sequence: Synthetic oligonucleotide
uuuuccccuacacucuca

SEQ ID NO: 15244 - RNA, 18 nt, Artificial Sequence
  Description of Artificial Sequence: Synthetic oligonucleotide
cuugcuuuuccccuacac

SEQ ID NO: 15245 - RNA, 18 nt, Artificial Sequence
  Description of Artificial Sequence: Synthetic oligonucleotide
auucucuugcuuuucccc

SEQ ID NO: 15246 - RNA, 18 nt, Artificial Sequence
  Description of Artificial Sequence: Synthetic oligonucleotide
gccccauucucuugcuuu

SEQ ID NO: 15247 - RNA, 18 nt, Artificial Sequence
  Description of Artificial Sequence: Synthetic oligonucleotide
ccacugccccauucucuu

SEQ ID NO: 15248 - RNA, 18 nt, Artificial Sequence
  Description of Artificial Sequence: Synthetic oligonucleotide
gggcaccacugccccauu

SEQ ID NO: 15249 - RNA, 18 nt, Artificial Sequence
  Description of Artificial Sequence: Synthetic oligonucleotide
uccccaucaccagccugc

SEQ ID NO: 15250 - RNA, 18 nt, Artificial Sequence
  Description of Artificial Sequence: Synthetic oligonucleotide
ccucuuccccaucaccag

SEQ ID NO: 15251 - RNA, 18 nt, Artificial Sequence
  Description of Artificial Sequence: Synthetic oligonucleotide
ugggcccucuuccccauc

SEQ ID NO: 15252 - RNA, 18 nt, Artificial Sequence
  Description of Artificial Sequence: Synthetic oligonucleotide
gggcugggcccucuuccc

SEQ ID NO: 15253 - RNA, 18 nt, Artificial Sequence
  Description of Artificial Sequence: Synthetic oligonucleotide
ggugagugaggcucaggg

SEQ ID NO: 15254 - RNA, 18 nt, Artificial Sequence
  Description of Artificial Sequence: Synthetic oligonucleotide
aggguggugagugaggcu

SEQ ID NO: 15255 - RNA, 18 nt, Artificial Sequence
  Description of Artificial Sequence: Synthetic oligonucleotide
uuuugaggguggugagug

SEQ ID NO: 15256 - RNA, 18 nt, Artificial Sequence
  Description of Artificial Sequence: Synthetic oligonucleotide
gauuuuuuugaggguggu

SEQ ID NO: 15257 - RNA, 18 nt, Artificial Sequence
  Description of Artificial Sequence: Synthetic oligonucleotide
gggauuuuuuugagggug

SEQ ID NO: 15258 - RNA, 18 nt, Artificial Sequence
  Description of Artificial Sequence: Synthetic oligonucleotide
gcugcugcagcacucggg

SEQ ID NO: 15259 - RNA, 18 nt, Artificial Sequence
  Description of Artificial Sequence: Synthetic oligonucleotide
aaccagcugcugcagcac

SEQ ID NO: 15260 - RNA, 18 nt, Artificial Sequence
  Description of Artificial Sequence: Synthetic oligonucleotide
uccucaaccagcugcugc

SEQ ID NO: 15261 - RNA, 18 nt, Artificial Sequence
  Description of Artificial Sequence: Synthetic oligonucleotide
gauccuccucaaccagcu

SEQ ID NO: 15262 - RNA, 18 nt, Artificial Sequence
  Description of Artificial Sequence: Synthetic oligonucleotide
cauucgauccuccucaac

SEQ ID NO: 15263 - RNA, 18 nt, Artificial Sequence
  Description of Artificial Sequence: Synthetic oligonucleotide
cuucucauucgauccucc

SEQ ID NO: 15264 - RNA, 18 nt, Artificial Sequence
  Description of Artificial Sequence: Synthetic oligonucleotide
gugcccuucucauucgau

SEQ ID NO: 15265 - RNA, 18 nt, Artificial Sequence
  Description of Artificial Sequence: Synthetic oligonucleotide
acugugugcccuucucau

SEQ ID NO: 15266 - RNA, 18 nt, Artificial Sequence
  Description of Artificial Sequence: Synthetic oligonucleotide
ugcccacugugugcccuu

SEQ ID NO: 15267 - RNA, 18 nt, Artificial Sequence
  Description of Artificial Sequence: Synthetic oligonucleotide
cuggaugcccacugugug

SEQ ID NO: 15268 - RNA, 18 nt, Artificial Sequence
  Description of Artificial Sequence: Synthetic oligonucleotide
agauccuggaugcccacu

SEQ ID NO: 15269 - RNA, 18 nt, Artificial Sequence
  Description of Artificial Sequence: Synthetic oligonucleotide
gggagauccuggaugccc

SEQ ID NO: 15270 - RNA, 18 nt, Artificial Sequence
  Description of Artificial Sequence: Synthetic oligonucleotide
ggcucaggcuaccucggg

SEQ ID NO: 15271 - RNA, 18 nt, Artificial Sequence
  Description of Artificial Sequence: Synthetic oligonucleotide
guggcggcucaggcuacc

SEQ ID NO: 15272 - RNA, 18 nt, Artificial Sequence
  Description of Artificial Sequence: Synthetic oligonucleotide
ggguggcggcucaggcua

SEQ ID NO: 15273 - RNA, 18 nt, Artificial Sequence
  Description of Artificial Sequence: Synthetic oligonucleotide
ugccaacugggagcuggg

SEQ ID NO: 15274 - RNA, 18 nt, Artificial Sequence
  Description of Artificial Sequence: Synthetic oligonucleotide
ggaccugccaacugggag

SEQ ID NO: 15275 - RNA, 18 nt, Artificial Sequence
  Description of Artificial Sequence: Synthetic oligonucleotide
ccccaggaccugccaacu

SEQ ID NO: 15276 - RNA, 18 nt, Artificial Sequence
  Description of Artificial Sequence: Synthetic oligonucleotide
cuccaccccaggaccugc

SEQ ID NO: 15277 - RNA, 18 nt, Artificial Sequence
  Description of Artificial Sequence: Synthetic oligonucleotide
ccccccuccaccccagga

SEQ ID NO: 15278 - RNA, 18 nt, Artificial Sequence
  Description of Artificial Sequence: Synthetic oligonucleotide
cuucaccccccuccaccc

SEQ ID NO: 15279 - RNA, 18 nt, Artificial Sequence
  Description of Artificial Sequence: Synthetic oligonucleotide
ggugccuucaccccccuc

SEQ ID NO: 15280 - RNA, 18 nt, Artificial Sequence
  Description of Artificial Sequence: Synthetic oligonucleotide
uucugggugccuucaccc

SEQ ID NO: 15281 - RNA, 18 nt, Artificial Sequence
  Description of Artificial Sequence: Synthetic oligonucleotide
gagguuucugggugccuu

SEQ ID NO: 15282 - RNA, 18 nt, Artificial Sequence
  Description of Artificial Sequence: Synthetic oligonucleotide
gucccgagguuucugggu

SEQ ID NO: 15283 - RNA, 18 nt, Artificial Sequence
  Description of Artificial Sequence: Synthetic oligonucleotide
auguagucccgagguuuc

SEQ ID NO: 15284 - RNA, 18 nt, Artificial Sequence
  Description of Artificial Sequence: Synthetic oligonucleotide
ggaugauguagucccgag

SEQ ID NO: 15285 - RNA, 18 nt, Artificial Sequence
  Description of Artificial Sequence: Synthetic oligonucleotide
ggcaaggaugauguaguc

SEQ ID NO: 15286 - RNA, 18 nt, Artificial Sequence
  Description of Artificial Sequence: Synthetic oligonucleotide
aggauggcaaggaugaug

SEQ ID NO: 15287 - RNA, 18 nt, Artificial Sequence
  Description of Artificial Sequence: Synthetic oligonucleotide
aggacaggauggcaagga

SEQ ID NO: 15288 - RNA, 18 nt, Artificial Sequence
  Description of Artificial Sequence: Synthetic oligonucleotide
gaagcaggacaggauggc

SEQ ID NO: 15289 - RNA, 18 nt, Artificial Sequence
  Description of Artificial Sequence: Synthetic oligonucleotide
gggcagaagcaggacagg

SEQ ID NO: 15290 - RNA, 18 nt, Artificial Sequence
  Description of Artificial Sequence: Synthetic oligonucleotide
cgauguugacaggccaca

SEQ ID NO: 15291 - RNA, 18 nt, Artificial Sequence
  Description of Artificial Sequence: Synthetic oligonucleotide
ggccacgauguugacagg

SEQ ID NO: 15292 - RNA, 18 nt, Artificial Sequence
  Description of Artificial Sequence: Synthetic oligonucleotide
gcgaaggccacgauguug

SEQ ID NO: 15293 - RNA, 18 nt, Artificial Sequence
  Description of Artificial Sequence: Synthetic oligonucleotide
cauaagcgaaggccacga

SEQ ID NO: 15294 - RNA, 18 nt, Artificial Sequence
  Description of Artificial Sequence: Synthetic oligonucleotide
gacagcauaagcgaaggc

SEQ ID NO: 15295 - RNA, 18 nt, Artificial Sequence
  Description of Artificial Sequence: Synthetic oligonucleotide
aagggagccacgcguuac

SEQ ID NO: 15296 - RNA, 18 nt, Artificial Sequence
  Description of Artificial Sequence: Synthetic oligonucleotide
agcccaagggagccacgc

SEQ ID NO: 15297 - RNA, 18 nt, Artificial Sequence
  Description of Artificial Sequence: Synthetic oligonucleotide
ccgccagcccaagggagc

SEQ ID NO: 15298 - RNA, 18 nt, Artificial Sequence
  Description of Artificial Sequence: Synthetic oligonucleotide
cccucccgccagcccaag

SEQ ID NO: 15299 - RNA, 18 nt, Artificial Sequence
  Description of Artificial Sequence: Synthetic oligonucleotide
ccggccccucccgccagc

SEQ ID NO: 15300 - RNA, 18 nt, Artificial Sequence
  Description of Artificial Sequence: Synthetic oligonucleotide
agccuccggccccucccg

SEQ ID NO: 15301 - RNA, 18 nt, Artificial Sequence
  Description of Artificial Sequence: Synthetic oligonucleotide
ucgcgagccuccggcccc

SEQ ID NO: 15302 - RNA, 18 nt, Artificial Sequence
  Description of Artificial Sequence: Synthetic oligonucleotide
gccccucgcgagccuccg

SEQ ID NO: 15303 - RNA, 18 nt, Artificial Sequence
  Description of Artificial Sequence: Synthetic oligonucleotide
cccccgccccucgcgagc

SEQ ID NO: 15304 - RNA, 18 nt, Artificial Sequence
  Description of Artificial Sequence: Synthetic oligonucleotide
cgccgcccccgccccucg

SEQ ID NO: 15305 - RNA, 18 nt, Artificial Sequence
  Description of Artificial Sequence: Synthetic oligonucleotide
gccgucgccgcccccgcc

SEQ ID NO: 15306 - RNA, 18 nt, Artificial Sequence
  Description of Artificial Sequence: Synthetic oligonucleotide
ccgccgccgucgccgccc

SEQ ID NO: 15307 - RNA, 18 nt, Artificial Sequence
  Description of Artificial Sequence: Synthetic oligonucleotide
acgcuccgccgccgucgc

SEQ ID NO: 15308 - RNA, 18 nt, Artificial Sequence
  Description of Artificial Sequence: Synthetic oligonucleotide
ccccuacgcuccgccgcc

SEQ ID NO: 15309 - RNA, 18 nt, Artificial Sequence
  Description of Artificial Sequence: Synthetic oligonucleotide
ccccuccccuacgcuccg

SEQ ID NO: 15310 - RNA, 18 nt, Artificial Sequence
  Description of Artificial Sequence: Synthetic oligonucleotide
ccgguccccuccccuacg

SEQ ID NO: 15311 - RNA, 18 nt, Artificial Sequence
  Description of Artificial Sequence: Synthetic oligonucleotide
ccucuccgguccccuccc

SEQ ID NO: 15312 - RNA, 18 nt, Artificial Sequence
  Description of Artificial Sequence: Synthetic oligonucleotide
ccccuccucuccgguccc

SEQ ID NO: 15313 - RNA, 18 nt, Artificial Sequence
  Description of Artificial Sequence: Synthetic oligonucleotide
cucauccccuccucuccg

SEQ ID NO: 15314 - RNA, 18 nt, Artificial Sequence
  Description of Artificial Sequence: Synthetic oligonucleotide
gugugcucauccccuccu

SEQ ID NO: 15315 - RNA, 18 nt, Artificial Sequence
  Description of Artificial Sequence: Synthetic oligonucleotide
cucccgugugcucauccc

SEQ ID NO: 15316 - RNA, 18 nt, Artificial Sequence
  Description of Artificial Sequence: Synthetic oligonucleotide
cuccucucccgugugcuc

SEQ ID NO: 15317 - RNA, 18 nt, Artificial Sequence
  Description of Artificial Sequence: Synthetic oligonucleotide
cucuucuccucucccgug

SEQ ID NO: 15318 - RNA, 18 nt, Artificial Sequence
  Description of Artificial Sequence: Synthetic oligonucleotide
ucucccucuucuccucuc

SEQ ID NO: 15319 - RNA, 18 nt, Artificial Sequence
  Description of Artificial Sequence: Synthetic oligonucleotide
gcgggucucccucuucuc

SEQ ID NO: 15320 - RNA, 18 nt, Artificial Sequence
  Description of Artificial Sequence: Synthetic oligonucleotide
aggcggcgggucucccuc

SEQ ID NO: 15321 - RNA, 18 nt, Artificial Sequence
  Description of Artificial Sequence: Synthetic oligonucleotide
gagggaggcggcgggucu

SEQ ID NO: 15322 - RNA, 18 nt, Artificial Sequence
  Description of Artificial Sequence: Synthetic oligonucleotide
ggagggagggaggcggcg

SEQ ID NO: 15323 - RNA, 18 nt, Artificial Sequence
  Description of Artificial Sequence: Synthetic oligonucleotide
gcuagggagggagggagg

SEQ ID NO: 15324 - RNA, 18 nt, Artificial Sequence
  Description of Artificial Sequence: Synthetic oligonucleotide
agucagcuagggagggag

SEQ ID NO: 15325 - RNA, 18 nt, Artificial Sequence
  Description of Artificial Sequence: Synthetic oligonucleotide
gagcaagucagcuaggga

SEQ ID NO: 15326 - RNA, 18 nt, Artificial Sequence
  Description of Artificial Sequence: Synthetic oligonucleotide
ggagggagcaagucagcu

SEQ ID NO: 15327 - RNA, 18 nt, Artificial Sequence
  Description of Artificial Sequence: Synthetic oligonucleotide
gcccgggagggagcaagu

SEQ ID NO: 15328 - RNA, 18 nt, Artificial Sequence
  Description of Artificial Sequence: Synthetic oligonucleotide
ccgcagcccgggagggag

SEQ ID NO: 15329 - RNA, 18 nt, Artificial Sequence
  Description of Artificial Sequence: Synthetic oligonucleotide
agcagccgcagcccggga

SEQ ID NO: 15330 - RNA, 18 nt, Artificial Sequence
  Description of Artificial Sequence: Synthetic oligonucleotide
uuugcagcagccgcagcc

SEQ ID NO: 15331 - RNA, 18 nt, Artificial Sequence
  Description of Artificial Sequence: Synthetic oligonucleotide
uggcuuuugcagcagccg

SEQ ID NO: 15332 - RNA, 18 nt, Artificial Sequence
  Description of Artificial Sequence: Synthetic oligonucleotide
gcugcuggcuuuugcagc

SEQ ID NO: 15333 - RNA, 18 nt, Artificial Sequence
  Description of Artificial Sequence: Synthetic oligonucleotide
cugccgcugcuggcuuuu

SEQ ID NO: 15334 - RNA, 18 nt, Artificial Sequence
  Description of Artificial Sequence: Synthetic oligonucleotide
ucccgcugccgcugcugg

SEQ ID NO: 15335 - RNA, 18 nt, Artificial Sequence
  Description of Artificial Sequence: Synthetic oligonucleotide
acagcucccgcugccgcu

SEQ ID NO: 15336 - RNA, 18 nt, Artificial Sequence
  Description of Artificial Sequence: Synthetic oligonucleotide
uccggacagcucccgcug

SEQ ID NO: 15337 - RNA, 18 nt, Artificial Sequence
  Description of Artificial Sequence: Synthetic oligonucleotide
cggccuccggacagcucc

SEQ ID NO: 15338 - RNA, 18 nt, Artificial Sequence
  Description of Artificial Sequence: Synthetic oligonucleotide
gacgccggccuccggaca

SEQ ID NO: 15339 - RNA, 18 nt, Artificial Sequence
  Description of Artificial Sequence: Synthetic oligonucleotide
gccucagucugcccgggu

SEQ ID NO: 15340 - RNA, 18 nt, Artificial Sequence
  Description of Artificial Sequence: Synthetic oligonucleotide
ccgcagccucagucugcc

SEQ ID NO: 15341 - RNA, 18 nt, Artificial Sequence
  Description of Artificial Sequence: Synthetic oligonucleotide
ccuacccgcagccucagu

SEQ ID NO: 15342 - RNA, 18 nt, Artificial Sequence
  Description of Artificial Sequence: Synthetic oligonucleotide
ccacuccuacccgcagcc

SEQ ID NO: 15343 - RNA, 18 nt, Artificial Sequence
  Description of Artificial Sequence: Synthetic oligonucleotide
ucgguccacuccuacccg

SEQ ID NO: 15344 - RNA, 18 nt, Artificial Sequence
  Description of Artificial Sequence: Synthetic oligonucleotide
gucggucgguccacuccu

SEQ ID NO: 15345 - RNA, 18 nt, Artificial Sequence
  Description of Artificial Sequence: Synthetic oligonucleotide
cagccgucggucggucca

SEQ ID NO: 15346 - RNA, 18 nt, Artificial Sequence
  Description of Artificial Sequence: Synthetic oligonucleotide
ggcgucagccgucggucg

SEQ ID NO: 15347 - RNA, 18 nt, Artificial Sequence
  Description of Artificial Sequence: Synthetic oligonucleotide
cgcccggcgucagccguc

SEQ ID NO: 15348 - RNA, 18 nt, Artificial Sequence
  Description of Artificial Sequence: Synthetic oligonucleotide
caguccgcccggcgucag

SEQ ID NO: 15349 - RNA, 18 nt, Artificial Sequence
  Description of Artificial Sequence: Synthetic oligonucleotide
ccgugcaguccgcccggc

SEQ ID NO: 15350 - RNA, 18 nt, Artificial Sequence
  Description of Artificial Sequence: Synthetic oligonucleotide
cauucccgugcaguccgc

SEQ ID NO: 15351 - RNA, 18 nt, Artificial Sequence
  Description of Artificial Sequence: Synthetic oligonucleotide
acccgcauucccgugcag

SEQ ID NO: 15352 - RNA, 18 nt, Artificial Sequence
  Description of Artificial Sequence: Synthetic oligonucleotide
cagacacccgcauucccg

SEQ ID NO: 15353 - RNA, 18 nt, Artificial Sequence
  Description of Artificial Sequence: Synthetic oligonucleotide
cccuccagacacccgcau

SEQ ID NO: 15354 - RNA, 18 nt, Artificial Sequence
  Description of Artificial Sequence: Synthetic oligonucleotide
accagcccuccagacacc

SEQ ID NO: 15355 - RNA, 18 nt, Artificial Sequence
  Description of Artificial Sequence: Synthetic oligonucleotide
ccaccaccagcccuccag

SEQ ID NO: 15356 - RNA, 18 nt, Artificial Sequence
  Description of Artificial Sequence: Synthetic oligonucleotide
cagcaccaccaccagccc

SEQ ID NO: 15357 - RNA, 18 nt, Artificial Sequence
  Description of Artificial Sequence: Synthetic oligonucleotide
ccgcccagcaccaccacc

SEQ ID NO: 15358 - RNA, 18 nt, Artificial Sequence
  Description of Artificial Sequence: Synthetic oligonucleotide
ucagcccgcccagcacca

SEQ ID NO: 15359 - RNA, 18 nt, Artificial Sequence
  Description of Artificial Sequence: Synthetic oligonucleotide
augguucagcccgcccag

SEQ ID NO: 15360 - RNA, 18 nt, Artificial Sequence
  Description of Artificial Sequence: Synthetic oligonucleotide
ucccgaugguucagcccg

SEQ ID NO: 15361 - RNA, 18 nt, Artificial Sequence
  Description of Artificial Sequence: Synthetic oligonucleotide
ccuccucccgaugguuca

SEQ ID NO: 15362 - RNA, 18 nt, Artificial Sequence
  Description of Artificial Sequence: Synthetic oligonucleotide
uggcgccuccucccgaug

SEQ ID NO: 15363 - RNA, 18 nt, Artificial Sequence
  Description of Artificial Sequence: Synthetic oligonucleotide
ugggcuggcgccuccucc

SEQ ID NO: 15364 - RNA, 18 nt, Artificial Sequence
  Description of Artificial Sequence: Synthetic oligonucleotide
uucggugggcuggcgccu

SEQ ID NO: 15365 - RNA, 18 nt, Artificial Sequence
  Description of Artificial Sequence: Synthetic oligonucleotide
ucgccuucggugggcugg

SEQ ID NO: 15366 - RNA, 18 nt, Artificial Sequence
  Description of Artificial Sequence: Synthetic oligonucleotide
uucccucgccuucggugg

SEQ ID NO: 15367 - RNA, 18 nt, Artificial Sequence
  Description of Artificial Sequence: Synthetic oligonucleotide
gggcuucccucgccuucg

SEQ ID NO: 15368 - RNA, 18 nt, Artificial Sequence
  Description of Artificial Sequence: Synthetic oligonucleotide
gucagccccucucccggg

SEQ ID NO: 15369 - RNA, 18 nt, Artificial Sequence
  Description of Artificial Sequence: Synthetic oligonucleotide
ccccugucagccccucuc

SEQ ID NO: 15370 - RNA, 18 nt, Artificial Sequence
  Description of Artificial Sequence: Synthetic oligonucleotide
ucgauccccugucagccc

SEQ ID NO: 15371 - RNA, 18 nt, Artificial Sequence
  Description of Artificial Sequence: Synthetic oligonucleotide
cuccuucgauccccuguc

SEQ ID NO: 15372 - RNA, 18 nt, Artificial Sequence
  Description of Artificial Sequence: Synthetic oligonucleotide
guuaucuccuucgauccc

SEQ ID NO: 15373 - RNA, 18 nt, Artificial Sequence
  Description of Artificial Sequence: Synthetic oligonucleotide
accugguuaucuccuucg

SEQ ID NO: 15374 - RNA, 18 nt, Artificial Sequence
  Description of Artificial Sequence: Synthetic oligonucleotide
gggaccugguuaucuccu

SEQ ID NO: 15375 - RNA, 18 nt, Artificial Sequence
  Description of Artificial Sequence: Synthetic oligonucleotide
cucccgccccuuucuggg

SEQ ID NO: 15376 - RNA, 18 nt, Artificial Sequence
  Description of Artificial Sequence: Synthetic oligonucleotide
ggacgcucccgccccuuu

SEQ ID NO: 15377 - RNA, 18 nt, Artificial Sequence
  Description of Artificial Sequence: Synthetic oligonucleotide
ggcgaggacgcucccgcc

SEQ ID NO: 15378 - RNA, 18 nt, Artificial Sequence
  Description of Artificial Sequence: Synthetic oligonucleotide
uuuagggcgaggacgcuc

SEQ ID NO: 15379 - RNA, 18 nt, Artificial Sequence
  Description of Artificial Sequence: Synthetic oligonucleotide
gcgcguuuagggcgagga

SEQ ID NO: 15380 - RNA, 18 nt, Artificial Sequence
  Description of Artificial Sequence: Synthetic oligonucleotide
uugcugcgcguuuagggc

SEQ ID NO: 15381 - RNA, 18 nt, Artificial Sequence
  Description of Artificial Sequence: Synthetic oligonucleotide
uuuucuugcugcgcguuu

SEQ ID NO: 15382 - RNA, 18 nt, Artificial Sequence
  Description of Artificial Sequence: Synthetic oligonucleotide
gcggguuuucuugcugcg

SEQ ID NO: 15383 - RNA, 18 nt, Artificial Sequence
  Description of Artificial Sequence: Synthetic oligonucleotide
gcggugcggguuuucuug

SEQ ID NO: 15384 - RNA, 18 nt, Artificial Sequence
  Description of Artificial Sequence: Synthetic oligonucleotide
cccaggcggugcggguuu

SEQ ID NO: 15385 - RNA, 18 nt, Artificial Sequence
  Description of Artificial Sequence: Synthetic oligonucleotide
gggcucccaggcggugcg

SEQ ID NO: 15386 - RNA, 18 nt, Artificial Sequence
  Description of Artificial Sequence: Synthetic oligonucleotide
ucccugggcucccaggcg

SEQ ID NO: 15387 - RNA, 18 nt, Artificial Sequence
  Description of Artificial Sequence: Synthetic oligonucleotide
ccuccucccugggcuccc

SEQ ID NO: 15388 - RNA, 18 nt, Artificial Sequence
  Description of Artificial Sequence: Synthetic oligonucleotide
ccuccccuccucccuggg

SEQ ID NO: 15389 - RNA, 18 nt, Artificial Sequence
  Description of Artificial Sequence: Synthetic oligonucleotide
ugcauccuccccuccucc

SEQ ID NO: 15390 - RNA, 18 nt, Artificial Sequence
  Description of Artificial Sequence: Synthetic oligonucleotide
cccucugcauccuccccu

SEQ ID NO: 15391 - RNA, 18 nt, Artificial Sequence
  Description of Artificial Sequence: Synthetic oligonucleotide
ccacucccucugcauccu

SEQ ID NO: 15392 - RNA, 18 nt, Artificial Sequence
  Description of Artificial Sequence: Synthetic oligonucleotide
gcauuccacucccucugc

SEQ ID NO: 15393 - RNA, 18 nt, Artificial Sequence
  Description of Artificial Sequence: Synthetic oligonucleotide
cauucgcauuccacuccc

SEQ ID NO: 15394 - RNA, 18 nt, Artificial Sequence
  Description of Artificial Sequence: Synthetic oligonucleotide
cccgacauucgcauucca

SEQ ID NO: 15395 - RNA, 18 nt, Artificial Sequence
  Description of Artificial Sequence: Synthetic oligonucleotide
gaggacccgacauucgca

SEQ ID NO: 15396 - RNA, 18 nt, Artificial Sequence
  Description of Artificial Sequence: Synthetic oligonucleotide
gggcagaggacccgacau

SEQ ID NO: 15397 - RNA, 18 nt, Artificial Sequence
  Description of Artificial Sequence: Synthetic oligonucleotide
cgacugggcagaggaccc

SEQ ID NO: 15398 - RNA, 18 nt, Artificial Sequence
  Description of Artificial Sequence: Synthetic oligonucleotide
caggccgacugggcagag

SEQ ID NO: 15399 - RNA, 18 nt, Artificial Sequence
  Description of Artificial Sequence: Synthetic oligonucleotide
uccgacaggccgacuggg

SEQ ID NO: 15400 - RNA, 18 nt, Artificial Sequence
  Description of Artificial Sequence: Synthetic oligonucleotide
agcacuccgacaggccga

SEQ ID NO: 15401 - RNA, 18 nt, Artificial Sequence
  Description of Artificial Sequence: Synthetic oligonucleotide
caaauagcacuccgacag

SEQ ID NO: 15402 - RNA, 18 nt, Artificial Sequence
  Description of Artificial Sequence: Synthetic oligonucleotide
cugugcaaauagcacucc

SEQ ID NO: 15403 - RNA, 18 nt, Artificial Sequence
  Description of Artificial Sequence: Synthetic oligonucleotide
acgagcugugcaaauagc

SEQ ID NO: 15404 - RNA, 18 nt, Artificial Sequence
  Description of Artificial Sequence: Synthetic oligonucleotide
aggacccgacauucgcau

SEQ ID NO: 15405 - RNA, 18 nt, Artificial Sequence
  Description of Artificial Sequence: Synthetic oligonucleotide
ggcagaggacccgacauu

SEQ ID NO: 15406 - RNA, 18 nt, Artificial Sequence
  Description of Artificial Sequence: Synthetic oligonucleotide
gacugggcagaggacccg

SEQ ID NO: 15407 - RNA, 18 nt, Artificial Sequence
  Description of Artificial Sequence: Synthetic oligonucleotide
aggccgacugggcagagg

SEQ ID NO: 15408 - RNA, 18 nt, Artificial Sequence
  Description of Artificial Sequence: Synthetic oligonucleotide
ccgacaggccgacugggc

SEQ ID NO: 15409 - RNA, 18 nt, Artificial Sequence
  Description of Artificial Sequence: Synthetic oligonucleotide
gcacuccgacaggccgac

SEQ ID NO: 15410 - RNA, 18 nt, Artificial Sequence
  Description of Artificial Sequence: Synthetic oligonucleotide
aaauagcacuccgacagg

SEQ ID NO: 15411 - RNA, 18 nt, Artificial Sequence
  Description of Artificial Sequence: Synthetic oligonucleotide
ugugcaaauagcacuccg

SEQ ID NO: 15412 - RNA, 18 nt, Artificial Sequence
  Description of Artificial Sequence: Synthetic oligonucleotide
cgagcugugcaaauagca

SEQ ID NO: 15413 - RNA, 18 nt, Artificial Sequence
  Description of Artificial Sequence: Synthetic oligonucleotide
aucaacgagcugugcaaa

SEQ ID NO: 15414 - RNA, 18 nt, Artificial Sequence
  Description of Artificial Sequence: Synthetic oligonucleotide
ccaaaaucaacgagcugu

SEQ ID NO: 15415 - RNA, 18 nt, Artificial Sequence
  Description of Artificial Sequence: Synthetic oligonucleotide
gcaccccaaaaucaacga

SEQ ID NO: 15416 - RNA, 18 nt, Artificial Sequence
  Description of Artificial Sequence: Synthetic oligonucleotide
ucccagcaccccaaaauc

SEQ ID NO: 15417 - RNA, 18 nt, Artificial Sequence
  Description of Artificial Sequence: Synthetic oligonucleotide
ucagaucccagcacccca

SEQ ID NO: 15418 - RNA, 18 nt, Artificial Sequence
  Description of Artificial Sequence: Synthetic oligonucleotide
gacucucagaucccagca

SEQ ID NO: 15419 - RNA, 18 nt, Artificial Sequence
  Description of Artificial Sequence: Synthetic oligonucleotide
auccagacucucagaucc

SEQ ID NO: 15420 - RNA, 18 nt, Artificial Sequence
  Description of Artificial Sequence: Synthetic oligonucleotide
acaagauccagacucuca

SEQ ID NO: 15421 - RNA, 18 nt, Artificial Sequence
  Description of Artificial Sequence: Synthetic oligonucleotide
auccaacaagauccagac

SEQ ID NO: 15422 - RNA, 18 nt, Artificial Sequence
  Description of Artificial Sequence: Synthetic oligonucleotide
gguccauccaacaagauc

SEQ ID NO: 15423 - RNA, 18 nt, Artificial Sequence
  Description of Artificial Sequence: Synthetic oligonucleotide
cccuggguccauccaaca

SEQ ID NO: 15424 - RNA, 18 nt, Artificial Sequence
  Description of Artificial Sequence: Synthetic oligonucleotide
ucucucccuggguccauc

SEQ ID NO: 15425 - RNA, 18 nt, Artificial Sequence
  Description of Artificial Sequence: Synthetic oligonucleotide
cagggucucucccugggu

SEQ ID NO: 15426 - RNA, 18 nt, Artificial Sequence
  Description of Artificial Sequence: Synthetic oligonucleotide
uucuccagggucucuccc

SEQ ID NO: 15427 - RNA, 18 nt, Artificial Sequence
  Description of Artificial Sequence: Synthetic oligonucleotide
ggaccuucuccagggucu

SEQ ID NO: 15428 - RNA, 18 nt, Artificial Sequence
  Description of Artificial Sequence: Synthetic oligonucleotide
aaacaggaccuucuccag

SEQ ID NO: 15429 - RNA, 18 nt, Artificial Sequence
  Description of Artificial Sequence: Synthetic oligonucleotide
uuuguaaacaggaccuuc

SEQ ID NO: 15430 - RNA, 18 nt, Artificial Sequence
  Description of Artificial Sequence: Synthetic oligonucleotide
acccuuuuguaaacagga

SEQ ID NO: 15431 - RNA, 18 nt, Artificial Sequence
  Description of Artificial Sequence: Synthetic oligonucleotide
gauuaacccuuuuguaaa

SEQ ID NO: 15432 - RNA, 18 nt, Artificial Sequence
  Description of Artificial Sequence: Synthetic oligonucleotide
gggaagauuaacccuuuu

SEQ ID NO: 15433 - RNA, 18 nt, Artificial Sequence
  Description of Artificial Sequence: Synthetic oligonucleotide
ugcuuggagagcccuggg

SEQ ID NO: 15434 - RNA, 18 nt, Artificial Sequence
  Description of Artificial Sequence: Synthetic oligonucleotide
cugcuuggagagcccugg

SEQ ID NO: 15435 - RNA, 18 nt, Artificial Sequence
  Description of Artificial Sequence: Synthetic oligonucleotide
gucuucugcuuggagagc

SEQ ID NO: 15436 - RNA, 18 nt, Artificial Sequence
  Description of Artificial Sequence: Synthetic oligonucleotide
ucaaagucuucugcuugg

SEQ ID NO: 15437 - RNA, 18 nt, Artificial Sequence
  Description of Artificial Sequence: Synthetic oligonucleotide
ucuacucaaagucuucug

SEQ ID NO: 15438 - RNA, 18 nt, Artificial Sequence
  Description of Artificial Sequence: Synthetic oligonucleotide
agugcucuacucaaaguc

SEQ ID NO: 15439 - RNA, 18 nt, Artificial Sequence
  Description of Artificial Sequence: Synthetic oligonucleotide
ggaggagugcucuacuca

SEQ ID NO: 15440 - RNA, 18 nt, Artificial Sequence
  Description of Artificial Sequence: Synthetic oligonucleotide
cugcgggaggagugcucu

SEQ ID NO: 15441 - RNA, 18 nt, Artificial Sequence
  Description of Artificial Sequence: Synthetic oligonucleotide
caucccugcgggaggagu

SEQ ID NO: 15442 - RNA, 18 nt, Artificial Sequence
  Description of Artificial Sequence: Synthetic oligonucleotide
ugggacaucccugcggga

SEQ ID NO: 15443 - RNA, 18 nt, Artificial Sequence
  Description of Artificial Sequence: Synthetic oligonucleotide
uagggugggacaucccug

SEQ ID NO: 15444 - RNA, 18 nt, Artificial Sequence
  Description of Artificial Sequence: Synthetic oligonucleotide
ugccuuagggugggacau

SEQ ID NO: 15445 - RNA, 18 nt, Artificial Sequence
  Description of Artificial Sequence: Synthetic oligonucleotide
uccuuugccuuagggugg

SEQ ID NO: 15446 - RNA, 18 nt, Artificial Sequence
  Description of Artificial Sequence: Synthetic oligonucleotide
ggguuuccuuugccuuag

SEQ ID NO: 15447 - RNA, 18 nt, Artificial Sequence
  Description of Artificial Sequence: Synthetic oligonucleotide
agaggaagaaaaguuggg

SEQ ID NO: 15448 - RNA, 18 nt, Artificial Sequence
  Description of Artificial Sequence: Synthetic oligonucleotide
gagaggaagaaaaguugg

SEQ ID NO: 15449 - RNA, 18 nt, Artificial Sequence
  Description of Artificial Sequence: Synthetic oligonucleotide
cuagggagaggaagaaaa

SEQ ID NO: 15450 - RNA, 18 nt, Artificial Sequence
  Description of Artificial Sequence: Synthetic oligonucleotide
ugccucuagggagaggaa

SEQ ID NO: 15451 - RNA, 18 nt, Artificial Sequence
  Description of Artificial Sequence: Synthetic oligonucleotide
ugcacugccucuagggag

SEQ ID NO: 15452 - RNA, 18 nt, Artificial Sequence
  Description of Artificial Sequence: Synthetic oligonucleotide
agccuugcacugccucua

SEQ ID NO: 15453 - RNA, 18 nt, Artificial Sequence
  Description of Artificial Sequence: Synthetic oligonucleotide
gggccagccuugcacugc

SEQ ID NO: 15454 - RNA, 18 nt, Artificial Sequence
  Description of Artificial Sequence: Synthetic oligonucleotide
ucucagggccagccuugc

SEQ ID NO: 15455 - RNA, 18 nt, Artificial Sequence
  Description of Artificial Sequence: Synthetic oligonucleotide
uccugucucagggccagc

SEQ ID NO: 15456 - RNA, 18 nt, Artificial Sequence
  Description of Artificial Sequence: Synthetic oligonucleotide
cacauuccugucucaggg

SEQ ID NO: 15457 - RNA, 18 nt, Artificial Sequence
  Description of Artificial Sequence: Synthetic oligonucleotide
ugggccacauuccugucu

SEQ ID NO: 15458 - RNA, 18 nt, Artificial Sequence
  Description of Artificial Sequence: Synthetic oligonucleotide
ccaauugggccacauucc

SEQ ID NO: 15459 - RNA, 18 nt, Artificial Sequence
  Description of Artificial Sequence: Synthetic oligonucleotide
caggcccaauugggccac

SEQ ID NO: 15460 - RNA, 18 nt, Artificial Sequence
  Description of Artificial Sequence: Synthetic oligonucleotide
cacugcaggcccaauugg

SEQ ID NO: 15461 - RNA, 18 nt, Artificial Sequence
  Description of Artificial Sequence: Synthetic oligonucleotide
cucagcacugcaggccca

SEQ ID NO: 15462 - RNA, 18 nt, Artificial Sequence
  Description of Artificial Sequence: Synthetic oligonucleotide
gggcgcucagcacugcag

SEQ ID NO: 15463 - RNA, 18 nt, Artificial Sequence
  Description of Artificial Sequence: Synthetic oligonucleotide
gaagagggcgcucagcac

SEQ ID NO: 15464 - RNA, 18 nt, Artificial Sequence
  Description of Artificial Sequence: Synthetic oligonucleotide
ggagggaagagggcgcuc

SEQ ID NO: 15465 - RNA, 18 nt, Artificial Sequence
  Description of Artificial Sequence: Synthetic oligonucleotide
ggugaggagggaagaggg

SEQ ID NO: 15466 - RNA, 18 nt, Artificial Sequence
  Description of Artificial Sequence: Synthetic oligonucleotide
gcagagacagcggcaaac

SEQ ID NO: 15467 - RNA, 18 nt, Artificial Sequence
  Description of Artificial Sequence: Synthetic oligonucleotide
gaauagcagagacagcgg

SEQ ID NO: 15468 - RNA, 18 nt, Artificial Sequence
  Description of Artificial Sequence: Synthetic oligonucleotide
ggauggaauagcagagac

SEQ ID NO: 15469 - RNA, 18 nt, Artificial Sequence
  Description of Artificial Sequence: Synthetic oligonucleotide
gggaggauggaauagcag

SEQ ID NO: 15470 - RNA, 18 nt, Artificial Sequence
  Description of Artificial Sequence: Synthetic oligonucleotide
ggagagagccccuauggg

SEQ ID NO: 15471 - RNA, 18 nt, Artificial Sequence
  Description of Artificial Sequence: Synthetic oligonucleotide
gggagagagccccuaugg

SEQ ID NO: 15472 - RNA, 18 nt, Artificial Sequence
  Description of Artificial Sequence: Synthetic oligonucleotide
ucuugagaugggagaggg

SEQ ID NO: 15473 - RNA, 18 nt, Artificial Sequence
  Description of Artificial Sequence: Synthetic oligonucleotide
ugccaucuugagauggga

SEQ ID NO: 15474 - RNA, 18 nt, Artificial Sequence
  Description of Artificial Sequence: Synthetic oligonucleotide
cuggcugccaucuugaga

SEQ ID NO: 15475 - RNA, 18 nt, Artificial Sequence
  Description of Artificial Sequence: Synthetic oligonucleotide
agcugcuggcugccaucu

SEQ ID NO: 15476 - RNA, 18 nt, Artificial Sequence
  Description of Artificial Sequence: Synthetic oligonucleotide
cucagagcugcuggcugc

SEQ ID NO: 15477 - RNA, 18 nt, Artificial Sequence
  Description of Artificial Sequence: Synthetic oligonucleotide
gagaucucagagcugcug

SEQ ID NO: 15478 - RNA, 18 nt, Artificial Sequence
  Description of Artificial Sequence: Synthetic oligonucleotide
ucucagagaucucagagc

SEQ ID NO: 15479 - RNA, 18 nt, Artificial Sequence
  Description of Artificial Sequence: Synthetic oligonucleotide
cuucaucucagagaucuc

SEQ ID NO: 15480 - RNA, 18 nt, Artificial Sequence
  Description of Artificial Sequence: Synthetic oligonucleotide
acccccuucaucucagag

SEQ ID NO: 15481 - RNA, 18 nt, Artificial Sequence
  Description of Artificial Sequence: Synthetic oligonucleotide
ccucaacccccuucaucu

SEQ ID NO: 15482 - RNA, 18 nt, Artificial Sequence
  Description of Artificial Sequence: Synthetic oligonucleotide
acucuccucaacccccuu

SEQ ID NO: 15483 - RNA, 18 nt, Artificial Sequence
  Description of Artificial Sequence: Synthetic oligonucleotide
uugggacucuccucaacc

SEQ ID NO: 15484 - RNA, 18 nt, Artificial Sequence
  Description of Artificial Sequence: Synthetic oligonucleotide
gaaccuugggacucuccu

SEQ ID NO: 15485 - RNA, 18 nt, Artificial Sequence
  Description of Artificial Sequence: Synthetic oligonucleotide
gccuggaaccuugggacu

SEQ ID NO: 15486 - RNA, 18 nt, Artificial Sequence
  Description of Artificial Sequence: Synthetic oligonucleotide
ccuucgccuggaaccuug

SEQ ID NO: 15487 - RNA, 18 nt, Artificial Sequence
  Description of Artificial Sequence: Synthetic oligonucleotide
caggcccuucgccuggaa

SEQ ID NO: 15488 - RNA, 18 nt, Artificial Sequence
  Description of Artificial Sequence: Synthetic oligonucleotide
auggccaggcccuucgcc

SEQ ID NO: 15489 - RNA, 18 nt, Artificial Sequence
  Description of Artificial Sequence: Synthetic oligonucleotide
ucagaauggccaggcccu

SEQ ID NO: 15490 - RNA, 18 nt, Artificial Sequence
  Description of Artificial Sequence: Synthetic oligonucleotide
cagcuucagaauggccag

SEQ ID NO: 15491 - RNA, 18 nt, Artificial Sequence
  Description of Artificial Sequence: Synthetic oligonucleotide
aguuucagcuucagaaug

SEQ ID NO: 15492 - RNA, 18 nt, Artificial Sequence
  Description of Artificial Sequence: Synthetic oligonucleotide
gggccaguuucagcuuca

SEQ ID NO: 15493 - RNA, 18 nt, Artificial Sequence
  Description of Artificial Sequence: Synthetic oligonucleotide
gggagggccaguuucagc

SEQ ID NO: 15494 - RNA, 18 nt, Artificial Sequence
  Description of Artificial Sequence: Synthetic oligonucleotide
ccccugcuaggaccuggg

SEQ ID NO: 15495 - RNA, 18 nt, Artificial Sequence
  Description of Artificial Sequence: Synthetic oligonucleotide
ugguaccccugcuaggac

SEQ ID NO: 15496 - RNA, 18 nt, Artificial Sequence
  Description of Artificial Sequence: Synthetic oligonucleotide
uggucugguaccccugcu

SEQ ID NO: 15497 - RNA, 18 nt, Artificial Sequence
  Description of Artificial Sequence: Synthetic oligonucleotide
cuggcuggucugguaccc

SEQ ID NO: 15498 - RNA, 18 nt, Artificial Sequence
  Description of Artificial Sequence: Synthetic oligonucleotide
ggccucuggcuggucugg

SEQ ID NO: 15499 - RNA, 18 nt, Artificial Sequence
  Description of Artificial Sequence: Synthetic oligonucleotide
gggccucuggcuggucug

SEQ ID NO: 15500 - RNA, 18 nt, Artificial Sequence
  Description of Artificial Sequence: Synthetic oligonucleotide
uuuggaccuggcugcggg

SEQ ID NO: 15501 - RNA, 18 nt, Artificial Sequence
  Description of Artificial Sequence: Synthetic oligonucleotide
ugguguuuggaccuggcu

SEQ ID NO: 15502 - RNA, 18 nt, Artificial Sequence
  Description of Artificial Sequence: Synthetic oligonucleotide
cgcagugguguuuggacc

SEQ ID NO: 15503 - RNA, 18 nt, Artificial Sequence
  Description of Artificial Sequence: Synthetic oligonucleotide
gggccgcagugguguuug

SEQ ID NO: 15504 - RNA, 18 nt, Artificial Sequence
  Description of Artificial Sequence: Synthetic oligonucleotide
ggcccugaguccacaggg

SEQ ID NO: 15505 - RNA, 18 nt, Artificial Sequence
  Description of Artificial Sequence: Synthetic oligonucleotide
ccuugggcccugagucca

SEQ ID NO: 15506 - RNA, 18 nt, Artificial Sequence
  Description of Artificial Sequence: Synthetic oligonucleotide
cccagccuugggcccuga

SEQ ID NO: 15507 - RNA, 18 nt, Artificial Sequence
  Description of Artificial Sequence: Synthetic oligonucleotide
gccagcccagccuugggc

SEQ ID NO: 15508 - RNA, 18 nt, Artificial Sequence
  Description of Artificial Sequence: Synthetic oligonucleotide
cuggagccagcccagccu

SEQ ID NO: 15509 - RNA, 18 nt, Artificial Sequence
  Description of Artificial Sequence: Synthetic oligonucleotide
gguuucuggagccagccc

SEQ ID NO: 15510 - RNA, 18 nt, Artificial Sequence
  Description of Artificial Sequence: Synthetic oligonucleotide
ucugugguuucuggagcc

SEQ ID NO: 15511 - RNA, 18 nt, Artificial Sequence
  Description of Artificial Sequence: Synthetic oligonucleotide
gggucucugugguuucug

SEQ ID NO: 15512 - RNA, 18 nt, Artificial Sequence
  Description of Artificial Sequence: Synthetic oligonucleotide
uguuucugaggccccagc

SEQ ID NO: 15513 - RNA, 18 nt, Artificial Sequence
  Description of Artificial Sequence: Synthetic oligonucleotide
ugggcuguuucugaggcc

SEQ ID NO: 15514 - RNA, 18 nt, Artificial Sequence
  Description of Artificial Sequence: Synthetic oligonucleotide
uggccugggcuguuucug

SEQ ID NO: 15515 - RNA, 18 nt, Artificial Sequence
  Description of Artificial Sequence: Synthetic oligonucleotide
gucuguggccugggcugu

SEQ ID NO: 15516 - RNA, 18 nt, Artificial Sequence
  Description of Artificial Sequence: Synthetic oligonucleotide
cugaggucuguggccugg

SEQ ID NO: 15517 - RNA, 18 nt, Artificial Sequence
  Description of Artificial Sequence: Synthetic oligonucleotide
uuaagcugaggucugugg

SEQ ID NO: 15518 - RNA, 18 nt, Artificial Sequence
  Description of Artificial Sequence: Synthetic oligonucleotide
ugggcuuaagcugagguc

SEQ ID NO: 15519 - RNA, 18 nt, Artificial Sequence
  Description of Artificial Sequence: Synthetic oligonucleotide
ccuccugggcuuaagcug

SEQ ID NO: 15520 - RNA, 18 nt, Artificial Sequence
  Description of Artificial Sequence: Synthetic oligonucleotide
auuccccuccugggcuua

SEQ ID NO: 15521 - RNA, 18 nt, Artificial Sequence
  Description of Artificial Sequence: Synthetic oligonucleotide
cuuugauuccccuccugg

SEQ ID NO: 15522 - RNA, 18 nt, Artificial Sequence
  Description of Artificial Sequence: Synthetic oligonucleotide
uuggccuuugauuccccu

SEQ ID NO: 15523 - RNA, 18 nt, Artificial Sequence
  Description of Artificial Sequence: Synthetic oligonucleotide
ugcaguuggccuuugauu

SEQ ID NO: 15524 - RNA, 18 nt, Artificial Sequence
  Description of Artificial Sequence: Synthetic oligonucleotide
gggcugcaguuggccuuu

SEQ ID NO: 15525 - RNA, 18 nt, Artificial Sequence
  Description of Artificial Sequence: Synthetic oligonucleotide
uuggcaugggucuucggg

SEQ ID NO: 15526 - RNA, 18 nt, Artificial Sequence
  Description of Artificial Sequence: Synthetic oligonucleotide
guuucuuggcaugggucu

SEQ ID NO: 15527 - RNA, 18 nt, Artificial Sequence
  Description of Artificial Sequence: Synthetic oligonucleotide
acacuguuucuuggcaug

SEQ ID NO: 15528 - RNA, 18 nt, Artificial Sequence
  Description of Artificial Sequence: Synthetic oligonucleotide
uuuggacacuguuucuug

SEQ ID NO: 15529 - RNA, 18 nt, Artificial Sequence
  Description of Artificial Sequence: Synthetic oligonucleotide
ucugguuuggacacuguu

SEQ ID NO: 15530 - RNA, 18 nt, Artificial Sequence
  Description of Artificial Sequence: Synthetic oligonucleotide
ucacuucugguuuggaca

SEQ ID NO: 15531 - RNA, 18 nt, Artificial Sequence
  Description of Artificial Sequence: Synthetic oligonucleotide
uuugcucacuucugguuu

SEQ ID NO: 15532 - RNA, 18 nt, Artificial Sequence
  Description of Artificial Sequence: Synthetic oligonucleotide
gccucuuugcucacuucu

SEQ ID NO: 15533 - RNA, 18 nt, Artificial Sequence
  Description of Artificial Sequence: Synthetic oligonucleotide
caguggccucuuugcuca

SEQ ID NO: 15534 - RNA, 18 nt, Artificial Sequence
  Description of Artificial Sequence: Synthetic oligonucleotide
gucugcaguggccucuuu

SEQ ID NO: 15535 - RNA, 18 nt, Artificial Sequence
  Description of Artificial Sequence: Synthetic oligonucleotide
cccuggucugcaguggcc

SEQ ID NO: 15536 - RNA, 18 nt, Artificial Sequence
  Description of Artificial Sequence: Synthetic oligonucleotide
uggaccccuggucugcag

SEQ ID NO: 15537 - RNA, 18 nt, Artificial Sequence
  Description of Artificial Sequence: Synthetic oligonucleotide
cagccuggaccccugguc

SEQ ID NO: 15538 - RNA, 18 nt, Artificial Sequence
  Description of Artificial Sequence: Synthetic oligonucleotide
gacuccagccuggacccc

SEQ ID NO: 15539 - RNA, 18 nt, Artificial Sequence
  Description of Artificial Sequence: Synthetic oligonucleotide
cugcagacuccagccugg

SEQ ID NO: 15540 - RNA, 18 nt, Artificial Sequence
  Description of Artificial Sequence: Synthetic oligonucleotide
gggcugcagacuccagcc

SEQ ID NO: 15541 - RNA, 18 nt, Artificial Sequence
  Description of Artificial Sequence: Synthetic oligonucleotide
gcugggaaucuggccggg

SEQ ID NO: 15542 - RNA, 18 nt, Artificial Sequence
  Description of Artificial Sequence: Synthetic oligonucleotide
gguaggcugggaaucugg

SEQ ID NO: 15543 - RNA, 18 nt, Artificial Sequence
  Description of Artificial Sequence: Synthetic oligonucleotide
ggguaggcugggaaucug

SEQ ID NO: 15544 - RNA, 18 nt, Artificial Sequence
  Description of Artificial Sequence: Synthetic oligonucleotide
uugaagggcuggcuuggg

SEQ ID NO: 15545 - RNA, 18 nt, Artificial Sequence
  Description of Artificial Sequence: Synthetic oligonucleotide
ucugguugaagggcuggc

SEQ ID NO: 15546 - RNA, 18 nt, Artificial Sequence
  Description of Artificial Sequence: Synthetic oligonucleotide
ggagcucugguugaaggg

SEQ ID NO: 15547 - RNA, 18 nt, Artificial Sequence
  Description of Artificial Sequence: Synthetic oligonucleotide
gguagggagcucugguug

SEQ ID NO: 15548 - RNA, 18 nt, Artificial Sequence
  Description of Artificial Sequence: Synthetic oligonucleotide
uccuggguagggagcucu

SEQ ID NO: 15549 - RNA, 18 nt, Artificial Sequence
  Description of Artificial Sequence: Synthetic oligonucleotide
gguccuccuggguaggga

SEQ ID NO: 15550 - RNA, 18 nt, Artificial Sequence
  Description of Artificial Sequence: Synthetic oligonucleotide
ggguccuccuggguaggg

SEQ ID NO: 15551 - RNA, 18 nt, Artificial Sequence
  Description of Artificial Sequence: Synthetic oligonucleotide
ucagacagaaucucaggg

SEQ ID NO: 15552 - RNA, 18 nt, Artificial Sequence
  Description of Artificial Sequence: Synthetic oligonucleotide
cacucucagacagaaucu

SEQ ID NO: 15553 - RNA, 18 nt, Artificial Sequence
  Description of Artificial Sequence: Synthetic oligonucleotide
cccuacacucucagacag

SEQ ID NO: 15554 - RNA, 18 nt, Artificial Sequence
  Description of Artificial Sequence: Synthetic oligonucleotide
uuuuccccuacacucuca

SEQ ID NO: 15555 - RNA, 18 nt, Artificial Sequence
  Description of Artificial Sequence: Synthetic oligonucleotide
cuugcuuuuccccuacac

SEQ ID NO: 15556 - RNA, 18 nt, Artificial Sequence
  Description of Artificial Sequence: Synthetic oligonucleotide
auucucuugcuuuucccc

SEQ ID NO: 15557 - RNA, 18 nt, Artificial Sequence
  Description of Artificial Sequence: Synthetic oligonucleotide
gccccauucucuugcuuu

SEQ ID NO: 15558 - RNA, 18 nt, Artificial Sequence
  Description of Artificial Sequence: Synthetic oligonucleotide
ccacugccccauucucuu

SEQ ID NO: 15559 - RNA, 18 nt, Artificial Sequence
  Description of Artificial Sequence: Synthetic oligonucleotide
gggcaccacugccccauu

SEQ ID NO: 15560 - RNA, 18 nt, Artificial Sequence
  Description of Artificial Sequence: Synthetic oligonucleotide
uccccaucaccagccugc

SEQ ID NO: 15561 - RNA, 18 nt, Artificial Sequence
  Description of Artificial Sequence: Synthetic oligonucleotide
ccucuuccccaucaccag

SEQ ID NO: 15562 - RNA, 18 nt, Artificial Sequence
  Description of Artificial Sequence: Synthetic oligonucleotide
ugggcccucuuccccauc

SEQ ID NO: 15563 - RNA, 18 nt, Artificial Sequence
  Description of Artificial Sequence: Synthetic oligonucleotide
gggcugggcccucuuccc

SEQ ID NO: 15564 - RNA, 18 nt, Artificial Sequence
  Description of Artificial Sequence: Synthetic oligonucleotide
ggugagugaggcucaggg

SEQ ID NO: 15565 - RNA, 18 nt, Artificial Sequence
  Description of Artificial Sequence: Synthetic oligonucleotide
aggguggugagugaggcu

SEQ ID NO: 15566 - RNA, 18 nt, Artificial Sequence
  Description of Artificial Sequence: Synthetic oligonucleotide
uuuugaggguggugagug

SEQ ID NO: 15567 - RNA, 18 nt, Artificial Sequence
  Description of Artificial Sequence: Synthetic oligonucleotide
gauuuuuuugaggguggu

SEQ ID NO: 15568 - RNA, 18 nt, Artificial Sequence
  Description of Artificial Sequence: Synthetic oligonucleotide
gggauuuuuuugagggug

SEQ ID NO: 15569 - RNA, 18 nt, Artificial Sequence
  Description of Artificial Sequence: Synthetic oligonucleotide
gcugcugcagcacucggg

SEQ ID NO: 15570 - RNA, 18 nt, Artificial Sequence
  Description of Artificial Sequence: Synthetic oligonucleotide
aaccagcugcugcagcac

SEQ ID NO: 15571 - RNA, 18 nt, Artificial Sequence
  Description of Artificial Sequence: Synthetic oligonucleotide
uccucaaccagcugcugc

SEQ ID NO: 15572 - RNA, 18 nt, Artificial Sequence
  Description of Artificial Sequence: Synthetic oligonucleotide
gauccuccucaaccagcu

SEQ ID NO: 15573 - RNA, 18 nt, Artificial Sequence
  Description of Artificial Sequence: Synthetic oligonucleotide
cauucgauccuccucaac

SEQ ID NO: 15574 - RNA, 18 nt, Artificial Sequence
  Description of Artificial Sequence: Synthetic oligonucleotide
cuucucauucgauccucc

SEQ ID NO: 15575 - RNA, 18 nt, Artificial Sequence
  Description of Artificial Sequence: Synthetic oligonucleotide
gugcccuucucauucgau

SEQ ID NO: 15576 - RNA, 18 nt, Artificial Sequence
  Description of Artificial Sequence: Synthetic oligonucleotide
acugugugcccuucucau

SEQ ID NO: 15577 - RNA, 18 nt, Artificial Sequence
  Description of Artificial Sequence: Synthetic oligonucleotide
ugcccacugugugcccuu

SEQ ID NO: 15578 - RNA, 18 nt, Artificial Sequence
  Description of Artificial Sequence: Synthetic oligonucleotide
cuggaugcccacugugug

SEQ ID NO: 15579 - RNA, 18 nt, Artificial Sequence
  Description of Artificial Sequence: Synthetic oligonucleotide
agauccuggaugcccacu

SEQ ID NO: 15580 - RNA, 18 nt, Artificial Sequence
  Description of Artificial Sequence: Synthetic oligonucleotide
gggagauccuggaugccc

SEQ ID NO: 15581 - RNA, 18 nt, Artificial Sequence
  Description of Artificial Sequence: Synthetic oligonucleotide
ggcucaggcuaccucggg

SEQ ID NO: 15582 - RNA, 18 nt, Artificial Sequence
  Description of Artificial Sequence: Synthetic oligonucleotide
guggcggcucaggcuacc

SEQ ID NO: 15583 - RNA, 18 nt, Artificial Sequence
  Description of Artificial Sequence: Synthetic oligonucleotide
ggguggcggcucaggcua

SEQ ID NO: 15584 - RNA, 18 nt, Artificial Sequence
  Description of Artificial Sequence: Synthetic oligonucleotide
ugccaacugggagcuggg

SEQ ID NO: 15585 - RNA, 18 nt, Artificial Sequence
  Description of Artificial Sequence: Synthetic oligonucleotide
ggaccugccaacugggag

SEQ ID NO: 15586 - RNA, 18 nt, Artificial Sequence
  Description of Artificial Sequence: Synthetic oligonucleotide
ccccaggaccugccaacu

SEQ ID NO: 15587 - RNA, 18 nt, Artificial Sequence
  Description of Artificial Sequence: Synthetic oligonucleotide
cuccaccccaggaccugc

SEQ ID NO: 15588 - RNA, 18 nt, Artificial Sequence
  Description of Artificial Sequence: Synthetic oligonucleotide
ccccccuccaccccagga

SEQ ID NO: 15589 - RNA, 18 nt, Artificial Sequence
  Description of Artificial Sequence: Synthetic oligonucleotide
cuucaccccccuccaccc

SEQ ID NO: 15590 - RNA, 18 nt, Artificial Sequence
  Description of Artificial Sequence: Synthetic oligonucleotide
ggugccuucaccccccuc

SEQ ID NO: 15591 - RNA, 18 nt, Artificial Sequence
  Description of Artificial Sequence: Synthetic oligonucleotide
uucugggugccuucaccc

SEQ ID NO: 15592 - RNA, 18 nt, Artificial Sequence
  Description of Artificial Sequence: Synthetic oligonucleotide
gagguuucugggugccuu

SEQ ID NO: 15593 - RNA, 18 nt, Artificial Sequence
  Description of Artificial Sequence: Synthetic oligonucleotide
gucccgagguuucugggu

SEQ ID NO: 15594 - RNA, 18 nt, Artificial Sequence
  Description of Artificial Sequence: Synthetic oligonucleotide
auguagucccgagguuuc

SEQ ID NO: 15595 - RNA, 18 nt, Artificial Sequence
  Description of Artificial Sequence: Synthetic oligonucleotide
ggaugauguagucccgag

SEQ ID NO: 15596 - RNA, 18 nt, Artificial Sequence
  Description of Artificial Sequence: Synthetic oligonucleotide
ggcaaggaugauguaguc

SEQ ID NO: 15597 - RNA, 18 nt, Artificial Sequence
  Description of Artificial Sequence: Synthetic oligonucleotide
aggauggcaaggaugaug

SEQ ID NO: 15598 - RNA, 18 nt, Artificial Sequence
  Description of Artificial Sequence: Synthetic oligonucleotide
aggacaggauggcaagga

SEQ ID NO: 15599 - RNA, 18 nt, Artificial Sequence
  Description of Artificial Sequence: Synthetic oligonucleotide
gaagcaggacaggauggc

SEQ ID NO: 15600 - RNA, 18 nt, Artificial Sequence
  Description of Artificial Sequence: Synthetic oligonucleotide
gggcagaagcaggacagg

SEQ ID NO: 15601 - RNA, 18 nt, Artificial Sequence
  Description of Artificial Sequence: Synthetic oligonucleotide
cgauguugacaggccaca

SEQ ID NO: 15602 - RNA, 18 nt, Artificial Sequence
  Description of Artificial Sequence: Synthetic oligonucleotide
ggccacgauguugacagg

SEQ ID NO: 15603 - RNA, 18 nt, Artificial Sequence
  Description of Artificial Sequence: Synthetic oligonucleotide
gcgaaggccacgauguug

SEQ ID NO: 15604 - RNA, 18 nt, Artificial Sequence
  Description of Artificial Sequence: Synthetic oligonucleotide
cauaagcgaaggccacga

SEQ ID NO: 15605 - RNA, 18 nt, Artificial Sequence
  Description of Artificial Sequence: Synthetic oligonucleotide
gacagcauaagcgaaggc

SEQ ID NO: 15606 - RNA, 18 nt, Artificial Sequence
  Description of Artificial Sequence: Synthetic oligonucleotide
cuuccgggacagugugga

SEQ ID NO: 15607 - RNA, 18 nt, Artificial Sequence
  Description of Artificial Sequence: Synthetic oligonucleotide
acgaacuuccgggacagu

SEQ ID NO: 15608 - RNA, 18 nt, Artificial Sequence
  Description of Artificial Sequence: Synthetic oligonucleotide
ccuccacgaacuuccggg

SEQ ID NO: 15609 - RNA, 18 nt, Artificial Sequence
  Description of Artificial Sequence: Synthetic oligonucleotide
cauuaccuccacgaacuu

SEQ ID NO: 15610 - RNA, 18 nt, Artificial Sequence
  Description of Artificial Sequence: Synthetic oligonucleotide
ucggucauuaccuccacg

SEQ ID NO: 15611 - RNA, 18 nt, Artificial Sequence
  Description of Artificial Sequence: Synthetic oligonucleotide
uauauucggucauuaccu

SEQ ID NO: 15612 - RNA, 18 nt, Artificial Sequence
  Description of Artificial Sequence: Synthetic oligonucleotide
cgcguuauauucggucau

SEQ ID NO: 15613 - RNA, 18 nt, Artificial Sequence
  Description of Artificial Sequence: Synthetic oligonucleotide
ugggucgcguuauauucg

SEQ ID NO: 15614 - RNA, 18 nt, Artificial Sequence
  Description of Artificial Sequence: Synthetic oligonucleotide
uggacugggucgcguuau

SEQ ID NO: 15615 - RNA, 18 nt, Artificial Sequence
  Description of Artificial Sequence: Synthetic oligonucleotide
guacuuggacugggucgc

SEQ ID NO: 15616 - RNA, 18 nt, Artificial Sequence
  Description of Artificial Sequence: Synthetic oligonucleotide
ucccgguacuuggacugg

SEQ ID NO: 15617 - RNA, 18 nt, Artificial Sequence
  Description of Artificial Sequence: Synthetic oligonucleotide
agcggucccgguacuugg

SEQ ID NO: 15618 - RNA, 18 nt, Artificial Sequence
  Description of Artificial Sequence: Synthetic oligonucleotide
cuugcagcggucccggua

SEQ ID NO: 15619 - RNA, 18 nt, Artificial Sequence
  Description of Artificial Sequence: Synthetic oligonucleotide
cgguccuugcagcggucc

SEQ ID NO: 15620 - RNA, 18 nt, Artificial Sequence
  Description of Artificial Sequence: Synthetic oligonucleotide
ggauccgguccuugcagc

SEQ ID NO: 15621 - RNA, 18 nt, Artificial Sequence
  Description of Artificial Sequence: Synthetic oligonucleotide
ccgcuggauccgguccuu

SEQ ID NO: 15622 - RNA, 18 nt, Artificial Sequence
  Description of Artificial Sequence: Synthetic oligonucleotide
aguugccgcuggauccgg

SEQ ID NO: 15623 - RNA, 18 nt, Artificial Sequence
  Description of Artificial Sequence: Synthetic oligonucleotide
ucuccaguugccgcugga

SEQ ID NO: 15624 - RNA, 18 nt, Artificial Sequence
  Description of Artificial Sequence: Synthetic oligonucleotide
agccucaaggaguucggg

SEQ ID NO: 15625 - RNA, 18 nt, Artificial Sequence
  Description of Artificial Sequence: Synthetic oligonucleotide
ugggcagccucaaggagu

SEQ ID NO: 15626 - RNA, 18 nt, Artificial Sequence
  Description of Artificial Sequence: Synthetic oligonucleotide
gggcuugggcagccucaa

SEQ ID NO: 15627 - RNA, 18 nt, Artificial Sequence
  Description of Artificial Sequence: Synthetic oligonucleotide
gagaggaaaugccuggaa

SEQ ID NO: 15628 - RNA, 18 nt, Artificial Sequence
  Description of Artificial Sequence: Synthetic oligonucleotide
cuccagagaggaaaugcc

SEQ ID NO: 15629 - RNA, 18 nt, Artificial Sequence
  Description of Artificial Sequence: Synthetic oligonucleotide
gcccccuccagagaggaa

SEQ ID NO: 15630 - RNA, 18 nt, Artificial Sequence
  Description of Artificial Sequence: Synthetic oligonucleotide
gggcccccuccagagagg

SEQ ID NO: 15631 - RNA, 18 nt, Artificial Sequence
  Description of Artificial Sequence: Synthetic oligonucleotide
cgccgccuuaagccaggg

SEQ ID NO: 15632 - RNA, 18 nt, Artificial Sequence
  Description of Artificial Sequence: Synthetic oligonucleotide
ucccacgccgccuuaagc

SEQ ID NO: 15633 - RNA, 18 nt, Artificial Sequence
  Description of Artificial Sequence: Synthetic oligonucleotide
cacccucccacgccgccu

SEQ ID NO: 15634 - RNA, 18 nt, Artificial Sequence
  Description of Artificial Sequence: Synthetic oligonucleotide
gggcccacccucccacgc

SEQ ID NO: 15635 - RNA, 18 nt, Artificial Sequence
  Description of Artificial Sequence: Synthetic oligonucleotide
cgccgccuuaagccaggg

SEQ ID NO: 15636 - RNA, 18 nt, Artificial Sequence
  Description of Artificial Sequence: Synthetic oligonucleotide
ucccacgccgccuuaagc

SEQ ID NO: 15637 - RNA, 18 nt, Artificial Sequence
  Description of Artificial Sequence: Synthetic oligonucleotide
cacccucccacgccgccu

SEQ ID NO: 15638 - RNA, 18 nt, Artificial Sequence
  Description of Artificial Sequence: Synthetic oligonucleotide
gggcccacccucccacgc

SEQ ID NO: 15639 - RNA, 18 nt, Artificial Sequence
  Description of Artificial Sequence: Synthetic oligonucleotide
gggcugggacagccuggg

SEQ ID NO: 15640 - RNA, 18 nt, Artificial Sequence
  Description of Artificial Sequence: Synthetic oligonucleotide
aaggacucccugcucggg

SEQ ID NO: 15641 - RNA, 18 nt, Artificial Sequence
  Description of Artificial Sequence: Synthetic oligonucleotide
uugguggugguccuucca

SEQ ID NO: 15642 - RNA, 18 nt, Artificial Sequence
  Description of Artificial Sequence: Synthetic oligonucleotide
cuucguuggugguggucc

SEQ ID NO: 15643 - RNA, 18 nt, Artificial Sequence
  Description of Artificial Sequence: Synthetic oligonucleotide
caguucuucguugguggu

SEQ ID NO: 15644 - RNA, 18 nt, Artificial Sequence
  Description of Artificial Sequence: Synthetic oligonucleotide
ucuuccaguucuucguug

SEQ ID NO: 15645 - RNA, 18 nt, Artificial Sequence
  Description of Artificial Sequence: Synthetic oligonucleotide
gcaugucuuccaguucuu

SEQ ID NO: 15646 - RNA, 18 nt, Artificial Sequence
  Description of Artificial Sequence: Synthetic oligonucleotide
cuccagcaugucuuccag

SEQ ID NO: 15647 - RNA, 18 nt, Artificial Sequence
  Description of Artificial Sequence: Synthetic oligonucleotide
ccgcucuccagcaugucu

SEQ ID NO: 15648 - RNA, 18 nt, Artificial Sequence
  Description of Artificial Sequence: Synthetic oligonucleotide
gcuucccgcucuccagca

SEQ ID NO: 15649 - RNA, 18 nt, Artificial Sequence
  Description of Artificial Sequence: Synthetic oligonucleotide
ggccagcuucccgcucuc

SEQ ID NO: 15650 - RNA, 18 nt, Artificial Sequence
  Description of Artificial Sequence: Synthetic oligonucleotide
aagauggccagcuucccg

SEQ ID NO: 15651 - RNA, 18 nt, Artificial Sequence
  Description of Artificial Sequence: Synthetic oligonucleotide
cugugaagauggccagcu

SEQ ID NO: 15652 - RNA, 18 nt, Artificial Sequence
  Description of Artificial Sequence: Synthetic oligonucleotide
gucaucugugaagauggc

SEQ ID NO: 15653 - RNA, 18 nt, Artificial Sequence
  Description of Artificial Sequence: Synthetic oligonucleotide
cguugguggugguccuuc

SEQ ID NO: 15654 - RNA, 18 nt, Artificial Sequence
  Description of Artificial Sequence: Synthetic oligonucleotide
uucuucguuggugguggu

SEQ ID NO: 15655 - RNA, 18 nt, Artificial Sequence
  Description of Artificial Sequence: Synthetic oligonucleotide
uccaguucuucguuggug

SEQ ID NO: 15656 - RNA, 18 nt, Artificial Sequence
  Description of Artificial Sequence: Synthetic oligonucleotide
ugucuuccaguucuucgu

SEQ ID NO: 15657 - RNA, 18 nt, Artificial Sequence
  Description of Artificial Sequence: Synthetic oligonucleotide
cagcaugucuuccaguuc

SEQ ID NO: 15658 - RNA, 18 nt, Artificial Sequence
  Description of Artificial Sequence: Synthetic oligonucleotide
cucuccagcaugucuucc

SEQ ID NO: 15659 - RNA, 18 nt, Artificial Sequence
  Description of Artificial Sequence: Synthetic oligonucleotide
ucccgcucuccagcaugu

SEQ ID NO: 15660 - RNA, 18 nt, Artificial Sequence
  Description of Artificial Sequence: Synthetic oligonucleotide
cagcuucccgcucuccag

SEQ ID NO: 15661 - RNA, 18 nt, Artificial Sequence
  Description of Artificial Sequence: Synthetic oligonucleotide
auggccagcuucccgcuc

SEQ ID NO: 15662 - RNA, 18 nt, Artificial Sequence
  Description of Artificial Sequence: Synthetic oligonucleotide
ugaagauggccagcuucc

SEQ ID NO: 15663 - RNA, 18 nt, Artificial Sequence
  Description of Artificial Sequence: Synthetic oligonucleotide
aucugugaagauggccag

SEQ ID NO: 15664 - RNA, 18 nt, Artificial Sequence
  Description of Artificial Sequence: Synthetic oligonucleotide
agcccgccccacccgcgg

SEQ ID NO: 15665 - RNA, 18 nt, Artificial Sequence
  Description of Artificial Sequence: Synthetic oligonucleotide
agcagagcccgccccacc

SEQ ID NO: 15666 - RNA, 18 nt, Artificial Sequence
  Description of Artificial Sequence: Synthetic oligonucleotide
ccaaaagcagagcccgcc

SEQ ID NO: 15667 - RNA, 18 nt, Artificial Sequence
  Description of Artificial Sequence: Synthetic oligonucleotide
auuuuccaaaagcagagc

SEQ ID NO: 15668 - RNA, 18 nt, Artificial Sequence
  Description of Artificial Sequence: Synthetic oligonucleotide
caaaaauuuuccaaaagc

SEQ ID NO: 15669 - RNA, 18 nt, Artificial Sequence
  Description of Artificial Sequence: Synthetic oligonucleotide
ggaggcaaaaauuuucca

SEQ ID NO: 15670 - RNA, 18 nt, Artificial Sequence
  Description of Artificial Sequence: Synthetic oligonucleotide
gggaggcaaaaauuuucc

SEQ ID NO: 15671 - RNA, 18 nt, Artificial Sequence
  Description of Artificial Sequence: Synthetic oligonucleotide
accugaacuuagggaggg

SEQ ID NO: 15672 - RNA, 18 nt, Artificial Sequence
  Description of Artificial Sequence: Synthetic oligonucleotide
guucaaccugaacuuagg

SEQ ID NO: 15673 - RNA, 18 nt, Artificial Sequence
  Description of Artificial Sequence: Synthetic oligonucleotide
ccuuaguucaaccugaac

SEQ ID NO: 15674 - RNA, 18 nt, Artificial Sequence
  Description of Artificial Sequence: Synthetic oligonucleotide
uaggaccuuaguucaacc

SEQ ID NO: 15675 - RNA, 18 nt, Artificial Sequence
  Description of Artificial Sequence: Synthetic oligonucleotide
ggacuuaggaccuuaguu

SEQ ID NO: 15676 - RNA, 18 nt, Artificial Sequence
  Description of Artificial Sequence: Synthetic oligonucleotide
aggguggacuuaggaccu

SEQ ID NO: 15677 - RNA, 18 nt, Artificial Sequence
  Description of Artificial Sequence: Synthetic oligonucleotide
uuuccaggguggacuuag

SEQ ID NO: 15678 - RNA, 18 nt, Artificial Sequence
  Description of Artificial Sequence: Synthetic oligonucleotide
ucauuuuuccagggugga

SEQ ID NO: 15679 - RNA, 18 nt, Artificial Sequence
  Description of Artificial Sequence: Synthetic oligonucleotide
gcugcucauuuuuccagg

SEQ ID NO: 15680 - RNA, 18 nt, Artificial Sequence
  Description of Artificial Sequence: Synthetic oligonucleotide
uucccgcugcucauuuuu

SEQ ID NO: 15681 - RNA, 18 nt, Artificial Sequence
  Description of Artificial Sequence: Synthetic oligonucleotide
caggcuucccgcugcuca

SEQ ID NO: 15682 - RNA, 18 nt, Artificial Sequence
  Description of Artificial Sequence: Synthetic oligonucleotide
cggcucaggcuucccgcu

SEQ ID NO: 15683 - RNA, 18 nt, Artificial Sequence
  Description of Artificial Sequence: Synthetic oligonucleotide
guucccggcucaggcuuc

SEQ ID NO: 15684 - RNA, 18 nt, Artificial Sequence
  Description of Artificial Sequence: Synthetic oligonucleotide
ccccaguucccggcucag

SEQ ID NO: 15685 - RNA, 18 nt, Artificial Sequence
  Description of Artificial Sequence: Synthetic oligonucleotide
gaauuccccaguucccgg

SEQ ID NO: 15686 - RNA, 18 nt, Artificial Sequence
  Description of Artificial Sequence: Synthetic oligonucleotide
ccauggaauuccccaguu

SEQ ID NO: 15687 - RNA, 18 nt, Artificial Sequence
  Description of Artificial Sequence: Synthetic oligonucleotide
cgcucccauggaauuccc

SEQ ID NO: 15688 - RNA, 18 nt, Artificial Sequence
  Description of Artificial Sequence: Synthetic oligonucleotide
ugcuccgcucccauggaa

SEQ ID NO: 15689 - RNA, 18 nt, Artificial Sequence
  Description of Artificial Sequence: Synthetic oligonucleotide
cuuccugcuccgcuccca

SEQ ID NO: 15690 - RNA, 18 nt, Artificial Sequence
  Description of Artificial Sequence: Synthetic oligonucleotide
ggugccuuccugcuccgc

SEQ ID NO: 15691 - RNA, 18 nt, Artificial Sequence
  Description of Artificial Sequence: Synthetic oligonucleotide
gggugccuuccugcuccg

SEQ ID NO: 15692 - RNA, 18 nt, Artificial Sequence
  Description of Artificial Sequence: Synthetic oligonucleotide
acuccgucaucugauggg

SEQ ID NO: 15693 - RNA, 18 nt, Artificial Sequence
  Description of Artificial Sequence: Synthetic oligonucleotide
gaacgacuccgucaucug

SEQ ID NO: 15694 - RNA, 18 nt, Artificial Sequence
  Description of Artificial Sequence: Synthetic oligonucleotide
cacacgaacgacuccguc

SEQ ID NO: 15695 - RNA, 18 nt, Artificial Sequence
  Description of Artificial Sequence: Synthetic oligonucleotide
ccuggcacacgaacgacu

SEQ ID NO: 15696 - RNA, 18 nt, Artificial Sequence
  Description of Artificial Sequence: Synthetic oligonucleotide
cagugccuggcacacgaa

SEQ ID NO: 15697 - RNA, 18 nt, Artificial Sequence
  Description of Artificial Sequence: Synthetic oligonucleotide
uagaacagugccuggcac

SEQ ID NO: 15698 - RNA, 18 nt, Artificial Sequence
  Description of Artificial Sequence: Synthetic oligonucleotide
gugcuuagaacagugccu

SEQ ID NO: 15699 - RNA, 18 nt, Artificial Sequence
  Description of Artificial Sequence: Synthetic oligonucleotide
ggaaagugcuuagaacag

SEQ ID NO: 15700 - RNA, 18 nt, Artificial Sequence
  Description of Artificial Sequence: Synthetic oligonucleotide
aagauggaaagugcuuag

SEQ ID NO: 15701 - RNA, 18 nt, Artificial Sequence
  Description of Artificial Sequence: Synthetic oligonucleotide
augugaagauggaaagug

SEQ ID NO: 15702 - RNA, 18 nt, Artificial Sequence
  Description of Artificial Sequence: Synthetic oligonucleotide
ggugaaugugaagaugga

SEQ ID NO: 15703 - RNA, 18 nt, Artificial Sequence
  Description of Artificial Sequence: Synthetic oligonucleotide
uggugggugaaugugaag

SEQ ID NO: 15704 - RNA, 18 nt, Artificial Sequence
  Description of Artificial Sequence: Synthetic oligonucleotide
ugaguuggugggugaaug

SEQ ID NO: 15705 - RNA, 18 nt, Artificial Sequence
  Description of Artificial Sequence: Synthetic oligonucleotide
uuaaaugaguuggugggu

SEQ ID NO: 15706 - RNA, 18 nt, Artificial Sequence
  Description of Artificial Sequence: Synthetic oligonucleotide
gaguauuaaaugaguugg

SEQ ID NO: 15707 - RNA, 18 nt, Artificial Sequence
  Description of Artificial Sequence: Synthetic oligonucleotide
ugugugaguauuaaauga

SEQ ID NO: 15708 - RNA, 18 nt, Artificial Sequence
  Description of Artificial Sequence: Synthetic oligonucleotide
gggaugugugaguauuaa

SEQ ID NO: 15709 - RNA, 18 nt, Artificial Sequence
  Description of Artificial Sequence: Synthetic oligonucleotide
ccucaucugugaaauggg

SEQ ID NO: 15710 - RNA, 18 nt, Artificial Sequence
  Description of Artificial Sequence: Synthetic oligonucleotide
guuuuccucaucugugaa

SEQ ID NO: 15711 - RNA, 18 nt, Artificial Sequence
  Description of Artificial Sequence: Synthetic oligonucleotide
ggccaguuuuccucaucu

SEQ ID NO: 15712 - RNA, 18 nt, Artificial Sequence
  Description of Artificial Sequence: Synthetic oligonucleotide
cucugggccaguuuuccu

SEQ ID NO: 15713 - RNA, 18 nt, Artificial Sequence
  Description of Artificial Sequence: Synthetic oligonucleotide
caucucucugggccaguu

SEQ ID NO: 15714 - RNA, 18 nt, Artificial Sequence
  Description of Artificial Sequence: Synthetic oligonucleotide
gauuucaucucucugggc

SEQ ID NO: 15715 - RNA, 18 nt, Artificial Sequence
  Description of Artificial Sequence: Synthetic oligonucleotide
caagugauuucaucucuc

SEQ ID NO: 15716 - RNA, 18 nt, Artificial Sequence
  Description of Artificial Sequence: Synthetic oligonucleotide
cuugccaagugauuucau

SEQ ID NO: 15717 - RNA, 18 nt, Artificial Sequence
  Description of Artificial Sequence: Synthetic oligonucleotide
gagaucuugccaagugau

SEQ ID NO: 15718 - RNA, 18 nt, Artificial Sequence
  Description of Artificial Sequence: Synthetic oligonucleotide
gcucugagaucuugccaa

SEQ ID NO: 15719 - RNA, 18 nt, Artificial Sequence
  Description of Artificial Sequence: Synthetic oligonucleotide
cccucgcucugagaucuu

SEQ ID NO: 15720 - RNA, 18 nt, Artificial Sequence
  Description of Artificial Sequence: Synthetic oligonucleotide
ccucucccucgcucugag

SEQ ID NO: 15721 - RNA, 18 nt, Artificial Sequence
  Description of Artificial Sequence: Synthetic oligonucleotide
cuggcccucucccucgcu

SEQ ID NO: 15722 - RNA, 18 nt, Artificial Sequence
  Description of Artificial Sequence: Synthetic oligonucleotide
aaguccuggcccucuccc

SEQ ID NO: 15723 - RNA, 18 nt, Artificial Sequence
  Description of Artificial Sequence: Synthetic oligonucleotide
gauucaaguccuggcccu

SEQ ID NO: 15724 - RNA, 18 nt, Artificial Sequence
  Description of Artificial Sequence: Synthetic oligonucleotide
gacaggauucaaguccug

SEQ ID NO: 15725 - RNA, 18 nt, Artificial Sequence
  Description of Artificial Sequence: Synthetic oligonucleotide
aacuagacaggauucaag

SEQ ID NO: 15726 - RNA, 18 nt, Artificial Sequence
  Description of Artificial Sequence: Synthetic oligonucleotide
ucugaaacuagacaggau

SEQ ID NO: 15727 - RNA, 18 nt, Artificial Sequence
  Description of Artificial Sequence: Synthetic oligonucleotide
cugacucugaaacuagac

SEQ ID NO: 15728 - RNA, 18 nt, Artificial Sequence
  Description of Artificial Sequence: Synthetic oligonucleotide
gaguucugacucugaaac

SEQ ID NO: 15729 - RNA, 18 nt, Artificial Sequence
  Description of Artificial Sequence: Synthetic oligonucleotide
cucgagaguucugacucu

SEQ ID NO: 15730 - RNA, 18 nt, Artificial Sequence
  Description of Artificial Sequence: Synthetic oligonucleotide
uagggcucgagaguucug

SEQ ID NO: 15731 - RNA, 18 nt, Artificial Sequence
  Description of Artificial Sequence: Synthetic oligonucleotide
uauccuagggcucgagag

SEQ ID NO: 15732 - RNA, 18 nt, Artificial Sequence
  Description of Artificial Sequence: Synthetic oligonucleotide
ucguguauccuagggcuc

SEQ ID NO: 15733 - RNA, 18 nt, Artificial Sequence
  Description of Artificial Sequence: Synthetic oligonucleotide
guaugucguguauccuag

SEQ ID NO: 15734 - RNA, 18 nt, Artificial Sequence
  Description of Artificial Sequence: Synthetic oligonucleotide
gcagaguaugucguguau

SEQ ID NO: 15735 - RNA, 18 nt, Artificial Sequence
  Description of Artificial Sequence: Synthetic oligonucleotide
caguagcagaguaugucg

SEQ ID NO: 15736 - RNA, 18 nt, Artificial Sequence
  Description of Artificial Sequence: Synthetic oligonucleotide
ugcuucaguagcagagua

SEQ ID NO: 15737 - RNA, 18 nt, Artificial Sequence
  Description of Artificial Sequence: Synthetic oligonucleotide
cgacuugcuucaguagca

SEQ ID NO: 15738 - RNA, 18 nt, Artificial Sequence
  Description of Artificial Sequence: Synthetic oligonucleotide
ugaaacgacuugcuucag

SEQ ID NO: 15739 - RNA, 18 nt, Artificial Sequence
  Description of Artificial Sequence: Synthetic oligonucleotide
ucuggugaaacgacuugc

SEQ ID NO: 15740 - RNA, 18 nt, Artificial Sequence
  Description of Artificial Sequence: Synthetic oligonucleotide
aguucucuggugaaacga

SEQ ID NO: 15741 - RNA, 18 nt, Artificial Sequence
  Description of Artificial Sequence: Synthetic oligonucleotide
aaaucaguucucugguga

SEQ ID NO: 15742 - RNA, 18 nt, Artificial Sequence
  Description of Artificial Sequence: Synthetic oligonucleotide
uaggcaaaucaguucucu

SEQ ID NO: 15743 - RNA, 18 nt, Artificial Sequence
  Description of Artificial Sequence: Synthetic oligonucleotide
uaauguaggcaaaucagu

SEQ ID NO: 15744 - RNA, 18 nt, Artificial Sequence
  Description of Artificial Sequence: Synthetic oligonucleotide
ucuuuuaauguaggcaaa

SEQ ID NO: 15745 - RNA, 18 nt, Artificial Sequence
  Description of Artificial Sequence: Synthetic oligonucleotide
aaauuucuuuuaauguag

SEQ ID NO: 15746 - RNA, 18 nt, Artificial Sequence
  Description of Artificial Sequence: Synthetic oligonucleotide
aaaaaaaauuucuuuuaa

SEQ ID NO: 15747 - RNA, 18 nt, Artificial Sequence
  Description of Artificial Sequence: Synthetic oligonucleotide
uaauuaaaaaaaauuucu

SEQ ID NO: 15748 - RNA, 18 nt, Artificial Sequence
  Description of Artificial Sequence: Synthetic oligonucleotide
uuuuuuaauuaaaaaaaa

SEQ ID NO: 15749 - RNA, 18 nt, Artificial Sequence
  Description of Artificial Sequence: Synthetic oligonucleotide
aaguuuuuuuuaauuaaa

SEQ ID NO: 15750 - RNA, 18 nt, Artificial Sequence
  Description of Artificial Sequence: Synthetic oligonucleotide
aaaaaaaguuuuuuuuaa

SEQ ID NO: 15751 - RNA, 18 nt, Artificial Sequence
  Description of Artificial Sequence: Synthetic oligonucleotide
aaaagaaaaaaaguuuuu

SEQ ID NO: 15752 - RNA, 18 nt, Artificial Sequence
  Description of Artificial Sequence: Synthetic oligonucleotide
aaaaaaaaagaaaaaaag

SEQ ID NO: 15753 - RNA, 18 nt, Artificial Sequence
  Description of Artificial Sequence: Synthetic oligonucleotide
gaagaaaaaaaaaagaaa

SEQ ID NO: 15754 - RNA, 18 nt, Artificial Sequence
  Description of Artificial Sequence: Synthetic oligonucleotide
gucuugaagaaaaaaaaa

SEQ ID NO: 15755 - RNA, 18 nt, Artificial Sequence
  Description of Artificial Sequence: Synthetic oligonucleotide
acuccgucuugaagaaaa

SEQ ID NO: 15756 - RNA, 18 nt, Artificial Sequence
  Description of Artificial Sequence: Synthetic oligonucleotide
ccaucucaaaaaaaaaaa

SEQ ID NO: 15757 - RNA, 18 nt, Artificial Sequence
  Description of Artificial Sequence: Synthetic oligonucleotide
aaauuccaucucaaaaaa

SEQ ID NO: 15758 - RNA, 18 nt, Artificial Sequence
  Description of Artificial Sequence: Synthetic oligonucleotide
gagugaaauuccaucuca

SEQ ID NO: 15759 - RNA, 18 nt, Artificial Sequence
  Description of Artificial Sequence: Synthetic oligonucleotide
aacaagagugaaauucca

SEQ ID NO: 15760 - RNA, 18 nt, Artificial Sequence
  Description of Artificial Sequence: Synthetic oligonucleotide
ugggcaacaagagugaaa

SEQ ID NO: 15761 - RNA, 18 nt, Artificial Sequence
  Description of Artificial Sequence: Synthetic oligonucleotide
cagccugggcaacaagag

SEQ ID NO: 15762 - RNA, 18 nt, Artificial Sequence
  Description of Artificial Sequence: Synthetic oligonucleotide
cacuccagccugggcaac

SEQ ID NO: 15763 - RNA, 18 nt, Artificial Sequence
  Description of Artificial Sequence: Synthetic oligonucleotide
cacugcacuccagccugg

SEQ ID NO: 15764 - RNA, 18 nt, Artificial Sequence
  Description of Artificial Sequence: Synthetic oligonucleotide
cacgccacugcacuccag

SEQ ID NO: 15765 - RNA, 18 nt, Artificial Sequence
  Description of Artificial Sequence: Synthetic oligonucleotide
gagaucacgccacugcac

SEQ ID NO: 15766 - RNA, 18 nt, Artificial Sequence
  Description of Artificial Sequence: Synthetic oligonucleotide
gagcugagaucacgccac

SEQ ID NO: 15767 - RNA, 18 nt, Artificial Sequence
  Description of Artificial Sequence: Synthetic oligonucleotide
gcagugagcugagaucac

SEQ ID NO: 15768 - RNA, 18 nt, Artificial Sequence
  Description of Artificial Sequence: Synthetic oligonucleotide
agguugcagugagcugag

SEQ ID NO: 15769 - RNA, 18 nt, Artificial Sequence
  Description of Artificial Sequence: Synthetic oligonucleotide
ggcagagguugcagugag

SEQ ID NO: 15770 - RNA, 18 nt, Artificial Sequence
  Description of Artificial Sequence: Synthetic oligonucleotide
gaauugcuugaacccggg

SEQ ID NO: 15771 - RNA, 18 nt, Artificial Sequence
  Description of Artificial Sequence: Synthetic oligonucleotide
caggagaauugcuugaac

SEQ ID NO: 15772 - RNA, 18 nt, Artificial Sequence
  Description of Artificial Sequence: Synthetic oligonucleotide
ugaggcaggagaauugcu

SEQ ID NO: 15773 - RNA, 18 nt, Artificial Sequence
  Description of Artificial Sequence: Synthetic oligonucleotide
gaggcugaggcaggagaa

SEQ ID NO: 15774 - RNA, 18 nt, Artificial Sequence
  Description of Artificial Sequence: Synthetic oligonucleotide
cucaggaggcugaggcag

SEQ ID NO: 15775 - RNA, 18 nt, Artificial Sequence
  Description of Artificial Sequence: Synthetic oligonucleotide
agcuacucaggaggcuga

SEQ ID NO: 15776 - RNA, 18 nt, Artificial Sequence
  Description of Artificial Sequence: Synthetic oligonucleotide
aucauagcuacucaggag

SEQ ID NO: 15777 - RNA, 18 nt, Artificial Sequence
  Description of Artificial Sequence: Synthetic oligonucleotide
cuguaaucauagcuacuc

SEQ ID NO: 15778 - RNA, 18 nt, Artificial Sequence
  Description of Artificial Sequence: Synthetic oligonucleotide
ggcaccuguaaucauagc

SEQ ID NO: 15779 - RNA, 18 nt, Artificial Sequence
  Description of Artificial Sequence: Synthetic oligonucleotide
uggugggcaccuguaauc

SEQ ID NO: 15780 - RNA, 18 nt, Artificial Sequence
  Description of Artificial Sequence: Synthetic oligonucleotide
ugugguggugggcaccug

SEQ ID NO: 15781 - RNA, 18 nt, Artificial Sequence
  Description of Artificial Sequence: Synthetic oligonucleotide
ccuggugugguggugggc

SEQ ID NO: 15782 - RNA, 18 nt, Artificial Sequence
  Description of Artificial Sequence: Synthetic oligonucleotide
auuagccugguguggugg

SEQ ID NO: 15783 - RNA, 18 nt, Artificial Sequence
  Description of Artificial Sequence: Synthetic oligonucleotide
uaaaaauuagccuggugu

SEQ ID NO: 15784 - RNA, 18 nt, Artificial Sequence
  Description of Artificial Sequence: Synthetic oligonucleotide
aaauauaaaaauuagccu

SEQ ID NO: 15785 - RNA, 18 nt, Artificial Sequence
  Description of Artificial Sequence: Synthetic oligonucleotide
acuaaaaauauaaaaauu

SEQ ID NO: 15786 - RNA, 18 nt, Artificial Sequence
  Description of Artificial Sequence: Synthetic oligonucleotide
ucucuacuaaaaauauaa

SEQ ID NO: 15787 - RNA, 18 nt, Artificial Sequence
  Description of Artificial Sequence: Synthetic oligonucleotide
ccucgucucuacuaaaaa

SEQ ID NO: 15788 - RNA, 18 nt, Artificial Sequence
  Description of Artificial Sequence: Synthetic oligonucleotide
cgaaaccucgucucuacu

SEQ ID NO: 15789 - RNA, 18 nt, Artificial Sequence
  Description of Artificial Sequence: Synthetic oligonucleotide
cauggcgaaaccucgucu

SEQ ID NO: 15790 - RNA, 18 nt, Artificial Sequence
  Description of Artificial Sequence: Synthetic oligonucleotide
gccaacauggcgaaaccu

SEQ ID NO: 15791 - RNA, 18 nt, Artificial Sequence
  Description of Artificial Sequence: Synthetic oligonucleotide
gccuggccaacauggcga

SEQ ID NO: 15792 - RNA, 18 nt, Artificial Sequence
  Description of Artificial Sequence: Synthetic oligonucleotide
gaccagccuggccaacau

SEQ ID NO: 15793 - RNA, 18 nt, Artificial Sequence
  Description of Artificial Sequence: Synthetic oligonucleotide
uuugagaccagccuggcc

SEQ ID NO: 15794 - RNA, 18 nt, Artificial Sequence
  Description of Artificial Sequence: Synthetic oligonucleotide
agaaguuugagaccagcc

SEQ ID NO: 15795 - RNA, 18 nt, Artificial Sequence
  Description of Artificial Sequence: Synthetic oligonucleotide
aggucagaaguuugagac

SEQ ID NO: 15796 - RNA, 18 nt, Artificial Sequence
  Description of Artificial Sequence: Synthetic oligonucleotide
accugaggucagaaguuu

SEQ ID NO: 15797 - RNA, 18 nt, Artificial Sequence
  Description of Artificial Sequence: Synthetic oligonucleotide
agaucaccugaggucaga

SEQ ID NO: 15798 - RNA, 18 nt, Artificial Sequence
  Description of Artificial Sequence: Synthetic oligonucleotide
uguguagaucaccugagg

SEQ ID NO: 15799 - RNA, 18 nt, Artificial Sequence
  Description of Artificial Sequence: Synthetic oligonucleotide
ggagguguguagaucacc

SEQ ID NO: 15800 - RNA, 18 nt, Artificial Sequence
  Description of Artificial Sequence: Synthetic oligonucleotide
cuuugggagguguguaga

SEQ ID NO: 15801 - RNA, 18 nt, Artificial Sequence
  Description of Artificial Sequence: Synthetic oligonucleotide
cagcacuuugggaggugu

SEQ ID NO: 15802 - RNA, 18 nt, Artificial Sequence
  Description of Artificial Sequence: Synthetic oligonucleotide
aaucccagcacuuuggga

SEQ ID NO: 15803 - RNA, 18 nt, Artificial Sequence
  Description of Artificial Sequence: Synthetic oligonucleotide
ccuguaaucccagcacuu

SEQ ID NO: 15804 - RNA, 18 nt, Artificial Sequence
  Description of Artificial Sequence: Synthetic oligonucleotide
ucacaccuguaaucccag

SEQ ID NO: 15805 - RNA, 18 nt, Artificial Sequence
  Description of Artificial Sequence: Synthetic oligonucleotide
auggcucacaccuguaau

SEQ ID NO: 15806 - RNA, 18 nt, Artificial Sequence
  Description of Artificial Sequence: Synthetic oligonucleotide
gcacgauggcucacaccu

SEQ ID NO: 15807 - RNA, 18 nt, Artificial Sequence
  Description of Artificial Sequence: Synthetic oligonucleotide
gucaggcacgauggcuca

SEQ ID NO: 15808 - RNA, 18 nt, Artificial Sequence
  Description of Artificial Sequence: Synthetic oligonucleotide
cauuggucaggcacgaug

SEQ ID NO: 15809 - RNA, 18 nt, Artificial Sequence
  Description of Artificial Sequence: Synthetic oligonucleotide
guacacauuggucaggca

SEQ ID NO: 15810 - RNA, 18 nt, Artificial Sequence
  Description of Artificial Sequence: Synthetic oligonucleotide
aauauguacacauugguc

SEQ ID NO: 15811 - RNA, 18 nt, Artificial Sequence
  Description of Artificial Sequence: Synthetic oligonucleotide
gaguuaauauguacacau

SEQ ID NO: 15812 - RNA, 18 nt, Artificial Sequence
  Description of Artificial Sequence: Synthetic oligonucleotide
ugagugaguuaauaugua

SEQ ID NO: 15813 - RNA, 18 nt, Artificial Sequence
  Description of Artificial Sequence: Synthetic oligonucleotide
aagacugagugaguuaau

SEQ ID NO: 15814 - RNA, 18 nt, Artificial Sequence
  Description of Artificial Sequence: Synthetic oligonucleotide
uugugaagacugagugag

SEQ ID NO: 15815 - RNA, 18 nt, Artificial Sequence
  Description of Artificial Sequence: Synthetic oligonucleotide
ggugguugugaagacuga

SEQ ID NO: 15816 - RNA, 18 nt, Artificial Sequence
  Description of Artificial Sequence: Synthetic oligonucleotide
cacagggugguugugaag

SEQ ID NO: 15817 - RNA, 18 nt, Artificial Sequence
  Description of Artificial Sequence: Synthetic oligonucleotide
caccucacagggugguug

SEQ ID NO: 15818 - RNA, 18 nt, Artificial Sequence
  Description of Artificial Sequence: Synthetic oligonucleotide
cugcccaccucacagggu

SEQ ID NO: 15819 - RNA, 18 nt, Artificial Sequence
  Description of Artificial Sequence: Synthetic oligonucleotide
uaacacugcccaccucac

SEQ ID NO: 15820 - RNA, 18 nt, Artificial Sequence
  Description of Artificial Sequence: Synthetic oligonucleotide
gaucauaacacugcccac

SEQ ID NO: 15821 - RNA, 18 nt, Artificial Sequence
  Description of Artificial Sequence: Synthetic oligonucleotide
auguggaucauaacacug

SEQ ID NO: 15822 - RNA, 18 nt, Artificial Sequence
  Description of Artificial Sequence: Synthetic oligonucleotide
agaaaauguggaucauaa

SEQ ID NO: 15823 - RNA, 18 nt, Artificial Sequence
  Description of Artificial Sequence: Synthetic oligonucleotide
caccuagaaaauguggau

SEQ ID NO: 15824 - RNA, 18 nt, Artificial Sequence
  Description of Artificial Sequence: Synthetic oligonucleotide
uuccccaccuagaaaaug

SEQ ID NO: 15825 - RNA, 18 nt, Artificial Sequence
  Description of Artificial Sequence: Synthetic oligonucleotide
ucaguuuccccaccuaga

SEQ ID NO: 15826 - RNA, 18 nt, Artificial Sequence
  Description of Artificial Sequence: Synthetic oligonucleotide
uggccucaguuuccccac

SEQ ID NO: 15827 - RNA, 18 nt, Artificial Sequence
  Description of Artificial Sequence: Synthetic oligonucleotide
gcucuuggccucaguuuc

SEQ ID NO: 15828 - RNA, 18 nt, Artificial Sequence
  Description of Artificial Sequence: Synthetic oligonucleotide
caccugcucuuggccuca

SEQ ID NO: 15829 - RNA, 18 nt, Artificial Sequence
  Description of Artificial Sequence: Synthetic oligonucleotide
uuauucaccugcucuugg

SEQ ID NO: 15830 - RNA, 18 nt, Artificial Sequence
  Description of Artificial Sequence: Synthetic oligonucleotide
gcacauuauucaccugcu

SEQ ID NO: 15831 - RNA, 18 nt, Artificial Sequence
  Description of Artificial Sequence: Synthetic oligonucleotide
cuuaggcacauuauucac

SEQ ID NO: 15832 - RNA, 18 nt, Artificial Sequence
  Description of Artificial Sequence: Synthetic oligonucleotide
gaaaccuuaggcacauua

SEQ ID NO: 15833 - RNA, 18 nt, Artificial Sequence
  Description of Artificial Sequence: Synthetic oligonucleotide
uagcugaaaccuuaggca

SEQ ID NO: 15834 - RNA, 18 nt, Artificial Sequence
  Description of Artificial Sequence: Synthetic oligonucleotide
uuuacuagcugaaaccuu

SEQ ID NO: 15835 - RNA, 18 nt, Artificial Sequence
  Description of Artificial Sequence: Synthetic oligonucleotide
ugucauuuacuagcugaa

SEQ ID NO: 15836 - RNA, 18 nt, Artificial Sequence
  Description of Artificial Sequence: Synthetic oligonucleotide
uccggugucauuuacuag

SEQ ID NO: 15837 - RNA, 18 nt, Artificial Sequence
  Description of Artificial Sequence: Synthetic oligonucleotide
ucaaauccggugucauuu

SEQ ID NO: 15838 - RNA, 18 nt, Artificial Sequence
  Description of Artificial Sequence: Synthetic oligonucleotide
cagggucaaauccggugu

SEQ ID NO: 15839 - RNA, 18 nt, Artificial Sequence
  Description of Artificial Sequence: Synthetic oligonucleotide
guggccagggucaaaucc

SEQ ID NO: 15840 - RNA, 18 nt, Artificial Sequence
  Description of Artificial Sequence: Synthetic oligonucleotide
guggaguggccaggguca

SEQ ID NO: 15841 - RNA, 18 nt, Artificial Sequence
  Description of Artificial Sequence: Synthetic oligonucleotide
ccgcaguggaguggccag

SEQ ID NO: 15842 - RNA, 18 nt, Artificial Sequence
  Description of Artificial Sequence: Synthetic oligonucleotide
cuccaccgcaguggagug

SEQ ID NO: 15843 - RNA, 18 nt, Artificial Sequence
  Description of Artificial Sequence: Synthetic oligonucleotide
agcgccuccaccgcagug

SEQ ID NO: 15844 - RNA, 18 nt, Artificial Sequence
  Description of Artificial Sequence: Synthetic oligonucleotide
ccaugagcgccuccaccg

SEQ ID NO: 15845 - RNA, 18 nt, Artificial Sequence
  Description of Artificial Sequence: Synthetic oligonucleotide
cuccgccaugagcgccuc

SEQ ID NO: 15846 - RNA, 18 nt, Artificial Sequence
  Description of Artificial Sequence: Synthetic oligonucleotide
cccuucuccgccaugagc

SEQ ID NO: 15847 - RNA, 18 nt, Artificial Sequence
  Description of Artificial Sequence: Synthetic oligonucleotide
aaucacccuucuccgcca

SEQ ID NO: 15848 - RNA, 18 nt, Artificial Sequence
  Description of Artificial Sequence: Synthetic oligonucleotide
gcuacaaucacccuucuc

SEQ ID NO: 15849 - RNA, 18 nt, Artificial Sequence
  Description of Artificial Sequence: Synthetic oligonucleotide
agagagcuacaaucaccc

SEQ ID NO: 15850 - RNA, 18 nt, Artificial Sequence
  Description of Artificial Sequence: Synthetic oligonucleotide
ucugugaguccauuuuga

SEQ ID NO: 15851 - RNA, 18 nt, Artificial Sequence
  Description of Artificial Sequence: Synthetic oligonucleotide
cgucaucugugaguccau

SEQ ID NO: 15852 - RNA, 18 nt, Artificial Sequence
  Description of Artificial Sequence: Synthetic oligonucleotide
ugcuucgucaucugugag

SEQ ID NO: 15853 - RNA, 18 nt, Artificial Sequence
  Description of Artificial Sequence: Synthetic oligonucleotide
gcgccugcuucgucaucu

SEQ ID NO: 15854 - RNA, 18 nt, Artificial Sequence
  Description of Artificial Sequence: Synthetic oligonucleotide
auucagcgccugcuucgu

SEQ ID NO: 15855 - RNA, 18 nt, Artificial Sequence
  Description of Artificial Sequence: Synthetic oligonucleotide
aucucauucagcgccugc

SEQ ID NO: 15856 - RNA, 18 nt, Artificial Sequence
  Description of Artificial Sequence: Synthetic oligonucleotide
ucucaaucucauucagcg

SEQ ID NO: 15857 - RNA, 18 nt, Artificial Sequence
  Description of Artificial Sequence: Synthetic oligonucleotide
ccucgucucaaucucauu

SEQ ID NO: 15858 - RNA, 18 nt, Artificial Sequence
  Description of Artificial Sequence: Synthetic oligonucleotide
uugugccucgucucaauc

SEQ ID NO: 15859 - RNA, 18 nt, Artificial Sequence
  Description of Artificial Sequence: Synthetic oligonucleotide
ucucauugugccucgucu

SEQ ID NO: 15860 - RNA, 18 nt, Artificial Sequence
  Description of Artificial Sequence: Synthetic oligonucleotide
gaugaucucauugugccu

SEQ ID NO: 15861 - RNA, 18 nt, Artificial Sequence
  Description of Artificial Sequence: Synthetic oligonucleotide
agcuugaugaucucauug

SEQ ID NO: 15862 - RNA, 18 nt, Artificial Sequence
  Description of Artificial Sequence: Synthetic oligonucleotide
ucuccagcuugaugaucu

SEQ ID NO: 15863 - RNA, 18 nt, Artificial Sequence
  Description of Artificial Sequence: Synthetic oligonucleotide
gcuggucuccagcuugau

SEQ ID NO: 15864 - RNA, 18 nt, Artificial Sequence
  Description of Artificial Sequence: Synthetic oligonucleotide
cggaugcuggucuccagc

SEQ ID NO: 15865 - RNA, 18 nt, Artificial Sequence
  Description of Artificial Sequence: Synthetic oligonucleotide
gcucgcggaugcuggucu

SEQ ID NO: 15866 - RNA, 18 nt, Artificial Sequence
  Description of Artificial Sequence: Synthetic oligonucleotide
gugcagcucgcggaugcu

SEQ ID NO: 15867 - RNA, 18 nt, Artificial Sequence
  Description of Artificial Sequence: Synthetic oligonucleotide
auaucgugcagcucgcgg

SEQ ID NO: 15868 - RNA, 18 nt, Artificial Sequence
  Description of Artificial Sequence: Synthetic oligonucleotide
caaacauaucgugcagcu

SEQ ID NO: 15869 - RNA, 18 nt, Artificial Sequence
  Description of Artificial Sequence: Synthetic oligonucleotide
guccacaaacauaucgug

SEQ ID NO: 15870 - RNA, 18 nt, Artificial Sequence
  Description of Artificial Sequence: Synthetic oligonucleotide
gccauguccacaaacaua

SEQ ID NO: 15871 - RNA, 18 nt, Artificial Sequence
  Description of Artificial Sequence: Synthetic oligonucleotide
gcauggccauguccacaa

SEQ ID NO: 15872 - RNA, 18 nt, Artificial Sequence
  Description of Artificial Sequence: Synthetic oligonucleotide
uacgagcauggccauguc

SEQ ID NO: 15873 - RNA, 18 nt, Artificial Sequence
  Description of Artificial Sequence: Synthetic oligonucleotide
cucucuacgagcauggcc

SEQ ID NO: 15874 - RNA, 18 nt, Artificial Sequence
  Description of Artificial Sequence: Synthetic oligonucleotide
uucuuggcagcuggaaca

SEQ ID NO: 15875 - RNA, 18 nt, Artificial Sequence
  Description of Artificial Sequence: Synthetic oligonucleotide
ccggcuucuuggcagcug

SEQ ID NO: 15876 - RNA, 18 nt, Artificial Sequence
  Description of Artificial Sequence: Synthetic oligonucleotide
uggccccggcuucuuggc

SEQ ID NO: 15877 - RNA, 18 nt, Artificial Sequence
  Description of Artificial Sequence: Synthetic oligonucleotide
aaugguggccccggcuuc

SEQ ID NO: 15878 - RNA, 18 nt, Artificial Sequence
  Description of Artificial Sequence: Synthetic oligonucleotide
cacccaaugguggccccg

SEQ ID NO: 15879 - RNA, 18 nt, Artificial Sequence
  Description of Artificial Sequence: Synthetic oligonucleotide
ggcagcacccaauggugg

SEQ ID NO: 15880 - RNA, 18 nt, Artificial Sequence
  Description of Artificial Sequence: Synthetic oligonucleotide
uuuguggcagcacccaau

SEQ ID NO: 15881 - RNA, 18 nt, Artificial Sequence
  Description of Artificial Sequence: Synthetic oligonucleotide
cauccuuuguggcagcac

SEQ ID NO: 15882 - RNA, 18 nt, Artificial Sequence
  Description of Artificial Sequence: Synthetic oligonucleotide
ggaggcauccuuuguggc

SEQ ID NO: 15883 - RNA, 18 nt, Artificial Sequence
  Description of Artificial Sequence: Synthetic oligonucleotide
gguguggaggcauccuuu

SEQ ID NO: 15884 - RNA, 18 nt, Artificial Sequence
  Description of Artificial Sequence: Synthetic oligonucleotide
ugguagguguggaggcau

SEQ ID NO: 15885 - RNA, 18 nt, Artificial Sequence
  Description of Artificial Sequence: Synthetic oligonucleotide
gguagugguaggugugga

SEQ ID NO: 15886 - RNA, 18 nt, Artificial Sequence
  Description of Artificial Sequence: Synthetic oligonucleotide
acacggguagugguaggu

SEQ ID NO: 15887 - RNA, 18 nt, Artificial Sequence
  Description of Artificial Sequence: Synthetic oligonucleotide
cuggcacacggguagugg

SEQ ID NO: 15888 - RNA, 18 nt, Artificial Sequence
  Description of Artificial Sequence: Synthetic oligonucleotide
caucgcuggcacacgggu

SEQ ID NO: 15889 - RNA, 18 nt, Artificial Sequence
  Description of Artificial Sequence: Synthetic oligonucleotide
ccuguuccugggcgggcu

SEQ ID NO: 15890 - RNA, 18 nt, Artificial Sequence
  Description of Artificial Sequence: Synthetic oligonucleotide
gcccuccuguuccugggc

SEQ ID NO: 15891 - RNA, 18 nt, Artificial Sequence
  Description of Artificial Sequence: Synthetic oligonucleotide
ccaaugcccuccuguucc

SEQ ID NO: 15892 - RNA, 18 nt, Artificial Sequence
  Description of Artificial Sequence: Synthetic oligonucleotide
gggcuccaaugcccuccu

SEQ ID NO: 15893 - RNA, 18 nt, Artificial Sequence
  Description of Artificial Sequence: Synthetic oligonucleotide
uggaugggcuccaaugcc

SEQ ID NO: 15894 - RNA, 18 nt, Artificial Sequence
  Description of Artificial Sequence: Synthetic oligonucleotide
cugcuuggaugggcucca

SEQ ID NO: 15895 - RNA, 18 nt, Artificial Sequence
  Description of Artificial Sequence: Synthetic oligonucleotide
cuggacugcuuggauggg

SEQ ID NO: 15896 - RNA, 18 nt, Artificial Sequence
  Description of Artificial Sequence: Synthetic oligonucleotide
ucccccuggacugcuugg

SEQ ID NO: 15897 - RNA, 18 nt, Artificial Sequence
  Description of Artificial Sequence: Synthetic oligonucleotide
gagggucccccuggacug

SEQ ID NO: 15898 - RNA, 18 nt, Artificial Sequence
  Description of Artificial Sequence: Synthetic oligonucleotide
ccagggagggucccccug

SEQ ID NO: 15899 - RNA, 18 nt, Artificial Sequence
  Description of Artificial Sequence: Synthetic oligonucleotide
ugugcccagggagggucc

SEQ ID NO: 15900 - RNA, 18 nt, Artificial Sequence
  Description of Artificial Sequence: Synthetic oligonucleotide
ggagcugugcccagggag

SEQ ID NO: 15901 - RNA, 18 nt, Artificial Sequence
  Description of Artificial Sequence: Synthetic oligonucleotide
gggagcugugcccaggga

SEQ ID NO: 15902 - RNA, 18 nt, Artificial Sequence
  Description of Artificial Sequence: Synthetic oligonucleotide
acugaagagugagauggg

SEQ ID NO: 15903 - RNA, 18 nt, Artificial Sequence
  Description of Artificial Sequence: Synthetic oligonucleotide
gggaaacugaagagugag

SEQ ID NO: 15904 - RNA, 18 nt, Artificial Sequence
  Description of Artificial Sequence: Synthetic oligonucleotide
gaggagggaaacugaaga

SEQ ID NO: 15905 - RNA, 18 nt, Artificial Sequence
  Description of Artificial Sequence: Synthetic oligonucleotide
caagagaggagggaaacu

SEQ ID NO: 15906 - RNA, 18 nt, Artificial Sequence
  Description of Artificial Sequence: Synthetic oligonucleotide
gggcaagagaggagggaa

SEQ ID NO: 15907 - RNA, 18 nt, Artificial Sequence
  Description of Artificial Sequence: Synthetic oligonucleotide
gauaaaagaauugcuggg

SEQ ID NO: 15908 - RNA, 18 nt, Artificial Sequence
  Description of Artificial Sequence: Synthetic oligonucleotide
agaaggauaaaagaauug

SEQ ID NO: 15909 - RNA, 18 nt, Artificial Sequence
  Description of Artificial Sequence: Synthetic oligonucleotide
cagacagaaggauaaaag

SEQ ID NO: 15910 - RNA, 18 nt, Artificial Sequence
  Description of Artificial Sequence: Synthetic oligonucleotide
cuaggcagacagaaggau

SEQ ID NO: 15911 - RNA, 18 nt, Artificial Sequence
  Description of Artificial Sequence: Synthetic oligonucleotide
gaggucuaggcagacaga

SEQ ID NO: 15912 - RNA, 18 nt, Artificial Sequence
  Description of Artificial Sequence: Synthetic oligonucleotide
cagcagaggucuaggcag

SEQ ID NO: 15913 - RNA, 18 nt, Artificial Sequence
  Description of Artificial Sequence: Synthetic oligonucleotide
uugcccagcagaggucua

SEQ ID NO: 15914 - RNA, 18 nt, Artificial Sequence
  Description of Artificial Sequence: Synthetic oligonucleotide
uggcauugcccagcagag

SEQ ID NO: 15915 - RNA, 18 nt, Artificial Sequence
  Description of Artificial Sequence: Synthetic oligonucleotide
gucccuggcauugcccag

SEQ ID NO: 15916 - RNA, 18 nt, Artificial Sequence
  Description of Artificial Sequence: Synthetic oligonucleotide
uccaugucccuggcauug

SEQ ID NO: 15917 - RNA, 18 nt, Artificial Sequence
  Description of Artificial Sequence: Synthetic oligonucleotide
ucauuuccaugucccugg

SEQ ID NO: 15918 - RNA, 18 nt, Artificial Sequence
  Description of Artificial Sequence: Synthetic oligonucleotide
augccucauuuccauguc

SEQ ID NO: 15919 - RNA, 18 nt, Artificial Sequence
  Description of Artificial Sequence: Synthetic oligonucleotide
gggaaugccucauuucca

SEQ ID NO: 15920 - RNA, 18 nt, Artificial Sequence
  Description of Artificial Sequence: Synthetic oligonucleotide
cucaagcaggugccuggg

SEQ ID NO: 15921 - RNA, 18 nt, Artificial Sequence
  Description of Artificial Sequence: Synthetic oligonucleotide
cacuccucaagcaggugc

SEQ ID NO: 15922 - RNA, 18 nt, Artificial Sequence
  Description of Artificial Sequence: Synthetic oligonucleotide
cugggcacuccucaagca

SEQ ID NO: 15923 - RNA, 18 nt, Artificial Sequence
  Description of Artificial Sequence: Synthetic oligonucleotide
cugcucugggcacuccuc

SEQ ID NO: 15924 - RNA, 18 nt, Artificial Sequence
  Description of Artificial Sequence: Synthetic oligonucleotide
ccucacugcucugggcac

SEQ ID NO: 15925 - RNA, 18 nt, Artificial Sequence
  Description of Artificial Sequence: Synthetic oligonucleotide
ucuucccucacugcucug

SEQ ID NO: 15926 - RNA, 18 nt, Artificial Sequence
  Description of Artificial Sequence: Synthetic oligonucleotide
uucuaucuucccucacug

SEQ ID NO: 15927 - RNA, 18 nt, Artificial Sequence
  Description of Artificial Sequence: Synthetic oligonucleotide
uaugcuucuaucuucccu

SEQ ID NO: 15928 - RNA, 18 nt, Artificial Sequence
  Description of Artificial Sequence: Synthetic oligonucleotide
uaauuuaugcuucuaucu

SEQ ID NO: 15929 - RNA, 18 nt, Artificial Sequence
  Description of Artificial Sequence: Synthetic oligonucleotide
cauuguaauuuaugcuuc

SEQ ID NO: 15930 - RNA, 18 nt, Artificial Sequence
  Description of Artificial Sequence: Synthetic oligonucleotide
uuccacauuguaauuuau

SEQ ID NO: 15931 - RNA, 18 nt, Artificial Sequence
  Description of Artificial Sequence: Synthetic oligonucleotide
cagcauuccacauuguaa

SEQ ID NO: 15932 - RNA, 18 nt, Artificial Sequence
  Description of Artificial Sequence: Synthetic oligonucleotide
gcagacagcauuccacau

SEQ ID NO: 15933 - RNA, 18 nt, Artificial Sequence
  Description of Artificial Sequence: Synthetic oligonucleotide
gcuccgcagacagcauuc

SEQ ID NO: 15934 - RNA, 18 nt, Artificial Sequence
  Description of Artificial Sequence: Synthetic oligonucleotide
ugauggcuccgcagacag

SEQ ID NO: 15935 - RNA, 18 nt, Artificial Sequence
  Description of Artificial Sequence: Synthetic oligonucleotide
ggcaaugauggcuccgca

SEQ ID NO: 15936 - RNA, 18 nt, Artificial Sequence
  Description of Artificial Sequence: Synthetic oligonucleotide
cccuuggcaaugauggcu

SEQ ID NO: 15937 - RNA, 18 nt, Artificial Sequence
  Description of Artificial Sequence: Synthetic oligonucleotide
ccugccccuuggcaauga

SEQ ID NO: 15938 - RNA, 18 nt, Artificial Sequence
  Description of Artificial Sequence: Synthetic oligonucleotide
uccucccugccccuuggc

SEQ ID NO: 15939 - RNA, 18 nt, Artificial Sequence
  Description of Artificial Sequence: Synthetic oligonucleotide
ugagauccucccugcccc

SEQ ID NO: 15940 - RNA, 18 nt, Artificial Sequence
  Description of Artificial Sequence: Synthetic oligonucleotide
aggccugagauccucccu

SEQ ID NO: 15941 - RNA, 18 nt, Artificial Sequence
  Description of Artificial Sequence: Synthetic oligonucleotide
cucugaggccugagaucc

SEQ ID NO: 15942 - RNA, 18 nt, Artificial Sequence
  Description of Artificial Sequence: Synthetic oligonucleotide
uuucucucugaggccuga

SEQ ID NO: 15943 - RNA, 18 nt, Artificial Sequence
  Description of Artificial Sequence: Synthetic oligonucleotide
accccuuucucucugagg

SEQ ID NO: 15944 - RNA, 18 nt, Artificial Sequence
  Description of Artificial Sequence: Synthetic oligonucleotide
ccaauaccccuuucucuc

SEQ ID NO: 15945 - RNA, 18 nt, Artificial Sequence
  Description of Artificial Sequence: Synthetic oligonucleotide
aaccuccaauaccccuuu

SEQ ID NO: 15946 - RNA, 18 nt, Artificial Sequence
  Description of Artificial Sequence: Synthetic oligonucleotide
ggcccaaccuccaauacc

SEQ ID NO: 15947 - RNA, 18 nt, Artificial Sequence
  Description of Artificial Sequence: Synthetic oligonucleotide
ucaaaggcccaaccucca

SEQ ID NO: 15948 - RNA, 18 nt, Artificial Sequence
  Description of Artificial Sequence: Synthetic oligonucleotide
auccuucaaaggcccaac

SEQ ID NO: 15949 - RNA, 18 nt, Artificial Sequence
  Description of Artificial Sequence: Synthetic oligonucleotide
uauuuauccuucaaaggc

SEQ ID NO: 15950 - RNA, 18 nt, Artificial Sequence
  Description of Artificial Sequence: Synthetic oligonucleotide
acuccuauuuauccuuca

SEQ ID NO: 15951 - RNA, 18 nt, Artificial Sequence
  Description of Artificial Sequence: Synthetic oligonucleotide
agugaacuccuauuuauc

SEQ ID NO: 15952 - RNA, 18 nt, Artificial Sequence
  Description of Artificial Sequence: Synthetic oligonucleotide
ugcugagugaacuccuau

SEQ ID NO: 15953 - RNA, 18 nt, Artificial Sequence
  Description of Artificial Sequence: Synthetic oligonucleotide
gucucugcugagugaacu

SEQ ID NO: 15954 - RNA, 18 nt, Artificial Sequence
  Description of Artificial Sequence: Synthetic oligonucleotide
cccuugucucugcugagu

SEQ ID NO: 15955 - RNA, 18 nt, Artificial Sequence
  Description of Artificial Sequence: Synthetic oligonucleotide
cuuuccccuugucucugc

SEQ ID NO: 15956 - RNA, 18 nt, Artificial Sequence
  Description of Artificial Sequence: Synthetic oligonucleotide
agugccuuuccccuuguc

SEQ ID NO: 15957 - RNA, 18 nt, Artificial Sequence
  Description of Artificial Sequence: Synthetic oligonucleotide
guaguagugccuuucccc

SEQ ID NO: 15958 - RNA, 18 nt, Artificial Sequence
  Description of Artificial Sequence: Synthetic oligonucleotide
cuguuguaguagugccuu

SEQ ID NO: 15959 - RNA, 18 nt, Artificial Sequence
  Description of Artificial Sequence: Synthetic oligonucleotide
uuuugcuguuguaguagu

SEQ ID NO: 15960 - RNA, 18 nt, Artificial Sequence
  Description of Artificial Sequence: Synthetic oligonucleotide
uugguuuuugcuguugua

SEQ ID NO: 15961 - RNA, 18 nt, Artificial Sequence
  Description of Artificial Sequence: Synthetic oligonucleotide
cucaguugguuuuugcug

SEQ ID NO: 15962 - RNA, 18 nt, Artificial Sequence
  Description of Artificial Sequence: Synthetic oligonucleotide
cccaacucaguugguuuu

SEQ ID NO: 15963 - RNA, 18 nt, Artificial Sequence
  Description of Artificial Sequence: Synthetic oligonucleotide
ucacccccaacucaguug

SEQ ID NO: 15964 - RNA, 18 nt, Artificial Sequence
  Description of Artificial Sequence: Synthetic oligonucleotide
ccucaucacccccaacuc

SEQ ID NO: 15965 - RNA, 18 nt, Artificial Sequence
  Description of Artificial Sequence: Synthetic oligonucleotide
uugaaccucaucaccccc

SEQ ID NO: 15966 - RNA, 18 nt, Artificial Sequence
  Description of Artificial Sequence: Synthetic oligonucleotide
cuguuuugaaccucauca

SEQ ID NO: 15967 - RNA, 18 nt, Artificial Sequence
  Description of Artificial Sequence: Synthetic oligonucleotide
ucagucuguuuugaaccu

SEQ ID NO: 15968 - RNA, 18 nt, Artificial Sequence
  Description of Artificial Sequence: Synthetic oligonucleotide
gggucucagucuguuuug

SEQ ID NO: 15969 - RNA, 18 nt, Artificial Sequence
  Description of Artificial Sequence: Synthetic oligonucleotide
uccaugggucucagucug

SEQ ID NO: 15970 - RNA, 18 nt, Artificial Sequence
  Description of Artificial Sequence: Synthetic oligonucleotide
auugcuccaugggucuca

SEQ ID NO: 15971 - RNA, 18 nt, Artificial Sequence
  Description of Artificial Sequence: Synthetic oligonucleotide
ccacaauugcuccauggg

SEQ ID NO: 15972 - RNA, 18 nt, Artificial Sequence
  Description of Artificial Sequence: Synthetic oligonucleotide
aacuuccacaauugcucc

SEQ ID NO: 15973 - RNA, 18 nt, Artificial Sequence
  Description of Artificial Sequence: Synthetic oligonucleotide
uucaaaacuuccacaauu

SEQ ID NO: 15974 - RNA, 18 nt, Artificial Sequence
  Description of Artificial Sequence: Synthetic oligonucleotide
ccugcuucaaaacuucca

SEQ ID NO: 15975 - RNA, 18 nt, Artificial Sequence
  Description of Artificial Sequence: Synthetic oligonucleotide
auuacccugcuucaaaac

SEQ ID NO: 15976 - RNA, 18 nt, Artificial Sequence
  Description of Artificial Sequence: Synthetic oligonucleotide
accccauuacccugcuuc

SEQ ID NO: 15977 - RNA, 18 nt, Artificial Sequence
  Description of Artificial Sequence: Synthetic oligonucleotide
uccauaccccauuacccu

SEQ ID NO: 15978 - RNA, 18 nt, Artificial Sequence
  Description of Artificial Sequence: Synthetic oligonucleotide
cuaccuccauaccccauu

SEQ ID NO: 15979 - RNA, 18 nt, Artificial Sequence
  Description of Artificial Sequence: Synthetic oligonucleotide
ugggccuaccuccauacc

SEQ ID NO: 15980 - RNA, 18 nt, Artificial Sequence
  Description of Artificial Sequence: Synthetic oligonucleotide
gagccugggccuaccucc

SEQ ID NO: 15981 - RNA, 18 nt, Artificial Sequence
  Description of Artificial Sequence: Synthetic oligonucleotide
acggacugguaguggugu

SEQ ID NO: 15982 - RNA, 18 nt, Artificial Sequence
  Description of Artificial Sequence: Synthetic oligonucleotide
uguggacggacugguagu

SEQ ID NO: 15983 - RNA, 18 nt, Artificial Sequence
  Description of Artificial Sequence: Synthetic oligonucleotide
accccuguggacggacug

SEQ ID NO: 15984 - RNA, 18 nt, Artificial Sequence
  Description of Artificial Sequence: Synthetic oligonucleotide
caugaaccccuguggacg

SEQ ID NO: 15985 - RNA, 18 nt, Artificial Sequence
  Description of Artificial Sequence: Synthetic oligonucleotide
caugucaugaaccccugu

SEQ ID NO: 15986 - RNA, 18 nt, Artificial Sequence
  Description of Artificial Sequence: Synthetic oligonucleotide
gugagcaugucaugaacc

SEQ ID NO: 15987 - RNA, 18 nt, Artificial Sequence
  Description of Artificial Sequence: Synthetic oligonucleotide
uuccagugagcaugucau

SEQ ID NO: 15988 - RNA, 18 nt, Artificial Sequence
  Description of Artificial Sequence: Synthetic oligonucleotide
cuaacuuccagugagcau

SEQ ID NO: 15989 - RNA, 18 nt, Artificial Sequence
  Description of Artificial Sequence: Synthetic oligonucleotide
gcucacuaacuuccagug

SEQ ID NO: 15990 - RNA, 18 nt, Artificial Sequence
  Description of Artificial Sequence: Synthetic oligonucleotide
gaagagcucacuaacuuc

SEQ ID NO: 15991 - RNA, 18 nt, Artificial Sequence
  Description of Artificial Sequence: Synthetic oligonucleotide
cccuggaagagcucacua

SEQ ID NO: 15992 - RNA, 18 nt, Artificial Sequence
  Description of Artificial Sequence: Synthetic oligonucleotide
ccagccccuggaagagcu

SEQ ID NO: 15993 - RNA, 18 nt, Artificial Sequence
  Description of Artificial Sequence: Synthetic oligonucleotide
uaugcccagccccuggaa

SEQ ID NO: 15994 - RNA, 18 nt, Artificial Sequence
  Description of Artificial Sequence: Synthetic oligonucleotide
ggauguaugcccagcccc

SEQ ID NO: 15995 - RNA, 18 nt, Artificial Sequence
  Description of Artificial Sequence: Synthetic oligonucleotide
ucccuggauguaugccca

SEQ ID NO: 15996 - RNA, 18 nt, Artificial Sequence
  Description of Artificial Sequence: Synthetic oligonucleotide
cuucuucccuggauguau

SEQ ID NO: 15997 - RNA, 18 nt, Artificial Sequence
  Description of Artificial Sequence: Synthetic oligonucleotide
ucugucuucuucccugga

SEQ ID NO: 15998 - RNA, 18 nt, Artificial Sequence
  Description of Artificial Sequence: Synthetic oligonucleotide
ccagcucugucuucuucc

SEQ ID NO: 15999 - RNA, 18 nt, Artificial Sequence
  Description of Artificial Sequence: Synthetic oligonucleotide
gggcaccagcucugucuu

SEQ ID NO: 16000 - RNA, 18 nt, Artificial Sequence
  Description of Artificial Sequence: Synthetic oligonucleotide
ccagagggcaccagcucu

SEQ ID NO: 16001 - RNA, 18 nt, Artificial Sequence
  Description of Artificial Sequence: Synthetic oligonucleotide
agcucccagagggcacca

SEQ ID NO: 16002 - RNA, 18 nt, Artificial Sequence
  Description of Artificial Sequence: Synthetic oligonucleotide
aggcaagcucccagaggg

SEQ ID NO: 16003 - RNA, 18 nt, Artificial Sequence
  Description of Artificial Sequence: Synthetic oligonucleotide
cuggcaggcaagcuccca

SEQ ID NO: 16004 - RNA, 18 nt, Artificial Sequence
  Description of Artificial Sequence: Synthetic oligonucleotide
ccccacuggcaggcaagc

SEQ ID NO: 16005 - RNA, 18 nt, Artificial Sequence
  Description of Artificial Sequence: Synthetic oligonucleotide
uucuuccccacuggcagg

SEQ ID NO: 16006 - RNA, 18 nt, Artificial Sequence
  Description of Artificial Sequence: Synthetic oligonucleotide
cuuguuucuuccccacug

SEQ ID NO: 16007 - RNA, 18 nt, Artificial Sequence
  Description of Artificial Sequence: Synthetic oligonucleotide
ugcuccuuguuucuuccc

SEQ ID NO: 16008 - RNA, 18 nt, Artificial Sequence
  Description of Artificial Sequence: Synthetic oligonucleotide
ugucuugcuccuuguuuc

SEQ ID NO: 16009 - RNA, 18 nt, Artificial Sequence
  Description of Artificial Sequence: Synthetic oligonucleotide
gaucuugucuugcuccuu

SEQ ID NO: 16010 - RNA, 18 nt, Artificial Sequence
  Description of Artificial Sequence: Synthetic oligonucleotide
ugugugaucuugucuugc

SEQ ID NO: 16011 - RNA, 18 nt, Artificial Sequence
  Description of Artificial Sequence: Synthetic oligonucleotide
uggccugugugaucuugu

SEQ ID NO: 16012 - RNA, 18 nt, Artificial Sequence
  Description of Artificial Sequence: Synthetic oligonucleotide
gagacuggccugugugau

SEQ ID NO: 16013 - RNA, 18 nt, Artificial Sequence
  Description of Artificial Sequence: Synthetic oligonucleotide
ccuaagagacuggccugu

SEQ ID NO: 16014 - RNA, 18 nt, Artificial Sequence
  Description of Artificial Sequence: Synthetic oligonucleotide
ugccuccuaagagacugg

SEQ ID NO: 16015 - RNA, 18 nt, Artificial Sequence
  Description of Artificial Sequence: Synthetic oligonucleotide
gucacugccuccuaagag

SEQ ID NO: 16016 - RNA, 18 nt, Artificial Sequence
  Description of Artificial Sequence: Synthetic oligonucleotide
cacuugucacugccuccu

SEQ ID NO: 16017 - RNA, 18 nt, Artificial Sequence
  Description of Artificial Sequence: Synthetic oligonucleotide
agccacacuugucacugc

SEQ ID NO: 16018 - RNA, 18 nt, Artificial Sequence
  Description of Artificial Sequence: Synthetic oligonucleotide
cugccagccacacuuguc

SEQ ID NO: 16019 - RNA, 18 nt, Artificial Sequence
  Description of Artificial Sequence: Synthetic oligonucleotide
uuacucugccagccacac

SEQ ID NO: 16020 - RNA, 18 nt, Artificial Sequence
  Description of Artificial Sequence: Synthetic oligonucleotide
ccgccuuacucugccagc

SEQ ID NO: 16021 - RNA, 18 nt, Artificial Sequence
  Description of Artificial Sequence: Synthetic oligonucleotide
cccucccgccuuacucug

SEQ ID NO: 16022 - RNA, 18 nt, Artificial Sequence
  Description of Artificial Sequence: Synthetic oligonucleotide
ucccucccucccgccuua

SEQ ID NO: 16023 - RNA, 18 nt, Artificial Sequence
  Description of Artificial Sequence: Synthetic oligonucleotide
gucccucccucccucccg

SEQ ID NO: 16024 - RNA, 18 nt, Artificial Sequence
  Description of Artificial Sequence: Synthetic oligonucleotide
ccucagucccucccuccc

SEQ ID NO: 16025 - RNA, 18 nt, Artificial Sequence
  Description of Artificial Sequence: Synthetic oligonucleotide
cagucccucagucccucc

SEQ ID NO: 16026 - RNA, 18 nt, Artificial Sequence
  Description of Artificial Sequence: Synthetic oligonucleotide
ugaggcagucccucaguc

SEQ ID NO: 16027 - RNA, 18 nt, Artificial Sequence
  Description of Artificial Sequence: Synthetic oligonucleotide
ucacuugaggcagucccu

SEQ ID NO: 16028 - RNA, 18 nt, Artificial Sequence
  Description of Artificial Sequence: Synthetic oligonucleotide
ccuccucacuugaggcag

SEQ ID NO: 16029 - RNA, 18 nt, Artificial Sequence
  Description of Artificial Sequence: Synthetic oligonucleotide
ccgccccuccucacuuga

SEQ ID NO: 16030 - RNA, 18 nt, Artificial Sequence
  Description of Artificial Sequence: Synthetic oligonucleotide
acgugccgccccuccuca

SEQ ID NO: 16031 - RNA, 18 nt, Artificial Sequence
  Description of Artificial Sequence: Synthetic oligonucleotide
guuccacgugccgccccu

SEQ ID NO: 16032 - RNA, 18 nt, Artificial Sequence
  Description of Artificial Sequence: Synthetic oligonucleotide
ccugaguuccacgugccg

SEQ ID NO: 16033 - RNA, 18 nt, Artificial Sequence
  Description of Artificial Sequence: Synthetic oligonucleotide
uucccccugaguuccacg

SEQ ID NO: 16034 - RNA, 18 nt, Artificial Sequence
  Description of Artificial Sequence: Synthetic oligonucleotide
agcuuuucccccugaguu

SEQ ID NO: 16035 - RNA, 18 nt, Artificial Sequence
  Description of Artificial Sequence: Synthetic oligonucleotide
cggagagcuuuucccccu

SEQ ID NO: 16036 - RNA, 18 nt, Artificial Sequence
  Description of Artificial Sequence: Synthetic oligonucleotide
cuccgcggagagcuuuuc

SEQ ID NO: 16037 - RNA, 18 nt, Artificial Sequence
  Description of Artificial Sequence: Synthetic oligonucleotide
accuccuccgcggagagc

SEQ ID NO: 16038 - RNA, 18 nt, Artificial Sequence
  Description of Artificial Sequence: Synthetic oligonucleotide
accucaccuccuccgcgg

SEQ ID NO: 16039 - RNA, 18 nt, Artificial Sequence
  Description of Artificial Sequence: Synthetic oligonucleotide
gacucaccucaccuccuc

SEQ ID NO: 16040 - RNA, 18 nt, Artificial Sequence
  Description of Artificial Sequence: Synthetic oligonucleotide
gucuugacucaccucacc

SEQ ID NO: 16041 - RNA, 18 nt, Artificial Sequence
  Description of Artificial Sequence: Synthetic oligonucleotide
uggcagucuugacucacc

SEQ ID NO: 16042 - RNA, 18 nt, Artificial Sequence
  Description of Artificial Sequence: Synthetic oligonucleotide
uggccuggcagucuugac

SEQ ID NO: 16043 - RNA, 18 nt, Artificial Sequence
  Description of Artificial Sequence: Synthetic oligonucleotide
gccccuggccuggcaguc

SEQ ID NO: 16044 - RNA, 18 nt, Artificial Sequence
  Description of Artificial Sequence: Synthetic oligonucleotide
gugcggccccuggccugg

SEQ ID NO: 16045 - RNA, 18 nt, Artificial Sequence
  Description of Artificial Sequence: Synthetic oligonucleotide
cgcgggugcggccccugg

SEQ ID NO: 16046 - RNA, 18 nt, Artificial Sequence
  Description of Artificial Sequence: Synthetic oligonucleotide
cacggcgcgggugcggcc

SEQ ID NO: 16047 - RNA, 18 nt, Artificial Sequence
  Description of Artificial Sequence: Synthetic oligonucleotide
cacuccacggcgcgggug

SEQ ID NO: 16048 - RNA, 18 nt, Artificial Sequence
  Description of Artificial Sequence: Synthetic oligonucleotide
cacuccacuccacggcgc

SEQ ID NO: 16049 - RNA, 18 nt, Artificial Sequence
  Description of Artificial Sequence: Synthetic oligonucleotide
cacuccacuccacuccac

SEQ ID NO: 16050 - RNA, 18 nt, Artificial Sequence
  Description of Artificial Sequence: Synthetic oligonucleotide
cuccacacuccacuccac

SEQ ID NO: 16051 - RNA, 18 nt, Artificial Sequence
  Description of Artificial Sequence: Synthetic oligonucleotide
aaacccuccacacuccac

SEQ ID NO: 16052 - RNA, 18 nt, Artificial Sequence
  Description of Artificial Sequence: Synthetic oligonucleotide
gcacaaaacccuccacac

SEQ ID NO: 16053 - RNA, 18 nt, Artificial Sequence
  Description of Artificial Sequence: Synthetic oligonucleotide
auucugcacaaaacccuc

SEQ ID NO: 16054 - RNA, 18 nt, Artificial Sequence
  Description of Artificial Sequence: Synthetic oligonucleotide
aucagauucugcacaaaa

SEQ ID NO: 16055 - RNA, 18 nt, Artificial Sequence
  Description of Artificial Sequence: Synthetic oligonucleotide
aguuaaucagauucugca

SEQ ID NO: 16056 - RNA, 18 nt, Artificial Sequence
  Description of Artificial Sequence: Synthetic oligonucleotide
caaagaguuaaucagauu

SEQ ID NO: 16057 - RNA, 18 nt, Artificial Sequence
  Description of Artificial Sequence: Synthetic oligonucleotide
cuuuucaaagaguuaauc

SEQ ID NO: 16058 - RNA, 18 nt, Artificial Sequence
  Description of Artificial Sequence: Synthetic oligonucleotide
gggcucuuuucaaagagu

SEQ ID NO: 16059 - RNA, 18 nt, Artificial Sequence
  Description of Artificial Sequence: Synthetic oligonucleotide
aggcuccagacugcaggg

SEQ ID NO: 16060 - RNA, 18 nt, Artificial Sequence
  Description of Artificial Sequence: Synthetic oligonucleotide
cgcgaggcuccagacugc

SEQ ID NO: 16061 - RNA, 18 nt, Artificial Sequence
  Description of Artificial Sequence: Synthetic oligonucleotide
cugcccgcgaggcuccag

SEQ ID NO: 16062 - RNA, 18 nt, Artificial Sequence
  Description of Artificial Sequence: Synthetic oligonucleotide
ccgcacugcccgcgaggc

SEQ ID NO: 16063 - RNA, 18 nt, Artificial Sequence
  Description of Artificial Sequence: Synthetic oligonucleotide
gggagccgcacugcccgc

SEQ ID NO: 16064 - RNA, 18 nt, Artificial Sequence
  Description of Artificial Sequence: Synthetic oligonucleotide
ugucugcagccaggaggg

SEQ ID NO: 16065 - RNA, 18 nt, Artificial Sequence
  Description of Artificial Sequence: Synthetic oligonucleotide
uuugucugcagccaggag

SEQ ID NO: 16066 - RNA, 18 nt, Artificial Sequence
  Description of Artificial Sequence: Synthetic oligonucleotide
gggccccacagcuguggg

SEQ ID NO: 16067 - RNA, 18 nt, Artificial Sequence
  Description of Artificial Sequence: Synthetic oligonucleotide
ugguuaggacaggguggg

SEQ ID NO: 16068 - RNA, 18 nt, Artificial Sequence
  Description of Artificial Sequence: Synthetic oligonucleotide
cggugguuaggacagggu

SEQ ID NO: 16069 - RNA, 18 nt, Artificial Sequence
  Description of Artificial Sequence: Synthetic oligonucleotide
aguuucggugguuaggac

SEQ ID NO: 16070 - RNA, 18 nt, Artificial Sequence
  Description of Artificial Sequence: Synthetic oligonucleotide
ucuucgaugaauaugcaa

SEQ ID NO: 16071 - RNA, 18 nt, Artificial Sequence
  Description of Artificial Sequence: Synthetic oligonucleotide
aguucucuucgaugaaua

SEQ ID NO: 16072 - RNA, 18 nt, Artificial Sequence
  Description of Artificial Sequence: Synthetic oligonucleotide
agaaaaguucucuucgau

SEQ ID NO: 16073 - RNA, 18 nt, Artificial Sequence
  Description of Artificial Sequence: Synthetic oligonucleotide
uucaaagaaaaguucucu

SEQ ID NO: 16074 - RNA, 18 nt, Artificial Sequence
  Description of Artificial Sequence: Synthetic oligonucleotide
gacauuucaaagaaaagu

SEQ ID NO: 16075 - RNA, 18 nt, Artificial Sequence
  Description of Artificial Sequence: Synthetic oligonucleotide
uuugggacauuucaaaga

SEQ ID NO: 16076 - RNA, 18 nt, Artificial Sequence
  Description of Artificial Sequence: Synthetic oligonucleotide
uuauguuugggacauuuc

SEQ ID NO: 16077 - RNA, 18 nt, Artificial Sequence
  Description of Artificial Sequence: Synthetic oligonucleotide
uucacgauggguccccac

SEQ ID NO: 16078 - RNA, 18 nt, Artificial Sequence
  Description of Artificial Sequence: Synthetic oligonucleotide
ccaucuucacgauggguc

SEQ ID NO: 16079 - RNA, 18 nt, Artificial Sequence
  Description of Artificial Sequence: Synthetic oligonucleotide
ccacgccaucuucacgau

SEQ ID NO: 16080 - RNA, 18 nt, Artificial Sequence
  Description of Artificial Sequence: Synthetic oligonucleotide
cagggccacgccaucuuc

SEQ ID NO: 16081 - RNA, 18 nt, Artificial Sequence
  Description of Artificial Sequence: Synthetic oligonucleotide
ccucucagggccacgcca

SEQ ID NO: 16082 - RNA, 18 nt, Artificial Sequence
  Description of Artificial Sequence: Synthetic oligonucleotide
ggcugccucucagggcca

SEQ ID NO: 16083 - RNA, 18 nt, Artificial Sequence
  Description of Artificial Sequence: Synthetic oligonucleotide
agaauggcugccucucag

SEQ ID NO: 16084 - RNA, 18 nt, Artificial Sequence
  Description of Artificial Sequence: Synthetic oligonucleotide
agaagagaauggcugccu

SEQ ID NO: 16085 - RNA, 18 nt, Artificial Sequence
  Description of Artificial Sequence: Synthetic oligonucleotide
uuggcagaagagaauggc

SEQ ID NO: 16086 - RNA, 18 nt, Artificial Sequence
  Description of Artificial Sequence: Synthetic oligonucleotide
cugguuuggcagaagaga

SEQ ID NO: 16087 - RNA, 18 nt, Artificial Sequence
  Description of Artificial Sequence: Synthetic oligonucleotide
ggaaccugguuuggcaga

SEQ ID NO: 16088 - RNA, 18 nt, Artificial Sequence
  Description of Artificial Sequence: Synthetic oligonucleotide
gaaccggaaccugguuug

SEQ ID NO: 16089 - RNA, 18 nt, Artificial Sequence
  Description of Artificial Sequence: Synthetic oligonucleotide
cuguggaaccggaaccug

SEQ ID NO: 16090 - RNA, 18 nt, Artificial Sequence
  Description of Artificial Sequence: Synthetic oligonucleotide
ggaagcuguggaaccgga

SEQ ID NO: 16091 - RNA, 18 nt, Artificial Sequence
  Description of Artificial Sequence: Synthetic oligonucleotide
ggacaggaagcuguggaa

SEQ ID NO: 16092 - RNA, 18 nt, Artificial Sequence
  Description of Artificial Sequence: Synthetic oligonucleotide
agacuggacaggaagcug

SEQ ID NO: 16093 - RNA, 18 nt, Artificial Sequence
  Description of Artificial Sequence: Synthetic oligonucleotide
gucgcagacuggacagga

SEQ ID NO: 16094 - RNA, 18 nt, Artificial Sequence
  Description of Artificial Sequence: Synthetic oligonucleotide
gggaagucgcagacugga

SEQ ID NO: 16095 - RNA, 18 nt, Artificial Sequence
  Description of Artificial Sequence: Synthetic oligonucleotide
gguggguucaggucaggg

SEQ ID NO: 16096 - RNA, 18 nt, Artificial Sequence
  Description of Artificial Sequence: Synthetic oligonucleotide
ggguggguucaggucagg

SEQ ID NO: 16097 - RNA, 18 nt, Artificial Sequence
  Description of Artificial Sequence: Synthetic oligonucleotide
cucuguaaggguccuggg

SEQ ID NO: 16098 - RNA, 18 nt, Artificial Sequence
  Description of Artificial Sequence: Synthetic oligonucleotide
gugcccuggugaggccaa

SEQ ID NO: 16099 - RNA, 18 nt, Artificial Sequence
  Description of Artificial Sequence: Synthetic oligonucleotide
cagaagugcccuggugag

SEQ ID NO: 16100 - RNA, 18 nt, Artificial Sequence
  Description of Artificial Sequence: Synthetic oligonucleotide
gaggucagaagugcccug

SEQ ID NO: 16101 - RNA, 18 nt, Artificial Sequence
  Description of Artificial Sequence: Synthetic oligonucleotide
aaagugaggucagaagug

SEQ ID NO: 16102 - RNA, 18 nt, Artificial Sequence
  Description of Artificial Sequence: Synthetic oligonucleotide
uugugaaagugaggucag

SEQ ID NO: 16103 - RNA, 18 nt, Artificial Sequence
  Description of Artificial Sequence: Synthetic oligonucleotide
uccuauugugaaagugag

SEQ ID NO: 16104 - RNA, 18 nt, Artificial Sequence
  Description of Artificial Sequence: Synthetic oligonucleotide
acugguccuauugugaaa

SEQ ID NO: 16105 - RNA, 18 nt, Artificial Sequence
  Description of Artificial Sequence: Synthetic oligonucleotide
ucaacacugguccuauug

SEQ ID NO: 16106 - RNA, 18 nt, Artificial Sequence
  Description of Artificial Sequence: Synthetic oligonucleotide
ggguaucaacacuggucc

SEQ ID NO: 16107 - RNA, 18 nt, Artificial Sequence
  Description of Artificial Sequence: Synthetic oligonucleotide
aggcuggguaucaacacu

SEQ ID NO: 16108 - RNA, 18 nt, Artificial Sequence
  Description of Artificial Sequence: Synthetic oligonucleotide
ccaagaggcuggguauca

SEQ ID NO: 16109 - RNA, 18 nt, Artificial Sequence
  Description of Artificial Sequence: Synthetic oligonucleotide
gaacaccaagaggcuggg

SEQ ID NO: 16110 - RNA, 18 nt, Artificial Sequence
  Description of Artificial Sequence: Synthetic oligonucleotide
gggaugaacaccaagagg

SEQ ID NO: 16111 - RNA, 18 nt, Artificial Sequence
  Description of Artificial Sequence: Synthetic oligonucleotide
cuugagggaugaacacca

SEQ ID NO: 16112 - RNA, 18 nt, Artificial Sequence
  Description of Artificial Sequence: Synthetic oligonucleotide
ugcuucuugagggaugaa

SEQ ID NO: 16113 - RNA, 18 nt, Artificial Sequence
  Description of Artificial Sequence: Synthetic oligonucleotide
gccagugcuucuugaggg

SEQ ID NO: 16114 - RNA, 18 nt, Artificial Sequence
  Description of Artificial Sequence: Synthetic oligonucleotide
uuucugccagugcuucuu

SEQ ID NO: 16115 - RNA, 18 nt, Artificial Sequence
  Description of Artificial Sequence: Synthetic oligonucleotide
cuggguuucugccagugc

SEQ ID NO: 16116 - RNA, 18 nt, Artificial Sequence
  Description of Artificial Sequence: Synthetic oligonucleotide
gauuccuggguuucugcc

SEQ ID NO: 16117 - RNA, 18 nt, Artificial Sequence
  Description of Artificial Sequence: Synthetic oligonucleotide
aauuugauuccuggguuu

SEQ ID NO: 16118 - RNA, 18 nt, Artificial Sequence
  Description of Artificial Sequence: Synthetic oligonucleotide
ugcccaauuugauuccug

SEQ ID NO: 16119 - RNA, 18 nt, Artificial Sequence
  Description of Artificial Sequence: Synthetic oligonucleotide
uuuugugcccaauuugau

SEQ ID NO: 16120 - RNA, 18 nt, Artificial Sequence
  Description of Artificial Sequence: Synthetic oligonucleotide
accauuuuugugcccaau

SEQ ID NO: 16121 - RNA, 18 nt, Artificial Sequence
  Description of Artificial Sequence: Synthetic oligonucleotide
uccuuaccauuuuugugc

SEQ ID NO: 16122 - RNA, 18 nt, Artificial Sequence
  Description of Artificial Sequence: Synthetic oligonucleotide
ccauuuccuuaccauuuu

SEQ ID NO: 16123 - RNA, 18 nt, Artificial Sequence
  Description of Artificial Sequence: Synthetic oligonucleotide
cuuugccauuuccuuacc

SEQ ID NO: 16124 - RNA, 18 nt, Artificial Sequence
  Description of Artificial Sequence: Synthetic oligonucleotide
aaauacuuugccauuucc

SEQ ID NO: 16125 - RNA, 18 nt, Artificial Sequence
  Description of Artificial Sequence: Synthetic oligonucleotide
guucuaaauacuuugcca

SEQ ID NO: 16126 - RNA, 18 nt, Artificial Sequence
  Description of Artificial Sequence: Synthetic oligonucleotide
gcgaaguucuaaauacuu

SEQ ID NO: 16127 - RNA, 18 nt, Artificial Sequence
  Description of Artificial Sequence: Synthetic oligonucleotide
agcgggcgaaguucuaaa

SEQ ID NO: 16128 - RNA, 18 nt, Artificial Sequence
  Description of Artificial Sequence: Synthetic oligonucleotide
caauuagcgggcgaaguu

SEQ ID NO: 16129 - RNA, 18 nt, Artificial Sequence
  Description of Artificial Sequence: Synthetic oligonucleotide
aaacacaauuagcgggcg

SEQ ID NO: 16130 - RNA, 18 nt, Artificial Sequence
  Description of Artificial Sequence: Synthetic oligonucleotide
uggagaaacacaauuagc

SEQ ID NO: 16131 - RNA, 18 nt, Artificial Sequence
  Description of Artificial Sequence: Synthetic oligonucleotide
gucccuggagaaacacaa

SEQ ID NO: 16132 - RNA, 18 nt, Artificial Sequence
  Description of Artificial Sequence: Synthetic oligonucleotide
aaacagucccuggagaaa

SEQ ID NO: 16133 - RNA, 18 nt, Artificial Sequence
  Description of Artificial Sequence: Synthetic oligonucleotide
gaggaaaacagucccugg

SEQ ID NO: 16134 - RNA, 18 nt, Artificial Sequence
  Description of Artificial Sequence: Synthetic oligonucleotide
uguuugaggaaaacaguc

SEQ ID NO: 16135 - RNA, 18 nt, Artificial Sequence
  Description of Artificial Sequence: Synthetic oligonucleotide
gaggauguuugaggaaaa

SEQ ID NO: 16136 - RNA, 18 nt, Artificial Sequence
  Description of Artificial Sequence: Synthetic oligonucleotide
uuucagaggauguuugag

SEQ ID NO: 16137 - RNA, 18 nt, Artificial Sequence
  Description of Artificial Sequence: Synthetic oligonucleotide
caggauuucagaggaugu

SEQ ID NO: 16138 - RNA, 18 nt, Artificial Sequence
  Description of Artificial Sequence: Synthetic oligonucleotide
aggaccaggauuucagag

SEQ ID NO: 16139 - RNA, 18 nt, Artificial Sequence
  Description of Artificial Sequence: Synthetic oligonucleotide
gauauaggaccaggauuu

SEQ ID NO: 16140 - RNA, 18 nt, Artificial Sequence
  Description of Artificial Sequence: Synthetic oligonucleotide
cugcugauauaggaccag

SEQ ID NO: 16141 - RNA, 18 nt, Artificial Sequence
  Description of Artificial Sequence: Synthetic oligonucleotide
auucccugcugauauagg

SEQ ID NO: 16142 - RNA, 18 nt, Artificial Sequence
  Description of Artificial Sequence: Synthetic oligonucleotide
gccucauucccugcugau

SEQ ID NO: 16143 - RNA, 18 nt, Artificial Sequence
  Description of Artificial Sequence: Synthetic oligonucleotide
cuguggccucauucccug

SEQ ID NO: 16144 - RNA, 18 nt, Artificial Sequence
  Description of Artificial Sequence: Synthetic oligonucleotide
ucagucuguggccucauu

SEQ ID NO: 16145 - RNA, 18 nt, Artificial Sequence
  Description of Artificial Sequence: Synthetic oligonucleotide
ucucaucagucuguggcc

SEQ ID NO: 16146 - RNA, 18 nt, Artificial Sequence
  Description of Artificial Sequence: Synthetic oligonucleotide
uuuccucucaucagucug

SEQ ID NO: 16147 - RNA, 18 nt, Artificial Sequence
  Description of Artificial Sequence: Synthetic oligonucleotide
uaaaauuuccucucauca

SEQ ID NO: 16148 - RNA, 18 nt, Artificial Sequence
  Description of Artificial Sequence: Synthetic oligonucleotide
uaaaauaaaauuuccucu

SEQ ID NO: 16149 - RNA, 18 nt, Artificial Sequence
  Description of Artificial Sequence: Synthetic oligonucleotide
auagcuaaaauaaaauuu

SEQ ID NO: 16150 - RNA, 18 nt, Artificial Sequence
  Description of Artificial Sequence: Synthetic oligonucleotide
uggaaauagcuaaaauaa

SEQ ID NO: 16151 - RNA, 18 nt, Artificial Sequence
  Description of Artificial Sequence: Synthetic oligonucleotide
aaauguggaaauagcuaa

SEQ ID NO: 16152 - RNA, 18 nt, Artificial Sequence
  Description of Artificial Sequence: Synthetic oligonucleotide
gagaaaaauguggaaaua

SEQ ID NO: 16153 - RNA, 18 nt, Artificial Sequence
  Description of Artificial Sequence: Synthetic oligonucleotide
ugaaugagaaaaaugugg

SEQ ID NO: 16154 - RNA, 18 nt, Artificial Sequence
  Description of Artificial Sequence: Synthetic oligonucleotide
ggaccugaaugagaaaaa

SEQ ID NO: 16155 - RNA, 18 nt, Artificial Sequence
  Description of Artificial Sequence: Synthetic oligonucleotide
uuagaggaccugaaugag

SEQ ID NO: 16156 - RNA, 18 nt, Artificial Sequence
  Description of Artificial Sequence: Synthetic oligonucleotide
ccacauuagaggaccuga

SEQ ID NO: 16157 - RNA, 18 nt, Artificial Sequence
  Description of Artificial Sequence: Synthetic oligonucleotide
acuaaccacauuagagga

SEQ ID NO: 16158 - RNA, 18 nt, Artificial Sequence
  Description of Artificial Sequence: Synthetic oligonucleotide
ccacaacuaaccacauua

SEQ ID NO: 16159 - RNA, 18 nt, Artificial Sequence
  Description of Artificial Sequence: Synthetic oligonucleotide
ucaggccacaacuaacca

SEQ ID NO: 16160 - RNA, 18 nt, Artificial Sequence
  Description of Artificial Sequence: Synthetic oligonucleotide
cauuuucaggccacaacu

SEQ ID NO: 16161 - RNA, 18 nt, Artificial Sequence
  Description of Artificial Sequence: Synthetic oligonucleotide
aauaucauuuucaggcca

SEQ ID NO: 16162 - RNA, 18 nt, Artificial Sequence
  Description of Artificial Sequence: Synthetic oligonucleotide
uuggaaauaucauuuuca

SEQ ID NO: 16163 - RNA, 18 nt, Artificial Sequence
  Description of Artificial Sequence: Synthetic oligonucleotide
uucauuuggaaauaucau

SEQ ID NO: 16164 - RNA, 18 nt, Artificial Sequence
  Description of Artificial Sequence: Synthetic oligonucleotide
uccuauucauuuggaaau

SEQ ID NO: 16165 - RNA, 18 nt, Artificial Sequence
  Description of Artificial Sequence: Synthetic oligonucleotide
uuccuuccuauucauuug

SEQ ID NO: 16166 - RNA, 18 nt, Artificial Sequence
  Description of Artificial Sequence: Synthetic oligonucleotide
uuuccuuccuuccuauuc

SEQ ID NO: 16167 - RNA, 18 nt, Artificial Sequence
  Description of Artificial Sequence: Synthetic oligonucleotide
aacaauuuccuuccuucc

SEQ ID NO: 16168 - RNA, 18 nt, Artificial Sequence
  Description of Artificial Sequence: Synthetic oligonucleotide
acaaaaacaauuuccuuc

SEQ ID NO: 16169 - RNA, 18 nt, Artificial Sequence
  Description of Artificial Sequence: Synthetic oligonucleotide
aaacaacaaaaacaauuu

SEQ ID NO: 16170 - RNA, 18 nt, Artificial Sequence
  Description of Artificial Sequence: Synthetic oligonucleotide
aucuuaaacaacaaaaac

SEQ ID NO: 16171 - RNA, 18 nt, Artificial Sequence
  Description of Artificial Sequence: Synthetic oligonucleotide
cuuccaucuuaaacaaca

SEQ ID NO: 16172 - RNA, 18 nt, Artificial Sequence
  Description of Artificial Sequence: Synthetic oligonucleotide
auuuccuuccaucuuaaa

SEQ ID NO: 16173 - RNA, 18 nt, Artificial Sequence
  Description of Artificial Sequence: Synthetic oligonucleotide
ccuauauuuccuuccauc

SEQ ID NO: 16174 - RNA, 18 nt, Artificial Sequence
  Description of Artificial Sequence: Synthetic oligonucleotide
augcaccuauauuuccuu

SEQ ID NO: 16175 - RNA, 18 nt, Artificial Sequence
  Description of Artificial Sequence: Synthetic oligonucleotide
uuuaaaugcaccuauauu

SEQ ID NO: 16176 - RNA, 18 nt, Artificial Sequence
  Description of Artificial Sequence: Synthetic oligonucleotide
cauuuuuuaaaugcaccu

SEQ ID NO: 16177 - RNA, 18 nt, Artificial Sequence
  Description of Artificial Sequence: Synthetic oligonucleotide
agcuccauuuuuuaaaug

SEQ ID NO: 16178 - RNA, 18 nt, Artificial Sequence
  Description of Artificial Sequence: Synthetic oligonucleotide
aaccaagcuccauuuuuu

SEQ ID NO: 16179 - RNA, 18 nt, Artificial Sequence
  Description of Artificial Sequence: Synthetic oligonucleotide
caugcaaccaagcuccau

SEQ ID NO: 16180 - RNA, 18 nt, Artificial Sequence
  Description of Artificial Sequence: Synthetic oligonucleotide
aaaaucaugcaaccaagc

SEQ ID NO: 16181 - RNA, 18 nt, Artificial Sequence
  Description of Artificial Sequence: Synthetic oligonucleotide
gagcgaaaaucaugcaac

SEQ ID NO: 16182 - RNA, 18 nt, Artificial Sequence
  Description of Artificial Sequence: Synthetic oligonucleotide
cucaagagcgaaaaucau

SEQ ID NO: 16183 - RNA, 18 nt, Artificial Sequence
  Description of Artificial Sequence: Synthetic oligonucleotide
gaugacucaagagcgaaa

SEQ ID NO: 16184 - RNA, 18 nt, Artificial Sequence
  Description of Artificial Sequence: Synthetic oligonucleotide
ggcuagaugacucaagag

SEQ ID NO: 16185 - RNA, 18 nt, Artificial Sequence
  Description of Artificial Sequence: Synthetic oligonucleotide
uagagggcuagaugacuc

SEQ ID NO: 16186 - RNA, 18 nt, Artificial Sequence
  Description of Artificial Sequence: Synthetic oligonucleotide
aucauuagagggcuagau

SEQ ID NO: 16187 - RNA, 18 nt, Artificial Sequence
  Description of Artificial Sequence: Synthetic oligonucleotide
aggcaaucauuagagggc

SEQ ID NO: 16188 - RNA, 18 nt, Artificial Sequence
  Description of Artificial Sequence: Synthetic oligonucleotide
guaugaggcaaucauuag

SEQ ID NO: 16189 - RNA, 18 nt, Artificial Sequence
  Description of Artificial Sequence: Synthetic oligonucleotide
caccgguaugaggcaauc

SEQ ID NO: 16190 - RNA, 18 nt, Artificial Sequence
  Description of Artificial Sequence: Synthetic oligonucleotide
guaaucaccgguaugagg

SEQ ID NO: 16191 - RNA, 18 nt, Artificial Sequence
  Description of Artificial Sequence: Synthetic oligonucleotide
cgcucguaaucaccggua

SEQ ID NO: 16192 - RNA, 18 nt, Artificial Sequence
  Description of Artificial Sequence: Synthetic oligonucleotide
aaagccgcucguaaucac

SEQ ID NO: 16193 - RNA, 18 nt, Artificial Sequence
  Description of Artificial Sequence: Synthetic oligonucleotide
caugaaaagccgcucgua

SEQ ID NO: 16194 - RNA, 18 nt, Artificial Sequence
  Description of Artificial Sequence: Synthetic oligonucleotide
gggucaugaaaagccgcu

SEQ ID NO: 16195 - RNA, 18 nt, Artificial Sequence
  Description of Artificial Sequence: Synthetic oligonucleotide
aaaugguacauauggaag

SEQ ID NO: 16196 - RNA, 18 nt, Artificial Sequence
  Description of Artificial Sequence: Synthetic oligonucleotide
uuuuaaaaugguacauau

SEQ ID NO: 16197 - RNA, 18 nt, Artificial Sequence
  Description of Artificial Sequence: Synthetic oligonucleotide
cagcauuuuaaaauggua

SEQ ID NO: 16198 - RNA, 18 nt, Artificial Sequence
  Description of Artificial Sequence: Synthetic oligonucleotide
guaaucagcauuuuaaaa

SEQ ID NO: 16199 - RNA, 18 nt, Artificial Sequence
  Description of Artificial Sequence: Synthetic oligonucleotide
aagaaguaaucagcauuu

SEQ ID NO: 16200 - RNA, 18 nt, Artificial Sequence
  Description of Artificial Sequence: Synthetic oligonucleotide
uucucaagaaguaaucag

SEQ ID NO: 16201 - RNA, 18 nt, Artificial Sequence
  Description of Artificial Sequence: Synthetic oligonucleotide
ucuuauucucaagaagua

SEQ ID NO: 16202 - RNA, 18 nt, Artificial Sequence
  Description of Artificial Sequence: Synthetic oligonucleotide
gcuucucuuauucucaag

SEQ ID NO: 16203 - RNA, 18 nt, Artificial Sequence
  Description of Artificial Sequence: Synthetic oligonucleotide
auuaggcuucucuuauuc

SEQ ID NO: 16204 - RNA, 18 nt, Artificial Sequence
  Description of Artificial Sequence: Synthetic oligonucleotide
cugaaauuaggcuucucu

SEQ ID NO: 16205 - RNA, 18 nt, Artificial Sequence
  Description of Artificial Sequence: Synthetic oligonucleotide
auauucugaaauuaggcu

SEQ ID NO: 16206 - RNA, 18 nt, Artificial Sequence
  Description of Artificial Sequence: Synthetic oligonucleotide
uaaugauauucugaaauu

SEQ ID NO: 16207 - RNA, 18 nt, Artificial Sequence
  Description of Artificial Sequence: Synthetic oligonucleotide
uacccuaaugauauucug

SEQ ID NO: 16208 - RNA, 18 nt, Artificial Sequence
  Description of Artificial Sequence: Synthetic oligonucleotide
auagguacccuaaugaua

SEQ ID NO: 16209 - RNA, 18 nt, Artificial Sequence
  Description of Artificial Sequence: Synthetic oligonucleotide
cuucaauagguacccuaa

SEQ ID NO: 16210 - RNA, 18 nt, Artificial Sequence
  Description of Artificial Sequence: Synthetic oligonucleotide
caagacuucaauagguac

SEQ ID NO: 16211 - RNA, 18 nt, Artificial Sequence
  Description of Artificial Sequence: Synthetic oligonucleotide
gcagucaagacuucaaua

SEQ ID NO: 16212 - RNA, 18 nt, Artificial Sequence
  Description of Artificial Sequence: Synthetic oligonucleotide
uaugugcagucaagacuu

SEQ ID NO: 16213 - RNA, 18 nt, Artificial Sequence
  Description of Artificial Sequence: Synthetic oligonucleotide
cuaaauaugugcagucaa

SEQ ID NO: 16214 - RNA, 18 nt, Artificial Sequence
  Description of Artificial Sequence: Synthetic oligonucleotide
guaugcuaaauaugugca

SEQ ID NO: 16215 - RNA, 18 nt, Artificial Sequence
  Description of Artificial Sequence: Synthetic oligonucleotide
agggaguaugcuaaauau

SEQ ID NO: 16216 - RNA, 18 nt, Artificial Sequence
  Description of Artificial Sequence: Synthetic oligonucleotide
uucccagggaguaugcua

SEQ ID NO: 16217 - RNA, 18 nt, Artificial Sequence
  Description of Artificial Sequence: Synthetic oligonucleotide
uauaauucccagggagua

SEQ ID NO: 16218 - RNA, 18 nt, Artificial Sequence
  Description of Artificial Sequence: Synthetic oligonucleotide
uaaaauauaauucccagg

SEQ ID NO: 16219 - RNA, 18 nt, Artificial Sequence
  Description of Artificial Sequence: Synthetic oligonucleotide
guccuuaaaauauaauuc

SEQ ID NO: 16220 - RNA, 18 nt, Artificial Sequence
  Description of Artificial Sequence: Synthetic oligonucleotide
aaaauguccuuaaaauau

SEQ ID NO: 16221 - RNA, 18 nt, Artificial Sequence
  Description of Artificial Sequence: Synthetic oligonucleotide
auagaaaaauguccuuaa

SEQ ID NO: 16222 - RNA, 18 nt, Artificial Sequence
  Description of Artificial Sequence: Synthetic oligonucleotide
auuuaauagaaaaauguc

SEQ ID NO: 16223 - RNA, 18 nt, Artificial Sequence
  Description of Artificial Sequence: Synthetic oligonucleotide
caaugauuuaauagaaaa

SEQ ID NO: 16224 - RNA, 18 nt, Artificial Sequence
  Description of Artificial Sequence: Synthetic oligonucleotide
auaugcaaugauuuaaua

SEQ ID NO: 16225 - RNA, 18 nt, Artificial Sequence
  Description of Artificial Sequence: Synthetic oligonucleotide
cuuccauaugcaaugauu

SEQ ID NO: 16226 - RNA, 18 nt, Artificial Sequence
  Description of Artificial Sequence: Synthetic oligonucleotide
aguuucuuccauaugcaa

SEQ ID NO: 16227 - RNA, 18 nt, Artificial Sequence
  Description of Artificial Sequence: Synthetic oligonucleotide
uauugaguuucuuccaua

SEQ ID NO: 16228 - RNA, 18 nt, Artificial Sequence
  Description of Artificial Sequence: Synthetic oligonucleotide
uauuauauugaguuucuu

SEQ ID NO: 16229 - RNA, 18 nt, Artificial Sequence
  Description of Artificial Sequence: Synthetic oligonucleotide
ucagcuauuauauugagu

SEQ ID NO: 16230 - RNA, 18 nt, Artificial Sequence
  Description of Artificial Sequence: Synthetic oligonucleotide
aaauaucagcuauuauau

SEQ ID NO: 16231 - RNA, 18 nt, Artificial Sequence
  Description of Artificial Sequence: Synthetic oligonucleotide
caaguaaauaucagcuau

SEQ ID NO: 16232 - RNA, 18 nt, Artificial Sequence
  Description of Artificial Sequence: Synthetic oligonucleotide
gaacccaaguaaauauca

SEQ ID NO: 16233 - RNA, 18 nt, Artificial Sequence
  Description of Artificial Sequence: Synthetic oligonucleotide
auuaagaacccaaguaaa

SEQ ID NO: 16234 - RNA, 18 nt, Artificial Sequence
  Description of Artificial Sequence: Synthetic oligonucleotide
uucugauuaagaacccaa

SEQ ID NO: 16235 - RNA, 18 nt, Artificial Sequence
  Description of Artificial Sequence: Synthetic oligonucleotide
caauguucugauuaagaa

SEQ ID NO: 16236 - RNA, 18 nt, Artificial Sequence
  Description of Artificial Sequence: Synthetic oligonucleotide
acagccaauguucugauu

SEQ ID NO: 16237 - RNA, 18 nt, Artificial Sequence
  Description of Artificial Sequence: Synthetic oligonucleotide
aucacacagccaauguuc

SEQ ID NO: 16238 - RNA, 18 nt, Artificial Sequence
  Description of Artificial Sequence: Synthetic oligonucleotide
ugaaaaucacacagccaa

SEQ ID NO: 16239 - RNA, 18 nt, Artificial Sequence
  Description of Artificial Sequence: Synthetic oligonucleotide
aaucaugaaaaucacaca

SEQ ID NO: 16240 - RNA, 18 nt, Artificial Sequence
  Description of Artificial Sequence: Synthetic oligonucleotide
aucauaaucaugaaaauc

SEQ ID NO: 16241 - RNA, 18 nt, Artificial Sequence
  Description of Artificial Sequence: Synthetic oligonucleotide
ugaaaaucauaaucauga

SEQ ID NO: 16242 - RNA, 18 nt, Artificial Sequence
  Description of Artificial Sequence: Synthetic oligonucleotide
ugcaaugaaaaucauaau

SEQ ID NO: 16243 - RNA, 18 nt, Artificial Sequence
  Description of Artificial Sequence: Synthetic oligonucleotide
uuaauugcaaugaaaauc

SEQ ID NO: 16244 - RNA, 18 nt, Artificial Sequence
  Description of Artificial Sequence: Synthetic oligonucleotide
ucaacuuaauugcaauga

SEQ ID NO: 16245 - RNA, 18 nt, Artificial Sequence
  Description of Artificial Sequence: Synthetic oligonucleotide
aaacaucaacuuaauugc

SEQ ID NO: 16246 - RNA, 18 nt, Artificial Sequence
  Description of Artificial Sequence: Synthetic oligonucleotide
cuacaaaacaucaacuua

SEQ ID NO: 16247 - RNA, 18 nt, Artificial Sequence
  Description of Artificial Sequence: Synthetic oligonucleotide
acugucuacaaaacauca

SEQ ID NO: 16248 - RNA, 18 nt, Artificial Sequence
  Description of Artificial Sequence: Synthetic oligonucleotide
auuucacugucuacaaaa

SEQ ID NO: 16249 - RNA, 18 nt, Artificial Sequence
  Description of Artificial Sequence: Synthetic oligonucleotide
ugguaauuucacugucua

SEQ ID NO: 16250 - RNA, 18 nt, Artificial Sequence
  Description of Artificial Sequence: Synthetic oligonucleotide
guagaugguaauuucacu

SEQ ID NO: 16251 - RNA, 18 nt, Artificial Sequence
  Description of Artificial Sequence: Synthetic oligonucleotide
uuggaguagaugguaauu

SEQ ID NO: 16252 - RNA, 18 nt, Artificial Sequence
  Description of Artificial Sequence: Synthetic oligonucleotide
aucuuuuggaguagaugg

SEQ ID NO: 16253 - RNA, 18 nt, Artificial Sequence
  Description of Artificial Sequence: Synthetic oligonucleotide
uugcaaucuuuuggagua

SEQ ID NO: 16254 - RNA, 18 nt, Artificial Sequence
  Description of Artificial Sequence: Synthetic oligonucleotide
cuauuuugcaaucuuuug

SEQ ID NO: 16255 - RNA, 18 nt, Artificial Sequence
  Description of Artificial Sequence: Synthetic oligonucleotide
aaauucuauuuugcaauc

SEQ ID NO: 16256 - RNA, 18 nt, Artificial Sequence
  Description of Artificial Sequence: Synthetic oligonucleotide
agguuaaauucuauuuug

SEQ ID NO: 16257 - RNA, 18 nt, Artificial Sequence
  Description of Artificial Sequence: Synthetic oligonucleotide
cucuaagguuaaauucua

SEQ ID NO: 16258 - RNA, 18 nt, Artificial Sequence
  Description of Artificial Sequence: Synthetic oligonucleotide
auuggcucuaagguuaaa

SEQ ID NO: 16259 - RNA, 18 nt, Artificial Sequence
  Description of Artificial Sequence: Synthetic oligonucleotide
ccugcauuggcucuaagg

SEQ ID NO: 16260 - RNA, 18 nt, Artificial Sequence
  Description of Artificial Sequence: Synthetic oligonucleotide
uuuucccugcauuggcuc

SEQ ID NO: 16261 - RNA, 18 nt, Artificial Sequence
  Description of Artificial Sequence: Synthetic oligonucleotide
acaaguuuucccugcauu

SEQ ID NO: 16262 - RNA, 18 nt, Artificial Sequence
  Description of Artificial Sequence: Synthetic oligonucleotide
cagaaacaaguuuucccu

SEQ ID NO: 16263 - RNA, 18 nt, Artificial Sequence
  Description of Artificial Sequence: Synthetic oligonucleotide
accugcagaaacaaguuu

SEQ ID NO: 16264 - RNA, 18 nt, Artificial Sequence
  Description of Artificial Sequence: Synthetic oligonucleotide
aaugcaccugcagaaaca

SEQ ID NO: 16265 - RNA, 18 nt, Artificial Sequence
  Description of Artificial Sequence: Synthetic oligonucleotide
caaaaaaugcaccugcag

SEQ ID NO: 16266 - RNA, 18 nt, Artificial Sequence
  Description of Artificial Sequence: Synthetic oligonucleotide
aguuucaaaaaaugcacc

SEQ ID NO: 16267 - RNA, 18 nt, Artificial Sequence
  Description of Artificial Sequence: Synthetic oligonucleotide
guugaaguuucaaaaaau

SEQ ID NO: 16268 - RNA, 18 nt, Artificial Sequence
  Description of Artificial Sequence: Synthetic oligonucleotide
uaucuguugaaguuucaa

SEQ ID NO: 16269 - RNA, 18 nt, Artificial Sequence
  Description of Artificial Sequence: Synthetic oligonucleotide
ccugcuaucuguugaagu

SEQ ID NO: 16270 - RNA, 18 nt, Artificial Sequence
  Description of Artificial Sequence: Synthetic oligonucleotide
uucccccugcuaucuguu

SEQ ID NO: 16271 - RNA, 18 nt, Artificial Sequence
  Description of Artificial Sequence: Synthetic oligonucleotide
uuuuuuucccccugcuau

SEQ ID NO: 16272 - RNA, 18 nt, Artificial Sequence
  Description of Artificial Sequence: Synthetic oligonucleotide
ucacuuuuuuuucccccu

SEQ ID NO: 16273 - RNA, 18 nt, Artificial Sequence
  Description of Artificial Sequence: Synthetic oligonucleotide
uucugucacuuuuuuuuc

SEQ ID NO: 16274 - RNA, 18 nt, Artificial Sequence
  Description of Artificial Sequence: Synthetic oligonucleotide
gauccuucugucacuuuu

SEQ ID NO: 16275 - RNA, 18 nt, Artificial Sequence
  Description of Artificial Sequence: Synthetic oligonucleotide
acugugauccuucuguca

SEQ ID NO: 16276 - RNA, 18 nt, Artificial Sequence
  Description of Artificial Sequence: Synthetic oligonucleotide
gcugaacugugauccuuc

SEQ ID NO: 16277 - RNA, 18 nt, Artificial Sequence
  Description of Artificial Sequence: Synthetic oligonucleotide
auacugcugaacugugau

SEQ ID NO: 16278 - RNA, 18 nt, Artificial Sequence
  Description of Artificial Sequence: Synthetic oligonucleotide
aauucauacugcugaacu

SEQ ID NO: 16279 - RNA, 18 nt, Artificial Sequence
  Description of Artificial Sequence: Synthetic oligonucleotide
cagacaauucauacugcu

SEQ ID NO: 16280 - RNA, 18 nt, Artificial Sequence
  Description of Artificial Sequence: Synthetic oligonucleotide
gccagcagacaauucaua

SEQ ID NO: 16281 - RNA, 18 nt, Artificial Sequence
  Description of Artificial Sequence: Synthetic oligonucleotide
aggcugccagcagacaau

SEQ ID NO: 16282 - RNA, 18 nt, Artificial Sequence
  Description of Artificial Sequence: Synthetic oligonucleotide
uugcaaggcugccagcag

SEQ ID NO: 16283 - RNA, 18 nt, Artificial Sequence
  Description of Artificial Sequence: Synthetic oligonucleotide
ccagauugcaaggcugcc

SEQ ID NO: 16284 - RNA, 18 nt, Artificial Sequence
  Description of Artificial Sequence: Synthetic oligonucleotide
gcacaccagauugcaagg

SEQ ID NO: 16285 - RNA, 18 nt, Artificial Sequence
  Description of Artificial Sequence: Synthetic oligonucleotide
ugccugcacaccagauug

SEQ ID NO: 16286 - RNA, 18 nt, Artificial Sequence
  Description of Artificial Sequence: Synthetic oligonucleotide
cucacugccugcacacca

SEQ ID NO: 16287 - RNA, 18 nt, Artificial Sequence
  Description of Artificial Sequence: Synthetic oligonucleotide
acaaucucacugccugca

SEQ ID NO: 16288 - RNA, 18 nt, Artificial Sequence
  Description of Artificial Sequence: Synthetic oligonucleotide
acaccacaaucucacugc

SEQ ID NO: 16289 - RNA, 18 nt, Artificial Sequence
  Description of Artificial Sequence: Synthetic oligonucleotide
cauguacaccacaaucuc

SEQ ID NO: 16290 - RNA, 18 nt, Artificial Sequence
  Description of Artificial Sequence: Synthetic oligonucleotide
ggugacauguacaccaca

SEQ ID NO: 16291 - RNA, 18 nt, Artificial Sequence
  Description of Artificial Sequence: Synthetic oligonucleotide
aaucaggugacauguaca

SEQ ID NO: 16292 - RNA, 18 nt, Artificial Sequence
  Description of Artificial Sequence: Synthetic oligonucleotide
uguaguccugguggcaug

SEQ ID NO: 16293 - RNA, 18 nt, Artificial Sequence
  Description of Artificial Sequence: Synthetic oligonucleotide
gccccuguaguccuggug

SEQ ID NO: 16294 - RNA, 18 nt, Artificial Sequence
  Description of Artificial Sequence: Synthetic oligonucleotide
acucugccccuguagucc

SEQ ID NO: 16295 - RNA, 18 nt, Artificial Sequence
  Description of Artificial Sequence: Synthetic oligonucleotide
gagacacucugccccugu

SEQ ID NO: 16296 - RNA, 18 nt, Artificial Sequence
  Description of Artificial Sequence: Synthetic oligonucleotide
cagaggagacacucugcc

SEQ ID NO: 16297 - RNA, 18 nt, Artificial Sequence
  Description of Artificial Sequence: Synthetic oligonucleotide
gcugccagaggagacacu

SEQ ID NO: 16298 - RNA, 18 nt, Artificial Sequence
  Description of Artificial Sequence: Synthetic oligonucleotide
ucagagcugccagaggag

SEQ ID NO: 16299 - RNA, 18 nt, Artificial Sequence
  Description of Artificial Sequence: Synthetic oligonucleotide
ugaucucagagcugccag

SEQ ID NO: 16300 - RNA, 18 nt, Artificial Sequence
  Description of Artificial Sequence: Synthetic oligonucleotide
ggauuugaucucagagcu

SEQ ID NO: 16301 - RNA, 18 nt, Artificial Sequence
  Description of Artificial Sequence: Synthetic oligonucleotide
ucaucggauuugaucuca

SEQ ID NO: 16302 - RNA, 18 nt, Artificial Sequence
  Description of Artificial Sequence: Synthetic oligonucleotide
ccucgucaucggauuuga

SEQ ID NO: 16303 - RNA, 18 nt, Artificial Sequence
  Description of Artificial Sequence: Synthetic oligonucleotide
aucacccucgucaucgga

SEQ ID NO: 16304 - RNA, 18 nt, Artificial Sequence
  Description of Artificial Sequence: Synthetic oligonucleotide
uucucaucacccucguca

SEQ ID NO: 16305 - RNA, 18 nt, Artificial Sequence
  Description of Artificial Sequence: Synthetic oligonucleotide
gcagguucucaucacccu

SEQ ID NO: 16306 - RNA, 18 nt, Artificial Sequence
  Description of Artificial Sequence: Synthetic oligonucleotide
gucuugcagguucucauc

SEQ ID NO: 16307 - RNA, 18 nt, Artificial Sequence
  Description of Artificial Sequence: Synthetic oligonucleotide
uucgugucuugcagguuc

SEQ ID NO: 16308 - RNA, 18 nt, Artificial Sequence
  Description of Artificial Sequence: Synthetic oligonucleotide
aagauuucgugucuugca

SEQ ID NO: 16309 - RNA, 18 nt, Artificial Sequence
  Description of Artificial Sequence: Synthetic oligonucleotide
cuccgaagauuucguguc

SEQ ID NO: 16310 - RNA, 18 nt, Artificial Sequence
  Description of Artificial Sequence: Synthetic oligonucleotide
uuguccuccgaagauuuc

SEQ ID NO: 16311 - RNA, 18 nt, Artificial Sequence
  Description of Artificial Sequence: Synthetic oligonucleotide
auuucuuguccuccgaag

SEQ ID NO: 16312 - RNA, 18 nt, Artificial Sequence
  Description of Artificial Sequence: Synthetic oligonucleotide
aucuaauuucuuguccuc

SEQ ID NO: 16313 - RNA, 18 nt, Artificial Sequence
  Description of Artificial Sequence: Synthetic oligonucleotide
ucgucaucuaauuucuug

SEQ ID NO: 16314 - RNA, 18 nt, Artificial Sequence
  Description of Artificial Sequence: Synthetic oligonucleotide
ucuugucgucaucuaauu

SEQ ID NO: 16315 - RNA, 18 nt, Artificial Sequence
  Description of Artificial Sequence: Synthetic oligonucleotide
auccuucuugucgucauc

SEQ ID NO: 16316 - RNA, 18 nt, Artificial Sequence
  Description of Artificial Sequence: Synthetic oligonucleotide
uugauauccuucuugucg

SEQ ID NO: 16317 - RNA, 18 nt, Artificial Sequence
  Description of Artificial Sequence: Synthetic oligonucleotide
uugauuugauauccuucu

SEQ ID NO: 16318 - RNA, 18 nt, Artificial Sequence
  Description of Artificial Sequence: Synthetic oligonucleotide
aguaauugauuugauauc

SEQ ID NO: 16319 - RNA, 18 nt, Artificial Sequence
  Description of Artificial Sequence: Synthetic oligonucleotide
uucacgauggguccccac

SEQ ID NO: 16320 - RNA, 18 nt, Artificial Sequence
  Description of Artificial Sequence: Synthetic oligonucleotide
ccaucuucacgauggguc

SEQ ID NO: 16321 - RNA, 18 nt, Artificial Sequence
  Description of Artificial Sequence: Synthetic oligonucleotide
ccacgccaucuucacgau

SEQ ID NO: 16322 - RNA, 18 nt, Artificial Sequence
  Description of Artificial Sequence: Synthetic oligonucleotide
cagggccacgccaucuuc

SEQ ID NO: 16323 - RNA, 18 nt, Artificial Sequence
  Description of Artificial Sequence: Synthetic oligonucleotide
ccucucagggccacgcca

SEQ ID NO: 16324 - RNA, 18 nt, Artificial Sequence
  Description of Artificial Sequence: Synthetic oligonucleotide
ggcugccucucagggcca

SEQ ID NO: 16325 - RNA, 18 nt, Artificial Sequence
  Description of Artificial Sequence: Synthetic oligonucleotide
agaauggcugccucucag

SEQ ID NO: 16326 - RNA, 18 nt, Artificial Sequence
  Description of Artificial Sequence: Synthetic oligonucleotide
agaagagaauggcugccu

SEQ ID NO: 16327 - RNA, 18 nt, Artificial Sequence
  Description of Artificial Sequence: Synthetic oligonucleotide
uuggcagaagagaauggc

SEQ ID NO: 16328 - RNA, 18 nt, Artificial Sequence
  Description of Artificial Sequence: Synthetic oligonucleotide
cugguuuggcagaagaga

SEQ ID NO: 16329 - RNA, 18 nt, Artificial Sequence
  Description of Artificial Sequence: Synthetic oligonucleotide
ggaaccugguuuggcaga

SEQ ID NO: 16330 - RNA, 18 nt, Artificial Sequence
  Description of Artificial Sequence: Synthetic oligonucleotide
gaaccggaaccugguuug

SEQ ID NO: 16331 - RNA, 18 nt, Artificial Sequence
  Description of Artificial Sequence: Synthetic oligonucleotide
cuguggaaccggaaccug

SEQ ID NO: 16332 - RNA, 18 nt, Artificial Sequence
  Description of Artificial Sequence: Synthetic oligonucleotide
ggaagcuguggaaccgga

SEQ ID NO: 16333 - RNA, 18 nt, Artificial Sequence
  Description of Artificial Sequence: Synthetic oligonucleotide
ggacaggaagcuguggaa

SEQ ID NO: 16334 - RNA, 18 nt, Artificial Sequence
  Description of Artificial Sequence: Synthetic oligonucleotide
agacuggacaggaagcug

SEQ ID NO: 16335 - RNA, 18 nt, Artificial Sequence
  Description of Artificial Sequence: Synthetic oligonucleotide
gucgcagacuggacagga

SEQ ID NO: 16336 - RNA, 18 nt, Artificial Sequence
  Description of Artificial Sequence: Synthetic oligonucleotide
gggaagucgcagacugga

SEQ ID NO: 16337 - RNA, 18 nt, Artificial Sequence
  Description of Artificial Sequence: Synthetic oligonucleotide
gguggguucaggucaggg

SEQ ID NO: 16338 - RNA, 18 nt, Artificial Sequence
  Description of Artificial Sequence: Synthetic oligonucleotide
ggguggguucaggucagg

SEQ ID NO: 16339 - RNA, 18 nt, Artificial Sequence
  Description of Artificial Sequence: Synthetic oligonucleotide
cucuguaaggguccuggg

SEQ ID NO: 16340 - RNA, 18 nt, Artificial Sequence
  Description of Artificial Sequence: Synthetic oligonucleotide
gugcccuggugaggccaa

SEQ ID NO: 16341 - RNA, 18 nt, Artificial Sequence
  Description of Artificial Sequence: Synthetic oligonucleotide
cagaagugcccuggugag

SEQ ID NO: 16342 - RNA, 18 nt, Artificial Sequence
  Description of Artificial Sequence: Synthetic oligonucleotide
gaggucagaagugcccug

SEQ ID NO: 16343 - RNA, 18 nt, Artificial Sequence
  Description of Artificial Sequence: Synthetic oligonucleotide
aaagugaggucagaagug

SEQ ID NO: 16344 - RNA, 18 nt, Artificial Sequence
  Description of Artificial Sequence: Synthetic oligonucleotide
uugugaaagugaggucag

SEQ ID NO: 16345 - RNA, 18 nt, Artificial Sequence
  Description of Artificial Sequence: Synthetic oligonucleotide
uccuauugugaaagugag

SEQ ID NO: 16346 - RNA, 18 nt, Artificial Sequence
  Description of Artificial Sequence: Synthetic oligonucleotide
acugguccuauugugaaa

SEQ ID NO: 16347 - RNA, 18 nt, Artificial Sequence
  Description of Artificial Sequence: Synthetic oligonucleotide
ucaacacugguccuauug

SEQ ID NO: 16348 - RNA, 18 nt, Artificial Sequence
  Description of Artificial Sequence: Synthetic oligonucleotide
ggguaucaacacuggucc

SEQ ID NO: 16349 - RNA, 18 nt, Artificial Sequence
  Description of Artificial Sequence: Synthetic oligonucleotide
aggcuggguaucaacacu

SEQ ID NO: 16350 - RNA, 18 nt, Artificial Sequence
  Description of Artificial Sequence: Synthetic oligonucleotide
ccaagaggcuggguauca

SEQ ID NO: 16351 - RNA, 18 nt, Artificial Sequence
  Description of Artificial Sequence: Synthetic oligonucleotide
gaacaccaagaggcuggg

SEQ ID NO: 16352 - RNA, 18 nt, Artificial Sequence
  Description of Artificial Sequence: Synthetic oligonucleotide
gggaugaacaccaagagg

SEQ ID NO: 16353 - RNA, 18 nt, Artificial Sequence
  Description of Artificial Sequence: Synthetic oligonucleotide
cuugagggaugaacacca

SEQ ID NO: 16354 - RNA, 18 nt, Artificial Sequence
  Description of Artificial Sequence: Synthetic oligonucleotide
ugcuucuugagggaugaa

SEQ ID NO: 16355 - RNA, 18 nt, Artificial Sequence
  Description of Artificial Sequence: Synthetic oligonucleotide
gccagugcuucuugaggg

SEQ ID NO: 16356 - RNA, 18 nt, Artificial Sequence
  Description of Artificial Sequence: Synthetic oligonucleotide
uuucugccagugcuucuu

SEQ ID NO: 16357 - RNA, 18 nt, Artificial Sequence
  Description of Artificial Sequence: Synthetic oligonucleotide
cuggguuucugccagugc

SEQ ID NO: 16358 - RNA, 18 nt, Artificial Sequence
  Description of Artificial Sequence: Synthetic oligonucleotide
gauuccuggguuucugcc

SEQ ID NO: 16359 - RNA, 18 nt, Artificial Sequence
  Description of Artificial Sequence: Synthetic oligonucleotide
aauuugauuccuggguuu

SEQ ID NO: 16360 - RNA, 18 nt, Artificial Sequence
  Description of Artificial Sequence: Synthetic oligonucleotide
ugcccaauuugauuccug

SEQ ID NO: 16361 - RNA, 18 nt, Artificial Sequence
  Description of Artificial Sequence: Synthetic oligonucleotide
uuuugugcccaauuugau

SEQ ID NO: 16362 - RNA, 18 nt, Artificial Sequence
  Description of Artificial Sequence: Synthetic oligonucleotide
accauuuuugugcccaau

SEQ ID NO: 16363 - RNA, 18 nt, Artificial Sequence
  Description of Artificial Sequence: Synthetic oligonucleotide
uccuuaccauuuuugugc

SEQ ID NO: 16364 - RNA, 18 nt, Artificial Sequence
  Description of Artificial Sequence: Synthetic oligonucleotide
ccauuuccuuaccauuuu

SEQ ID NO: 16365 - RNA, 18 nt, Artificial Sequence
  Description of Artificial Sequence: Synthetic oligonucleotide
cuuugccauuuccuuacc

SEQ ID NO: 16366 - RNA, 18 nt, Artificial Sequence
  Description of Artificial Sequence: Synthetic oligonucleotide
aaauacuuugccauuucc

SEQ ID NO: 16367 - RNA, 18 nt, Artificial Sequence
  Description of Artificial Sequence: Synthetic oligonucleotide
guucuaaauacuuugcca

SEQ ID NO: 16368 - RNA, 18 nt, Artificial Sequence
  Description of Artificial Sequence: Synthetic oligonucleotide
gcgaaguucuaaauacuu

SEQ ID NO: 16369 - RNA, 18 nt, Artificial Sequence
  Description of Artificial Sequence: Synthetic oligonucleotide
agcgggcgaaguucuaaa

SEQ ID NO: 16370 - RNA, 18 nt, Artificial Sequence
  Description of Artificial Sequence: Synthetic oligonucleotide
caauuagcgggcgaaguu

SEQ ID NO: 16371 - RNA, 18 nt, Artificial Sequence
  Description of Artificial Sequence: Synthetic oligonucleotide
aaacacaauuagcgggcg

SEQ ID NO: 16372 - RNA, 18 nt, Artificial Sequence
  Description of Artificial Sequence: Synthetic oligonucleotide
uggagaaacacaauuagc

SEQ ID NO: 16373 - RNA, 18 nt, Artificial Sequence
  Description of Artificial Sequence: Synthetic oligonucleotide
gucccuggagaaacacaa

SEQ ID NO: 16374 - RNA, 18 nt, Artificial Sequence
  Description of Artificial Sequence: Synthetic oligonucleotide
aaacagucccuggagaaa

SEQ ID NO: 16375 - RNA, 18 nt, Artificial Sequence
  Description of Artificial Sequence: Synthetic oligonucleotide
gaggaaaacagucccugg

SEQ ID NO: 16376 - RNA, 18 nt, Artificial Sequence
  Description of Artificial Sequence: Synthetic oligonucleotide
uguuugaggaaaacaguc

SEQ ID NO: 16377 - RNA, 18 nt, Artificial Sequence
  Description of Artificial Sequence: Synthetic oligonucleotide
gaggauguuugaggaaaa

SEQ ID NO: 16378 - RNA, 18 nt, Artificial Sequence
  Description of Artificial Sequence: Synthetic oligonucleotide
uuucagaggauguuugag

SEQ ID NO: 16379 - RNA, 18 nt, Artificial Sequence
  Description of Artificial Sequence: Synthetic oligonucleotide
caggauuucagaggaugu

SEQ ID NO: 16380 - RNA, 18 nt, Artificial Sequence
  Description of Artificial Sequence: Synthetic oligonucleotide
aggaccaggauuucagag

SEQ ID NO: 16381 - RNA, 18 nt, Artificial Sequence
  Description of Artificial Sequence: Synthetic oligonucleotide
gauauaggaccaggauuu

SEQ ID NO: 16382 - RNA, 18 nt, Artificial Sequence
  Description of Artificial Sequence: Synthetic oligonucleotide
cugcugauauaggaccag

SEQ ID NO: 16383 - RNA, 18 nt, Artificial Sequence
  Description of Artificial Sequence: Synthetic oligonucleotide
auucccugcugauauagg

SEQ ID NO: 16384 - RNA, 18 nt, Artificial Sequence
  Description of Artificial Sequence: Synthetic oligonucleotide
gccucauucccugcugau

SEQ ID NO: 16385 - RNA, 18 nt, Artificial Sequence
  Description of Artificial Sequence: Synthetic oligonucleotide
cuguggccucauucccug

SEQ ID NO: 16386 - RNA, 18 nt, Artificial Sequence
  Description of Artificial Sequence: Synthetic oligonucleotide
ucagucuguggccucauu

SEQ ID NO: 16387 - RNA, 18 nt, Artificial Sequence
  Description of Artificial Sequence: Synthetic oligonucleotide
ucucaucagucuguggcc

SEQ ID NO: 16388 - RNA, 18 nt, Artificial Sequence
  Description of Artificial Sequence: Synthetic oligonucleotide
uuuccucucaucagucug

SEQ ID NO: 16389 - RNA, 18 nt, Artificial Sequence
  Description of Artificial Sequence: Synthetic oligonucleotide
uaaaauuuccucucauca

SEQ ID NO: 16390 - RNA, 18 nt, Artificial Sequence
  Description of Artificial Sequence: Synthetic oligonucleotide
uaaaauaaaauuuccucu

SEQ ID NO: 16391 - RNA, 18 nt, Artificial Sequence
  Description of Artificial Sequence: Synthetic oligonucleotide
auagcuaaaauaaaauuu

SEQ ID NO: 16392 - RNA, 18 nt, Artificial Sequence
  Description of Artificial Sequence: Synthetic oligonucleotide
uggaaauagcuaaaauaa

SEQ ID NO: 16393 - RNA, 18 nt, Artificial Sequence
  Description of Artificial Sequence: Synthetic oligonucleotide
aaauguggaaauagcuaa

SEQ ID NO: 16394 - RNA, 18 nt, Artificial Sequence
  Description of Artificial Sequence: Synthetic oligonucleotide
gagaaaaauguggaaaua

SEQ ID NO: 16395 - RNA, 18 nt, Artificial Sequence
  Description of Artificial Sequence: Synthetic oligonucleotide
ugaaugagaaaaaugugg

SEQ ID NO: 16396 - RNA, 18 nt, Artificial Sequence
  Description of Artificial Sequence: Synthetic oligonucleotide
ggaccugaaugagaaaaa

SEQ ID NO: 16397 - RNA, 18 nt, Artificial Sequence
  Description of Artificial Sequence: Synthetic oligonucleotide
uuagaggaccugaaugag

SEQ ID NO: 16398 - RNA, 18 nt, Artificial Sequence
  Description of Artificial Sequence: Synthetic oligonucleotide
ccacauuagaggaccuga

SEQ ID NO: 16399 - RNA, 18 nt, Artificial Sequence
  Description of Artificial Sequence: Synthetic oligonucleotide
acuaaccacauuagagga

SEQ ID NO: 16400 - RNA, 18 nt, Artificial Sequence
  Description of Artificial Sequence: Synthetic oligonucleotide
ccacaacuaaccacauua

SEQ ID NO: 16401 - RNA, 18 nt, Artificial Sequence
  Description of Artificial Sequence: Synthetic oligonucleotide
ucaggccacaacuaacca

SEQ ID NO: 16402 - RNA, 18 nt, Artificial Sequence
  Description of Artificial Sequence: Synthetic oligonucleotide
cauuuucaggccacaacu

SEQ ID NO: 16403 - RNA, 18 nt, Artificial Sequence
  Description of Artificial Sequence: Synthetic oligonucleotide
aauaucauuuucaggcca

SEQ ID NO: 16404 - RNA, 18 nt, Artificial Sequence
  Description of Artificial Sequence: Synthetic oligonucleotide
uuggaaauaucauuuuca

SEQ ID NO: 16405 - RNA, 18 nt, Artificial Sequence
  Description of Artificial Sequence: Synthetic oligonucleotide
uucauuuggaaauaucau

SEQ ID NO: 16406 - RNA, 18 nt, Artificial Sequence
  Description of Artificial Sequence: Synthetic oligonucleotide
uccuauucauuuggaaau

SEQ ID NO: 16407 - RNA, 18 nt, Artificial Sequence
  Description of Artificial Sequence: Synthetic oligonucleotide
uuccuuccuauucauuug

SEQ ID NO: 16408 - RNA, 18 nt, Artificial Sequence
  Description of Artificial Sequence: Synthetic oligonucleotide
uuuccuuccuuccuauuc

SEQ ID NO: 16409 - RNA, 18 nt, Artificial Sequence
  Description of Artificial Sequence: Synthetic oligonucleotide
aacaauuuccuuccuucc

SEQ ID NO: 16410 - RNA, 18 nt, Artificial Sequence
  Description of Artificial Sequence: Synthetic oligonucleotide
acaaaaacaauuuccuuc

SEQ ID NO: 16411 - RNA, 18 nt, Artificial Sequence
  Description of Artificial Sequence: Synthetic oligonucleotide
aaacaacaaaaacaauuu

SEQ ID NO: 16412 - RNA, 18 nt, Artificial Sequence
  Description of Artificial Sequence: Synthetic oligonucleotide
aucuuaaacaacaaaaac

SEQ ID NO: 16413 - RNA, 18 nt, Artificial Sequence
  Description of Artificial Sequence: Synthetic oligonucleotide
cuuccaucuuaaacaaca

SEQ ID NO: 16414 - RNA, 18 nt, Artificial Sequence
  Description of Artificial Sequence: Synthetic oligonucleotide
auuuccuuccaucuuaaa

SEQ ID NO: 16415 - RNA, 18 nt, Artificial Sequence
  Description of Artificial Sequence: Synthetic oligonucleotide
ccuauauuuccuuccauc

SEQ ID NO: 16416 - RNA, 18 nt, Artificial Sequence
  Description of Artificial Sequence: Synthetic oligonucleotide
augcaccuauauuuccuu

SEQ ID NO: 16417 - RNA, 18 nt, Artificial Sequence
  Description of Artificial Sequence: Synthetic oligonucleotide
uuuaaaugcaccuauauu

SEQ ID NO: 16418 - RNA, 18 nt, Artificial Sequence
  Description of Artificial Sequence: Synthetic oligonucleotide
cauuuuuuaaaugcaccu

SEQ ID NO: 16419 - RNA, 18 nt, Artificial Sequence
  Description of Artificial Sequence: Synthetic oligonucleotide
agcuccauuuuuuaaaug

SEQ ID NO: 16420 - RNA, 18 nt, Artificial Sequence
  Description of Artificial Sequence: Synthetic oligonucleotide
aaccaagcuccauuuuuu

SEQ ID NO: 16421 - RNA, 18 nt, Artificial Sequence
  Description of Artificial Sequence: Synthetic oligonucleotide
caugcaaccaagcuccau

SEQ ID NO: 16422 - RNA, 18 nt, Artificial Sequence
  Description of Artificial Sequence: Synthetic oligonucleotide
aaaaucaugcaaccaagc

SEQ ID NO: 16423 - RNA, 18 nt, Artificial Sequence
  Description of Artificial Sequence: Synthetic oligonucleotide
gagcgaaaaucaugcaac

SEQ ID NO: 16424 - RNA, 18 nt, Artificial Sequence
  Description of Artificial Sequence: Synthetic oligonucleotide
cucaagagcgaaaaucau

SEQ ID NO: 16425 - RNA, 18 nt, Artificial Sequence
  Description of Artificial Sequence: Synthetic oligonucleotide
gaugacucaagagcgaaa

SEQ ID NO: 16426 - RNA, 18 nt, Artificial Sequence
  Description of Artificial Sequence: Synthetic oligonucleotide
ggcuagaugacucaagag

SEQ ID NO: 16427 - RNA, 18 nt, Artificial Sequence
  Description of Artificial Sequence: Synthetic oligonucleotide
uagagggcuagaugacuc

SEQ ID NO: 16428 - RNA, 18 nt, Artificial Sequence
  Description of Artificial Sequence: Synthetic oligonucleotide
aucauuagagggcuagau

SEQ ID NO: 16429 - RNA, 18 nt, Artificial Sequence
  Description of Artificial Sequence: Synthetic oligonucleotide
aggcaaucauuagagggc

SEQ ID NO: 16430 - RNA, 18 nt, Artificial Sequence
  Description of Artificial Sequence: Synthetic oligonucleotide
guaugaggcaaucauuag

SEQ ID NO: 16431 - RNA, 18 nt, Artificial Sequence
  Description of Artificial Sequence: Synthetic oligonucleotide
caccgguaugaggcaauc

SEQ ID NO: 16432 - RNA, 18 nt, Artificial Sequence
  Description of Artificial Sequence: Synthetic oligonucleotide
guaaucaccgguaugagg

SEQ ID NO: 16433 - RNA, 18 nt, Artificial Sequence
  Description of Artificial Sequence: Synthetic oligonucleotide
cgcucguaaucaccggua

SEQ ID NO: 16434 - RNA, 18 nt, Artificial Sequence
  Description of Artificial Sequence: Synthetic oligonucleotide
aaagccgcucguaaucac

SEQ ID NO: 16435 - RNA, 18 nt, Artificial Sequence
  Description of Artificial Sequence: Synthetic oligonucleotide
caugaaaagccgcucgua

SEQ ID NO: 16436 - RNA, 18 nt, Artificial Sequence
  Description of Artificial Sequence: Synthetic oligonucleotide
gggucaugaaaagccgcu

SEQ ID NO: 16437 - RNA, 18 nt, Artificial Sequence
  Description of Artificial Sequence: Synthetic oligonucleotide
aaaugguacauauggaag

SEQ ID NO: 16438 - RNA, 18 nt, Artificial Sequence
  Description of Artificial Sequence: Synthetic oligonucleotide
uuuuaaaaugguacauau

SEQ ID NO: 16439 - RNA, 18 nt, Artificial Sequence
  Description of Artificial Sequence: Synthetic oligonucleotide
cagcauuuuaaaauggua

SEQ ID NO: 16440 - RNA, 18 nt, Artificial Sequence
  Description of Artificial Sequence: Synthetic oligonucleotide
guaaucagcauuuuaaaa

SEQ ID NO: 16441 - RNA, 18 nt, Artificial Sequence
  Description of Artificial Sequence: Synthetic oligonucleotide
aagaaguaaucagcauuu

SEQ ID NO: 16442 - RNA, 18 nt, Artificial Sequence
  Description of Artificial Sequence: Synthetic oligonucleotide
uucucaagaaguaaucag

SEQ ID NO: 16443 - RNA, 18 nt, Artificial Sequence
  Description of Artificial Sequence: Synthetic oligonucleotide
ucuuauucucaagaagua

SEQ ID NO: 16444 - RNA, 18 nt, Artificial Sequence
  Description of Artificial Sequence: Synthetic oligonucleotide
gcuucucuuauucucaag

SEQ ID NO: 16445 - RNA, 18 nt, Artificial Sequence
  Description of Artificial Sequence: Synthetic oligonucleotide
auuaggcuucucuuauuc

SEQ ID NO: 16446 - RNA, 18 nt, Artificial Sequence
  Description of Artificial Sequence: Synthetic oligonucleotide
cugaaauuaggcuucucu

SEQ ID NO: 16447 - RNA, 18 nt, Artificial Sequence
  Description of Artificial Sequence: Synthetic oligonucleotide
auauucugaaauuaggcu

SEQ ID NO: 16448 - RNA, 18 nt, Artificial Sequence
  Description of Artificial Sequence: Synthetic oligonucleotide
uaaugauauucugaaauu

SEQ ID NO: 16449 - RNA, 18 nt, Artificial Sequence
  Description of Artificial Sequence: Synthetic oligonucleotide
uacccuaaugauauucug

SEQ ID NO: 16450 - RNA, 18 nt, Artificial Sequence
  Description of Artificial Sequence: Synthetic oligonucleotide
auagguacccuaaugaua

SEQ ID NO: 16451 - RNA, 18 nt, Artificial Sequence
  Description of Artificial Sequence: Synthetic oligonucleotide
cuucaauagguacccuaa

SEQ ID NO: 16452 - RNA, 18 nt, Artificial Sequence
  Description of Artificial Sequence: Synthetic oligonucleotide
caagacuucaauagguac

SEQ ID NO: 16453 - RNA, 18 nt, Artificial Sequence
  Description of Artificial Sequence: Synthetic oligonucleotide
gcagucaagacuucaaua

SEQ ID NO: 16454 - RNA, 18 nt, Artificial Sequence
  Description of Artificial Sequence: Synthetic oligonucleotide
uaugugcagucaagacuu

SEQ ID NO: 16455 - RNA, 18 nt, Artificial Sequence
  Description of Artificial Sequence: Synthetic oligonucleotide
cuaaauaugugcagucaa

SEQ ID NO: 16456 - RNA, 18 nt, Artificial Sequence
  Description of Artificial Sequence: Synthetic oligonucleotide
guaugcuaaauaugugca

SEQ ID NO: 16457 - RNA, 18 nt, Artificial Sequence
  Description of Artificial Sequence: Synthetic oligonucleotide
agggaguaugcuaaauau

SEQ ID NO: 16458 - RNA, 18 nt, Artificial Sequence
  Description of Artificial Sequence: Synthetic oligonucleotide
uucccagggaguaugcua

SEQ ID NO: 16459 - RNA, 18 nt, Artificial Sequence
  Description of Artificial Sequence: Synthetic oligonucleotide
uauaauucccagggagua

SEQ ID NO: 16460 - RNA, 18 nt, Artificial Sequence
  Description of Artificial Sequence: Synthetic oligonucleotide
uaaaauauaauucccagg

SEQ ID NO: 16461 - RNA, 18 nt, Artificial Sequence
  Description of Artificial Sequence: Synthetic oligonucleotide
guccuuaaaauauaauuc

SEQ ID NO: 16462 - RNA, 18 nt, Artificial Sequence
  Description of Artificial Sequence: Synthetic oligonucleotide
aaaauguccuuaaaauau

SEQ ID NO: 16463 - RNA, 18 nt, Artificial Sequence
  Description of Artificial Sequence: Synthetic oligonucleotide
auagaaaaauguccuuaa

SEQ ID NO: 16464 - RNA, 18 nt, Artificial Sequence
  Description of Artificial Sequence: Synthetic oligonucleotide
auuuaauagaaaaauguc

SEQ ID NO: 16465 - RNA, 18 nt, Artificial Sequence
  Description of Artificial Sequence: Synthetic oligonucleotide
caaugauuuaauagaaaa

SEQ ID NO: 16466 - RNA, 18 nt, Artificial Sequence
  Description of Artificial Sequence: Synthetic oligonucleotide
auaugcaaugauuuaaua

SEQ ID NO: 16467 - RNA, 18 nt, Artificial Sequence
  Description of Artificial Sequence: Synthetic oligonucleotide
cuuccauaugcaaugauu

SEQ ID NO: 16468 - RNA, 18 nt, Artificial Sequence
  Description of Artificial Sequence: Synthetic oligonucleotide
aguuucuuccauaugcaa

SEQ ID NO: 16469 - RNA, 18 nt, Artificial Sequence
  Description of Artificial Sequence: Synthetic oligonucleotide
uauugaguuucuuccaua

SEQ ID NO: 16470 - RNA, 18 nt, Artificial Sequence
  Description of Artificial Sequence: Synthetic oligonucleotide
uauuauauugaguuucuu

SEQ ID NO: 16471 - RNA, 18 nt, Artificial Sequence
  Description of Artificial Sequence: Synthetic oligonucleotide
ucagcuauuauauugagu

SEQ ID NO: 16472 - RNA, 18 nt, Artificial Sequence
  Description of Artificial Sequence: Synthetic oligonucleotide
aaauaucagcuauuauau

SEQ ID NO: 16473 - RNA, 18 nt, Artificial Sequence
  Description of Artificial Sequence: Synthetic oligonucleotide
caaguaaauaucagcuau

SEQ ID NO: 16474 - RNA, 18 nt, Artificial Sequence
  Description of Artificial Sequence: Synthetic oligonucleotide
gaacccaaguaaauauca

SEQ ID NO: 16475 - RNA, 18 nt, Artificial Sequence
  Description of Artificial Sequence: Synthetic oligonucleotide
auuaagaacccaaguaaa

SEQ ID NO: 16476 - RNA, 18 nt, Artificial Sequence
  Description of Artificial Sequence: Synthetic oligonucleotide
uucugauuaagaacccaa

SEQ ID NO: 16477 - RNA, 18 nt, Artificial Sequence
  Description of Artificial Sequence: Synthetic oligonucleotide
caauguucugauuaagaa

SEQ ID NO: 16478 - RNA, 18 nt, Artificial Sequence
  Description of Artificial Sequence: Synthetic oligonucleotide
acagccaauguucugauu

SEQ ID NO: 16479 - RNA, 18 nt, Artificial Sequence
  Description of Artificial Sequence: Synthetic oligonucleotide
aucacacagccaauguuc

SEQ ID NO: 16480 - RNA, 18 nt, Artificial Sequence
  Description of Artificial Sequence: Synthetic oligonucleotide
ugaaaaucacacagccaa

SEQ ID NO: 16481 - RNA, 18 nt, Artificial Sequence
  Description of Artificial Sequence: Synthetic oligonucleotide
aaucaugaaaaucacaca

SEQ ID NO: 16482 - RNA, 18 nt, Artificial Sequence
  Description of Artificial Sequence: Synthetic oligonucleotide
aucauaaucaugaaaauc

SEQ ID NO: 16483 - RNA, 18 nt, Artificial Sequence
  Description of Artificial Sequence: Synthetic oligonucleotide
ugaaaaucauaaucauga

SEQ ID NO: 16484 - RNA, 18 nt, Artificial Sequence
  Description of Artificial Sequence: Synthetic oligonucleotide
ugcaaugaaaaucauaau

SEQ ID NO: 16485 - RNA, 18 nt, Artificial Sequence
  Description of Artificial Sequence: Synthetic oligonucleotide
uuaauugcaaugaaaauc

SEQ ID NO: 16486 - RNA, 18 nt, Artificial Sequence
  Description of Artificial Sequence: Synthetic oligonucleotide
ucaacuuaauugcaauga

SEQ ID NO: 16487 - RNA, 18 nt, Artificial Sequence
  Description of Artificial Sequence: Synthetic oligonucleotide
aaacaucaacuuaauugc

SEQ ID NO: 16488 - RNA, 18 nt, Artificial Sequence
  Description of Artificial Sequence: Synthetic oligonucleotide
cuacaaaacaucaacuua

SEQ ID NO: 16489 - RNA, 18 nt, Artificial Sequence
  Description of Artificial Sequence: Synthetic oligonucleotide
acugucuacaaaacauca

SEQ ID NO: 16490 - RNA, 18 nt, Artificial Sequence
  Description of Artificial Sequence: Synthetic oligonucleotide
auuucacugucuacaaaa

SEQ ID NO: 16491 - RNA, 18 nt, Artificial Sequence
  Description of Artificial Sequence: Synthetic oligonucleotide
ugguaauuucacugucua

SEQ ID NO: 16492 - RNA, 18 nt, Artificial Sequence
  Description of Artificial Sequence: Synthetic oligonucleotide
guagaugguaauuucacu

SEQ ID NO: 16493 - RNA, 18 nt, Artificial Sequence
  Description of Artificial Sequence: Synthetic oligonucleotide
uuggaguagaugguaauu

SEQ ID NO: 16494 - RNA, 18 nt, Artificial Sequence
  Description of Artificial Sequence: Synthetic oligonucleotide
aucuuuuggaguagaugg

SEQ ID NO: 16495 - RNA, 18 nt, Artificial Sequence
  Description of Artificial Sequence: Synthetic oligonucleotide
uugcaaucuuuuggagua

SEQ ID NO: 16496 - RNA, 18 nt, Artificial Sequence
  Description of Artificial Sequence: Synthetic oligonucleotide
cuauuuugcaaucuuuug

SEQ ID NO: 16497 - RNA, 18 nt, Artificial Sequence
  Description of Artificial Sequence: Synthetic oligonucleotide
aaauucuauuuugcaauc

SEQ ID NO: 16498 - RNA, 18 nt, Artificial Sequence
  Description of Artificial Sequence: Synthetic oligonucleotide
agguuaaauucuauuuug

SEQ ID NO: 16499 - RNA, 18 nt, Artificial Sequence
  Description of Artificial Sequence: Synthetic oligonucleotide
cucuaagguuaaauucua

SEQ ID NO: 16500 - RNA, 18 nt, Artificial Sequence
  Description of Artificial Sequence: Synthetic oligonucleotide
auuggcucuaagguuaaa

SEQ ID NO: 16501 - RNA, 18 nt, Artificial Sequence
  Description of Artificial Sequence: Synthetic oligonucleotide
ccugcauuggcucuaagg

SEQ ID NO: 16502 - RNA, 18 nt, Artificial Sequence
  Description of Artificial Sequence: Synthetic oligonucleotide
uuuucccugcauuggcuc

SEQ ID NO: 16503 - RNA, 18 nt, Artificial Sequence
  Description of Artificial Sequence: Synthetic oligonucleotide
acaaguuuucccugcauu

SEQ ID NO: 16504 - RNA, 18 nt, Artificial Sequence
  Description of Artificial Sequence: Synthetic oligonucleotide
cagaaacaaguuuucccu

SEQ ID NO: 16505 - RNA, 18 nt, Artificial Sequence
  Description of Artificial Sequence: Synthetic oligonucleotide
accugcagaaacaaguuu

SEQ ID NO: 16506 - RNA, 18 nt, Artificial Sequence
  Description of Artificial Sequence: Synthetic oligonucleotide
aaugcaccugcagaaaca

SEQ ID NO: 16507 - RNA, 18 nt, Artificial Sequence
  Description of Artificial Sequence: Synthetic oligonucleotide
caaaaaaugcaccugcag

SEQ ID NO: 16508 - RNA, 18 nt, Artificial Sequence
  Description of Artificial Sequence: Synthetic oligonucleotide
aguuucaaaaaaugcacc

SEQ ID NO: 16509 - RNA, 18 nt, Artificial Sequence
  Description of Artificial Sequence: Synthetic oligonucleotide
guugaaguuucaaaaaau

SEQ ID NO: 16510 - RNA, 18 nt, Artificial Sequence
  Description of Artificial Sequence: Synthetic oligonucleotide
uaucuguugaaguuucaa

SEQ ID NO: 16511 - RNA, 18 nt, Artificial Sequence
  Description of Artificial Sequence: Synthetic oligonucleotide
ccugcuaucuguugaagu

SEQ ID NO: 16512 - RNA, 18 nt, Artificial Sequence
  Description of Artificial Sequence: Synthetic oligonucleotide
uucccccugcuaucuguu

SEQ ID NO: 16513 - RNA, 18 nt, Artificial Sequence
  Description of Artificial Sequence: Synthetic oligonucleotide
uuuuuuucccccugcuau

SEQ ID NO: 16514 - RNA, 18 nt, Artificial Sequence
  Description of Artificial Sequence: Synthetic oligonucleotide
ucacuuuuuuuucccccu

SEQ ID NO: 16515 - RNA, 18 nt, Artificial Sequence
  Description of Artificial Sequence: Synthetic oligonucleotide
uucugucacuuuuuuuuc

SEQ ID NO: 16516 - RNA, 18 nt, Artificial Sequence
  Description of Artificial Sequence: Synthetic oligonucleotide
gauccuucugucacuuuu

SEQ ID NO: 16517 - RNA, 18 nt, Artificial Sequence
  Description of Artificial Sequence: Synthetic oligonucleotide
acugugauccuucuguca

SEQ ID NO: 16518 - RNA, 18 nt, Artificial Sequence
  Description of Artificial Sequence: Synthetic oligonucleotide
gcugaacugugauccuuc

SEQ ID NO: 16519 - RNA, 18 nt, Artificial Sequence
  Description of Artificial Sequence: Synthetic oligonucleotide
auacugcugaacugugau

SEQ ID NO: 16520 - RNA, 18 nt, Artificial Sequence
  Description of Artificial Sequence: Synthetic oligonucleotide
aauucauacugcugaacu

SEQ ID NO: 16521 - RNA, 18 nt, Artificial Sequence
  Description of Artificial Sequence: Synthetic oligonucleotide
cagacaauucauacugcu

SEQ ID NO: 16522 - RNA, 18 nt, Artificial Sequence
  Description of Artificial Sequence: Synthetic oligonucleotide
gccagcagacaauucaua

SEQ ID NO: 16523 - RNA, 18 nt, Artificial Sequence
  Description of Artificial Sequence: Synthetic oligonucleotide
aggcugccagcagacaau

SEQ ID NO: 16524 - RNA, 18 nt, Artificial Sequence
  Description of Artificial Sequence: Synthetic oligonucleotide
uugcaaggcugccagcag

SEQ ID NO: 16525 - RNA, 18 nt, Artificial Sequence
  Description of Artificial Sequence: Synthetic oligonucleotide
ccagauugcaaggcugcc

SEQ ID NO: 16526 - RNA, 18 nt, Artificial Sequence
  Description of Artificial Sequence: Synthetic oligonucleotide
gcacaccagauugcaagg

SEQ ID NO: 16527 - RNA, 18 nt, Artificial Sequence
  Description of Artificial Sequence: Synthetic oligonucleotide
ugccugcacaccagauug

SEQ ID NO: 16528 - RNA, 18 nt, Artificial Sequence
  Description of Artificial Sequence: Synthetic oligonucleotide
cucacugccugcacacca

SEQ ID NO: 16529 - RNA, 18 nt, Artificial Sequence
  Description of Artificial Sequence: Synthetic oligonucleotide
acaaucucacugccugca

SEQ ID NO: 16530 - RNA, 18 nt, Artificial Sequence
  Description of Artificial Sequence: Synthetic oligonucleotide
acaccacaaucucacugc

SEQ ID NO: 16531 - RNA, 18 nt, Artificial Sequence
  Description of Artificial Sequence: Synthetic oligonucleotide
cauguacaccacaaucuc

SEQ ID NO: 16532 - RNA, 18 nt, Artificial Sequence
  Description of Artificial Sequence: Synthetic oligonucleotide
ggugacauguacaccaca

SEQ ID NO: 16533 - RNA, 18 nt, Artificial Sequence
  Description of Artificial Sequence: Synthetic oligonucleotide
aaucaggugacauguaca

SEQ ID NO: 16534 - RNA, 18 nt, Artificial Sequence
  Description of Artificial Sequence: Synthetic oligonucleotide
uguaguccugguggcaug

SEQ ID NO: 16535 - RNA, 18 nt, Artificial Sequence
  Description of Artificial Sequence: Synthetic oligonucleotide
gccccuguaguccuggug

SEQ ID NO: 16536 - RNA, 18 nt, Artificial Sequence
  Description of Artificial Sequence: Synthetic oligonucleotide
acucugccccuguagucc

SEQ ID NO: 16537 - RNA, 18 nt, Artificial Sequence
  Description of Artificial Sequence: Synthetic oligonucleotide
gagacacucugccccugu

SEQ ID NO: 16538 - RNA, 18 nt, Artificial Sequence
  Description of Artificial Sequence: Synthetic oligonucleotide
cagaggagacacucugcc

SEQ ID NO: 16539 - RNA, 18 nt, Artificial Sequence
  Description of Artificial Sequence: Synthetic oligonucleotide
gcugccagaggagacacu

SEQ ID NO: 16540 - RNA, 18 nt, Artificial Sequence
  Description of Artificial Sequence: Synthetic oligonucleotide
ucagagcugccagaggag

SEQ ID NO: 16541 - RNA, 18 nt, Artificial Sequence
  Description of Artificial Sequence: Synthetic oligonucleotide
ugaucucagagcugccag

SEQ ID NO: 16542 - RNA, 18 nt, Artificial Sequence
  Description of Artificial Sequence: Synthetic oligonucleotide
ggauuugaucucagagcu

SEQ ID NO: 16543 - RNA, 18 nt, Artificial Sequence
  Description of Artificial Sequence: Synthetic oligonucleotide
ucaucggauuugaucuca

SEQ ID NO: 16544 - RNA, 18 nt, Artificial Sequence
  Description of Artificial Sequence: Synthetic oligonucleotide
ccucgucaucggauuuga

SEQ ID NO: 16545 - RNA, 18 nt, Artificial Sequence
  Description of Artificial Sequence: Synthetic oligonucleotide
aucacccucgucaucgga

SEQ ID NO: 16546 - RNA, 18 nt, Artificial Sequence
  Description of Artificial Sequence: Synthetic oligonucleotide
uucucaucacccucguca

SEQ ID NO: 16547 - RNA, 18 nt, Artificial Sequence
  Description of Artificial Sequence: Synthetic oligonucleotide
gcagguucucaucacccu

SEQ ID NO: 16548 - RNA, 18 nt, Artificial Sequence
  Description of Artificial Sequence: Synthetic oligonucleotide
gucuugcagguucucauc

SEQ ID NO: 16549 - RNA, 18 nt, Artificial Sequence
  Description of Artificial Sequence: Synthetic oligonucleotide
uucgugucuugcagguuc

SEQ ID NO: 16550 - RNA, 18 nt, Artificial Sequence
  Description of Artificial Sequence: Synthetic oligonucleotide
aagauuucgugucuugca

SEQ ID NO: 16551 - RNA, 18 nt, Artificial Sequence
  Description of Artificial Sequence: Synthetic oligonucleotide
cuccgaagauuucguguc

SEQ ID NO: 16552 - RNA, 18 nt, Artificial Sequence
  Description of Artificial Sequence: Synthetic oligonucleotide
uuguccuccgaagauuuc

SEQ ID NO: 16553 - RNA, 18 nt, Artificial Sequence
  Description of Artificial Sequence: Synthetic oligonucleotide
auuucuuguccuccgaag

SEQ ID NO: 16554 - RNA, 18 nt, Artificial Sequence
  Description of Artificial Sequence: Synthetic oligonucleotide
aucuaauuucuuguccuc

SEQ ID NO: 16555 - RNA, 18 nt, Artificial Sequence
  Description of Artificial Sequence: Synthetic oligonucleotide
ucgucaucuaauuucuug

SEQ ID NO: 16556 - RNA, 18 nt, Artificial Sequence
  Description of Artificial Sequence: Synthetic oligonucleotide
ucuugucgucaucuaauu

SEQ ID NO: 16557 - RNA, 18 nt, Artificial Sequence
  Description of Artificial Sequence: Synthetic oligonucleotide
auccuucuugucgucauc

SEQ ID NO: 16558 - RNA, 18 nt, Artificial Sequence
  Description of Artificial Sequence: Synthetic oligonucleotide
uugauauccuucuugucg

SEQ ID NO: 16559 - RNA, 18 nt, Artificial Sequence
  Description of Artificial Sequence: Synthetic oligonucleotide
uugauuugauauccuucu

SEQ ID NO: 16560 - RNA, 18 nt, Artificial Sequence
  Description of Artificial Sequence: Synthetic oligonucleotide
aguaauugauuugauauc

SEQ ID NO: 16561 - RNA, 18 nt, Artificial Sequence
  Description of Artificial Sequence: Synthetic oligonucleotide
uucacgauggguccccac

SEQ ID NO: 16562 - RNA, 18 nt, Artificial Sequence
  Description of Artificial Sequence: Synthetic oligonucleotide
ccaucuucacgauggguc

SEQ ID NO: 16563 - RNA, 18 nt, Artificial Sequence
  Description of Artificial Sequence: Synthetic oligonucleotide
ccacgccaucuucacgau

SEQ ID NO: 16564 - RNA, 18 nt, Artificial Sequence
  Description of Artificial Sequence: Synthetic oligonucleotide
cagggccacgccaucuuc

SEQ ID NO: 16565 - RNA, 18 nt, Artificial Sequence
  Description of Artificial Sequence: Synthetic oligonucleotide
ccucucagggccacgcca

SEQ ID NO: 16566 - RNA, 18 nt, Artificial Sequence
  Description of Artificial Sequence: Synthetic oligonucleotide
ggcugccucucagggcca

SEQ ID NO: 16567 - RNA, 18 nt, Artificial Sequence
  Description of Artificial Sequence: Synthetic oligonucleotide
agaauggcugccucucag

SEQ ID NO: 16568 - RNA, 18 nt, Artificial Sequence
  Description of Artificial Sequence: Synthetic oligonucleotide
agaagagaauggcugccu

SEQ ID NO: 16569 - RNA, 18 nt, Artificial Sequence
  Description of Artificial Sequence: Synthetic oligonucleotide
uuggcagaagagaauggc

SEQ ID NO: 16570 - RNA, 18 nt, Artificial Sequence
  Description of Artificial Sequence: Synthetic oligonucleotide
cugguuuggcagaagaga

SEQ ID NO: 16571 - RNA, 18 nt, Artificial Sequence
  Description of Artificial Sequence: Synthetic oligonucleotide
ggaaccugguuuggcaga

SEQ ID NO: 16572 - RNA, 18 nt, Artificial Sequence
  Description of Artificial Sequence: Synthetic oligonucleotide
gaaccggaaccugguuug

SEQ ID NO: 16573 - RNA, 18 nt, Artificial Sequence
  Description of Artificial Sequence: Synthetic oligonucleotide
cuguggaaccggaaccug

SEQ ID NO: 16574 - RNA, 18 nt, Artificial Sequence
  Description of Artificial Sequence: Synthetic oligonucleotide
ggaagcuguggaaccgga

SEQ ID NO: 16575 - RNA, 18 nt, Artificial Sequence
  Description of Artificial Sequence: Synthetic oligonucleotide
ggacaggaagcuguggaa

SEQ ID NO: 16576 - RNA, 18 nt, Artificial Sequence
  Description of Artificial Sequence: Synthetic oligonucleotide
agacuggacaggaagcug

SEQ ID NO: 16577 - RNA, 18 nt, Artificial Sequence
  Description of Artificial Sequence: Synthetic oligonucleotide
gucgcagacuggacagga

SEQ ID NO: 16578 - RNA, 18 nt, Artificial Sequence
  Description of Artificial Sequence: Synthetic oligonucleotide
gggaagucgcagacugga

SEQ ID NO: 16579 - RNA, 18 nt, Artificial Sequence
  Description of Artificial Sequence: Synthetic oligonucleotide
gguggguucaggucaggg

SEQ ID NO: 16580 - RNA, 18 nt, Artificial Sequence
  Description of Artificial Sequence: Synthetic oligonucleotide
ggguggguucaggucagg

SEQ ID NO: 16581 - RNA, 18 nt, Artificial Sequence
  Description of Artificial Sequence: Synthetic oligonucleotide
cucuguaaggguccuggg

SEQ ID NO: 16582 - RNA, 18 nt, Artificial Sequence
  Description of Artificial Sequence: Synthetic oligonucleotide
gugcccuggugaggccaa

SEQ ID NO: 16583 - RNA, 18 nt, Artificial Sequence
  Description of Artificial Sequence: Synthetic oligonucleotide
cagaagugcccuggugag

SEQ ID NO: 16584 - RNA, 18 nt, Artificial Sequence
  Description of Artificial Sequence: Synthetic oligonucleotide
gaggucagaagugcccug

SEQ ID NO: 16585 - RNA, 18 nt, Artificial Sequence
  Description of Artificial Sequence: Synthetic oligonucleotide
aaagugaggucagaagug

SEQ ID NO: 16586 - RNA, 18 nt, Artificial Sequence
  Description of Artificial Sequence: Synthetic oligonucleotide
uugugaaagugaggucag

SEQ ID NO: 16587 - RNA, 18 nt, Artificial Sequence
  Description of Artificial Sequence: Synthetic oligonucleotide
uccuauugugaaagugag

SEQ ID NO: 16588 - RNA, 18 nt, Artificial Sequence
  Description of Artificial Sequence: Synthetic oligonucleotide
acugguccuauugugaaa

SEQ ID NO: 16589 - RNA, 18 nt, Artificial Sequence
  Description of Artificial Sequence: Synthetic oligonucleotide
ucaacacugguccuauug

SEQ ID NO: 16590 - RNA, 18 nt, Artificial Sequence
  Description of Artificial Sequence: Synthetic oligonucleotide
ggguaucaacacuggucc

SEQ ID NO: 16591 - RNA, 18 nt, Artificial Sequence
  Description of Artificial Sequence: Synthetic oligonucleotide
aggcuggguaucaacacu

SEQ ID NO: 16592 - RNA, 18 nt, Artificial Sequence
  Description of Artificial Sequence: Synthetic oligonucleotide
ccaagaggcuggguauca

SEQ ID NO: 16593 - RNA, 18 nt, Artificial Sequence
  Description of Artificial Sequence: Synthetic oligonucleotide
gaacaccaagaggcuggg

SEQ ID NO: 16594 - RNA, 18 nt, Artificial Sequence
  Description of Artificial Sequence: Synthetic oligonucleotide
gggaugaacaccaagagg

SEQ ID NO: 16595 - RNA, 18 nt, Artificial Sequence
  Description of Artificial Sequence: Synthetic oligonucleotide
cuugagggaugaacacca

SEQ ID NO: 16596 - RNA, 18 nt, Artificial Sequence
  Description of Artificial Sequence: Synthetic oligonucleotide
ugcuucuugagggaugaa

SEQ ID NO: 16597 - RNA, 18 nt, Artificial Sequence
  Description of Artificial Sequence: Synthetic oligonucleotide
gccagugcuucuugaggg

SEQ ID NO: 16598 - RNA, 18 nt, Artificial Sequence
  Description of Artificial Sequence: Synthetic oligonucleotide
uuucugccagugcuucuu

SEQ ID NO: 16599 - RNA, 18 nt, Artificial Sequence
  Description of Artificial Sequence: Synthetic oligonucleotide
cuggguuucugccagugc

SEQ ID NO: 16600 - RNA, 18 nt, Artificial Sequence
  Description of Artificial Sequence: Synthetic oligonucleotide
gauuccuggguuucugcc

SEQ ID NO: 16601 - RNA, 18 nt, Artificial Sequence
  Description of Artificial Sequence: Synthetic oligonucleotide
aauuugauuccuggguuu

SEQ ID NO: 16602 - RNA, 18 nt, Artificial Sequence
  Description of Artificial Sequence: Synthetic oligonucleotide
ugcccaauuugauuccug

SEQ ID NO: 16603 - RNA, 18 nt, Artificial Sequence
  Description of Artificial Sequence: Synthetic oligonucleotide
uuuugugcccaauuugau

SEQ ID NO: 16604 - RNA, 18 nt, Artificial Sequence
  Description of Artificial Sequence: Synthetic oligonucleotide
accauuuuugugcccaau

SEQ ID NO: 16605 - RNA, 18 nt, Artificial Sequence
  Description of Artificial Sequence: Synthetic oligonucleotide
uccuuaccauuuuugugc

SEQ ID NO: 16606 - RNA, 18 nt, Artificial Sequence
  Description of Artificial Sequence: Synthetic oligonucleotide
ccauuuccuuaccauuuu

SEQ ID NO: 16607 - RNA, 18 nt, Artificial Sequence
  Description of Artificial Sequence: Synthetic oligonucleotide
cuuugccauuuccuuacc

SEQ ID NO: 16608 - RNA, 18 nt, Artificial Sequence
  Description of Artificial Sequence: Synthetic oligonucleotide
aaauacuuugccauuucc

SEQ ID NO: 16609 - RNA, 18 nt, Artificial Sequence
  Description of Artificial Sequence: Synthetic oligonucleotide
guucuaaauacuuugcca

SEQ ID NO: 16610 - RNA, 18 nt, Artificial Sequence
  Description of Artificial Sequence: Synthetic oligonucleotide
gcgaaguucuaaauacuu

SEQ ID NO: 16611 - RNA, 18 nt, Artificial Sequence
  Description of Artificial Sequence: Synthetic oligonucleotide
agcgggcgaaguucuaaa

SEQ ID NO: 16612 - RNA, 18 nt, Artificial Sequence
  Description of Artificial Sequence: Synthetic oligonucleotide
caauuagcgggcgaaguu

SEQ ID NO: 16613 - RNA, 18 nt, Artificial Sequence
  Description of Artificial Sequence: Synthetic oligonucleotide
aaacacaauuagcgggcg

SEQ ID NO: 16614 - RNA, 18 nt, Artificial Sequence
  Description of Artificial Sequence: Synthetic oligonucleotide
uggagaaacacaauuagc

SEQ ID NO: 16615 - RNA, 18 nt, Artificial Sequence
  Description of Artificial Sequence: Synthetic oligonucleotide
gucccuggagaaacacaa

SEQ ID NO: 16616 - RNA, 18 nt, Artificial Sequence
  Description of Artificial Sequence: Synthetic oligonucleotide
aaacagucccuggagaaa

SEQ ID NO: 16617 - RNA, 18 nt, Artificial Sequence
  Description of Artificial Sequence: Synthetic oligonucleotide
gaggaaaacagucccugg

SEQ ID NO: 16618 - RNA, 18 nt, Artificial Sequence
  Description of Artificial Sequence: Synthetic oligonucleotide
uguuugaggaaaacaguc

SEQ ID NO: 16619 - RNA, 18 nt, Artificial Sequence
  Description of Artificial Sequence: Synthetic oligonucleotide
gaggauguuugaggaaaa

SEQ ID NO: 16620 - RNA, 18 nt, Artificial Sequence
  Description of Artificial Sequence: Synthetic oligonucleotide
uuucagaggauguuugag

SEQ ID NO: 16621 - RNA, 18 nt, Artificial Sequence
  Description of Artificial Sequence: Synthetic oligonucleotide
caggauuucagaggaugu

SEQ ID NO: 16622 - RNA, 18 nt, Artificial Sequence
  Description of Artificial Sequence: Synthetic oligonucleotide
aggaccaggauuucagag

SEQ ID NO: 16623 - RNA, 18 nt, Artificial Sequence
  Description of Artificial Sequence: Synthetic oligonucleotide
gauauaggaccaggauuu

SEQ ID NO: 16624 - RNA, 18 nt, Artificial Sequence
  Description of Artificial Sequence: Synthetic oligonucleotide
cugcugauauaggaccag

SEQ ID NO: 16625 - RNA, 18 nt, Artificial Sequence
  Description of Artificial Sequence: Synthetic oligonucleotide
auucccugcugauauagg

SEQ ID NO: 16626 - RNA, 18 nt, Artificial Sequence
  Description of Artificial Sequence: Synthetic oligonucleotide
gccucauucccugcugau

SEQ ID NO: 16627 - RNA, 18 nt, Artificial Sequence
  Description of Artificial Sequence: Synthetic oligonucleotide
cuguggccucauucccug

SEQ ID NO: 16628 - RNA, 18 nt, Artificial Sequence
  Description of Artificial Sequence: Synthetic oligonucleotide
ucagucuguggccucauu

SEQ ID NO: 16629 - RNA, 18 nt, Artificial Sequence
  Description of Artificial Sequence: Synthetic oligonucleotide
ucucaucagucuguggcc

SEQ ID NO: 16630 - RNA, 18 nt, Artificial Sequence
  Description of Artificial Sequence: Synthetic oligonucleotide
uuuccucucaucagucug

SEQ ID NO: 16631 - RNA, 18 nt, Artificial Sequence
  Description of Artificial Sequence: Synthetic oligonucleotide
uaaaauuuccucucauca

SEQ ID NO: 16632 - RNA, 18 nt, Artificial Sequence
  Description of Artificial Sequence: Synthetic oligonucleotide
uaaaauaaaauuuccucu

SEQ ID NO: 16633 - RNA, 18 nt, Artificial Sequence
  Description of Artificial Sequence: Synthetic oligonucleotide
auagcuaaaauaaaauuu

SEQ ID NO: 16634 - RNA, 18 nt, Artificial Sequence
  Description of Artificial Sequence: Synthetic oligonucleotide
uggaaauagcuaaaauaa

SEQ ID NO: 16635 - RNA, 18 nt, Artificial Sequence
  Description of Artificial Sequence: Synthetic oligonucleotide
aaauguggaaauagcuaa

SEQ ID NO: 16636 - RNA, 18 nt, Artificial Sequence
  Description of Artificial Sequence: Synthetic oligonucleotide
gagaaaaauguggaaaua

SEQ ID NO: 16637 - RNA, 18 nt, Artificial Sequence
  Description of Artificial Sequence: Synthetic oligonucleotide
ugaaugagaaaaaugugg

SEQ ID NO: 16638 - RNA, 18 nt, Artificial Sequence
  Description of Artificial Sequence: Synthetic oligonucleotide
ggaccugaaugagaaaaa

SEQ ID NO: 16639 - RNA, 18 nt, Artificial Sequence
  Description of Artificial Sequence: Synthetic oligonucleotide
uuagaggaccugaaugag

SEQ ID NO: 16640 - RNA, 18 nt, Artificial Sequence
  Description of Artificial Sequence: Synthetic oligonucleotide
ccacauuagaggaccuga

SEQ ID NO: 16641 - RNA, 18 nt, Artificial Sequence
  Description of Artificial Sequence: Synthetic oligonucleotide
acuaaccacauuagagga

SEQ ID NO: 16642 - RNA, 18 nt, Artificial Sequence
  Description of Artificial Sequence: Synthetic oligonucleotide
ccacaacuaaccacauua

SEQ ID NO: 16643 - RNA, 18 nt, Artificial Sequence
  Description of Artificial Sequence: Synthetic oligonucleotide
ucaggccacaacuaacca

SEQ ID NO: 16644 - RNA, 18 nt, Artificial Sequence
  Description of Artificial Sequence: Synthetic oligonucleotide
cauuuucaggccacaacu

SEQ ID NO: 16645 - RNA, 18 nt, Artificial Sequence
  Description of Artificial Sequence: Synthetic oligonucleotide
aauaucauuuucaggcca

SEQ ID NO: 16646 - RNA, 18 nt, Artificial Sequence
  Description of Artificial Sequence: Synthetic oligonucleotide
uuggaaauaucauuuuca

SEQ ID NO: 16647 - RNA, 18 nt, Artificial Sequence
  Description of Artificial Sequence: Synthetic oligonucleotide
uucauuuggaaauaucau

SEQ ID NO: 16648 - RNA, 18 nt, Artificial Sequence
  Description of Artificial Sequence: Synthetic oligonucleotide
uccuauucauuuggaaau

SEQ ID NO: 16649 - RNA, 18 nt, Artificial Sequence
  Description of Artificial Sequence: Synthetic oligonucleotide
uuccuuccuauucauuug

SEQ ID NO: 16650 - RNA, 18 nt, Artificial Sequence
  Description of Artificial Sequence: Synthetic oligonucleotide
uuuccuuccuuccuauuc

SEQ ID NO: 16651 - RNA, 18 nt, Artificial Sequence
  Description of Artificial Sequence: Synthetic oligonucleotide
aacaauuuccuuccuucc

SEQ ID NO: 16652 - RNA, 18 nt, Artificial Sequence
  Description of Artificial Sequence: Synthetic oligonucleotide
acaaaaacaauuuccuuc

SEQ ID NO: 16653 - RNA, 18 nt, Artificial Sequence
  Description of Artificial Sequence: Synthetic oligonucleotide
aaacaacaaaaacaauuu

SEQ ID NO: 16654 - RNA, 18 nt, Artificial Sequence
  Description of Artificial Sequence: Synthetic oligonucleotide
aucuuaaacaacaaaaac

SEQ ID NO: 16655 - RNA, 18 nt, Artificial Sequence
  Description of Artificial Sequence: Synthetic oligonucleotide
cuuccaucuuaaacaaca

SEQ ID NO: 16656 - RNA, 18 nt, Artificial Sequence
  Description of Artificial Sequence: Synthetic oligonucleotide
auuuccuuccaucuuaaa

SEQ ID NO: 16657 - RNA, 18 nt, Artificial Sequence
  Description of Artificial Sequence: Synthetic oligonucleotide
ccuauauuuccuuccauc

SEQ ID NO: 16658 - RNA, 18 nt, Artificial Sequence
  Description of Artificial Sequence: Synthetic oligonucleotide
augcaccuauauuuccuu

SEQ ID NO: 16659 - RNA, 18 nt, Artificial Sequence
  Description of Artificial Sequence: Synthetic oligonucleotide
uuuaaaugcaccuauauu

SEQ ID NO: 16660 - RNA, 18 nt, Artificial Sequence
  Description of Artificial Sequence: Synthetic oligonucleotide
cauuuuuuaaaugcaccu

SEQ ID NO: 16661 - RNA, 18 nt, Artificial Sequence
  Description of Artificial Sequence: Synthetic oligonucleotide
agcuccauuuuuuaaaug

SEQ ID NO: 16662 - RNA, 18 nt, Artificial Sequence
  Description of Artificial Sequence: Synthetic oligonucleotide
aaccaagcuccauuuuuu

SEQ ID NO: 16663 - RNA, 18 nt, Artificial Sequence
  Description of Artificial Sequence: Synthetic oligonucleotide
caugcaaccaagcuccau

SEQ ID NO: 16664 - RNA, 18 nt, Artificial Sequence
  Description of Artificial Sequence: Synthetic oligonucleotide
aaaaucaugcaaccaagc

SEQ ID NO: 16665 - RNA, 18 nt, Artificial Sequence
  Description of Artificial Sequence: Synthetic oligonucleotide
gagcgaaaaucaugcaac

SEQ ID NO: 16666 - RNA, 18 nt, Artificial Sequence
  Description of Artificial Sequence: Synthetic oligonucleotide
cucaagagcgaaaaucau

SEQ ID NO: 16667 - RNA, 18 nt, Artificial Sequence
  Description of Artificial Sequence: Synthetic oligonucleotide
gaugacucaagagcgaaa

SEQ ID NO: 16668 - RNA, 18 nt, Artificial Sequence
  Description of Artificial Sequence: Synthetic oligonucleotide
ggcuagaugacucaagag

SEQ ID NO: 16669 - RNA, 18 nt, Artificial Sequence
  Description of Artificial Sequence: Synthetic oligonucleotide
uagagggcuagaugacuc

SEQ ID NO: 16670 - RNA, 18 nt, Artificial Sequence
  Description of Artificial Sequence: Synthetic oligonucleotide
aucauuagagggcuagau

SEQ ID NO: 16671 - RNA, 18 nt, Artificial Sequence
  Description of Artificial Sequence: Synthetic oligonucleotide
aggcaaucauuagagggc

SEQ ID NO: 16672 - RNA, 18 nt, Artificial Sequence
  Description of Artificial Sequence: Synthetic oligonucleotide
guaugaggcaaucauuag

SEQ ID NO: 16673 - RNA, 18 nt, Artificial Sequence
  Description of Artificial Sequence: Synthetic oligonucleotide
caccgguaugaggcaauc

SEQ ID NO: 16674 - RNA, 18 nt, Artificial Sequence
  Description of Artificial Sequence: Synthetic oligonucleotide
guaaucaccgguaugagg

SEQ ID NO: 16675 - RNA, 18 nt, Artificial Sequence
  Description of Artificial Sequence: Synthetic oligonucleotide
cgcucguaaucaccggua

SEQ ID NO: 16676 - RNA, 18 nt, Artificial Sequence
  Description of Artificial Sequence: Synthetic oligonucleotide
aaagccgcucguaaucac

SEQ ID NO: 16677 - RNA, 18 nt, Artificial Sequence
  Description of Artificial Sequence: Synthetic oligonucleotide
caugaaaagccgcucgua

SEQ ID NO: 16678 - RNA, 18 nt, Artificial Sequence
  Description of Artificial Sequence: Synthetic oligonucleotide
gggucaugaaaagccgcu

SEQ ID NO: 16679 - RNA, 18 nt, Artificial Sequence
  Description of Artificial Sequence: Synthetic oligonucleotide
aaaugguacauauggaag

SEQ ID NO: 16680 - RNA, 18 nt, Artificial Sequence
  Description of Artificial Sequence: Synthetic oligonucleotide
uuuuaaaaugguacauau

SEQ ID NO: 16681 - RNA, 18 nt, Artificial Sequence
  Description of Artificial Sequence: Synthetic oligonucleotide
cagcauuuuaaaauggua

SEQ ID NO: 16682 - RNA, 18 nt, Artificial Sequence
  Description of Artificial Sequence: Synthetic oligonucleotide
guaaucagcauuuuaaaa

SEQ ID NO: 16683 - RNA, 18 nt, Artificial Sequence
  Description of Artificial Sequence: Synthetic oligonucleotide
aagaaguaaucagcauuu

SEQ ID NO: 16684 - RNA, 18 nt, Artificial Sequence
  Description of Artificial Sequence: Synthetic oligonucleotide
uucucaagaaguaaucag

SEQ ID NO: 16685 - RNA, 18 nt, Artificial Sequence
  Description of Artificial Sequence: Synthetic oligonucleotide
ucuuauucucaagaagua

SEQ ID NO: 16686 - RNA, 18 nt, Artificial Sequence
  Description of Artificial Sequence: Synthetic oligonucleotide
gcuucucuuauucucaag

SEQ ID NO: 16687 - RNA, 18 nt, Artificial Sequence
  Description of Artificial Sequence: Synthetic oligonucleotide
auuaggcuucucuuauuc

SEQ ID NO: 16688 - RNA, 18 nt, Artificial Sequence
  Description of Artificial Sequence: Synthetic oligonucleotide
cugaaauuaggcuucucu

SEQ ID NO: 16689 - RNA, 18 nt, Artificial Sequence
  Description of Artificial Sequence: Synthetic oligonucleotide
auauucugaaauuaggcu

SEQ ID NO: 16690 - RNA, 18 nt, Artificial Sequence
  Description of Artificial Sequence: Synthetic oligonucleotide
uaaugauauucugaaauu

SEQ ID NO: 16691 - RNA, 18 nt, Artificial Sequence
  Description of Artificial Sequence: Synthetic oligonucleotide
uacccuaaugauauucug

SEQ ID NO: 16692 - RNA, 18 nt, Artificial Sequence
  Description of Artificial Sequence: Synthetic oligonucleotide
auagguacccuaaugaua

SEQ ID NO: 16693 - RNA, 18 nt, Artificial Sequence
  Description of Artificial Sequence: Synthetic oligonucleotide
cuucaauagguacccuaa

SEQ ID NO: 16694 - RNA, 18 nt, Artificial Sequence
  Description of Artificial Sequence: Synthetic oligonucleotide
caagacuucaauagguac

SEQ ID NO: 16695 - RNA, 18 nt, Artificial Sequence
  Description of Artificial Sequence: Synthetic oligonucleotide
gcagucaagacuucaaua

SEQ ID NO: 16696 - RNA, 18 nt, Artificial Sequence
  Description of Artificial Sequence: Synthetic oligonucleotide
uaugugcagucaagacuu

SEQ ID NO: 16697 - RNA, 18 nt, Artificial Sequence
  Description of Artificial Sequence: Synthetic oligonucleotide
cuaaauaugugcagucaa

SEQ ID NO: 16698 - RNA, 18 nt, Artificial Sequence
  Description of Artificial Sequence: Synthetic oligonucleotide
guaugcuaaauaugugca

SEQ ID NO: 16699 - RNA, 18 nt, Artificial Sequence
  Description of Artificial Sequence: Synthetic oligonucleotide
agggaguaugcuaaauau

SEQ ID NO: 16700 - RNA, 18 nt, Artificial Sequence
  Description of Artificial Sequence: Synthetic oligonucleotide
uucccagggaguaugcua

SEQ ID NO: 16701 - RNA, 18 nt, Artificial Sequence
  Description of Artificial Sequence: Synthetic oligonucleotide
uauaauucccagggagua

SEQ ID NO: 16702 - RNA, 18 nt, Artificial Sequence
  Description of Artificial Sequence: Synthetic oligonucleotide
uaaaauauaauucccagg

SEQ ID NO: 16703 - RNA, 18 nt, Artificial Sequence
  Description of Artificial Sequence: Synthetic oligonucleotide
guccuuaaaauauaauuc

SEQ ID NO: 16704 - RNA, 18 nt, Artificial Sequence
  Description of Artificial Sequence: Synthetic oligonucleotide
aaaauguccuuaaaauau

SEQ ID NO: 16705 - RNA, 18 nt, Artificial Sequence
  Description of Artificial Sequence: Synthetic oligonucleotide
auagaaaaauguccuuaa

SEQ ID NO: 16706 - RNA, 18 nt, Artificial Sequence
  Description of Artificial Sequence: Synthetic oligonucleotide
auuuaauagaaaaauguc

SEQ ID NO: 16707 - RNA, 18 nt, Artificial Sequence
  Description of Artificial Sequence: Synthetic oligonucleotide
caaugauuuaauagaaaa

SEQ ID NO: 16708 - RNA, 18 nt, Artificial Sequence
  Description of Artificial Sequence: Synthetic oligonucleotide
auaugcaaugauuuaaua

SEQ ID NO: 16709 - RNA, 18 nt, Artificial Sequence
  Description of Artificial Sequence: Synthetic oligonucleotide
cuuccauaugcaaugauu

SEQ ID NO: 16710 - RNA, 18 nt, Artificial Sequence
  Description of Artificial Sequence: Synthetic oligonucleotide
aguuucuuccauaugcaa

SEQ ID NO: 16711 - RNA, 18 nt, Artificial Sequence
  Description of Artificial Sequence: Synthetic oligonucleotide
uauugaguuucuuccaua

SEQ ID NO: 16712 - RNA, 18 nt, Artificial Sequence
  Description of Artificial Sequence: Synthetic oligonucleotide
uauuauauugaguuucuu

SEQ ID NO: 16713 - RNA, 18 nt, Artificial Sequence
  Description of Artificial Sequence: Synthetic oligonucleotide
ucagcuauuauauugagu

SEQ ID NO: 16714 - RNA, 18 nt, Artificial Sequence
  Description of Artificial Sequence: Synthetic oligonucleotide
aaauaucagcuauuauau

SEQ ID NO: 16715 - RNA, 18 nt, Artificial Sequence
  Description of Artificial Sequence: Synthetic oligonucleotide
caaguaaauaucagcuau

SEQ ID NO: 16716 - RNA, 18 nt, Artificial Sequence
  Description of Artificial Sequence: Synthetic oligonucleotide
gaacccaaguaaauauca

SEQ ID NO: 16717 - RNA, 18 nt, Artificial Sequence
  Description of Artificial Sequence: Synthetic oligonucleotide
auuaagaacccaaguaaa

SEQ ID NO: 16718 - RNA, 18 nt, Artificial Sequence
  Description of Artificial Sequence: Synthetic oligonucleotide
uucugauuaagaacccaa

SEQ ID NO: 16719 - RNA, 18 nt, Artificial Sequence
  Description of Artificial Sequence: Synthetic oligonucleotide
caauguucugauuaagaa

SEQ ID NO: 16720 - RNA, 18 nt, Artificial Sequence
  Description of Artificial Sequence: Synthetic oligonucleotide
acagccaauguucugauu

SEQ ID NO: 16721 - RNA, 18 nt, Artificial Sequence
  Description of Artificial Sequence: Synthetic oligonucleotide
aucacacagccaauguuc

SEQ ID NO: 16722 - RNA, 18 nt, Artificial Sequence
  Description of Artificial Sequence: Synthetic oligonucleotide
ugaaaaucacacagccaa

SEQ ID NO: 16723 - RNA, 18 nt, Artificial Sequence
  Description of Artificial Sequence: Synthetic oligonucleotide
aaucaugaaaaucacaca

SEQ ID NO: 16724 - RNA, 18 nt, Artificial Sequence
  Description of Artificial Sequence: Synthetic oligonucleotide
aucauaaucaugaaaauc

SEQ ID NO: 16725 - RNA, 18 nt, Artificial Sequence
  Description of Artificial Sequence: Synthetic oligonucleotide
ugaaaaucauaaucauga

SEQ ID NO: 16726 - RNA, 18 nt, Artificial Sequence
  Description of Artificial Sequence: Synthetic oligonucleotide
ugcaaugaaaaucauaau

SEQ ID NO: 16727 - RNA, 18 nt, Artificial Sequence
  Description of Artificial Sequence: Synthetic oligonucleotide
uuaauugcaaugaaaauc

SEQ ID NO: 16728 - RNA, 18 nt, Artificial Sequence
  Description of Artificial Sequence: Synthetic oligonucleotide
ucaacuuaauugcaauga

SEQ ID NO: 16729 - RNA, 18 nt, Artificial Sequence
  Description of Artificial Sequence: Synthetic oligonucleotide
aaacaucaacuuaauugc

SEQ ID NO: 16730 - RNA, 18 nt, Artificial Sequence
  Description of Artificial Sequence: Synthetic oligonucleotide
cuacaaaacaucaacuua

SEQ ID NO: 16731 - RNA, 18 nt, Artificial Sequence
  Description of Artificial Sequence: Synthetic oligonucleotide
acugucuacaaaacauca

SEQ ID NO: 16732 - RNA, 18 nt, Artificial Sequence
  Description of Artificial Sequence: Synthetic oligonucleotide
auuucacugucuacaaaa

SEQ ID NO: 16733 - RNA, 18 nt, Artificial Sequence
  Description of Artificial Sequence: Synthetic oligonucleotide
ugguaauuucacugucua

SEQ ID NO: 16734 - RNA, 18 nt, Artificial Sequence
  Description of Artificial Sequence: Synthetic oligonucleotide
guagaugguaauuucacu

SEQ ID NO: 16735 - RNA, 18 nt, Artificial Sequence
  Description of Artificial Sequence: Synthetic oligonucleotide
uuggaguagaugguaauu

SEQ ID NO: 16736 - RNA, 18 nt, Artificial Sequence
  Description of Artificial Sequence: Synthetic oligonucleotide
aucuuuuggaguagaugg

SEQ ID NO: 16737 - RNA, 18 nt, Artificial Sequence
  Description of Artificial Sequence: Synthetic oligonucleotide
uugcaaucuuuuggagua

SEQ ID NO: 16738 - RNA, 18 nt, Artificial Sequence
  Description of Artificial Sequence: Synthetic oligonucleotide
cuauuuugcaaucuuuug

SEQ ID NO: 16739 - RNA, 18 nt, Artificial Sequence
  Description of Artificial Sequence: Synthetic oligonucleotide
aaauucuauuuugcaauc

SEQ ID NO: 16740 - RNA, 18 nt, Artificial Sequence
  Description of Artificial Sequence: Synthetic oligonucleotide
agguuaaauucuauuuug

SEQ ID NO: 16741 - RNA, 18 nt, Artificial Sequence
  Description of Artificial Sequence: Synthetic oligonucleotide
cucuaagguuaaauucua

SEQ ID NO: 16742 - RNA, 18 nt, Artificial Sequence
  Description of Artificial Sequence: Synthetic oligonucleotide
auuggcucuaagguuaaa

SEQ ID NO: 16743 - RNA, 18 nt, Artificial Sequence
  Description of Artificial Sequence: Synthetic oligonucleotide
ccugcauuggcucuaagg

SEQ ID NO: 16744 - RNA, 18 nt, Artificial Sequence
  Description of Artificial Sequence: Synthetic oligonucleotide
uuuucccugcauuggcuc

SEQ ID NO: 16745 - RNA, 18 nt, Artificial Sequence
  Description of Artificial Sequence: Synthetic oligonucleotide
acaaguuuucccugcauu

SEQ ID NO: 16746 - RNA, 18 nt, Artificial Sequence
  Description of Artificial Sequence: Synthetic oligonucleotide
cagaaacaaguuuucccu

SEQ ID NO: 16747 - RNA, 18 nt, Artificial Sequence
  Description of Artificial Sequence: Synthetic oligonucleotide
accugcagaaacaaguuu

SEQ ID NO: 16748 - RNA, 18 nt, Artificial Sequence
  Description of Artificial Sequence: Synthetic oligonucleotide
aaugcaccugcagaaaca

SEQ ID NO: 16749 - RNA, 18 nt, Artificial Sequence
  Description of Artificial Sequence: Synthetic oligonucleotide
caaaaaaugcaccugcag

SEQ ID NO: 16750 - RNA, 18 nt, Artificial Sequence
  Description of Artificial Sequence: Synthetic oligonucleotide
aguuucaaaaaaugcacc

SEQ ID NO: 16751 - RNA, 18 nt, Artificial Sequence
  Description of Artificial Sequence: Synthetic oligonucleotide
guugaaguuucaaaaaau

SEQ ID NO: 16752 - RNA, 18 nt, Artificial Sequence
  Description of Artificial Sequence: Synthetic oligonucleotide
uaucuguugaaguuucaa

SEQ ID NO: 16753 - RNA, 18 nt, Artificial Sequence
  Description of Artificial Sequence: Synthetic oligonucleotide
ccugcuaucuguugaagu

SEQ ID NO: 16754 - RNA, 18 nt, Artificial Sequence
  Description of Artificial Sequence: Synthetic oligonucleotide
uucccccugcuaucuguu

SEQ ID NO: 16755 - RNA, 18 nt, Artificial Sequence
  Description of Artificial Sequence: Synthetic oligonucleotide
uuuuuuucccccugcuau

SEQ ID NO: 16756 - RNA, 18 nt, Artificial Sequence
  Description of Artificial Sequence: Synthetic oligonucleotide
ucacuuuuuuuucccccu

SEQ ID NO: 16757 - RNA, 18 nt, Artificial Sequence
  Description of Artificial Sequence: Synthetic oligonucleotide
uucugucacuuuuuuuuc

SEQ ID NO: 16758 - RNA, 18 nt, Artificial Sequence
  Description of Artificial Sequence: Synthetic oligonucleotide
gauccuucugucacuuuu

SEQ ID NO: 16759 - RNA, 18 nt, Artificial Sequence
  Description of Artificial Sequence: Synthetic oligonucleotide
acugugauccuucuguca

SEQ ID NO: 16760 - RNA, 18 nt, Artificial Sequence
  Description of Artificial Sequence: Synthetic oligonucleotide
gcugaacugugauccuuc

SEQ ID NO: 16761 - RNA, 18 nt, Artificial Sequence
  Description of Artificial Sequence: Synthetic oligonucleotide
auacugcugaacugugau

SEQ ID NO: 16762 - RNA, 18 nt, Artificial Sequence
  Description of Artificial Sequence: Synthetic oligonucleotide
aauucauacugcugaacu

SEQ ID NO: 16763 - RNA, 18 nt, Artificial Sequence
  Description of Artificial Sequence: Synthetic oligonucleotide
cagacaauucauacugcu

SEQ ID NO: 16764 - RNA, 18 nt, Artificial Sequence
  Description of Artificial Sequence: Synthetic oligonucleotide
gccagcagacaauucaua

SEQ ID NO: 16765 - RNA, 18 nt, Artificial Sequence
  Description of Artificial Sequence: Synthetic oligonucleotide
aggcugccagcagacaau

SEQ ID NO: 16766 - RNA, 18 nt, Artificial Sequence
  Description of Artificial Sequence: Synthetic oligonucleotide
uugcaaggcugccagcag

SEQ ID NO: 16767 - RNA, 18 nt, Artificial Sequence
  Description of Artificial Sequence: Synthetic oligonucleotide
ccagauugcaaggcugcc

SEQ ID NO: 16768 - RNA, 18 nt, Artificial Sequence
  Description of Artificial Sequence: Synthetic oligonucleotide
gcacaccagauugcaagg

SEQ ID NO: 16769 - RNA, 18 nt, Artificial Sequence
  Description of Artificial Sequence: Synthetic oligonucleotide
ugccugcacaccagauug

SEQ ID NO: 16770 - RNA, 18 nt, Artificial Sequence
  Description of Artificial Sequence: Synthetic oligonucleotide
cucacugccugcacacca

SEQ ID NO: 16771 - RNA, 18 nt, Artificial Sequence
  Description of Artificial Sequence: Synthetic oligonucleotide
acaaucucacugccugca

SEQ ID NO: 16772 - RNA, 18 nt, Artificial Sequence
  Description of Artificial Sequence: Synthetic oligonucleotide
acaccacaaucucacugc

SEQ ID NO: 16773 - RNA, 18 nt, Artificial Sequence
  Description of Artificial Sequence: Synthetic oligonucleotide
cauguacaccacaaucuc

SEQ ID NO: 16774 - RNA, 18 nt, Artificial Sequence
  Description of Artificial Sequence: Synthetic oligonucleotide
ggugacauguacaccaca

SEQ ID NO: 16775 - RNA, 18 nt, Artificial Sequence
  Description of Artificial Sequence: Synthetic oligonucleotide
aaucaggugacauguaca

SEQ ID NO: 16776 - RNA, 18 nt, Artificial Sequence
  Description of Artificial Sequence: Synthetic oligonucleotide
uguaguccugguggcaug

SEQ ID NO: 16777 - RNA, 18 nt, Artificial Sequence
  Description of Artificial Sequence: Synthetic oligonucleotide
gccccuguaguccuggug

SEQ ID NO: 16778 - RNA, 18 nt, Artificial Sequence
  Description of Artificial Sequence: Synthetic oligonucleotide
acucugccccuguagucc

SEQ ID NO: 16779 - RNA, 18 nt, Artificial Sequence
  Description of Artificial Sequence: Synthetic oligonucleotide
gagacacucugccccugu

SEQ ID NO: 16780 - RNA, 18 nt, Artificial Sequence
  Description of Artificial Sequence: Synthetic oligonucleotide
cagaggagacacucugcc

SEQ ID NO: 16781 - RNA, 18 nt, Artificial Sequence
  Description of Artificial Sequence: Synthetic oligonucleotide
gcugccagaggagacacu

SEQ ID NO: 16782 - RNA, 18 nt, Artificial Sequence
  Description of Artificial Sequence: Synthetic oligonucleotide
ucagagcugccagaggag

SEQ ID NO: 16783 - RNA, 18 nt, Artificial Sequence
  Description of Artificial Sequence: Synthetic oligonucleotide
ugaucucagagcugccag

SEQ ID NO: 16784 - RNA, 18 nt, Artificial Sequence
  Description of Artificial Sequence: Synthetic oligonucleotide
ggauuugaucucagagcu

SEQ ID NO: 16785 - RNA, 18 nt, Artificial Sequence
  Description of Artificial Sequence: Synthetic oligonucleotide
ucaucggauuugaucuca

SEQ ID NO: 16786 - RNA, 18 nt, Artificial Sequence
  Description of Artificial Sequence: Synthetic oligonucleotide
ccucgucaucggauuuga

SEQ ID NO: 16787 - RNA, 18 nt, Artificial Sequence
  Description of Artificial Sequence: Synthetic oligonucleotide
aucacccucgucaucgga

SEQ ID NO: 16788 - RNA, 18 nt, Artificial Sequence
  Description of Artificial Sequence: Synthetic oligonucleotide
uucucaucacccucguca

SEQ ID NO: 16789 - RNA, 18 nt, Artificial Sequence
  Description of Artificial Sequence: Synthetic oligonucleotide
gcagguucucaucacccu

SEQ ID NO: 16790 - RNA, 18 nt, Artificial Sequence
  Description of Artificial Sequence: Synthetic oligonucleotide
gucuugcagguucucauc

SEQ ID NO: 16791 - RNA, 18 nt, Artificial Sequence
  Description of Artificial Sequence: Synthetic oligonucleotide
uucgugucuugcagguuc

SEQ ID NO: 16792 - RNA, 18 nt, Artificial Sequence
  Description of Artificial Sequence: Synthetic oligonucleotide
aagauuucgugucuugca

SEQ ID NO: 16793 - RNA, 18 nt, Artificial Sequence
  Description of Artificial Sequence: Synthetic oligonucleotide
cuccgaagauuucguguc

SEQ ID NO: 16794 - RNA, 18 nt, Artificial Sequence
  Description of Artificial Sequence: Synthetic oligonucleotide
uuguccuccgaagauuuc

SEQ ID NO: 16795 - RNA, 18 nt, Artificial Sequence
  Description of Artificial Sequence: Synthetic oligonucleotide
auuucuuguccuccgaag

SEQ ID NO: 16796 - RNA, 18 nt, Artificial Sequence
  Description of Artificial Sequence: Synthetic oligonucleotide
aucuaauuucuuguccuc

SEQ ID NO: 16797 - RNA, 18 nt, Artificial Sequence
  Description of Artificial Sequence: Synthetic oligonucleotide
ucgucaucuaauuucuug

SEQ ID NO: 16798 - RNA, 18 nt, Artificial Sequence
  Description of Artificial Sequence: Synthetic oligonucleotide
ucuugucgucaucuaauu

SEQ ID NO: 16799 - RNA, 18 nt, Artificial Sequence
  Description of Artificial Sequence: Synthetic oligonucleotide
auccuucuugucgucauc

SEQ ID NO: 16800 - RNA, 18 nt, Artificial Sequence
  Description of Artificial Sequence: Synthetic oligonucleotide
uugauauccuucuugucg

SEQ ID NO: 16801 - RNA, 18 nt, Artificial Sequence
  Description of Artificial Sequence: Synthetic oligonucleotide
uugauuugauauccuucu

SEQ ID NO: 16802 - RNA, 18 nt, Artificial Sequence
  Description of Artificial Sequence: Synthetic oligonucleotide
aguaauugauuugauauc

SEQ ID NO: 16803 - RNA, 18 nt, Artificial Sequence
  Description of Artificial Sequence: Synthetic oligonucleotide
gaccuaguaauugauuug

SEQ ID NO: 16804 - RNA, 18 nt, Artificial Sequence
  Description of Artificial Sequence: Synthetic oligonucleotide
aucuugaccuaguaauug

SEQ ID NO: 16805 - RNA, 18 nt, Artificial Sequence
  Description of Artificial Sequence: Synthetic oligonucleotide
uucacgauggguccccac

SEQ ID NO: 16806 - RNA, 18 nt, Artificial Sequence
  Description of Artificial Sequence: Synthetic oligonucleotide
ccaucuucacgauggguc

SEQ ID NO: 16807 - RNA, 18 nt, Artificial Sequence
  Description of Artificial Sequence: Synthetic oligonucleotide
ccacgccaucuucacgau

SEQ ID NO: 16808 - RNA, 18 nt, Artificial Sequence
  Description of Artificial Sequence: Synthetic oligonucleotide
cagggccacgccaucuuc

SEQ ID NO: 16809 - RNA, 18 nt, Artificial Sequence
  Description of Artificial Sequence: Synthetic oligonucleotide
ccucucagggccacgcca

SEQ ID NO: 16810 - RNA, 18 nt, Artificial Sequence
  Description of Artificial Sequence: Synthetic oligonucleotide
ggcugccucucagggcca

SEQ ID NO: 16811 - RNA, 18 nt, Artificial Sequence
  Description of Artificial Sequence: Synthetic oligonucleotide
agaauggcugccucucag

SEQ ID NO: 16812 - RNA, 18 nt, Artificial Sequence
  Description of Artificial Sequence: Synthetic oligonucleotide
agaagagaauggcugccu

SEQ ID NO: 16813 - RNA, 18 nt, Artificial Sequence
  Description of Artificial Sequence: Synthetic oligonucleotide
uuggcagaagagaauggc

SEQ ID NO: 16814 - RNA, 18 nt, Artificial Sequence
  Description of Artificial Sequence: Synthetic oligonucleotide
cugguuuggcagaagaga

SEQ ID NO: 16815 - RNA, 18 nt, Artificial Sequence
  Description of Artificial Sequence: Synthetic oligonucleotide
ggaaccugguuuggcaga

SEQ ID NO: 16816 - RNA, 18 nt, Artificial Sequence
  Description of Artificial Sequence: Synthetic oligonucleotide
gaaccggaaccugguuug

SEQ ID NO: 16817 - RNA, 18 nt, Artificial Sequence
  Description of Artificial Sequence: Synthetic oligonucleotide
cuguggaaccggaaccug

SEQ ID NO: 16818 - RNA, 18 nt, Artificial Sequence
  Description of Artificial Sequence: Synthetic oligonucleotide
ggaagcuguggaaccgga

SEQ ID NO: 16819 - RNA, 18 nt, Artificial Sequence
  Description of Artificial Sequence: Synthetic oligonucleotide
ggacaggaagcuguggaa

SEQ ID NO: 16820 - RNA, 18 nt, Artificial Sequence
  Description of Artificial Sequence: Synthetic oligonucleotide
agacuggacaggaagcug

SEQ ID NO: 16821 - RNA, 18 nt, Artificial Sequence
  Description of Artificial Sequence: Synthetic oligonucleotide
gucgcagacuggacagga

SEQ ID NO: 16822 - RNA, 18 nt, Artificial Sequence
  Description of Artificial Sequence: Synthetic oligonucleotide
gggaagucgcagacugga

SEQ ID NO: 16823 - RNA, 18 nt, Artificial Sequence
  Description of Artificial Sequence: Synthetic oligonucleotide
gguggguucaggucaggg

SEQ ID NO: 16824 - RNA, 18 nt, Artificial Sequence
  Description of Artificial Sequence: Synthetic oligonucleotide
ggguggguucaggucagg

SEQ ID NO: 16825 - RNA, 18 nt, Artificial Sequence
  Description of Artificial Sequence: Synthetic oligonucleotide
cucuguaaggguccuggg

SEQ ID NO: 16826 - RNA, 18 nt, Artificial Sequence
  Description of Artificial Sequence: Synthetic oligonucleotide
gugcccuggugaggccaa

SEQ ID NO: 16827 - RNA, 18 nt, Artificial Sequence
  Description of Artificial Sequence: Synthetic oligonucleotide
cagaagugcccuggugag

SEQ ID NO: 16828 - RNA, 18 nt, Artificial Sequence
  Description of Artificial Sequence: Synthetic oligonucleotide
gaggucagaagugcccug

SEQ ID NO: 16829 - RNA, 18 nt, Artificial Sequence
  Description of Artificial Sequence: Synthetic oligonucleotide
aaagugaggucagaagug

SEQ ID NO: 16830 - RNA, 18 nt, Artificial Sequence
  Description of Artificial Sequence: Synthetic oligonucleotide
uugugaaagugaggucag

SEQ ID NO: 16831 - RNA, 18 nt, Artificial Sequence
  Description of Artificial Sequence: Synthetic oligonucleotide
uccuauugugaaagugag

SEQ ID NO: 16832 - RNA, 18 nt, Artificial Sequence
  Description of Artificial Sequence: Synthetic oligonucleotide
acugguccuauugugaaa

SEQ ID NO: 16833 - RNA, 18 nt, Artificial Sequence
  Description of Artificial Sequence: Synthetic oligonucleotide
ucaacacugguccuauug

SEQ ID NO: 16834 - RNA, 18 nt, Artificial Sequence
  Description of Artificial Sequence: Synthetic oligonucleotide
ggguaucaacacuggucc

SEQ ID NO: 16835 - RNA, 18 nt, Artificial Sequence
  Description of Artificial Sequence: Synthetic oligonucleotide
aggcuggguaucaacacu

SEQ ID NO: 16836 - RNA, 18 nt, Artificial Sequence
  Description of Artificial Sequence: Synthetic oligonucleotide
ccaagaggcuggguauca

SEQ ID NO: 16837 - RNA, 18 nt, Artificial Sequence
  Description of Artificial Sequence: Synthetic oligonucleotide
gaacaccaagaggcuggg

SEQ ID NO: 16838 - RNA, 18 nt, Artificial Sequence
  Description of Artificial Sequence: Synthetic oligonucleotide
gggaugaacaccaagagg

SEQ ID NO: 16839 - RNA, 18 nt, Artificial Sequence
  Description of Artificial Sequence: Synthetic oligonucleotide
cuugagggaugaacacca

SEQ ID NO: 16840 - RNA, 18 nt, Artificial Sequence
  Description of Artificial Sequence: Synthetic oligonucleotide
ugcuucuugagggaugaa

SEQ ID NO: 16841 - RNA, 18 nt, Artificial Sequence
  Description of Artificial Sequence: Synthetic oligonucleotide
gccagugcuucuugaggg

SEQ ID NO: 16842 - RNA, 18 nt, Artificial Sequence
  Description of Artificial Sequence: Synthetic oligonucleotide
uuucugccagugcuucuu

SEQ ID NO: 16843 - RNA, 18 nt, Artificial Sequence
  Description of Artificial Sequence: Synthetic oligonucleotide
cuggguuucugccagugc

SEQ ID NO: 16844 - RNA, 18 nt, Artificial Sequence
  Description of Artificial Sequence: Synthetic oligonucleotide
gauuccuggguuucugcc

SEQ ID NO: 16845 - RNA, 18 nt, Artificial Sequence
  Description of Artificial Sequence: Synthetic oligonucleotide
aauuugauuccuggguuu

SEQ ID NO: 16846 - RNA, 18 nt, Artificial Sequence
  Description of Artificial Sequence: Synthetic oligonucleotide
ugcccaauuugauuccug

SEQ ID NO: 16847 - RNA, 18 nt, Artificial Sequence
  Description of Artificial Sequence: Synthetic oligonucleotide
uuuugugcccaauuugau

SEQ ID NO: 16848 - RNA, 18 nt, Artificial Sequence
  Description of Artificial Sequence: Synthetic oligonucleotide
accauuuuugugcccaau

SEQ ID NO: 16849 - RNA, 18 nt, Artificial Sequence
  Description of Artificial Sequence: Synthetic oligonucleotide
uccuuaccauuuuugugc

SEQ ID NO: 16850 - RNA, 18 nt, Artificial Sequence
  Description of Artificial Sequence: Synthetic oligonucleotide
ccauuuccuuaccauuuu

SEQ ID NO: 16851 - RNA, 18 nt, Artificial Sequence
  Description of Artificial Sequence: Synthetic oligonucleotide
cuuugccauuuccuuacc

SEQ ID NO: 16852 - RNA, 18 nt, Artificial Sequence
  Description of Artificial Sequence: Synthetic oligonucleotide
aaauacuuugccauuucc

SEQ ID NO: 16853 - RNA, 18 nt, Artificial Sequence
  Description of Artificial Sequence: Synthetic oligonucleotide
guucuaaauacuuugcca

SEQ ID NO: 16854 - RNA, 18 nt, Artificial Sequence
  Description of Artificial Sequence: Synthetic oligonucleotide
gcgaaguucuaaauacuu

SEQ ID NO: 16855 - RNA, 18 nt, Artificial Sequence
  Description of Artificial Sequence: Synthetic oligonucleotide
agcgggcgaaguucuaaa

SEQ ID NO: 16856 - RNA, 18 nt, Artificial Sequence
  Description of Artificial Sequence: Synthetic oligonucleotide
caauuagcgggcgaaguu

SEQ ID NO: 16857 - RNA, 18 nt, Artificial Sequence
  Description of Artificial Sequence: Synthetic oligonucleotide
aaacacaauuagcgggcg

SEQ ID NO: 16858 - RNA, 18 nt, Artificial Sequence
  Description of Artificial Sequence: Synthetic oligonucleotide
uggagaaacacaauuagc

SEQ ID NO: 16859 - RNA, 18 nt, Artificial Sequence
  Description of Artificial Sequence: Synthetic oligonucleotide
gucccuggagaaacacaa

SEQ ID NO: 16860 - RNA, 18 nt, Artificial Sequence
  Description of Artificial Sequence: Synthetic oligonucleotide
aaacagucccuggagaaa

SEQ ID NO: 16861 - RNA, 18 nt, Artificial Sequence
  Description of Artificial Sequence: Synthetic oligonucleotide
gaggaaaacagucccugg

SEQ ID NO: 16862 - RNA, 18 nt, Artificial Sequence
  Description of Artificial Sequence: Synthetic oligonucleotide
uguuugaggaaaacaguc

SEQ ID NO: 16863 - RNA, 18 nt, Artificial Sequence
  Description of Artificial Sequence: Synthetic oligonucleotide
gaggauguuugaggaaaa

SEQ ID NO: 16864 - RNA, 18 nt, Artificial Sequence
  Description of Artificial Sequence: Synthetic oligonucleotide
uuucagaggauguuugag

SEQ ID NO: 16865 - RNA, 18 nt, Artificial Sequence
  Description of Artificial Sequence: Synthetic oligonucleotide
caggauuucagaggaugu

SEQ ID NO: 16866 - RNA, 18 nt, Artificial Sequence
  Description of Artificial Sequence: Synthetic oligonucleotide
aggaccaggauuucagag

SEQ ID NO: 16867 - RNA, 18 nt, Artificial Sequence
  Description of Artificial Sequence: Synthetic oligonucleotide
gauauaggaccaggauuu

SEQ ID NO: 16868 - RNA, 18 nt, Artificial Sequence
  Description of Artificial Sequence: Synthetic oligonucleotide
cugcugauauaggaccag

SEQ ID NO: 16869 - RNA, 18 nt, Artificial Sequence
  Description of Artificial Sequence: Synthetic oligonucleotide
auucccugcugauauagg

SEQ ID NO: 16870 - RNA, 18 nt, Artificial Sequence
  Description of Artificial Sequence: Synthetic oligonucleotide
gccucauucccugcugau

SEQ ID NO: 16871 - RNA, 18 nt, Artificial Sequence
  Description of Artificial Sequence: Synthetic oligonucleotide
cuguggccucauucccug

SEQ ID NO: 16872 - RNA, 18 nt, Artificial Sequence
  Description of Artificial Sequence: Synthetic oligonucleotide
ucagucuguggccucauu

SEQ ID NO: 16873 - RNA, 18 nt, Artificial Sequence
  Description of Artificial Sequence: Synthetic oligonucleotide
ucucaucagucuguggcc

SEQ ID NO: 16874 - RNA, 18 nt, Artificial Sequence
  Description of Artificial Sequence: Synthetic oligonucleotide
uuuccucucaucagucug

SEQ ID NO: 16875 - RNA, 18 nt, Artificial Sequence
  Description of Artificial Sequence: Synthetic oligonucleotide
uaaaauuuccucucauca

SEQ ID NO: 16876 - RNA, 18 nt, Artificial Sequence
  Description of Artificial Sequence: Synthetic oligonucleotide
uaaaauaaaauuuccucu

SEQ ID NO: 16877 - RNA, 18 nt, Artificial Sequence
  Description of Artificial Sequence: Synthetic oligonucleotide
auagcuaaaauaaaauuu

SEQ ID NO: 16878 - RNA, 18 nt, Artificial Sequence
  Description of Artificial Sequence: Synthetic oligonucleotide
uggaaauagcuaaaauaa

SEQ ID NO: 16879 - RNA, 18 nt, Artificial Sequence
  Description of Artificial Sequence: Synthetic oligonucleotide
aaauguggaaauagcuaa

SEQ ID NO: 16880 - RNA, 18 nt, Artificial Sequence
  Description of Artificial Sequence: Synthetic oligonucleotide
gagaaaaauguggaaaua

SEQ ID NO: 16881 - RNA, 18 nt, Artificial Sequence
  Description of Artificial Sequence: Synthetic oligonucleotide
ugaaugagaaaaaugugg

SEQ ID NO: 16882 - RNA, 18 nt, Artificial Sequence
  Description of Artificial Sequence: Synthetic oligonucleotide
ggaccugaaugagaaaaa

SEQ ID NO: 16883 - RNA, 18 nt, Artificial Sequence
  Description of Artificial Sequence: Synthetic oligonucleotide
uuagaggaccugaaugag

SEQ ID NO: 16884 - RNA, 18 nt, Artificial Sequence
  Description of Artificial Sequence: Synthetic oligonucleotide
ccacauuagaggaccuga

SEQ ID NO: 16885 - RNA, 18 nt, Artificial Sequence
  Description of Artificial Sequence: Synthetic oligonucleotide
acuaaccacauuagagga

SEQ ID NO: 16886 - RNA, 18 nt, Artificial Sequence
  Description of Artificial Sequence: Synthetic oligonucleotide
ccacaacuaaccacauua

SEQ ID NO: 16887 - RNA, 18 nt, Artificial Sequence
  Description of Artificial Sequence: Synthetic oligonucleotide
ucaggccacaacuaacca

SEQ ID NO: 16888 - RNA, 18 nt, Artificial Sequence
  Description of Artificial Sequence: Synthetic oligonucleotide
cauuuucaggccacaacu

SEQ ID NO: 16889 - RNA, 18 nt, Artificial Sequence
  Description of Artificial Sequence: Synthetic oligonucleotide
aauaucauuuucaggcca

SEQ ID NO: 16890 - RNA, 18 nt, Artificial Sequence
  Description of Artificial Sequence: Synthetic oligonucleotide
uuggaaauaucauuuuca

SEQ ID NO: 16891 - RNA, 18 nt, Artificial Sequence
  Description of Artificial Sequence: Synthetic oligonucleotide
uucauuuggaaauaucau

SEQ ID NO: 16892 - RNA, 18 nt, Artificial Sequence
  Description of Artificial Sequence: Synthetic oligonucleotide
uccuauucauuuggaaau

SEQ ID NO: 16893 - RNA, 18 nt, Artificial Sequence
  Description of Artificial Sequence: Synthetic oligonucleotide
uuccuuccuauucauuug

SEQ ID NO: 16894 - RNA, 18 nt, Artificial Sequence
  Description of Artificial Sequence: Synthetic oligonucleotide
uuuccuuccuuccuauuc

SEQ ID NO: 16895 - RNA, 18 nt, Artificial Sequence
  Description of Artificial Sequence: Synthetic oligonucleotide
aacaauuuccuuccuucc

SEQ ID NO: 16896 - RNA, 18 nt, Artificial Sequence
  Description of Artificial Sequence: Synthetic oligonucleotide
acaaaaacaauuuccuuc

SEQ ID NO: 16897 - RNA, 18 nt, Artificial Sequence
  Description of Artificial Sequence: Synthetic oligonucleotide
aaacaacaaaaacaauuu

SEQ ID NO: 16898 - RNA, 18 nt, Artificial Sequence
  Description of Artificial Sequence: Synthetic oligonucleotide
aucuuaaacaacaaaaac

SEQ ID NO: 16899 - RNA, 18 nt, Artificial Sequence
  Description of Artificial Sequence: Synthetic oligonucleotide
cuuccaucuuaaacaaca

SEQ ID NO: 16900 - RNA, 18 nt, Artificial Sequence
  Description of Artificial Sequence: Synthetic oligonucleotide
auuuccuuccaucuuaaa

SEQ ID NO: 16901 - RNA, 18 nt, Artificial Sequence
  Description of Artificial Sequence: Synthetic oligonucleotide
ccuauauuuccuuccauc

SEQ ID NO: 16902 - RNA, 18 nt, Artificial Sequence
  Description of Artificial Sequence: Synthetic oligonucleotide
augcaccuauauuuccuu

SEQ ID NO: 16903 - RNA, 18 nt, Artificial Sequence
  Description of Artificial Sequence: Synthetic oligonucleotide
uuuaaaugcaccuauauu

SEQ ID NO: 16904 - RNA, 18 nt, Artificial Sequence
  Description of Artificial Sequence: Synthetic oligonucleotide
cauuuuuuaaaugcaccu

SEQ ID NO: 16905 - RNA, 18 nt, Artificial Sequence
  Description of Artificial Sequence: Synthetic oligonucleotide
agcuccauuuuuuaaaug

SEQ ID NO: 16906 - RNA, 18 nt, Artificial Sequence
  Description of Artificial Sequence: Synthetic oligonucleotide
aaccaagcuccauuuuuu

SEQ ID NO: 16907 - RNA, 18 nt, Artificial Sequence
  Description of Artificial Sequence: Synthetic oligonucleotide
caugcaaccaagcuccau

SEQ ID NO: 16908 - RNA, 18 nt, Artificial Sequence
  Description of Artificial Sequence: Synthetic oligonucleotide
aaaaucaugcaaccaagc

SEQ ID NO: 16909 - RNA, 18 nt, Artificial Sequence
  Description of Artificial Sequence: Synthetic oligonucleotide
gagcgaaaaucaugcaac

SEQ ID NO: 16910 - RNA, 18 nt, Artificial Sequence
  Description of Artificial Sequence: Synthetic oligonucleotide
cucaagagcgaaaaucau

SEQ ID NO: 16911 - RNA, 18 nt, Artificial Sequence
  Description of Artificial Sequence: Synthetic oligonucleotide
gaugacucaagagcgaaa

SEQ ID NO: 16912 - RNA, 18 nt, Artificial Sequence
  Description of Artificial Sequence: Synthetic oligonucleotide
ggcuagaugacucaagag

SEQ ID NO: 16913 - RNA, 18 nt, Artificial Sequence
  Description of Artificial Sequence: Synthetic oligonucleotide
uagagggcuagaugacuc

SEQ ID NO: 16914 - RNA, 18 nt, Artificial Sequence
  Description of Artificial Sequence: Synthetic oligonucleotide
aucauuagagggcuagau

SEQ ID NO: 16915 - RNA, 18 nt, Artificial Sequence
  Description of Artificial Sequence: Synthetic oligonucleotide
aggcaaucauuagagggc

SEQ ID NO: 16916 - RNA, 18 nt, Artificial Sequence
  Description of Artificial Sequence: Synthetic oligonucleotide
guaugaggcaaucauuag

SEQ ID NO: 16917 - RNA, 18 nt, Artificial Sequence
  Description of Artificial Sequence: Synthetic oligonucleotide
caccgguaugaggcaauc

SEQ ID NO: 16918 - RNA, 18 nt, Artificial Sequence
  Description of Artificial Sequence: Synthetic oligonucleotide
guaaucaccgguaugagg

SEQ ID NO: 16919 - RNA, 18 nt, Artificial Sequence
  Description of Artificial Sequence: Synthetic oligonucleotide
cgcucguaaucaccggua

SEQ ID NO: 16920 - RNA, 18 nt, Artificial Sequence
  Description of Artificial Sequence: Synthetic oligonucleotide
aaagccgcucguaaucac

SEQ ID NO: 16921 - RNA, 18 nt, Artificial Sequence
  Description of Artificial Sequence: Synthetic oligonucleotide
caugaaaagccgcucgua

SEQ ID NO: 16922 - RNA, 18 nt, Artificial Sequence
  Description of Artificial Sequence: Synthetic oligonucleotide
gggucaugaaaagccgcu

SEQ ID NO: 16923 - RNA, 18 nt, Artificial Sequence
  Description of Artificial Sequence: Synthetic oligonucleotide
aaaugguacauauggaag

SEQ ID NO: 16924 - RNA, 18 nt, Artificial Sequence
  Description of Artificial Sequence: Synthetic oligonucleotide
uuuuaaaaugguacauau

SEQ ID NO: 16925 - RNA, 18 nt, Artificial Sequence
  Description of Artificial Sequence: Synthetic oligonucleotide
cagcauuuuaaaauggua

SEQ ID NO: 16926 - RNA, 18 nt, Artificial Sequence
  Description of Artificial Sequence: Synthetic oligonucleotide
guaaucagcauuuuaaaa

SEQ ID NO: 16927 - RNA, 18 nt, Artificial Sequence
  Description of Artificial Sequence: Synthetic oligonucleotide
aagaaguaaucagcauuu

SEQ ID NO: 16928 - RNA, 18 nt, Artificial Sequence
  Description of Artificial Sequence: Synthetic oligonucleotide
uucucaagaaguaaucag

SEQ ID NO: 16929 - RNA, 18 nt, Artificial Sequence
  Description of Artificial Sequence: Synthetic oligonucleotide
ucuuauucucaagaagua

SEQ ID NO: 16930 - RNA, 18 nt, Artificial Sequence
  Description of Artificial Sequence: Synthetic oligonucleotide
gcuucucuuauucucaag

SEQ ID NO: 16931 - RNA, 18 nt, Artificial Sequence
  Description of Artificial Sequence: Synthetic oligonucleotide
auuaggcuucucuuauuc

SEQ ID NO: 16932 - RNA, 18 nt, Artificial Sequence
  Description of Artificial Sequence: Synthetic oligonucleotide
cugaaauuaggcuucucu

SEQ ID NO: 16933 - RNA, 18 nt, Artificial Sequence
  Description of Artificial Sequence: Synthetic oligonucleotide
auauucugaaauuaggcu

SEQ ID NO: 16934 - RNA, 18 nt, Artificial Sequence
  Description of Artificial Sequence: Synthetic oligonucleotide
uaaugauauucugaaauu

SEQ ID NO: 16935 - RNA, 18 nt, Artificial Sequence
  Description of Artificial Sequence: Synthetic oligonucleotide
uacccuaaugauauucug

SEQ ID NO: 16936 - RNA, 18 nt, Artificial Sequence
  Description of Artificial Sequence: Synthetic oligonucleotide
auagguacccuaaugaua

SEQ ID NO: 16937 - RNA, 18 nt, Artificial Sequence
  Description of Artificial Sequence: Synthetic oligonucleotide
cuucaauagguacccuaa

SEQ ID NO: 16938 - RNA, 18 nt, Artificial Sequence
  Description of Artificial Sequence: Synthetic oligonucleotide
caagacuucaauagguac

SEQ ID NO: 16939 - RNA, 18 nt, Artificial Sequence
  Description of Artificial Sequence: Synthetic oligonucleotide
gcagucaagacuucaaua

SEQ ID NO: 16940 - RNA, 18 nt, Artificial Sequence
  Description of Artificial Sequence: Synthetic oligonucleotide
uaugugcagucaagacuu

SEQ ID NO: 16941 - RNA, 18 nt, Artificial Sequence
  Description of Artificial Sequence: Synthetic oligonucleotide
cuaaauaugugcagucaa

SEQ ID NO: 16942 - RNA, 18 nt, Artificial Sequence
  Description of Artificial Sequence: Synthetic oligonucleotide
guaugcuaaauaugugca

SEQ ID NO: 16943 - RNA, 18 nt, Artificial Sequence
  Description of Artificial Sequence: Synthetic oligonucleotide
agggaguaugcuaaauau

SEQ ID NO: 16944 - RNA, 18 nt, Artificial Sequence
  Description of Artificial Sequence: Synthetic oligonucleotide
uucccagggaguaugcua

SEQ ID NO: 16945 - RNA, 18 nt, Artificial Sequence
  Description of Artificial Sequence: Synthetic oligonucleotide
uauaauucccagggagua

SEQ ID NO: 16946 - RNA, 18 nt, Artificial Sequence
  Description of Artificial Sequence: Synthetic oligonucleotide
uaaaauauaauucccagg

SEQ ID NO: 16947 - RNA, 18 nt, Artificial Sequence
  Description of Artificial Sequence: Synthetic oligonucleotide
guccuuaaaauauaauuc

SEQ ID NO: 16948 - RNA, 18 nt, Artificial Sequence
  Description of Artificial Sequence: Synthetic oligonucleotide
aaaauguccuuaaaauau

SEQ ID NO: 16949 - RNA, 18 nt, Artificial Sequence
  Description of Artificial Sequence: Synthetic oligonucleotide
auagaaaaauguccuuaa

SEQ ID NO: 16950 - RNA, 18 nt, Artificial Sequence
  Description of Artificial Sequence: Synthetic oligonucleotide
auuuaauagaaaaauguc

SEQ ID NO: 16951 - RNA, 18 nt, Artificial Sequence
  Description of Artificial Sequence: Synthetic oligonucleotide
caaugauuuaauagaaaa

SEQ ID NO: 16952 - RNA, 18 nt, Artificial Sequence
  Description of Artificial Sequence: Synthetic oligonucleotide
auaugcaaugauuuaaua

SEQ ID NO: 16953 - RNA, 18 nt, Artificial Sequence
  Description of Artificial Sequence: Synthetic oligonucleotide
cuuccauaugcaaugauu

SEQ ID NO: 16954 - RNA, 18 nt, Artificial Sequence
  Description of Artificial Sequence: Synthetic oligonucleotide
aguuucuuccauaugcaa

SEQ ID NO: 16955 - RNA, 18 nt, Artificial Sequence
  Description of Artificial Sequence: Synthetic oligonucleotide
uauugaguuucuuccaua

SEQ ID NO: 16956 - RNA, 18 nt, Artificial Sequence
  Description of Artificial Sequence: Synthetic oligonucleotide
uauuauauugaguuucuu

SEQ ID NO: 16957 - RNA, 18 nt, Artificial Sequence
  Description of Artificial Sequence: Synthetic oligonucleotide
ucagcuauuauauugagu

SEQ ID NO: 16958 - RNA, 18 nt, Artificial Sequence
  Description of Artificial Sequence: Synthetic oligonucleotide
aaauaucagcuauuauau

SEQ ID NO: 16959 - RNA, 18 nt, Artificial Sequence
  Description of Artificial Sequence: Synthetic oligonucleotide
caaguaaauaucagcuau

SEQ ID NO: 16960 - RNA, 18 nt, Artificial Sequence
  Description of Artificial Sequence: Synthetic oligonucleotide
gaacccaaguaaauauca

SEQ ID NO: 16961 - RNA, 18 nt, Artificial Sequence
  Description of Artificial Sequence: Synthetic oligonucleotide
auuaagaacccaaguaaa

SEQ ID NO: 16962 - RNA, 18 nt, Artificial Sequence
  Description of Artificial Sequence: Synthetic oligonucleotide
uucugauuaagaacccaa

SEQ ID NO: 16963 - RNA, 18 nt, Artificial Sequence
  Description of Artificial Sequence: Synthetic oligonucleotide
caauguucugauuaagaa

SEQ ID NO: 16964 - RNA, 18 nt, Artificial Sequence
  Description of Artificial Sequence: Synthetic oligonucleotide
acagccaauguucugauu

SEQ ID NO: 16965 - RNA, 18 nt, Artificial Sequence
  Description of Artificial Sequence: Synthetic oligonucleotide
aucacacagccaauguuc

SEQ ID NO: 16966 - RNA, 18 nt, Artificial Sequence
  Description of Artificial Sequence: Synthetic oligonucleotide
ugaaaaucacacagccaa

SEQ ID NO: 16967 - RNA, 18 nt, Artificial Sequence
  Description of Artificial Sequence: Synthetic oligonucleotide
aaucaugaaaaucacaca

SEQ ID NO: 16968 - RNA, 18 nt, Artificial Sequence
  Description of Artificial Sequence: Synthetic oligonucleotide
aucauaaucaugaaaauc

SEQ ID NO: 16969 - RNA, 18 nt, Artificial Sequence
  Description of Artificial Sequence: Synthetic oligonucleotide
ugaaaaucauaaucauga

SEQ ID NO: 16970 - RNA, 18 nt, Artificial Sequence
  Description of Artificial Sequence: Synthetic oligonucleotide
ugcaaugaaaaucauaau

SEQ ID NO: 16971 - RNA, 18 nt, Artificial Sequence
  Description of Artificial Sequence: Synthetic oligonucleotide
uuaauugcaaugaaaauc

SEQ ID NO: 16972 - RNA, 18 nt, Artificial Sequence
  Description of Artificial Sequence: Synthetic oligonucleotide
ucaacuuaauugcaauga

SEQ ID NO: 16973 - RNA, 18 nt, Artificial Sequence
  Description of Artificial Sequence: Synthetic oligonucleotide
aaacaucaacuuaauugc

SEQ ID NO: 16974 - RNA, 18 nt, Artificial Sequence
  Description of Artificial Sequence: Synthetic oligonucleotide
cuacaaaacaucaacuua

SEQ ID NO: 16975 - RNA, 18 nt, Artificial Sequence
  Description of Artificial Sequence: Synthetic oligonucleotide
acugucuacaaaacauca

SEQ ID NO: 16976 - RNA, 18 nt, Artificial Sequence
  Description of Artificial Sequence: Synthetic oligonucleotide
auuucacugucuacaaaa

SEQ ID NO: 16977 - RNA, 18 nt, Artificial Sequence
  Description of Artificial Sequence: Synthetic oligonucleotide
ugguaauuucacugucua

SEQ ID NO: 16978 - RNA, 18 nt, Artificial Sequence
  Description of Artificial Sequence: Synthetic oligonucleotide
guagaugguaauuucacu

SEQ ID NO: 16979 - RNA, 18 nt, Artificial Sequence
  Description of Artificial Sequence: Synthetic oligonucleotide
uuggaguagaugguaauu

SEQ ID NO: 16980 - RNA, 18 nt, Artificial Sequence
  Description of Artificial Sequence: Synthetic oligonucleotide
aucuuuuggaguagaugg

SEQ ID NO: 16981 - RNA, 18 nt, Artificial Sequence
  Description of Artificial Sequence: Synthetic oligonucleotide
uugcaaucuuuuggagua

SEQ ID NO: 16982 - RNA, 18 nt, Artificial Sequence
  Description of Artificial Sequence: Synthetic oligonucleotide
cuauuuugcaaucuuuug

SEQ ID NO: 16983 - RNA, 18 nt, Artificial Sequence
  Description of Artificial Sequence: Synthetic oligonucleotide
aaauucuauuuugcaauc

SEQ ID NO: 16984 - RNA, 18 nt, Artificial Sequence
  Description of Artificial Sequence: Synthetic oligonucleotide
agguuaaauucuauuuug

SEQ ID NO: 16985 - RNA, 18 nt, Artificial Sequence
  Description of Artificial Sequence: Synthetic oligonucleotide
cucuaagguuaaauucua

SEQ ID NO: 16986 - RNA, 18 nt, Artificial Sequence
  Description of Artificial Sequence: Synthetic oligonucleotide
auuggcucuaagguuaaa

SEQ ID NO: 16987 - RNA, 18 nt, Artificial Sequence
  Description of Artificial Sequence: Synthetic oligonucleotide
ccugcauuggcucuaagg

SEQ ID NO: 16988 - RNA, 18 nt, Artificial Sequence
  Description of Artificial Sequence: Synthetic oligonucleotide
uuuucccugcauuggcuc

SEQ ID NO: 16989 - RNA, 18 nt, Artificial Sequence
  Description of Artificial Sequence: Synthetic oligonucleotide
acaaguuuucccugcauu

SEQ ID NO: 16990 - RNA, 18 nt, Artificial Sequence
  Description of Artificial Sequence: Synthetic oligonucleotide
cagaaacaaguuuucccu

SEQ ID NO: 16991 - RNA, 18 nt, Artificial Sequence
  Description of Artificial Sequence: Synthetic oligonucleotide
accugcagaaacaaguuu

SEQ ID NO: 16992 - RNA, 18 nt, Artificial Sequence
  Description of Artificial Sequence: Synthetic oligonucleotide
aaugcaccugcagaaaca

SEQ ID NO: 16993 - RNA, 18 nt, Artificial Sequence
  Description of Artificial Sequence: Synthetic oligonucleotide
caaaaaaugcaccugcag

SEQ ID NO: 16994 - RNA, 18 nt, Artificial Sequence
  Description of Artificial Sequence: Synthetic oligonucleotide
aguuucaaaaaaugcacc

SEQ ID NO: 16995 - RNA, 18 nt, Artificial Sequence
  Description of Artificial Sequence: Synthetic oligonucleotide
guugaaguuucaaaaaau

SEQ ID NO: 16996 - RNA, 18 nt, Artificial Sequence
  Description of Artificial Sequence: Synthetic oligonucleotide
uaucuguugaaguuucaa

SEQ ID NO: 16997 - RNA, 18 nt, Artificial Sequence
  Description of Artificial Sequence: Synthetic oligonucleotide
ccugcuaucuguugaagu

SEQ ID NO: 16998 - RNA, 18 nt, Artificial Sequence
  Description of Artificial Sequence: Synthetic oligonucleotide
uucccccugcuaucuguu

SEQ ID NO: 16999 - RNA, 18 nt, Artificial Sequence
  Description of Artificial Sequence: Synthetic oligonucleotide
uuuuuuucccccugcuau

SEQ ID NO: 17000 - RNA, 18 nt, Artificial Sequence
  Description of Artificial Sequence: Synthetic oligonucleotide
ucacuuuuuuuucccccu

SEQ ID NO: 17001 - RNA, 18 nt, Artificial Sequence
  Description of Artificial Sequence: Synthetic oligonucleotide
uucugucacuuuuuuuuc

SEQ ID NO: 17002 - RNA, 18 nt, Artificial Sequence
  Description of Artificial Sequence: Synthetic oligonucleotide
gauccuucugucacuuuu

SEQ ID NO: 17003 - RNA, 18 nt, Artificial Sequence
  Description of Artificial Sequence: Synthetic oligonucleotide
acugugauccuucuguca

SEQ ID NO: 17004 - RNA, 18 nt, Artificial Sequence
  Description of Artificial Sequence: Synthetic oligonucleotide
gcugaacugugauccuuc

SEQ ID NO: 17005 - RNA, 18 nt, Artificial Sequence
  Description of Artificial Sequence: Synthetic oligonucleotide
auacugcugaacugugau

SEQ ID NO: 17006 - RNA, 18 nt, Artificial Sequence
  Description of Artificial Sequence: Synthetic oligonucleotide
aauucauacugcugaacu

SEQ ID NO: 17007 - RNA, 18 nt, Artificial Sequence
  Description of Artificial Sequence: Synthetic oligonucleotide
cagacaauucauacugcu

SEQ ID NO: 17008 - RNA, 18 nt, Artificial Sequence
  Description of Artificial Sequence: Synthetic oligonucleotide
gccagcagacaauucaua

SEQ ID NO: 17009 - RNA, 18 nt, Artificial Sequence
  Description of Artificial Sequence: Synthetic oligonucleotide
aggcugccagcagacaau

SEQ ID NO: 17010 - RNA, 18 nt, Artificial Sequence
  Description of Artificial Sequence: Synthetic oligonucleotide
uugcaaggcugccagcag

SEQ ID NO: 17011 - RNA, 18 nt, Artificial Sequence
  Description of Artificial Sequence: Synthetic oligonucleotide
ccagauugcaaggcugcc

SEQ ID NO: 17012 - RNA, 18 nt, Artificial Sequence
  Description of Artificial Sequence: Synthetic oligonucleotide
gcacaccagauugcaagg

SEQ ID NO: 17013 - RNA, 18 nt, Artificial Sequence
  Description of Artificial Sequence: Synthetic oligonucleotide
ugccugcacaccagauug

SEQ ID NO: 17014 - RNA, 18 nt, Artificial Sequence
  Description of Artificial Sequence: Synthetic oligonucleotide
cucacugccugcacacca

SEQ ID NO: 17015 - RNA, 18 nt, Artificial Sequence
  Description of Artificial Sequence: Synthetic oligonucleotide
acaaucucacugccugca

SEQ ID NO: 17016 - RNA, 18 nt, Artificial Sequence
  Description of Artificial Sequence: Synthetic oligonucleotide
acaccacaaucucacugc

SEQ ID NO: 17017 - RNA, 18 nt, Artificial Sequence
  Description of Artificial Sequence: Synthetic oligonucleotide
cauguacaccacaaucuc

SEQ ID NO: 17018 - RNA, 18 nt, Artificial Sequence
  Description of Artificial Sequence: Synthetic oligonucleotide
ggugacauguacaccaca

SEQ ID NO: 17019 - RNA, 18 nt, Artificial Sequence
  Description of Artificial Sequence: Synthetic oligonucleotide
aaucaggugacauguaca

SEQ ID NO: 17020 - RNA, 18 nt, Artificial Sequence
  Description of Artificial Sequence: Synthetic oligonucleotide
uguaguccugguggcaug

SEQ ID NO: 17021 - RNA, 18 nt, Artificial Sequence
  Description of Artificial Sequence: Synthetic oligonucleotide
gccccuguaguccuggug

SEQ ID NO: 17022 - RNA, 18 nt, Artificial Sequence
  Description of Artificial Sequence: Synthetic oligonucleotide
acucugccccuguagucc

SEQ ID NO: 17023 - RNA, 18 nt, Artificial Sequence
  Description of Artificial Sequence: Synthetic oligonucleotide
gagacacucugccccugu

SEQ ID NO: 17024 - RNA, 18 nt, Artificial Sequence
  Description of Artificial Sequence: Synthetic oligonucleotide
cagaggagacacucugcc

SEQ ID NO: 17025 - RNA, 18 nt, Artificial Sequence
  Description of Artificial Sequence: Synthetic oligonucleotide
gcugccagaggagacacu

SEQ ID NO: 17026 - RNA, 18 nt, Artificial Sequence
  Description of Artificial Sequence: Synthetic oligonucleotide
ucagagcugccagaggag

SEQ ID NO: 17027 - RNA, 18 nt, Artificial Sequence
  Description of Artificial Sequence: Synthetic oligonucleotide
ugaucucagagcugccag

SEQ ID NO: 17028 - RNA, 18 nt, Artificial Sequence
  Description of Artificial Sequence: Synthetic oligonucleotide
ggauuugaucucagagcu

SEQ ID NO: 17029 - RNA, 18 nt, Artificial Sequence
  Description of Artificial Sequence: Synthetic oligonucleotide
ucaucggauuugaucuca

SEQ ID NO: 17030 - RNA, 18 nt, Artificial Sequence
  Description of Artificial Sequence: Synthetic oligonucleotide
ccucgucaucggauuuga

SEQ ID NO: 17031 - RNA, 18 nt, Artificial Sequence
  Description of Artificial Sequence: Synthetic oligonucleotide
aucacccucgucaucgga

SEQ ID NO: 17032 - RNA, 18 nt, Artificial Sequence
  Description of Artificial Sequence: Synthetic oligonucleotide
uucucaucacccucguca

SEQ ID NO: 17033 - RNA, 18 nt, Artificial Sequence
  Description of Artificial Sequence: Synthetic oligonucleotide
gcagguucucaucacccu

SEQ ID NO: 17034 - RNA, 18 nt, Artificial Sequence
  Description of Artificial Sequence: Synthetic oligonucleotide
gucuugcagguucucauc

SEQ ID NO: 17035 - RNA, 18 nt, Artificial Sequence
  Description of Artificial Sequence: Synthetic oligonucleotide
uucgugucuugcagguuc

SEQ ID NO: 17036 - RNA, 18 nt, Artificial Sequence
  Description of Artificial Sequence: Synthetic oligonucleotide
aagauuucgugucuugca

SEQ ID NO: 17037 - RNA, 18 nt, Artificial Sequence
  Description of Artificial Sequence: Synthetic oligonucleotide
cuccgaagauuucguguc

SEQ ID NO: 17038 - RNA, 18 nt, Artificial Sequence
  Description of Artificial Sequence: Synthetic oligonucleotide
uuguccuccgaagauuuc

SEQ ID NO: 17039 - RNA, 18 nt, Artificial Sequence
  Description of Artificial Sequence: Synthetic oligonucleotide
auuucuuguccuccgaag

SEQ ID NO: 17040 - RNA, 18 nt, Artificial Sequence
  Description of Artificial Sequence: Synthetic oligonucleotide
aucuaauuucuuguccuc

SEQ ID NO: 17041 - RNA, 18 nt, Artificial Sequence
  Description of Artificial Sequence: Synthetic oligonucleotide
ucgucaucuaauuucuug

SEQ ID NO: 17042 - RNA, 18 nt, Artificial Sequence
  Description of Artificial Sequence: Synthetic oligonucleotide
ucuugucgucaucuaauu

SEQ ID NO: 17043 - RNA, 18 nt, Artificial Sequence
  Description of Artificial Sequence: Synthetic oligonucleotide
auccuucuugucgucauc

SEQ ID NO: 17044 - RNA, 18 nt, Artificial Sequence
  Description of Artificial Sequence: Synthetic oligonucleotide
uugauauccuucuugucg

SEQ ID NO: 17045 - RNA, 18 nt, Artificial Sequence
  Description of Artificial Sequence: Synthetic oligonucleotide
uugauuugauauccuucu

SEQ ID NO: 17046 - RNA, 18 nt, Artificial Sequence
  Description of Artificial Sequence: Synthetic oligonucleotide
aguaauugauuugauauc

SEQ ID NO: 17047 - RNA, 18 nt, Artificial Sequence
  Description of Artificial Sequence: Synthetic oligonucleotide
uucacgauggguccccac

SEQ ID NO: 17048 - RNA, 18 nt, Artificial Sequence
  Description of Artificial Sequence: Synthetic oligonucleotide
ccaucuucacgauggguc

SEQ ID NO: 17049 - RNA, 18 nt, Artificial Sequence
  Description of Artificial Sequence: Synthetic oligonucleotide
ccacgccaucuucacgau

SEQ ID NO: 17050 - RNA, 18 nt, Artificial Sequence
  Description of Artificial Sequence: Synthetic oligonucleotide
cagggccacgccaucuuc

SEQ ID NO: 17051 - RNA, 18 nt, Artificial Sequence
  Description of Artificial Sequence: Synthetic oligonucleotide
ccucucagggccacgcca

SEQ ID NO: 17052 - RNA, 18 nt, Artificial Sequence
  Description of Artificial Sequence: Synthetic oligonucleotide
ggcugccucucagggcca

SEQ ID NO: 17053 - RNA, 18 nt, Artificial Sequence
  Description of Artificial Sequence: Synthetic oligonucleotide
agaauggcugccucucag

SEQ ID NO: 17054 - RNA, 18 nt, Artificial Sequence
  Description of Artificial Sequence: Synthetic oligonucleotide
agaagagaauggcugccu

SEQ ID NO: 17055 - RNA, 18 nt, Artificial Sequence
  Description of Artificial Sequence: Synthetic oligonucleotide
uuggcagaagagaauggc

SEQ ID NO: 17056 - RNA, 18 nt, Artificial Sequence
  Description of Artificial Sequence: Synthetic oligonucleotide
cugguuuggcagaagaga

SEQ ID NO: 17057 - RNA, 18 nt, Artificial Sequence
  Description of Artificial Sequence: Synthetic oligonucleotide
ggaaccugguuuggcaga

SEQ ID NO: 17058 - RNA, 18 nt, Artificial Sequence
  Description of Artificial Sequence: Synthetic oligonucleotide
gaaccggaaccugguuug

SEQ ID NO: 17059 - RNA, 18 nt, Artificial Sequence
  Description of Artificial Sequence: Synthetic oligonucleotide
cuguggaaccggaaccug

SEQ ID NO: 17060 - RNA, 18 nt, Artificial Sequence
  Description of Artificial Sequence: Synthetic oligonucleotide
ggaagcuguggaaccgga

SEQ ID NO: 17061 - RNA, 18 nt, Artificial Sequence
  Description of Artificial Sequence: Synthetic oligonucleotide
ggacaggaagcuguggaa

SEQ ID NO: 17062 - RNA, 18 nt, Artificial Sequence
  Description of Artificial Sequence: Synthetic oligonucleotide
agacuggacaggaagcug

SEQ ID NO: 17063 - RNA, 18 nt, Artificial Sequence
  Description of Artificial Sequence: Synthetic oligonucleotide
gucgcagacuggacagga

SEQ ID NO: 17064 - RNA, 18 nt, Artificial Sequence
  Description of Artificial Sequence: Synthetic oligonucleotide
gggaagucgcagacugga

SEQ ID NO: 17065 - RNA, 18 nt, Artificial Sequence
  Description of Artificial Sequence: Synthetic oligonucleotide
gguggguucaggucaggg

SEQ ID NO: 17066 - RNA, 18 nt, Artificial Sequence
  Description of Artificial Sequence: Synthetic oligonucleotide
ggguggguucaggucagg

SEQ ID NO: 17067 - RNA, 18 nt, Artificial Sequence
  Description of Artificial Sequence: Synthetic oligonucleotide
cucuguaaggguccuggg

SEQ ID NO: 17068 - RNA, 18 nt, Artificial Sequence
  Description of Artificial Sequence: Synthetic oligonucleotide
gugcccuggugaggccaa

SEQ ID NO: 17069 - RNA, 18 nt, Artificial Sequence
  Description of Artificial Sequence: Synthetic oligonucleotide
cagaagugcccuggugag

SEQ ID NO: 17070 - RNA, 18 nt, Artificial Sequence
  Description of Artificial Sequence: Synthetic oligonucleotide
gaggucagaagugcccug

SEQ ID NO: 17071 - RNA, 18 nt, Artificial Sequence
  Description of Artificial Sequence: Synthetic oligonucleotide
aaagugaggucagaagug

SEQ ID NO: 17072 - RNA, 18 nt, Artificial Sequence
  Description of Artificial Sequence: Synthetic oligonucleotide
uugugaaagugaggucag

SEQ ID NO: 17073 - RNA, 18 nt, Artificial Sequence
  Description of Artificial Sequence: Synthetic oligonucleotide
uccuauugugaaagugag

SEQ ID NO: 17074 - RNA, 18 nt, Artificial Sequence
  Description of Artificial Sequence: Synthetic oligonucleotide
acugguccuauugugaaa

SEQ ID NO: 17075 - RNA, 18 nt, Artificial Sequence
  Description of Artificial Sequence: Synthetic oligonucleotide
ucaacacugguccuauug

SEQ ID NO: 17076 - RNA, 18 nt, Artificial Sequence
  Description of Artificial Sequence: Synthetic oligonucleotide
ggguaucaacacuggucc

SEQ ID NO: 17077 - RNA, 18 nt, Artificial Sequence
  Description of Artificial Sequence: Synthetic oligonucleotide
aggcuggguaucaacacu

SEQ ID NO: 17078 - RNA, 18 nt, Artificial Sequence
  Description of Artificial Sequence: Synthetic oligonucleotide
ccaagaggcuggguauca

SEQ ID NO: 17079 - RNA, 18 nt, Artificial Sequence
  Description of Artificial Sequence: Synthetic oligonucleotide
gaacaccaagaggcuggg

SEQ ID NO: 17080 - RNA, 18 nt, Artificial Sequence
  Description of Artificial Sequence: Synthetic oligonucleotide
gggaugaacaccaagagg

SEQ ID NO: 17081 - RNA, 18 nt, Artificial Sequence
  Description of Artificial Sequence: Synthetic oligonucleotide
cuugagggaugaacacca

SEQ ID NO: 17082 - RNA, 18 nt, Artificial Sequence
  Description of Artificial Sequence: Synthetic oligonucleotide
ugcuucuugagggaugaa

SEQ ID NO: 17083 - RNA, 18 nt, Artificial Sequence
  Description of Artificial Sequence: Synthetic oligonucleotide
gccagugcuucuugaggg

SEQ ID NO: 17084 - RNA, 18 nt, Artificial Sequence
  Description of Artificial Sequence: Synthetic oligonucleotide
uuucugccagugcuucuu

SEQ ID NO: 17085 - RNA, 18 nt, Artificial Sequence
  Description of Artificial Sequence: Synthetic oligonucleotide
cuggguuucugccagugc

SEQ ID NO: 17086 - RNA, 18 nt, Artificial Sequence
  Description of Artificial Sequence: Synthetic oligonucleotide
gauuccuggguuucugcc

SEQ ID NO: 17087 - RNA, 18 nt, Artificial Sequence
  Description of Artificial Sequence: Synthetic oligonucleotide
aauuugauuccuggguuu

SEQ ID NO: 17088 - RNA, 18 nt, Artificial Sequence
  Description of Artificial Sequence: Synthetic oligonucleotide
ugcccaauuugauuccug

SEQ ID NO: 17089 - RNA, 18 nt, Artificial Sequence
  Description of Artificial Sequence: Synthetic oligonucleotide
uuuugugcccaauuugau

SEQ ID NO: 17090 - RNA, 18 nt, Artificial Sequence
  Description of Artificial Sequence: Synthetic oligonucleotide
accauuuuugugcccaau

SEQ ID NO: 17091 - RNA, 18 nt, Artificial Sequence
  Description of Artificial Sequence: Synthetic oligonucleotide
uccuuaccauuuuugugc

SEQ ID NO: 17092 - RNA, 18 nt, Artificial Sequence
  Description of Artificial Sequence: Synthetic oligonucleotide
ccauuuccuuaccauuuu

SEQ ID NO: 17093 - RNA, 18 nt, Artificial Sequence
  Description of Artificial Sequence: Synthetic oligonucleotide
cuuugccauuuccuuacc

SEQ ID NO: 17094 - RNA, 18 nt, Artificial Sequence
  Description of Artificial Sequence: Synthetic oligonucleotide
aaauacuuugccauuucc

SEQ ID NO: 17095 - RNA, 18 nt, Artificial Sequence
  Description of Artificial Sequence: Synthetic oligonucleotide
guucuaaauacuuugcca

SEQ ID NO: 17096 - RNA, 18 nt, Artificial Sequence
  Description of Artificial Sequence: Synthetic oligonucleotide
gcgaaguucuaaauacuu

SEQ ID NO: 17097 - RNA, 18 nt, Artificial Sequence
  Description of Artificial Sequence: Synthetic oligonucleotide
agcgggcgaaguucuaaa

SEQ ID NO: 17098 - RNA, 18 nt, Artificial Sequence
  Description of Artificial Sequence: Synthetic oligonucleotide
caauuagcgggcgaaguu

SEQ ID NO: 17099 - RNA, 18 nt, Artificial Sequence
  Description of Artificial Sequence: Synthetic oligonucleotide
aaacacaauuagcgggcg

SEQ ID NO: 17100 - RNA, 18 nt, Artificial Sequence
  Description of Artificial Sequence: Synthetic oligonucleotide
uggagaaacacaauuagc

SEQ ID NO: 17101 - RNA, 18 nt, Artificial Sequence
  Description of Artificial Sequence: Synthetic oligonucleotide
gucccuggagaaacacaa

SEQ ID NO: 17102 - RNA, 18 nt, Artificial Sequence
  Description of Artificial Sequence: Synthetic oligonucleotide
aaacagucccuggagaaa

SEQ ID NO: 17103 - RNA, 18 nt, Artificial Sequence
  Description of Artificial Sequence: Synthetic oligonucleotide
gaggaaaacagucccugg

SEQ ID NO: 17104 - RNA, 18 nt, Artificial Sequence
  Description of Artificial Sequence: Synthetic oligonucleotide
uguuugaggaaaacaguc

SEQ ID NO: 17105 - RNA, 18 nt, Artificial Sequence
  Description of Artificial Sequence: Synthetic oligonucleotide
gaggauguuugaggaaaa

SEQ ID NO: 17106 - RNA, 18 nt, Artificial Sequence
  Description of Artificial Sequence: Synthetic oligonucleotide
uuucagaggauguuugag

SEQ ID NO: 17107 - RNA, 18 nt, Artificial Sequence
  Description of Artificial Sequence: Synthetic oligonucleotide
caggauuucagaggaugu

SEQ ID NO: 17108 - RNA, 18 nt, Artificial Sequence
  Description of Artificial Sequence: Synthetic oligonucleotide
aggaccaggauuucagag

SEQ ID NO: 17109 - RNA, 18 nt, Artificial Sequence
  Description of Artificial Sequence: Synthetic oligonucleotide
gauauaggaccaggauuu

SEQ ID NO: 17110 - RNA, 18 nt, Artificial Sequence
  Description of Artificial Sequence: Synthetic oligonucleotide
cugcugauauaggaccag

SEQ ID NO: 17111 - RNA, 18 nt, Artificial Sequence
  Description of Artificial Sequence: Synthetic oligonucleotide
auucccugcugauauagg

SEQ ID NO: 17112 - RNA, 18 nt, Artificial Sequence
  Description of Artificial Sequence: Synthetic oligonucleotide
gccucauucccugcugau

SEQ ID NO: 17113 - RNA, 18 nt, Artificial Sequence
  Description of Artificial Sequence: Synthetic oligonucleotide
cuguggccucauucccug

SEQ ID NO: 17114 - RNA, 18 nt, Artificial Sequence
  Description of Artificial Sequence: Synthetic oligonucleotide
ucagucuguggccucauu

SEQ ID NO: 17115 - RNA, 18 nt, Artificial Sequence
  Description of Artificial Sequence: Synthetic oligonucleotide
ucucaucagucuguggcc

SEQ ID NO: 17116 - RNA, 18 nt, Artificial Sequence
  Description of Artificial Sequence: Synthetic oligonucleotide
uuuccucucaucagucug

SEQ ID NO: 17117 - RNA, 18 nt, Artificial Sequence
  Description of Artificial Sequence: Synthetic oligonucleotide
uaaaauuuccucucauca

SEQ ID NO: 17118 - RNA, 18 nt, Artificial Sequence
  Description of Artificial Sequence: Synthetic oligonucleotide
uaaaauaaaauuuccucu

SEQ ID NO: 17119 - RNA, 18 nt, Artificial Sequence
  Description of Artificial Sequence: Synthetic oligonucleotide
auagcuaaaauaaaauuu

SEQ ID NO: 17120 - RNA, 18 nt, Artificial Sequence
  Description of Artificial Sequence: Synthetic oligonucleotide
uggaaauagcuaaaauaa

SEQ ID NO: 17121 - RNA, 18 nt, Artificial Sequence
  Description of Artificial Sequence: Synthetic oligonucleotide
aaauguggaaauagcuaa

SEQ ID NO: 17122 - RNA, 18 nt, Artificial Sequence
  Description of Artificial Sequence: Synthetic oligonucleotide
gagaaaaauguggaaaua

SEQ ID NO: 17123 - RNA, 18 nt, Artificial Sequence
  Description of Artificial Sequence: Synthetic oligonucleotide
ugaaugagaaaaaugugg

SEQ ID NO: 17124 - RNA, 18 nt, Artificial Sequence
  Description of Artificial Sequence: Synthetic oligonucleotide
ggaccugaaugagaaaaa

SEQ ID NO: 17125 - RNA, 18 nt, Artificial Sequence
  Description of Artificial Sequence: Synthetic oligonucleotide
uuagaggaccugaaugag

SEQ ID NO: 17126 - RNA, 18 nt, Artificial Sequence
  Description of Artificial Sequence: Synthetic oligonucleotide
ccacauuagaggaccuga

SEQ ID NO: 17127 - RNA, 18 nt, Artificial Sequence
  Description of Artificial Sequence: Synthetic oligonucleotide
acuaaccacauuagagga

SEQ ID NO: 17128 - RNA, 18 nt, Artificial Sequence
  Description of Artificial Sequence: Synthetic oligonucleotide
ccacaacuaaccacauua

SEQ ID NO: 17129 - RNA, 18 nt, Artificial Sequence
  Description of Artificial Sequence: Synthetic oligonucleotide
ucaggccacaacuaacca

SEQ ID NO: 17130 - RNA, 18 nt, Artificial Sequence
  Description of Artificial Sequence: Synthetic oligonucleotide
cauuuucaggccacaacu

SEQ ID NO: 17131 - RNA, 18 nt, Artificial Sequence
  Description of Artificial Sequence: Synthetic oligonucleotide
aauaucauuuucaggcca

SEQ ID NO: 17132 - RNA, 18 nt, Artificial Sequence
  Description of Artificial Sequence: Synthetic oligonucleotide
uuggaaauaucauuuuca

SEQ ID NO: 17133 - RNA, 18 nt, Artificial Sequence
  Description of Artificial Sequence: Synthetic oligonucleotide
uucauuuggaaauaucau

SEQ ID NO: 17134 - RNA, 18 nt, Artificial Sequence
  Description of Artificial Sequence: Synthetic oligonucleotide
uccuauucauuuggaaau

SEQ ID NO: 17135 - RNA, 18 nt, Artificial Sequence
  Description of Artificial Sequence: Synthetic oligonucleotide
uuccuuccuauucauuug

SEQ ID NO: 17136 - RNA, 18 nt, Artificial Sequence
  Description of Artificial Sequence: Synthetic oligonucleotide
uuuccuuccuuccuauuc

SEQ ID NO: 17137 - RNA, 18 nt, Artificial Sequence
  Description of Artificial Sequence: Synthetic oligonucleotide
aacaauuuccuuccuucc

SEQ ID NO: 17138 - RNA, 18 nt, Artificial Sequence
  Description of Artificial Sequence: Synthetic oligonucleotide
acaaaaacaauuuccuuc

SEQ ID NO: 17139 - RNA, 18 nt, Artificial Sequence
  Description of Artificial Sequence: Synthetic oligonucleotide
aaacaacaaaaacaauuu

SEQ ID NO: 17140 - RNA, 18 nt, Artificial Sequence
  Description of Artificial Sequence: Synthetic oligonucleotide
aucuuaaacaacaaaaac

SEQ ID NO: 17141 - RNA, 18 nt, Artificial Sequence
  Description of Artificial Sequence: Synthetic oligonucleotide
cuuccaucuuaaacaaca

SEQ ID NO: 17142 - RNA, 18 nt, Artificial Sequence
  Description of Artificial Sequence: Synthetic oligonucleotide
auuuccuuccaucuuaaa

SEQ ID NO: 17143 - RNA, 18 nt, Artificial Sequence
  Description of Artificial Sequence: Synthetic oligonucleotide
ccuauauuuccuuccauc

SEQ ID NO: 17144 - RNA, 18 nt, Artificial Sequence
  Description of Artificial Sequence: Synthetic oligonucleotide
augcaccuauauuuccuu

SEQ ID NO: 17145 - RNA, 18 nt, Artificial Sequence
  Description of Artificial Sequence: Synthetic oligonucleotide
uuuaaaugcaccuauauu

SEQ ID NO: 17146 - RNA, 18 nt, Artificial Sequence
  Description of Artificial Sequence: Synthetic oligonucleotide
cauuuuuuaaaugcaccu

SEQ ID NO: 17147 - RNA, 18 nt, Artificial Sequence
  Description of Artificial Sequence: Synthetic oligonucleotide
agcuccauuuuuuaaaug

SEQ ID NO: 17148 - RNA, 18 nt, Artificial Sequence
  Description of Artificial Sequence: Synthetic oligonucleotide
aaccaagcuccauuuuuu

SEQ ID NO: 17149 - RNA, 18 nt, Artificial Sequence
  Description of Artificial Sequence: Synthetic oligonucleotide
caugcaaccaagcuccau

SEQ ID NO: 17150 - RNA, 18 nt, Artificial Sequence
  Description of Artificial Sequence: Synthetic oligonucleotide
aaaaucaugcaaccaagc

SEQ ID NO: 17151 - RNA, 18 nt, Artificial Sequence
  Description of Artificial Sequence: Synthetic oligonucleotide
gagcgaaaaucaugcaac

SEQ ID NO: 17152 - RNA, 18 nt, Artificial Sequence
  Description of Artificial Sequence: Synthetic oligonucleotide
cucaagagcgaaaaucau

SEQ ID NO: 17153 - RNA, 18 nt, Artificial Sequence
  Description of Artificial Sequence: Synthetic oligonucleotide
gaugacucaagagcgaaa

SEQ ID NO: 17154 - RNA, 18 nt, Artificial Sequence
  Description of Artificial Sequence: Synthetic oligonucleotide
ggcuagaugacucaagag

SEQ ID NO: 17155 - RNA, 18 nt, Artificial Sequence
  Description of Artificial Sequence: Synthetic oligonucleotide
uagagggcuagaugacuc

SEQ ID NO: 17156 - RNA, 18 nt, Artificial Sequence
  Description of Artificial Sequence: Synthetic oligonucleotide
aucauuagagggcuagau

SEQ ID NO: 17157 - RNA, 18 nt, Artificial Sequence
  Description of Artificial Sequence: Synthetic oligonucleotide
aggcaaucauuagagggc

SEQ ID NO: 17158 - RNA, 18 nt, Artificial Sequence
  Description of Artificial Sequence: Synthetic oligonucleotide
guaugaggcaaucauuag

SEQ ID NO: 17159 - RNA, 18 nt, Artificial Sequence
  Description of Artificial Sequence: Synthetic oligonucleotide
caccgguaugaggcaauc

SEQ ID NO: 17160 - RNA, 18 nt, Artificial Sequence
  Description of Artificial Sequence: Synthetic oligonucleotide
guaaucaccgguaugagg

SEQ ID NO: 17161 - RNA, 18 nt, Artificial Sequence
  Description of Artificial Sequence: Synthetic oligonucleotide
cgcucguaaucaccggua

SEQ ID NO: 17162 - RNA, 18 nt, Artificial Sequence
  Description of Artificial Sequence: Synthetic oligonucleotide
aaagccgcucguaaucac

SEQ ID NO: 17163 - RNA, 18 nt, Artificial Sequence
  Description of Artificial Sequence: Synthetic oligonucleotide
caugaaaagccgcucgua

SEQ ID NO: 17164 - RNA, 18 nt, Artificial Sequence
  Description of Artificial Sequence: Synthetic oligonucleotide
gggucaugaaaagccgcu

SEQ ID NO: 17165 - RNA, 18 nt, Artificial Sequence
  Description of Artificial Sequence: Synthetic oligonucleotide
aaaugguacauauggaag

SEQ ID NO: 17166 - RNA, 18 nt, Artificial Sequence
  Description of Artificial Sequence: Synthetic oligonucleotide
uuuuaaaaugguacauau

SEQ ID NO: 17167 - RNA, 18 nt, Artificial Sequence
  Description of Artificial Sequence: Synthetic oligonucleotide
cagcauuuuaaaauggua

SEQ ID NO: 17168 - RNA, 18 nt, Artificial Sequence
  Description of Artificial Sequence: Synthetic oligonucleotide
guaaucagcauuuuaaaa

SEQ ID NO: 17169 - RNA, 18 nt, Artificial Sequence
  Description of Artificial Sequence: Synthetic oligonucleotide
aagaaguaaucagcauuu

SEQ ID NO: 17170 - RNA, 18 nt, Artificial Sequence
  Description of Artificial Sequence: Synthetic oligonucleotide
uucucaagaaguaaucag

SEQ ID NO: 17171 - RNA, 18 nt, Artificial Sequence
  Description of Artificial Sequence: Synthetic oligonucleotide
ucuuauucucaagaagua

SEQ ID NO: 17172 - RNA, 18 nt, Artificial Sequence
  Description of Artificial Sequence: Synthetic oligonucleotide
gcuucucuuauucucaag

SEQ ID NO: 17173 - RNA, 18 nt, Artificial Sequence
  Description of Artificial Sequence: Synthetic oligonucleotide
auuaggcuucucuuauuc

SEQ ID NO: 17174 - RNA, 18 nt, Artificial Sequence
  Description of Artificial Sequence: Synthetic oligonucleotide
cugaaauuaggcuucucu

SEQ ID NO: 17175 - RNA, 18 nt, Artificial Sequence
  Description of Artificial Sequence: Synthetic oligonucleotide
auauucugaaauuaggcu

SEQ ID NO: 17176 - RNA, 18 nt, Artificial Sequence
  Description of Artificial Sequence: Synthetic oligonucleotide
uaaugauauucugaaauu

SEQ ID NO: 17177 - RNA, 18 nt, Artificial Sequence
  Description of Artificial Sequence: Synthetic oligonucleotide
uacccuaaugauauucug

SEQ ID NO: 17178 - RNA, 18 nt, Artificial Sequence
  Description of Artificial Sequence: Synthetic oligonucleotide
auagguacccuaaugaua

SEQ ID NO: 17179 - RNA, 18 nt, Artificial Sequence
  Description of Artificial Sequence: Synthetic oligonucleotide
cuucaauagguacccuaa

SEQ ID NO: 17180 - RNA, 18 nt, Artificial Sequence
  Description of Artificial Sequence: Synthetic oligonucleotide
caagacuucaauagguac

SEQ ID NO: 17181 - RNA, 18 nt, Artificial Sequence
  Description of Artificial Sequence: Synthetic oligonucleotide
gcagucaagacuucaaua

SEQ ID NO: 17182 - RNA, 18 nt, Artificial Sequence
  Description of Artificial Sequence: Synthetic oligonucleotide
uaugugcagucaagacuu

SEQ ID NO: 17183 - RNA, 18 nt, Artificial Sequence
  Description of Artificial Sequence: Synthetic oligonucleotide
cuaaauaugugcagucaa

SEQ ID NO: 17184 - RNA, 18 nt, Artificial Sequence
  Description of Artificial Sequence: Synthetic oligonucleotide
guaugcuaaauaugugca

SEQ ID NO: 17185 - RNA, 18 nt, Artificial Sequence
  Description of Artificial Sequence: Synthetic oligonucleotide
agggaguaugcuaaauau

SEQ ID NO: 17186 - RNA, 18 nt, Artificial Sequence
  Description of Artificial Sequence: Synthetic oligonucleotide
uucccagggaguaugcua

SEQ ID NO: 17187 - RNA, 18 nt, Artificial Sequence
  Description of Artificial Sequence: Synthetic oligonucleotide
uauaauucccagggagua

SEQ ID NO: 17188 - RNA, 18 nt, Artificial Sequence
  Description of Artificial Sequence: Synthetic oligonucleotide
uaaaauauaauucccagg

SEQ ID NO: 17189 - RNA, 18 nt, Artificial Sequence
  Description of Artificial Sequence: Synthetic oligonucleotide
guccuuaaaauauaauuc

SEQ ID NO: 17190 - RNA, 18 nt, Artificial Sequence
  Description of Artificial Sequence: Synthetic oligonucleotide
aaaauguccuuaaaauau

SEQ ID NO: 17191 - RNA, 18 nt, Artificial Sequence
  Description of Artificial Sequence: Synthetic oligonucleotide
auagaaaaauguccuuaa

SEQ ID NO: 17192 - RNA, 18 nt, Artificial Sequence
  Description of Artificial Sequence: Synthetic oligonucleotide
auuuaauagaaaaauguc

SEQ ID NO: 17193 - RNA, 18 nt, Artificial Sequence
  Description of Artificial Sequence: Synthetic oligonucleotide
caaugauuuaauagaaaa

SEQ ID NO: 17194 - RNA, 18 nt, Artificial Sequence
  Description of Artificial Sequence: Synthetic oligonucleotide
auaugcaaugauuuaaua

SEQ ID NO: 17195 - RNA, 18 nt, Artificial Sequence
  Description of Artificial Sequence: Synthetic oligonucleotide
cuuccauaugcaaugauu

SEQ ID NO: 17196 - RNA, 18 nt, Artificial Sequence
  Description of Artificial Sequence: Synthetic oligonucleotide
aguuucuuccauaugcaa

SEQ ID NO: 17197 - RNA, 18 nt, Artificial Sequence
  Description of Artificial Sequence: Synthetic oligonucleotide
uauugaguuucuuccaua

SEQ ID NO: 17198 - RNA, 18 nt, Artificial Sequence
  Description of Artificial Sequence: Synthetic oligonucleotide
uauuauauugaguuucuu

SEQ ID NO: 17199 - RNA, 18 nt, Artificial Sequence
  Description of Artificial Sequence: Synthetic oligonucleotide
ucagcuauuauauugagu

SEQ ID NO: 17200 - RNA, 18 nt, Artificial Sequence
  Description of Artificial Sequence: Synthetic oligonucleotide
aaauaucagcuauuauau

SEQ ID NO: 17201 - RNA, 18 nt, Artificial Sequence
  Description of Artificial Sequence: Synthetic oligonucleotide
caaguaaauaucagcuau

SEQ ID NO: 17202 - RNA, 18 nt, Artificial Sequence
  Description of Artificial Sequence: Synthetic oligonucleotide
gaacccaaguaaauauca

SEQ ID NO: 17203 - RNA, 18 nt, Artificial Sequence
  Description of Artificial Sequence: Synthetic oligonucleotide
auuaagaacccaaguaaa

SEQ ID NO: 17204 - RNA, 18 nt, Artificial Sequence
  Description of Artificial Sequence: Synthetic oligonucleotide
uucugauuaagaacccaa

SEQ ID NO: 17205 - RNA, 18 nt, Artificial Sequence
  Description of Artificial Sequence: Synthetic oligonucleotide
caauguucugauuaagaa

SEQ ID NO: 17206 - RNA, 18 nt, Artificial Sequence
  Description of Artificial Sequence: Synthetic oligonucleotide
acagccaauguucugauu

SEQ ID NO: 17207 - RNA, 18 nt, Artificial Sequence
  Description of Artificial Sequence: Synthetic oligonucleotide
aucacacagccaauguuc

SEQ ID NO: 17208 - RNA, 18 nt, Artificial Sequence
  Description of Artificial Sequence: Synthetic oligonucleotide
ugaaaaucacacagccaa

SEQ ID NO: 17209 - RNA, 18 nt, Artificial Sequence
  Description of Artificial Sequence: Synthetic oligonucleotide
aaucaugaaaaucacaca

SEQ ID NO: 17210 - RNA, 18 nt, Artificial Sequence
  Description of Artificial Sequence: Synthetic oligonucleotide
aucauaaucaugaaaauc

SEQ ID NO: 17211 - RNA, 18 nt, Artificial Sequence
  Description of Artificial Sequence: Synthetic oligonucleotide
ugaaaaucauaaucauga

SEQ ID NO: 17212 - RNA, 18 nt, Artificial Sequence
  Description of Artificial Sequence: Synthetic oligonucleotide
ugcaaugaaaaucauaau

SEQ ID NO: 17213 - RNA, 18 nt, Artificial Sequence
  Description of Artificial Sequence: Synthetic oligonucleotide
uuaauugcaaugaaaauc

SEQ ID NO: 17214 - RNA, 18 nt, Artificial Sequence
  Description of Artificial Sequence: Synthetic oligonucleotide
ucaacuuaauugcaauga

SEQ ID NO: 17215 - RNA, 18 nt, Artificial Sequence
  Description of Artificial Sequence: Synthetic oligonucleotide
aaacaucaacuuaauugc

SEQ ID NO: 17216 - RNA, 18 nt, Artificial Sequence
  Description of Artificial Sequence: Synthetic oligonucleotide
cuacaaaacaucaacuua

SEQ ID NO: 17217 - RNA, 18 nt, Artificial Sequence
  Description of Artificial Sequence: Synthetic oligonucleotide
acugucuacaaaacauca

SEQ ID NO: 17218 - RNA, 18 nt, Artificial Sequence
  Description of Artificial Sequence: Synthetic oligonucleotide
auuucacugucuacaaaa

SEQ ID NO: 17219 - RNA, 18 nt, Artificial Sequence
  Description of Artificial Sequence: Synthetic oligonucleotide
ugguaauuucacugucua

SEQ ID NO: 17220 - RNA, 18 nt, Artificial Sequence
  Description of Artificial Sequence: Synthetic oligonucleotide
guagaugguaauuucacu

SEQ ID NO: 17221 - RNA, 18 nt, Artificial Sequence
  Description of Artificial Sequence: Synthetic oligonucleotide
uuggaguagaugguaauu

SEQ ID NO: 17222 - RNA, 18 nt, Artificial Sequence
  Description of Artificial Sequence: Synthetic oligonucleotide
aucuuuuggaguagaugg

SEQ ID NO: 17223 - RNA, 18 nt, Artificial Sequence
  Description of Artificial Sequence: Synthetic oligonucleotide
uugcaaucuuuuggagua

SEQ ID NO: 17224 - RNA, 18 nt, Artificial Sequence
  Description of Artificial Sequence: Synthetic oligonucleotide
cuauuuugcaaucuuuug

SEQ ID NO: 17225 - RNA, 18 nt, Artificial Sequence
  Description of Artificial Sequence: Synthetic oligonucleotide
aaauucuauuuugcaauc

SEQ ID NO: 17226 - RNA, 18 nt, Artificial Sequence
  Description of Artificial Sequence: Synthetic oligonucleotide
agguuaaauucuauuuug

SEQ ID NO: 17227 - RNA, 18 nt, Artificial Sequence
  Description of Artificial Sequence: Synthetic oligonucleotide
cucuaagguuaaauucua

SEQ ID NO: 17228 - RNA, 18 nt, Artificial Sequence
  Description of Artificial Sequence: Synthetic oligonucleotide
auuggcucuaagguuaaa

SEQ ID NO: 17229 - RNA, 18 nt, Artificial Sequence
  Description of Artificial Sequence: Synthetic oligonucleotide
ccugcauuggcucuaagg

SEQ ID NO: 17230 - RNA, 18 nt, Artificial Sequence
  Description of Artificial Sequence: Synthetic oligonucleotide
uuuucccugcauuggcuc

SEQ ID NO: 17231 - RNA, 18 nt, Artificial Sequence
  Description of Artificial Sequence: Synthetic oligonucleotide
acaaguuuucccugcauu

SEQ ID NO: 17232 - RNA, 18 nt, Artificial Sequence
  Description of Artificial Sequence: Synthetic oligonucleotide
cagaaacaaguuuucccu

SEQ ID NO: 17233 - RNA, 18 nt, Artificial Sequence
  Description of Artificial Sequence: Synthetic oligonucleotide
accugcagaaacaaguuu

SEQ ID NO: 17234 - RNA, 18 nt, Artificial Sequence
  Description of Artificial Sequence: Synthetic oligonucleotide
aaugcaccugcagaaaca

SEQ ID NO: 17235 - RNA, 18 nt, Artificial Sequence
  Description of Artificial Sequence: Synthetic oligonucleotide
caaaaaaugcaccugcag

SEQ ID NO: 17236 - RNA, 18 nt, Artificial Sequence
  Description of Artificial Sequence: Synthetic oligonucleotide
aguuucaaaaaaugcacc

SEQ ID NO: 17237 - RNA, 18 nt, Artificial Sequence
  Description of Artificial Sequence: Synthetic oligonucleotide
guugaaguuucaaaaaau

SEQ ID NO: 17238 - RNA, 18 nt, Artificial Sequence
  Description of Artificial Sequence: Synthetic oligonucleotide
uaucuguugaaguuucaa

SEQ ID NO: 17239 - RNA, 18 nt, Artificial Sequence
  Description of Artificial Sequence: Synthetic oligonucleotide
ccugcuaucuguugaagu

SEQ ID NO: 17240 - RNA, 18 nt, Artificial Sequence
  Description of Artificial Sequence: Synthetic oligonucleotide
uucccccugcuaucuguu

SEQ ID NO: 17241 - RNA, 18 nt, Artificial Sequence
  Description of Artificial Sequence: Synthetic oligonucleotide
uuuuuuucccccugcuau

SEQ ID NO: 17242 - RNA, 18 nt, Artificial Sequence
  Description of Artificial Sequence: Synthetic oligonucleotide
ucacuuuuuuuucccccu

SEQ ID NO: 17243 - RNA, 18 nt, Artificial Sequence
  Description of Artificial Sequence: Synthetic oligonucleotide
uucugucacuuuuuuuuc

SEQ ID NO: 17244 - RNA, 18 nt, Artificial Sequence
  Description of Artificial Sequence: Synthetic oligonucleotide
gauccuucugucacuuuu

SEQ ID NO: 17245 - RNA, 18 nt, Artificial Sequence
  Description of Artificial Sequence: Synthetic oligonucleotide
acugugauccuucuguca

SEQ ID NO: 17246 - RNA, 18 nt, Artificial Sequence
  Description of Artificial Sequence: Synthetic oligonucleotide
gcugaacugugauccuuc

SEQ ID NO: 17247 - RNA, 18 nt, Artificial Sequence
  Description of Artificial Sequence: Synthetic oligonucleotide
auacugcugaacugugau

SEQ ID NO: 17248 - RNA, 18 nt, Artificial Sequence
  Description of Artificial Sequence: Synthetic oligonucleotide
aauucauacugcugaacu

SEQ ID NO: 17249 - RNA, 18 nt, Artificial Sequence
  Description of Artificial Sequence: Synthetic oligonucleotide
cagacaauucauacugcu

SEQ ID NO: 17250 - RNA, 18 nt, Artificial Sequence
  Description of Artificial Sequence: Synthetic oligonucleotide
gccagcagacaauucaua

SEQ ID NO: 17251 - RNA, 18 nt, Artificial Sequence
  Description of Artificial Sequence: Synthetic oligonucleotide
aggcugccagcagacaau

SEQ ID NO: 17252 - RNA, 18 nt, Artificial Sequence
  Description of Artificial Sequence: Synthetic oligonucleotide
uugcaaggcugccagcag

SEQ ID NO: 17253 - RNA, 18 nt, Artificial Sequence
  Description of Artificial Sequence: Synthetic oligonucleotide
ccagauugcaaggcugcc

SEQ ID NO: 17254 - RNA, 18 nt, Artificial Sequence
  Description of Artificial Sequence: Synthetic oligonucleotide
gcacaccagauugcaagg

SEQ ID NO: 17255 - RNA, 18 nt, Artificial Sequence
  Description of Artificial Sequence: Synthetic oligonucleotide
ugccugcacaccagauug

SEQ ID NO: 17256 - RNA, 18 nt, Artificial Sequence
  Description of Artificial Sequence: Synthetic oligonucleotide
cucacugccugcacacca

SEQ ID NO: 17257 - RNA, 18 nt, Artificial Sequence
  Description of Artificial Sequence: Synthetic oligonucleotide
acaaucucacugccugca

SEQ ID NO: 17258 - RNA, 18 nt, Artificial Sequence
  Description of Artificial Sequence: Synthetic oligonucleotide
acaccacaaucucacugc

SEQ ID NO: 17259 - RNA, 18 nt, Artificial Sequence
  Description of Artificial Sequence: Synthetic oligonucleotide
cauguacaccacaaucuc

SEQ ID NO: 17260 - RNA, 18 nt, Artificial Sequence
  Description of Artificial Sequence: Synthetic oligonucleotide
ggugacauguacaccaca

SEQ ID NO: 17261 - RNA, 18 nt, Artificial Sequence
  Description of Artificial Sequence: Synthetic oligonucleotide
aaucaggugacauguaca

SEQ ID NO: 17262 - RNA, 18 nt, Artificial Sequence
  Description of Artificial Sequence: Synthetic oligonucleotide
uguaguccugguggcaug

SEQ ID NO: 17263 - RNA, 18 nt, Artificial Sequence
  Description of Artificial Sequence: Synthetic oligonucleotide
gccccuguaguccuggug

SEQ ID NO: 17264 - RNA, 18 nt, Artificial Sequence
  Description of Artificial Sequence: Synthetic oligonucleotide
acucugccccuguagucc

SEQ ID NO: 17265 - RNA, 18 nt, Artificial Sequence
  Description of Artificial Sequence: Synthetic oligonucleotide
gagacacucugccccugu

SEQ ID NO: 17266 - RNA, 18 nt, Artificial Sequence
  Description of Artificial Sequence: Synthetic oligonucleotide
cagaggagacacucugcc

SEQ ID NO: 17267 - RNA, 18 nt, Artificial Sequence
  Description of Artificial Sequence: Synthetic oligonucleotide
gcugccagaggagacacu

SEQ ID NO: 17268 - RNA, 18 nt, Artificial Sequence
  Description of Artificial Sequence: Synthetic oligonucleotide
ucagagcugccagaggag

SEQ ID NO: 17269 - RNA, 18 nt, Artificial Sequence
  Description of Artificial Sequence: Synthetic oligonucleotide
ugaucucagagcugccag

SEQ ID NO: 17270 - RNA, 18 nt, Artificial Sequence
  Description of Artificial Sequence: Synthetic oligonucleotide
ggauuugaucucagagcu

SEQ ID NO: 17271 - RNA, 18 nt, Artificial Sequence
  Description of Artificial Sequence: Synthetic oligonucleotide
ucaucggauuugaucuca

SEQ ID NO: 17272 - RNA, 18 nt, Artificial Sequence
  Description of Artificial Sequence: Synthetic oligonucleotide
ccucgucaucggauuuga

SEQ ID NO: 17273 - RNA, 18 nt, Artificial Sequence
  Description of Artificial Sequence: Synthetic oligonucleotide
aucacccucgucaucgga

SEQ ID NO: 17274 - RNA, 18 nt, Artificial Sequence
  Description of Artificial Sequence: Synthetic oligonucleotide
uucucaucacccucguca

SEQ ID NO: 17275 - RNA, 18 nt, Artificial Sequence
  Description of Artificial Sequence: Synthetic oligonucleotide
gcagguucucaucacccu

SEQ ID NO: 17276 - RNA, 18 nt, Artificial Sequence
  Description of Artificial Sequence: Synthetic oligonucleotide
gucuugcagguucucauc

SEQ ID NO: 17277 - RNA, 18 nt, Artificial Sequence
  Description of Artificial Sequence: Synthetic oligonucleotide
uucgugucuugcagguuc

SEQ ID NO: 17278 - RNA, 18 nt, Artificial Sequence
  Description of Artificial Sequence: Synthetic oligonucleotide
aagauuucgugucuugca

SEQ ID NO: 17279 - RNA, 18 nt, Artificial Sequence
  Description of Artificial Sequence: Synthetic oligonucleotide
cuccgaagauuucguguc

SEQ ID NO: 17280 - RNA, 18 nt, Artificial Sequence
  Description of Artificial Sequence: Synthetic oligonucleotide
uuguccuccgaagauuuc

SEQ ID NO: 17281 - RNA, 18 nt, Artificial Sequence
  Description of Artificial Sequence: Synthetic oligonucleotide
auuucuuguccuccgaag

SEQ ID NO: 17282 - RNA, 18 nt, Artificial Sequence
  Description of Artificial Sequence: Synthetic oligonucleotide
aucuaauuucuuguccuc

SEQ ID NO: 17283 - RNA, 18 nt, Artificial Sequence
  Description of Artificial Sequence: Synthetic oligonucleotide
ucgucaucuaauuucuug

SEQ ID NO: 17284 - RNA, 18 nt, Artificial Sequence
  Description of Artificial Sequence: Synthetic oligonucleotide
ucuugucgucaucuaauu

SEQ ID NO: 17285 - RNA, 18 nt, Artificial Sequence
  Description of Artificial Sequence: Synthetic oligonucleotide
auccuucuugucgucauc

SEQ ID NO: 17286 - RNA, 18 nt, Artificial Sequence
  Description of Artificial Sequence: Synthetic oligonucleotide
uugauauccuucuugucg

SEQ ID NO: 17287 - RNA, 18 nt, Artificial Sequence
  Description of Artificial Sequence: Synthetic oligonucleotide
uugauuugauauccuucu

SEQ ID NO: 17288 - RNA, 18 nt, Artificial Sequence
  Description of Artificial Sequence: Synthetic oligonucleotide
aguaauugauuugauauc

SEQ ID NO: 17289 - RNA, 18 nt, Artificial Sequence
  Description of Artificial Sequence: Synthetic oligonucleotide
gaccuaguaauugauuug

SEQ ID NO: 17290 - RNA, 18 nt, Artificial Sequence
  Description of Artificial Sequence: Synthetic oligonucleotide
aucuugaccuaguaauug

SEQ ID NO: 17291 - RNA, 18 nt, Artificial Sequence
  Description of Artificial Sequence: Synthetic oligonucleotide
uucacgauggguccccac

SEQ ID NO: 17292 - RNA, 18 nt, Artificial Sequence
  Description of Artificial Sequence: Synthetic oligonucleotide
ccaucuucacgauggguc

SEQ ID NO: 17293 - RNA, 18 nt, Artificial Sequence
  Description of Artificial Sequence: Synthetic oligonucleotide
ccacgccaucuucacgau

SEQ ID NO: 17294 - RNA, 18 nt, Artificial Sequence
  Description of Artificial Sequence: Synthetic oligonucleotide
cagggccacgccaucuuc

SEQ ID NO: 17295 - RNA, 18 nt, Artificial Sequence
  Description of Artificial Sequence: Synthetic oligonucleotide
ccucucagggccacgcca

SEQ ID NO: 17296 - RNA, 18 nt, Artificial Sequence
  Description of Artificial Sequence: Synthetic oligonucleotide
ggcugccucucagggcca

SEQ ID NO: 17297 - RNA, 18 nt, Artificial Sequence
  Description of Artificial Sequence: Synthetic oligonucleotide
agaauggcugccucucag

SEQ ID NO: 17298 - RNA, 18 nt, Artificial Sequence
  Description of Artificial Sequence: Synthetic oligonucleotide
agaagagaauggcugccu

SEQ ID NO: 17299 - RNA, 18 nt, Artificial Sequence
  Description of Artificial Sequence: Synthetic oligonucleotide
uuggcagaagagaauggc

SEQ ID NO: 17300 - RNA, 18 nt, Artificial Sequence
  Description of Artificial Sequence: Synthetic oligonucleotide
cugguuuggcagaagaga

SEQ ID NO: 17301 - RNA, 18 nt, Artificial Sequence
  Description of Artificial Sequence: Synthetic oligonucleotide
ggaaccugguuuggcaga

SEQ ID NO: 17302 - RNA, 18 nt, Artificial Sequence
  Description of Artificial Sequence: Synthetic oligonucleotide
gaaccggaaccugguuug

SEQ ID NO: 17303 - RNA, 18 nt, Artificial Sequence
  Description of Artificial Sequence: Synthetic oligonucleotide
cuguggaaccggaaccug

SEQ ID NO: 17304 - RNA, 18 nt, Artificial Sequence
  Description of Artificial Sequence: Synthetic oligonucleotide
ggaagcuguggaaccgga

SEQ ID NO: 17305 - RNA, 18 nt, Artificial Sequence
  Description of Artificial Sequence: Synthetic oligonucleotide
ggacaggaagcuguggaa

SEQ ID NO: 17306 - RNA, 18 nt, Artificial Sequence
  Description of Artificial Sequence: Synthetic oligonucleotide
agacuggacaggaagcug

SEQ ID NO: 17307 - RNA, 18 nt, Artificial Sequence
  Description of Artificial Sequence: Synthetic oligonucleotide
gucgcagacuggacagga

SEQ ID NO: 17308 - RNA, 18 nt, Artificial Sequence
  Description of Artificial Sequence: Synthetic oligonucleotide
gggaagucgcagacugga

SEQ ID NO: 17309 - RNA, 18 nt, Artificial Sequence
  Description of Artificial Sequence: Synthetic oligonucleotide
gguggguucaggucaggg

SEQ ID NO: 17310 - RNA, 18 nt, Artificial Sequence
  Description of Artificial Sequence: Synthetic oligonucleotide
ggguggguucaggucagg

SEQ ID NO: 17311 - RNA, 18 nt, Artificial Sequence
  Description of Artificial Sequence: Synthetic oligonucleotide
cucuguaaggguccuggg

SEQ ID NO: 17312 - RNA, 18 nt, Artificial Sequence
  Description of Artificial Sequence: Synthetic oligonucleotide
gugcccuggugaggccaa

SEQ ID NO: 17313 - RNA, 18 nt, Artificial Sequence
  Description of Artificial Sequence: Synthetic oligonucleotide
cagaagugcccuggugag

SEQ ID NO: 17314 - RNA, 18 nt, Artificial Sequence
  Description of Artificial Sequence: Synthetic oligonucleotide
gaggucagaagugcccug

SEQ ID NO: 17315 - RNA, 18 nt, Artificial Sequence
  Description of Artificial Sequence: Synthetic oligonucleotide
aaagugaggucagaagug

SEQ ID NO: 17316 - RNA, 18 nt, Artificial Sequence
  Description of Artificial Sequence: Synthetic oligonucleotide
uugugaaagugaggucag

SEQ ID NO: 17317 - RNA, 18 nt, Artificial Sequence
  Description of Artificial Sequence: Synthetic oligonucleotide
uccuauugugaaagugag

SEQ ID NO: 17318 - RNA, 18 nt, Artificial Sequence
  Description of Artificial Sequence: Synthetic oligonucleotide
acugguccuauugugaaa

SEQ ID NO: 17319 - RNA, 18 nt, Artificial Sequence
  Description of Artificial Sequence: Synthetic oligonucleotide
ucaacacugguccuauug

SEQ ID NO: 17320 - RNA, 18 nt, Artificial Sequence
  Description of Artificial Sequence: Synthetic oligonucleotide
ggguaucaacacuggucc

SEQ ID NO: 17321 - RNA, 18 nt, Artificial Sequence
  Description of Artificial Sequence: Synthetic oligonucleotide
aggcuggguaucaacacu

SEQ ID NO: 17322 - RNA, 18 nt, Artificial Sequence
  Description of Artificial Sequence: Synthetic oligonucleotide
ccaagaggcuggguauca

SEQ ID NO: 17323 - RNA, 18 nt, Artificial Sequence
  Description of Artificial Sequence: Synthetic oligonucleotide
gaacaccaagaggcuggg

SEQ ID NO: 17324 - RNA, 18 nt, Artificial Sequence
  Description of Artificial Sequence: Synthetic oligonucleotide
gggaugaacaccaagagg

SEQ ID NO: 17325 - RNA, 18 nt, Artificial Sequence
  Description of Artificial Sequence: Synthetic oligonucleotide
cuugagggaugaacacca

SEQ ID NO: 17326 - RNA, 18 nt, Artificial Sequence
  Description of Artificial Sequence: Synthetic oligonucleotide
ugcuucuugagggaugaa

SEQ ID NO: 17327 - RNA, 18 nt, Artificial Sequence
  Description of Artificial Sequence: Synthetic oligonucleotide
gccagugcuucuugaggg

SEQ ID NO: 17328 - RNA, 18 nt, Artificial Sequence
  Description of Artificial Sequence: Synthetic oligonucleotide
uuucugccagugcuucuu

SEQ ID NO: 17329 - RNA, 18 nt, Artificial Sequence
  Description of Artificial Sequence: Synthetic oligonucleotide
cuggguuucugccagugc

SEQ ID NO: 17330 - RNA, 18 nt, Artificial Sequence
  Description of Artificial Sequence: Synthetic oligonucleotide
gauuccuggguuucugcc

SEQ ID NO: 17331 - RNA, 18 nt, Artificial Sequence
  Description of Artificial Sequence: Synthetic oligonucleotide
aauuugauuccuggguuu

SEQ ID NO: 17332 - RNA, 18 nt, Artificial Sequence
  Description of Artificial Sequence: Synthetic oligonucleotide
ugcccaauuugauuccug

SEQ ID NO: 17333 - RNA, 18 nt, Artificial Sequence
  Description of Artificial Sequence: Synthetic oligonucleotide
uuuugugcccaauuugau

SEQ ID NO: 17334 - RNA, 18 nt, Artificial Sequence
  Description of Artificial Sequence: Synthetic oligonucleotide
accauuuuugugcccaau

SEQ ID NO: 17335 - RNA, 18 nt, Artificial Sequence
  Description of Artificial Sequence: Synthetic oligonucleotide
uccuuaccauuuuugugc

SEQ ID NO: 17336 - RNA, 18 nt, Artificial Sequence
  Description of Artificial Sequence: Synthetic oligonucleotide
ccauuuccuuaccauuuu

SEQ ID NO: 17337 - RNA, 18 nt, Artificial Sequence
  Description of Artificial Sequence: Synthetic oligonucleotide
cuuugccauuuccuuacc

SEQ ID NO: 17338 - RNA, 18 nt, Artificial Sequence
  Description of Artificial Sequence: Synthetic oligonucleotide
aaauacuuugccauuucc

SEQ ID NO: 17339 - RNA, 18 nt, Artificial Sequence
  Description of Artificial Sequence: Synthetic oligonucleotide
guucuaaauacuuugcca

SEQ ID NO: 17340 - RNA, 18 nt, Artificial Sequence
  Description of Artificial Sequence: Synthetic oligonucleotide
gcgaaguucuaaauacuu

SEQ ID NO: 17341 - RNA, 18 nt, Artificial Sequence
  Description of Artificial Sequence: Synthetic oligonucleotide
agcgggcgaaguucuaaa

SEQ ID NO: 17342 - RNA, 18 nt, Artificial Sequence
  Description of Artificial Sequence: Synthetic oligonucleotide
caauuagcgggcgaaguu

SEQ ID NO: 17343 - RNA, 18 nt, Artificial Sequence
  Description of Artificial Sequence: Synthetic oligonucleotide
aaacacaauuagcgggcg

SEQ ID NO: 17344 - RNA, 18 nt, Artificial Sequence
  Description of Artificial Sequence: Synthetic oligonucleotide
uggagaaacacaauuagc

SEQ ID NO: 17345 - RNA, 18 nt, Artificial Sequence
  Description of Artificial Sequence: Synthetic oligonucleotide
gucccuggagaaacacaa

SEQ ID NO: 17346 - RNA, 18 nt, Artificial Sequence
  Description of Artificial Sequence: Synthetic oligonucleotide
aaacagucccuggagaaa

SEQ ID NO: 17347 - RNA, 18 nt, Artificial Sequence
  Description of Artificial Sequence: Synthetic oligonucleotide
gaggaaaacagucccugg

SEQ ID NO: 17348 - RNA, 18 nt, Artificial Sequence
  Description of Artificial Sequence: Synthetic oligonucleotide
uguuugaggaaaacaguc

SEQ ID NO: 17349 - RNA, 18 nt, Artificial Sequence
  Description of Artificial Sequence: Synthetic oligonucleotide
gaggauguuugaggaaaa

SEQ ID NO: 17350 - RNA, 18 nt, Artificial Sequence
  Description of Artificial Sequence: Synthetic oligonucleotide
uuucagaggauguuugag

SEQ ID NO: 17351 - RNA, 18 nt, Artificial Sequence
  Description of Artificial Sequence: Synthetic oligonucleotide
caggauuucagaggaugu

SEQ ID NO: 17352 - RNA, 18 nt, Artificial Sequence
  Description of Artificial Sequence: Synthetic oligonucleotide
aggaccaggauuucagag

SEQ ID NO: 17353 - RNA, 18 nt, Artificial Sequence
  Description of Artificial Sequence: Synthetic oligonucleotide
gauauaggaccaggauuu

SEQ ID NO: 17354 - RNA, 18 nt, Artificial Sequence
  Description of Artificial Sequence: Synthetic oligonucleotide
cugcugauauaggaccag

SEQ ID NO: 17355 - RNA, 18 nt, Artificial Sequence
  Description of Artificial Sequence: Synthetic oligonucleotide
auucccugcugauauagg

SEQ ID NO: 17356 - RNA, 18 nt, Artificial Sequence
  Description of Artificial Sequence: Synthetic oligonucleotide
gccucauucccugcugau

SEQ ID NO: 17357 - RNA, 18 nt, Artificial Sequence
  Description of Artificial Sequence: Synthetic oligonucleotide
cuguggccucauucccug

SEQ ID NO: 17358 - RNA, 18 nt, Artificial Sequence
  Description of Artificial Sequence: Synthetic oligonucleotide
ucagucuguggccucauu

SEQ ID NO: 17359 - RNA, 18 nt, Artificial Sequence
  Description of Artificial Sequence: Synthetic oligonucleotide
ucucaucagucuguggcc

SEQ ID NO: 17360 - RNA, 18 nt, Artificial Sequence
  Description of Artificial Sequence: Synthetic oligonucleotide
uuuccucucaucagucug

SEQ ID NO: 17361 - RNA, 18 nt, Artificial Sequence
  Description of Artificial Sequence: Synthetic oligonucleotide
uaaaauuuccucucauca

SEQ ID NO: 17362 - RNA, 18 nt, Artificial Sequence
  Description of Artificial Sequence: Synthetic oligonucleotide
uaaaauaaaauuuccucu

SEQ ID NO: 17363 - RNA, 18 nt, Artificial Sequence
  Description of Artificial Sequence: Synthetic oligonucleotide
auagcuaaaauaaaauuu

SEQ ID NO: 17364 - RNA, 18 nt, Artificial Sequence
  Description of Artificial Sequence: Synthetic oligonucleotide
uggaaauagcuaaaauaa

SEQ ID NO: 17365 - RNA, 18 nt, Artificial Sequence
  Description of Artificial Sequence: Synthetic oligonucleotide
aaauguggaaauagcuaa

SEQ ID NO: 17366 - RNA, 18 nt, Artificial Sequence
  Description of Artificial Sequence: Synthetic oligonucleotide
gagaaaaauguggaaaua

SEQ ID NO: 17367 - RNA, 18 nt, Artificial Sequence
  Description of Artificial Sequence: Synthetic oligonucleotide
ugaaugagaaaaaugugg

SEQ ID NO: 17368 - RNA, 18 nt, Artificial Sequence
  Description of Artificial Sequence: Synthetic oligonucleotide
ggaccugaaugagaaaaa

SEQ ID NO: 17369 - RNA, 18 nt, Artificial Sequence
  Description of Artificial Sequence: Synthetic oligonucleotide
uuagaggaccugaaugag

SEQ ID NO: 17370 - RNA, 18 nt, Artificial Sequence
  Description of Artificial Sequence: Synthetic oligonucleotide
ccacauuagaggaccuga

SEQ ID NO: 17371 - RNA, 18 nt, Artificial Sequence
  Description of Artificial Sequence: Synthetic oligonucleotide
acuaaccacauuagagga

SEQ ID NO: 17372 - RNA, 18 nt, Artificial Sequence
  Description of Artificial Sequence: Synthetic oligonucleotide
ccacaacuaaccacauua

SEQ ID NO: 17373 - RNA, 18 nt, Artificial Sequence
  Description of Artificial Sequence: Synthetic oligonucleotide
ucaggccacaacuaacca

SEQ ID NO: 17374 - RNA, 18 nt, Artificial Sequence
  Description of Artificial Sequence: Synthetic oligonucleotide
cauuuucaggccacaacu

SEQ ID NO: 17375 - RNA, 18 nt, Artificial Sequence
  Description of Artificial Sequence: Synthetic oligonucleotide
aauaucauuuucaggcca

SEQ ID NO: 17376 - RNA, 18 nt, Artificial Sequence
  Description of Artificial Sequence: Synthetic oligonucleotide
uuggaaauaucauuuuca

SEQ ID NO: 17377 - RNA, 18 nt, Artificial Sequence
  Description of Artificial Sequence: Synthetic oligonucleotide
uucauuuggaaauaucau

SEQ ID NO: 17378 - RNA, 18 nt, Artificial Sequence
  Description of Artificial Sequence: Synthetic oligonucleotide
uccuauucauuuggaaau

SEQ ID NO: 17379 - RNA, 18 nt, Artificial Sequence
  Description of Artificial Sequence: Synthetic oligonucleotide
uuccuuccuauucauuug

SEQ ID NO: 17380 - RNA, 18 nt, Artificial Sequence
  Description of Artificial Sequence: Synthetic oligonucleotide
uuuccuuccuuccuauuc

SEQ ID NO: 17381 - RNA, 18 nt, Artificial Sequence
  Description of Artificial Sequence: Synthetic oligonucleotide
aacaauuuccuuccuucc

SEQ ID NO: 17382 - RNA, 18 nt, Artificial Sequence
  Description of Artificial Sequence: Synthetic oligonucleotide
acaaaaacaauuuccuuc

SEQ ID NO: 17383 - RNA, 18 nt, Artificial Sequence
  Description of Artificial Sequence: Synthetic oligonucleotide
aaacaacaaaaacaauuu

SEQ ID NO: 17384 - RNA, 18 nt, Artificial Sequence
  Description of Artificial Sequence: Synthetic oligonucleotide
aucuuaaacaacaaaaac

SEQ ID NO: 17385 - RNA, 18 nt, Artificial Sequence
  Description of Artificial Sequence: Synthetic oligonucleotide
cuuccaucuuaaacaaca

SEQ ID NO: 17386 - RNA, 18 nt, Artificial Sequence
  Description of Artificial Sequence: Synthetic oligonucleotide
auuuccuuccaucuuaaa

SEQ ID NO: 17387 - RNA, 18 nt, Artificial Sequence
  Description of Artificial Sequence: Synthetic oligonucleotide
ccuauauuuccuuccauc

SEQ ID NO: 17388 - RNA, 18 nt, Artificial Sequence
  Description of Artificial Sequence: Synthetic oligonucleotide
augcaccuauauuuccuu

SEQ ID NO: 17389 - RNA, 18 nt, Artificial Sequence
  Description of Artificial Sequence: Synthetic oligonucleotide
uuuaaaugcaccuauauu

SEQ ID NO: 17390 - RNA, 18 nt, Artificial Sequence
  Description of Artificial Sequence: Synthetic oligonucleotide
cauuuuuuaaaugcaccu

SEQ ID NO: 17391 - RNA, 18 nt, Artificial Sequence
  Description of Artificial Sequence: Synthetic oligonucleotide
agcuccauuuuuuaaaug

SEQ ID NO: 17392 - RNA, 18 nt, Artificial Sequence
  Description of Artificial Sequence: Synthetic oligonucleotide
aaccaagcuccauuuuuu

SEQ ID NO: 17393 - RNA, 18 nt, Artificial Sequence
  Description of Artificial Sequence: Synthetic oligonucleotide
caugcaaccaagcuccau

SEQ ID NO: 17394 - RNA, 18 nt, Artificial Sequence
  Description of Artificial Sequence: Synthetic oligonucleotide
aaaaucaugcaaccaagc

SEQ ID NO: 17395 - RNA, 18 nt, Artificial Sequence
  Description of Artificial Sequence: Synthetic oligonucleotide
gagcgaaaaucaugcaac

SEQ ID NO: 17396 - RNA, 18 nt, Artificial Sequence
  Description of Artificial Sequence: Synthetic oligonucleotide
cucaagagcgaaaaucau

SEQ ID NO: 17397 - RNA, 18 nt, Artificial Sequence
  Description of Artificial Sequence: Synthetic oligonucleotide
gaugacucaagagcgaaa

SEQ ID NO: 17398 - RNA, 18 nt, Artificial Sequence
  Description of Artificial Sequence: Synthetic oligonucleotide
ggcuagaugacucaagag

SEQ ID NO: 17399 - RNA, 18 nt, Artificial Sequence
  Description of Artificial Sequence: Synthetic oligonucleotide
uagagggcuagaugacuc

SEQ ID NO: 17400 - RNA, 18 nt, Artificial Sequence
  Description of Artificial Sequence: Synthetic oligonucleotide
aucauuagagggcuagau

SEQ ID NO: 17401 - RNA, 18 nt, Artificial Sequence
  Description of Artificial Sequence: Synthetic oligonucleotide
aggcaaucauuagagggc

SEQ ID NO: 17402 - RNA, 18 nt, Artificial Sequence
  Description of Artificial Sequence: Synthetic oligonucleotide
guaugaggcaaucauuag

SEQ ID NO: 17403 - RNA, 18 nt, Artificial Sequence
  Description of Artificial Sequence: Synthetic oligonucleotide
caccgguaugaggcaauc

SEQ ID NO: 17404 - RNA, 18 nt, Artificial Sequence
  Description of Artificial Sequence: Synthetic oligonucleotide
guaaucaccgguaugagg

SEQ ID NO: 17405 - RNA, 18 nt, Artificial Sequence
  Description of Artificial Sequence: Synthetic oligonucleotide
cgcucguaaucaccggua

SEQ ID NO: 17406 - RNA, 18 nt, Artificial Sequence
  Description of Artificial Sequence: Synthetic oligonucleotide
aaagccgcucguaaucac

SEQ ID NO: 17407 - RNA, 18 nt, Artificial Sequence
  Description of Artificial Sequence: Synthetic oligonucleotide
caugaaaagccgcucgua

SEQ ID NO: 17408 - RNA, 18 nt, Artificial Sequence
  Description of Artificial Sequence: Synthetic oligonucleotide
gggucaugaaaagccgcu

SEQ ID NO: 17409 - RNA, 18 nt, Artificial Sequence
  Description of Artificial Sequence: Synthetic oligonucleotide
aaaugguacauauggaag

SEQ ID NO: 17410 - RNA, 18 nt, Artificial Sequence
  Description of Artificial Sequence: Synthetic oligonucleotide
uuuuaaaaugguacauau

SEQ ID NO: 17411 - RNA, 18 nt, Artificial Sequence
  Description of Artificial Sequence: Synthetic oligonucleotide
cagcauuuuaaaauggua

SEQ ID NO: 17412 - RNA, 18 nt, Artificial Sequence
  Description of Artificial Sequence: Synthetic oligonucleotide
guaaucagcauuuuaaaa

SEQ ID NO: 17413 - RNA, 18 nt, Artificial Sequence
  Description of Artificial Sequence: Synthetic oligonucleotide
aagaaguaaucagcauuu

SEQ ID NO: 17414 - RNA, 18 nt, Artificial Sequence
  Description of Artificial Sequence: Synthetic oligonucleotide
uucucaagaaguaaucag

SEQ ID NO: 17415 - RNA, 18 nt, Artificial Sequence
  Description of Artificial Sequence: Synthetic oligonucleotide
ucuuauucucaagaagua

SEQ ID NO: 17416 - RNA, 18 nt, Artificial Sequence
  Description of Artificial Sequence: Synthetic oligonucleotide
gcuucucuuauucucaag

SEQ ID NO: 17417 - RNA, 18 nt, Artificial Sequence
  Description of Artificial Sequence: Synthetic oligonucleotide
auuaggcuucucuuauuc

SEQ ID NO: 17418 - RNA, 18 nt, Artificial Sequence
  Description of Artificial Sequence: Synthetic oligonucleotide
cugaaauuaggcuucucu

SEQ ID NO: 17419 - RNA, 18 nt, Artificial Sequence
  Description of Artificial Sequence: Synthetic oligonucleotide
auauucugaaauuaggcu

SEQ ID NO: 17420 - RNA, 18 nt, Artificial Sequence
  Description of Artificial Sequence: Synthetic oligonucleotide
uaaugauauucugaaauu

SEQ ID NO: 17421 - RNA, 18 nt, Artificial Sequence
  Description of Artificial Sequence: Synthetic oligonucleotide
uacccuaaugauauucug

SEQ ID NO: 17422 - RNA, 18 nt, Artificial Sequence
  Description of Artificial Sequence: Synthetic oligonucleotide
auagguacccuaaugaua

SEQ ID NO: 17423 - RNA, 18 nt, Artificial Sequence
  Description of Artificial Sequence: Synthetic oligonucleotide
cuucaauagguacccuaa

SEQ ID NO: 17424 - RNA, 18 nt, Artificial Sequence
  Description of Artificial Sequence: Synthetic oligonucleotide
caagacuucaauagguac

SEQ ID NO: 17425 - RNA, 18 nt, Artificial Sequence
  Description of Artificial Sequence: Synthetic oligonucleotide
gcagucaagacuucaaua

SEQ ID NO: 17426 - RNA, 18 nt, Artificial Sequence
  Description of Artificial Sequence: Synthetic oligonucleotide
uaugugcagucaagacuu

SEQ ID NO: 17427 - RNA, 18 nt, Artificial Sequence
  Description of Artificial Sequence: Synthetic oligonucleotide
cuaaauaugugcagucaa

SEQ ID NO: 17428 - RNA, 18 nt, Artificial Sequence
  Description of Artificial Sequence: Synthetic oligonucleotide
guaugcuaaauaugugca

SEQ ID NO: 17429 - RNA, 18 nt, Artificial Sequence
  Description of Artificial Sequence: Synthetic oligonucleotide
agggaguaugcuaaauau

SEQ ID NO: 17430 - RNA, 18 nt, Artificial Sequence
  Description of Artificial Sequence: Synthetic oligonucleotide
uucccagggaguaugcua

SEQ ID NO: 17431 - RNA, 18 nt, Artificial Sequence
  Description of Artificial Sequence: Synthetic oligonucleotide
uauaauucccagggagua

SEQ ID NO: 17432 - RNA, 18 nt, Artificial Sequence
  Description of Artificial Sequence: Synthetic oligonucleotide
uaaaauauaauucccagg

SEQ ID NO: 17433 - RNA, 18 nt, Artificial Sequence
  Description of Artificial Sequence: Synthetic oligonucleotide
guccuuaaaauauaauuc

SEQ ID NO: 17434 - RNA, 18 nt, Artificial Sequence
  Description of Artificial Sequence: Synthetic oligonucleotide
aaaauguccuuaaaauau

SEQ ID NO: 17435 - RNA, 18 nt, Artificial Sequence
  Description of Artificial Sequence: Synthetic oligonucleotide
auagaaaaauguccuuaa

SEQ ID NO: 17436 - RNA, 18 nt, Artificial Sequence
  Description of Artificial Sequence: Synthetic oligonucleotide
auuuaauagaaaaauguc

SEQ ID NO: 17437 - RNA, 18 nt, Artificial Sequence
  Description of Artificial Sequence: Synthetic oligonucleotide
caaugauuuaauagaaaa

SEQ ID NO: 17438 - RNA, 18 nt, Artificial Sequence
  Description of Artificial Sequence: Synthetic oligonucleotide
auaugcaaugauuuaaua

SEQ ID NO: 17439 - RNA, 18 nt, Artificial Sequence
  Description of Artificial Sequence: Synthetic oligonucleotide
cuuccauaugcaaugauu

SEQ ID NO: 17440 - RNA, 18 nt, Artificial Sequence
  Description of Artificial Sequence: Synthetic oligonucleotide
aguuucuuccauaugcaa

SEQ ID NO: 17441 - RNA, 18 nt, Artificial Sequence
  Description of Artificial Sequence: Synthetic oligonucleotide
uauugaguuucuuccaua

SEQ ID NO: 17442 - RNA, 18 nt, Artificial Sequence
  Description of Artificial Sequence: Synthetic oligonucleotide
uauuauauugaguuucuu

SEQ ID NO: 17443 - RNA, 18 nt, Artificial Sequence
  Description of Artificial Sequence: Synthetic oligonucleotide
ucagcuauuauauugagu

SEQ ID NO: 17444 - RNA, 18 nt, Artificial Sequence
  Description of Artificial Sequence: Synthetic oligonucleotide
aaauaucagcuauuauau

SEQ ID NO: 17445 - RNA, 18 nt, Artificial Sequence
  Description of Artificial Sequence: Synthetic oligonucleotide
caaguaaauaucagcuau

SEQ ID NO: 17446 - RNA, 18 nt, Artificial Sequence
  Description of Artificial Sequence: Synthetic oligonucleotide
gaacccaaguaaauauca

SEQ ID NO: 17447 - RNA, 18 nt, Artificial Sequence
  Description of Artificial Sequence: Synthetic oligonucleotide
auuaagaacccaaguaaa

SEQ ID NO: 17448 - RNA, 18 nt, Artificial Sequence
  Description of Artificial Sequence: Synthetic oligonucleotide
uucugauuaagaacccaa

SEQ ID NO: 17449 - RNA, 18 nt, Artificial Sequence
  Description of Artificial Sequence: Synthetic oligonucleotide
caauguucugauuaagaa

SEQ ID NO: 17450 - RNA, 18 nt, Artificial Sequence
  Description of Artificial Sequence: Synthetic oligonucleotide
acagccaauguucugauu

SEQ ID NO: 17451 - RNA, 18 nt, Artificial Sequence
  Description of Artificial Sequence: Synthetic oligonucleotide
aucacacagccaauguuc

SEQ ID NO: 17452 - RNA, 18 nt, Artificial Sequence
  Description of Artificial Sequence: Synthetic oligonucleotide
ugaaaaucacacagccaa

SEQ ID NO: 17453 - RNA, 18 nt, Artificial Sequence
  Description of Artificial Sequence: Synthetic oligonucleotide
aaucaugaaaaucacaca

SEQ ID NO: 17454 - RNA, 18 nt, Artificial Sequence
  Description of Artificial Sequence: Synthetic oligonucleotide
aucauaaucaugaaaauc

SEQ ID NO: 17455 - RNA, 18 nt, Artificial Sequence
  Description of Artificial Sequence: Synthetic oligonucleotide
ugaaaaucauaaucauga

SEQ ID NO: 17456 - RNA, 18 nt, Artificial Sequence
  Description of Artificial Sequence: Synthetic oligonucleotide
ugcaaugaaaaucauaau

SEQ ID NO: 17457 - RNA, 18 nt, Artificial Sequence
  Description of Artificial Sequence: Synthetic oligonucleotide
uuaauugcaaugaaaauc

SEQ ID NO: 17458 - RNA, 18 nt, Artificial Sequence
  Description of Artificial Sequence: Synthetic oligonucleotide
ucaacuuaauugcaauga

SEQ ID NO: 17459 - RNA, 18 nt, Artificial Sequence
  Description of Artificial Sequence: Synthetic oligonucleotide
aaacaucaacuuaauugc

SEQ ID NO: 17460 - RNA, 18 nt, Artificial Sequence
  Description of Artificial Sequence: Synthetic oligonucleotide
cuacaaaacaucaacuua

SEQ ID NO: 17461 - RNA, 18 nt, Artificial Sequence
  Description of Artificial Sequence: Synthetic oligonucleotide
acugucuacaaaacauca

SEQ ID NO: 17462 - RNA, 18 nt, Artificial Sequence
  Description of Artificial Sequence: Synthetic oligonucleotide
auuucacugucuacaaaa

SEQ ID NO: 17463 - RNA, 18 nt, Artificial Sequence
  Description of Artificial Sequence: Synthetic oligonucleotide
ugguaauuucacugucua

SEQ ID NO: 17464 - RNA, 18 nt, Artificial Sequence
  Description of Artificial Sequence: Synthetic oligonucleotide
guagaugguaauuucacu

SEQ ID NO: 17465 - RNA, 18 nt, Artificial Sequence
  Description of Artificial Sequence: Synthetic oligonucleotide
uuggaguagaugguaauu

SEQ ID NO: 17466 - RNA, 18 nt, Artificial Sequence
  Description of Artificial Sequence: Synthetic oligonucleotide
aucuuuuggaguagaugg

SEQ ID NO: 17467 - RNA, 18 nt, Artificial Sequence
  Description of Artificial Sequence: Synthetic oligonucleotide
uugcaaucuuuuggagua

SEQ ID NO: 17468 - RNA, 18 nt, Artificial Sequence
  Description of Artificial Sequence: Synthetic oligonucleotide
cuauuuugcaaucuuuug

SEQ ID NO: 17469 - RNA, 18 nt, Artificial Sequence
  Description of Artificial Sequence: Synthetic oligonucleotide
aaauucuauuuugcaauc

SEQ ID NO: 17470 - RNA, 18 nt, Artificial Sequence
  Description of Artificial Sequence: Synthetic oligonucleotide
agguuaaauucuauuuug

SEQ ID NO: 17471 - RNA, 18 nt, Artificial Sequence
  Description of Artificial Sequence: Synthetic oligonucleotide
cucuaagguuaaauucua

SEQ ID NO: 17472 - RNA, 18 nt, Artificial Sequence
  Description of Artificial Sequence: Synthetic oligonucleotide
auuggcucuaagguuaaa

SEQ ID NO: 17473 - RNA, 18 nt, Artificial Sequence
  Description of Artificial Sequence: Synthetic oligonucleotide
ccugcauuggcucuaagg

SEQ ID NO: 17474 - RNA, 18 nt, Artificial Sequence
  Description of Artificial Sequence: Synthetic oligonucleotide
uuuucccugcauuggcuc

SEQ ID NO: 17475 - RNA, 18 nt, Artificial Sequence
  Description of Artificial Sequence: Synthetic oligonucleotide
acaaguuuucccugcauu

SEQ ID NO: 17476 - RNA, 18 nt, Artificial Sequence
  Description of Artificial Sequence: Synthetic oligonucleotide
cagaaacaaguuuucccu

SEQ ID NO: 17477 - RNA, 18 nt, Artificial Sequence
  Description of Artificial Sequence: Synthetic oligonucleotide
accugcagaaacaaguuu

SEQ ID NO: 17478 - RNA, 18 nt, Artificial Sequence
  Description of Artificial Sequence: Synthetic oligonucleotide
aaugcaccugcagaaaca

SEQ ID NO: 17479 - RNA, 18 nt, Artificial Sequence
  Description of Artificial Sequence: Synthetic oligonucleotide
caaaaaaugcaccugcag

SEQ ID NO: 17480 - RNA, 18 nt, Artificial Sequence
  Description of Artificial Sequence: Synthetic oligonucleotide
aguuucaaaaaaugcacc

SEQ ID NO: 17481 - RNA, 18 nt, Artificial Sequence
  Description of Artificial Sequence: Synthetic oligonucleotide
guugaaguuucaaaaaau

SEQ ID NO: 17482 - RNA, 18 nt, Artificial Sequence
  Description of Artificial Sequence: Synthetic oligonucleotide
uaucuguugaaguuucaa

SEQ ID NO: 17483 - RNA, 18 nt, Artificial Sequence
  Description of Artificial Sequence: Synthetic oligonucleotide
ccugcuaucuguugaagu

SEQ ID NO: 17484 - RNA, 18 nt, Artificial Sequence
  Description of Artificial Sequence: Synthetic oligonucleotide
uucccccugcuaucuguu

SEQ ID NO: 17485 - RNA, 18 nt, Artificial Sequence
  Description of Artificial Sequence: Synthetic oligonucleotide
uuuuuuucccccugcuau

SEQ ID NO: 17486 - RNA, 18 nt, Artificial Sequence
  Description of Artificial Sequence: Synthetic oligonucleotide
ucacuuuuuuuucccccu

SEQ ID NO: 17487 - RNA, 18 nt, Artificial Sequence
  Description of Artificial Sequence: Synthetic oligonucleotide
uucugucacuuuuuuuuc

SEQ ID NO: 17488 - RNA, 18 nt, Artificial Sequence
  Description of Artificial Sequence: Synthetic oligonucleotide
gauccuucugucacuuuu

SEQ ID NO: 17489 - RNA, 18 nt, Artificial Sequence
  Description of Artificial Sequence: Synthetic oligonucleotide
acugugauccuucuguca

SEQ ID NO: 17490 - RNA, 18 nt, Artificial Sequence
  Description of Artificial Sequence: Synthetic oligonucleotide
gcugaacugugauccuuc

SEQ ID NO: 17491 - RNA, 18 nt, Artificial Sequence
  Description of Artificial Sequence: Synthetic oligonucleotide
auacugcugaacugugau

SEQ ID NO: 17492 - RNA, 18 nt, Artificial Sequence
  Description of Artificial Sequence: Synthetic oligonucleotide
aauucauacugcugaacu

SEQ ID NO: 17493 - RNA, 18 nt, Artificial Sequence
  Description of Artificial Sequence: Synthetic oligonucleotide
cagacaauucauacugcu

SEQ ID NO: 17494 - RNA, 18 nt, Artificial Sequence
  Description of Artificial Sequence: Synthetic oligonucleotide
gccagcagacaauucaua

SEQ ID NO: 17495 - RNA, 18 nt, Artificial Sequence
  Description of Artificial Sequence: Synthetic oligonucleotide
aggcugccagcagacaau

SEQ ID NO: 17496 - RNA, 18 nt, Artificial Sequence
  Description of Artificial Sequence: Synthetic oligonucleotide
uugcaaggcugccagcag

SEQ ID NO: 17497 - RNA, 18 nt, Artificial Sequence
  Description of Artificial Sequence: Synthetic oligonucleotide
ccagauugcaaggcugcc

SEQ ID NO: 17498 - RNA, 18 nt, Artificial Sequence
  Description of Artificial Sequence: Synthetic oligonucleotide
gcacaccagauugcaagg

SEQ ID NO: 17499 - RNA, 18 nt, Artificial Sequence
  Description of Artificial Sequence: Synthetic oligonucleotide
ugccugcacaccagauug

SEQ ID NO: 17500 - RNA, 18 nt, Artificial Sequence
  Description of Artificial Sequence: Synthetic oligonucleotide
cucacugccugcacacca

SEQ ID NO: 17501 - RNA, 18 nt, Artificial Sequence
  Description of Artificial Sequence: Synthetic oligonucleotide
acaaucucacugccugca

SEQ ID NO: 17502 - RNA, 18 nt, Artificial Sequence
  Description of Artificial Sequence: Synthetic oligonucleotide
acaccacaaucucacugc

SEQ ID NO: 17503 - RNA, 18 nt, Artificial Sequence
  Description of Artificial Sequence: Synthetic oligonucleotide
cauguacaccacaaucuc

SEQ ID NO: 17504 - RNA, 18 nt, Artificial Sequence
  Description of Artificial Sequence: Synthetic oligonucleotide
ggugacauguacaccaca

SEQ ID NO: 17505 - RNA, 18 nt, Artificial Sequence
  Description of Artificial Sequence: Synthetic oligonucleotide
aaucaggugacauguaca

SEQ ID NO: 17506 - RNA, 18 nt, Artificial Sequence
  Description of Artificial Sequence: Synthetic oligonucleotide
uguaguccugguggcaug

SEQ ID NO: 17507 - RNA, 18 nt, Artificial Sequence
  Description of Artificial Sequence: Synthetic oligonucleotide
gccccuguaguccuggug

SEQ ID NO: 17508 - RNA, 18 nt, Artificial Sequence
  Description of Artificial Sequence: Synthetic oligonucleotide
acucugccccuguagucc

SEQ ID NO: 17509 - RNA, 18 nt, Artificial Sequence
  Description of Artificial Sequence: Synthetic oligonucleotide
gagacacucugccccugu

SEQ ID NO: 17510 - RNA, 18 nt, Artificial Sequence
  Description of Artificial Sequence: Synthetic oligonucleotide
cagaggagacacucugcc

SEQ ID NO: 17511 - RNA, 18 nt, Artificial Sequence
  Description of Artificial Sequence: Synthetic oligonucleotide
gcugccagaggagacacu

SEQ ID NO: 17512 - RNA, 18 nt, Artificial Sequence
  Description of Artificial Sequence: Synthetic oligonucleotide
ucagagcugccagaggag

SEQ ID NO: 17513 - RNA, 18 nt, Artificial Sequence
  Description of Artificial Sequence: Synthetic oligonucleotide
ugaucucagagcugccag

SEQ ID NO: 17514 - RNA, 18 nt, Artificial Sequence
  Description of Artificial Sequence: Synthetic oligonucleotide
ggauuugaucucagagcu

SEQ ID NO: 17515 - RNA, 18 nt, Artificial Sequence
  Description of Artificial Sequence: Synthetic oligonucleotide
ucaucggauuugaucuca

SEQ ID NO: 17516 - RNA, 18 nt, Artificial Sequence
  Description of Artificial Sequence: Synthetic oligonucleotide
ccucgucaucggauuuga

SEQ ID NO: 17517 - RNA, 18 nt, Artificial Sequence
  Description of Artificial Sequence: Synthetic oligonucleotide
aucacccucgucaucgga

SEQ ID NO: 17518 - RNA, 18 nt, Artificial Sequence
  Description of Artificial Sequence: Synthetic oligonucleotide
uucucaucacccucguca

SEQ ID NO: 17519 - RNA, 18 nt, Artificial Sequence
  Description of Artificial Sequence: Synthetic oligonucleotide
gcagguucucaucacccu

SEQ ID NO: 17520 - RNA, 18 nt, Artificial Sequence
  Description of Artificial Sequence: Synthetic oligonucleotide
gucuugcagguucucauc

SEQ ID NO: 17521 - RNA, 18 nt, Artificial Sequence
  Description of Artificial Sequence: Synthetic oligonucleotide
uucgugucuugcagguuc

SEQ ID NO: 17522 - RNA, 18 nt, Artificial Sequence
  Description of Artificial Sequence: Synthetic oligonucleotide
aagauuucgugucuugca

SEQ ID NO: 17523 - RNA, 18 nt, Artificial Sequence
  Description of Artificial Sequence: Synthetic oligonucleotide
cuccgaagauuucguguc

SEQ ID NO: 17524 - RNA, 18 nt, Artificial Sequence
  Description of Artificial Sequence: Synthetic oligonucleotide
uuguccuccgaagauuuc

SEQ ID NO: 17525 - RNA, 18 nt, Artificial Sequence
  Description of Artificial Sequence: Synthetic oligonucleotide
auuucuuguccuccgaag

SEQ ID NO: 17526 - RNA, 18 nt, Artificial Sequence
  Description of Artificial Sequence: Synthetic oligonucleotide
aucuaauuucuuguccuc

SEQ ID NO: 17527 - RNA, 18 nt, Artificial Sequence
  Description of Artificial Sequence: Synthetic oligonucleotide
ucgucaucuaauuucuug

SEQ ID NO: 17528 - RNA, 18 nt, Artificial Sequence
  Description of Artificial Sequence: Synthetic oligonucleotide
ucuugucgucaucuaauu

SEQ ID NO: 17529 - RNA, 18 nt, Artificial Sequence
  Description of Artificial Sequence: Synthetic oligonucleotide
auccuucuugucgucauc

SEQ ID NO: 17530 - RNA, 18 nt, Artificial Sequence
  Description of Artificial Sequence: Synthetic oligonucleotide
uugauauccuucuugucg

SEQ ID NO: 17531 - RNA, 18 nt, Artificial Sequence
  Description of Artificial Sequence: Synthetic oligonucleotide
uugauuugauauccuucu

SEQ ID NO: 17532 - RNA, 18 nt, Artificial Sequence
  Description of Artificial Sequence: Synthetic oligonucleotide
aguaauugauuugauauc

SEQ ID NO: 17533 - RNA, 18 nt, Artificial Sequence
  Description of Artificial Sequence: Synthetic oligonucleotide
uucacgauggguccccac

SEQ ID NO: 17534 - RNA, 18 nt, Artificial Sequence
  Description of Artificial Sequence: Synthetic oligonucleotide
ccaucuucacgauggguc

SEQ ID NO: 17535 - RNA, 18 nt, Artificial Sequence
  Description of Artificial Sequence: Synthetic oligonucleotide
ccacgccaucuucacgau

SEQ ID NO: 17536 - RNA, 18 nt, Artificial Sequence
  Description of Artificial Sequence: Synthetic oligonucleotide
cagggccacgccaucuuc

SEQ ID NO: 17537 - RNA, 18 nt, Artificial Sequence
  Description of Artificial Sequence: Synthetic oligonucleotide
ccucucagggccacgcca

SEQ ID NO: 17538 - RNA, 18 nt, Artificial Sequence
  Description of Artificial Sequence: Synthetic oligonucleotide
ggcugccucucagggcca

SEQ ID NO: 17539 - RNA, 18 nt, Artificial Sequence
  Description of Artificial Sequence: Synthetic oligonucleotide
agaauggcugccucucag

SEQ ID NO: 17540 - RNA, 18 nt, Artificial Sequence
  Description of Artificial Sequence: Synthetic oligonucleotide
agaagagaauggcugccu

SEQ ID NO: 17541 - RNA, 18 nt, Artificial Sequence
  Description of Artificial Sequence: Synthetic oligonucleotide
uuggcagaagagaauggc

SEQ ID NO: 17542 - RNA, 18 nt, Artificial Sequence
  Description of Artificial Sequence: Synthetic oligonucleotide
cugguuuggcagaagaga

SEQ ID NO: 17543 - RNA, 18 nt, Artificial Sequence
  Description of Artificial Sequence: Synthetic oligonucleotide
ggaaccugguuuggcaga

SEQ ID NO: 17544 - RNA, 18 nt, Artificial Sequence
  Description of Artificial Sequence: Synthetic oligonucleotide
gaaccggaaccugguuug

SEQ ID NO: 17545 - RNA, 18 nt, Artificial Sequence
  Description of Artificial Sequence: Synthetic oligonucleotide
cuguggaaccggaaccug

SEQ ID NO: 17546 - RNA, 18 nt, Artificial Sequence
  Description of Artificial Sequence: Synthetic oligonucleotide
ggaagcuguggaaccgga

SEQ ID NO: 17547 - RNA, 18 nt, Artificial Sequence
  Description of Artificial Sequence: Synthetic oligonucleotide
ggacaggaagcuguggaa

SEQ ID NO: 17548 - RNA, 18 nt, Artificial Sequence
  Description of Artificial Sequence: Synthetic oligonucleotide
agacuggacaggaagcug

SEQ ID NO: 17549 - RNA, 18 nt, Artificial Sequence
  Description of Artificial Sequence: Synthetic oligonucleotide
gucgcagacuggacagga

SEQ ID NO: 17550 - RNA, 18 nt, Artificial Sequence
  Description of Artificial Sequence: Synthetic oligonucleotide
gggaagucgcagacugga

SEQ ID NO: 17551 - RNA, 18 nt, Artificial Sequence
  Description of Artificial Sequence: Synthetic oligonucleotide
gguggguucaggucaggg

SEQ ID NO: 17552 - RNA, 18 nt, Artificial Sequence
  Description of Artificial Sequence: Synthetic oligonucleotide
ggguggguucaggucagg

SEQ ID NO: 17553 - RNA, 18 nt, Artificial Sequence
  Description of Artificial Sequence: Synthetic oligonucleotide
cucuguaaggguccuggg

SEQ ID NO: 17554 - RNA, 18 nt, Artificial Sequence
  Description of Artificial Sequence: Synthetic oligonucleotide
gugcccuggugaggccaa

SEQ ID NO: 17555 - RNA, 18 nt, Artificial Sequence
  Description of Artificial Sequence: Synthetic oligonucleotide
cagaagugcccuggugag

SEQ ID NO: 17556 - RNA, 18 nt, Artificial Sequence
  Description of Artificial Sequence: Synthetic oligonucleotide
gaggucagaagugcccug

SEQ ID NO: 17557 - RNA, 18 nt, Artificial Sequence
  Description of Artificial Sequence: Synthetic oligonucleotide
aaagugaggucagaagug

SEQ ID NO: 17558 - RNA, 18 nt, Artificial Sequence
  Description of Artificial Sequence: Synthetic oligonucleotide
uugugaaagugaggucag

SEQ ID NO: 17559 - RNA, 18 nt, Artificial Sequence
  Description of Artificial Sequence: Synthetic oligonucleotide
uccuauugugaaagugag

SEQ ID NO: 17560 - RNA, 18 nt, Artificial Sequence
  Description of Artificial Sequence: Synthetic oligonucleotide
acugguccuauugugaaa

SEQ ID NO: 17561 - RNA, 18 nt, Artificial Sequence
  Description of Artificial Sequence: Synthetic oligonucleotide
ucaacacugguccuauug

SEQ ID NO: 17562 - RNA, 18 nt, Artificial Sequence
  Description of Artificial Sequence: Synthetic oligonucleotide
ggguaucaacacuggucc

SEQ ID NO: 17563 - RNA, 18 nt, Artificial Sequence
  Description of Artificial Sequence: Synthetic oligonucleotide
aggcuggguaucaacacu

SEQ ID NO: 17564 - RNA, 18 nt, Artificial Sequence
  Description of Artificial Sequence: Synthetic oligonucleotide
ccaagaggcuggguauca

SEQ ID NO: 17565 - RNA, 18 nt, Artificial Sequence
  Description of Artificial Sequence: Synthetic oligonucleotide
gaacaccaagaggcuggg

SEQ ID NO: 17566 - RNA, 18 nt, Artificial Sequence
  Description of Artificial Sequence: Synthetic oligonucleotide
gggaugaacaccaagagg

SEQ ID NO: 17567 - RNA, 18 nt, Artificial Sequence
  Description of Artificial Sequence: Synthetic oligonucleotide
cuugagggaugaacacca

SEQ ID NO: 17568 - RNA, 18 nt, Artificial Sequence
  Description of Artificial Sequence: Synthetic oligonucleotide
ugcuucuugagggaugaa

SEQ ID NO: 17569 - RNA, 18 nt, Artificial Sequence
  Description of Artificial Sequence: Synthetic oligonucleotide
gccagugcuucuugaggg

SEQ ID NO: 17570 - RNA, 18 nt, Artificial Sequence
  Description of Artificial Sequence: Synthetic oligonucleotide
uuucugccagugcuucuu

SEQ ID NO: 17571 - RNA, 18 nt, Artificial Sequence
  Description of Artificial Sequence: Synthetic oligonucleotide
cuggguuucugccagugc

SEQ ID NO: 17572 - RNA, 18 nt, Artificial Sequence
  Description of Artificial Sequence: Synthetic oligonucleotide
gauuccuggguuucugcc

SEQ ID NO: 17573 - RNA, 18 nt, Artificial Sequence
  Description of Artificial Sequence: Synthetic oligonucleotide
aauuugauuccuggguuu

SEQ ID NO: 17574 - RNA, 18 nt, Artificial Sequence
  Description of Artificial Sequence: Synthetic oligonucleotide
ugcccaauuugauuccug

SEQ ID NO: 17575 - RNA, 18 nt, Artificial Sequence
  Description of Artificial Sequence: Synthetic oligonucleotide
uuuugugcccaauuugau

SEQ ID NO: 17576 - RNA, 18 nt, Artificial Sequence
  Description of Artificial Sequence: Synthetic oligonucleotide
accauuuuugugcccaau

SEQ ID NO: 17577 - RNA, 18 nt, Artificial Sequence
  Description of Artificial Sequence: Synthetic oligonucleotide
uccuuaccauuuuugugc

SEQ ID NO: 17578 - RNA, 18 nt, Artificial Sequence
  Description of Artificial Sequence: Synthetic oligonucleotide
ccauuuccuuaccauuuu

SEQ ID NO: 17579 - RNA, 18 nt, Artificial Sequence
  Description of Artificial Sequence: Synthetic oligonucleotide
cuuugccauuuccuuacc

SEQ ID NO: 17580 - RNA, 18 nt, Artificial Sequence
  Description of Artificial Sequence: Synthetic oligonucleotide
aaauacuuugccauuucc

SEQ ID NO: 17581 - RNA, 18 nt, Artificial Sequence
  Description of Artificial Sequence: Synthetic oligonucleotide
guucuaaauacuuugcca

SEQ ID NO: 17582 - RNA, 18 nt, Artificial Sequence
  Description of Artificial Sequence: Synthetic oligonucleotide
gcgaaguucuaaauacuu

SEQ ID NO: 17583 - RNA, 18 nt, Artificial Sequence
  Description of Artificial Sequence: Synthetic oligonucleotide
agcgggcgaaguucuaaa

SEQ ID NO: 17584 - RNA, 18 nt, Artificial Sequence
  Description of Artificial Sequence: Synthetic oligonucleotide
caauuagcgggcgaaguu

SEQ ID NO: 17585 - RNA, 18 nt, Artificial Sequence
  Description of Artificial Sequence: Synthetic oligonucleotide
aaacacaauuagcgggcg

SEQ ID NO: 17586 - RNA, 18 nt, Artificial Sequence
  Description of Artificial Sequence: Synthetic oligonucleotide
uggagaaacacaauuagc

SEQ ID NO: 17587 - RNA, 18 nt, Artificial Sequence
  Description of Artificial Sequence: Synthetic oligonucleotide
gucccuggagaaacacaa

SEQ ID NO: 17588 - RNA, 18 nt, Artificial Sequence
  Description of Artificial Sequence: Synthetic oligonucleotide
aaacagucccuggagaaa

SEQ ID NO: 17589 - RNA, 18 nt, Artificial Sequence
  Description of Artificial Sequence: Synthetic oligonucleotide
gaggaaaacagucccugg

SEQ ID NO: 17590 - RNA, 18 nt, Artificial Sequence
  Description of Artificial Sequence: Synthetic oligonucleotide
uguuugaggaaaacaguc

SEQ ID NO: 17591 - RNA, 18 nt, Artificial Sequence
  Description of Artificial Sequence: Synthetic oligonucleotide
gaggauguuugaggaaaa

SEQ ID NO: 17592 - RNA, 18 nt, Artificial Sequence
  Description of Artificial Sequence: Synthetic oligonucleotide
uuucagaggauguuugag

SEQ ID NO: 17593 - RNA, 18 nt, Artificial Sequence
  Description of Artificial Sequence: Synthetic oligonucleotide
caggauuucagaggaugu

SEQ ID NO: 17594 - RNA, 18 nt, Artificial Sequence
  Description of Artificial Sequence: Synthetic oligonucleotide
aggaccaggauuucagag

SEQ ID NO: 17595 - RNA, 18 nt, Artificial Sequence
  Description of Artificial Sequence: Synthetic oligonucleotide
gauauaggaccaggauuu

SEQ ID NO: 17596 - RNA, 18 nt, Artificial Sequence
  Description of Artificial Sequence: Synthetic oligonucleotide
cugcugauauaggaccag

SEQ ID NO: 17597 - RNA, 18 nt, Artificial Sequence
  Description of Artificial Sequence: Synthetic oligonucleotide
auucccugcugauauagg

SEQ ID NO: 17598 - RNA, 18 nt, Artificial Sequence
  Description of Artificial Sequence: Synthetic oligonucleotide
gccucauucccugcugau

SEQ ID NO: 17599 - RNA, 18 nt, Artificial Sequence
  Description of Artificial Sequence: Synthetic oligonucleotide
cuguggccucauucccug

SEQ ID NO: 17600 - RNA, 18 nt, Artificial Sequence
  Description of Artificial Sequence: Synthetic oligonucleotide
ucagucuguggccucauu

SEQ ID NO: 17601 - RNA, 18 nt, Artificial Sequence
  Description of Artificial Sequence: Synthetic oligonucleotide
ucucaucagucuguggcc

SEQ ID NO: 17602 - RNA, 18 nt, Artificial Sequence
  Description of Artificial Sequence: Synthetic oligonucleotide
uuuccucucaucagucug

SEQ ID NO: 17603 - RNA, 18 nt, Artificial Sequence
  Description of Artificial Sequence: Synthetic oligonucleotide
uaaaauuuccucucauca

SEQ ID NO: 17604 - RNA, 18 nt, Artificial Sequence
  Description of Artificial Sequence: Synthetic oligonucleotide
uaaaauaaaauuuccucu

SEQ ID NO: 17605 - RNA, 18 nt, Artificial Sequence
  Description of Artificial Sequence: Synthetic oligonucleotide
auagcuaaaauaaaauuu

SEQ ID NO: 17606 - RNA, 18 nt, Artificial Sequence
  Description of Artificial Sequence: Synthetic oligonucleotide
uggaaauagcuaaaauaa

SEQ ID NO: 17607 - RNA, 18 nt, Artificial Sequence
  Description of Artificial Sequence: Synthetic oligonucleotide
aaauguggaaauagcuaa

SEQ ID NO: 17608 - RNA, 18 nt, Artificial Sequence
  Description of Artificial Sequence: Synthetic oligonucleotide
gagaaaaauguggaaaua

SEQ ID NO: 17609 - RNA, 18 nt, Artificial Sequence
  Description of Artificial Sequence: Synthetic oligonucleotide
ugaaugagaaaaaugugg

SEQ ID NO: 17610 - RNA, 18 nt, Artificial Sequence
  Description of Artificial Sequence: Synthetic oligonucleotide
ggaccugaaugagaaaaa

SEQ ID NO: 17611 - RNA, 18 nt, Artificial Sequence
  Description of Artificial Sequence: Synthetic oligonucleotide
uuagaggaccugaaugag

SEQ ID NO: 17612 - RNA, 18 nt, Artificial Sequence
  Description of Artificial Sequence: Synthetic oligonucleotide
ccacauuagaggaccuga

SEQ ID NO: 17613 - RNA, 18 nt, Artificial Sequence
  Description of Artificial Sequence: Synthetic oligonucleotide
acuaaccacauuagagga

SEQ ID NO: 17614 - RNA, 18 nt, Artificial Sequence
  Description of Artificial Sequence: Synthetic oligonucleotide
ccacaacuaaccacauua

SEQ ID NO: 17615 - RNA, 18 nt, Artificial Sequence
  Description of Artificial Sequence: Synthetic oligonucleotide
ucaggccacaacuaacca

SEQ ID NO: 17616 - RNA, 18 nt, Artificial Sequence
  Description of Artificial Sequence: Synthetic oligonucleotide
cauuuucaggccacaacu

SEQ ID NO: 17617 - RNA, 18 nt, Artificial Sequence
  Description of Artificial Sequence: Synthetic oligonucleotide
aauaucauuuucaggcca

SEQ ID NO: 17618 - RNA, 18 nt, Artificial Sequence
  Description of Artificial Sequence: Synthetic oligonucleotide
uuggaaauaucauuuuca

SEQ ID NO: 17619 - RNA, 18 nt, Artificial Sequence
  Description of Artificial Sequence: Synthetic oligonucleotide
uucauuuggaaauaucau

SEQ ID NO: 17620 - RNA, 18 nt, Artificial Sequence
  Description of Artificial Sequence: Synthetic oligonucleotide
uccuauucauuuggaaau

SEQ ID NO: 17621 - RNA, 18 nt, Artificial Sequence
  Description of Artificial Sequence: Synthetic oligonucleotide
uuccuuccuauucauuug

SEQ ID NO: 17622 - RNA, 18 nt, Artificial Sequence
  Description of Artificial Sequence: Synthetic oligonucleotide
uuuccuuccuuccuauuc

SEQ ID NO: 17623 - RNA, 18 nt, Artificial Sequence
  Description of Artificial Sequence: Synthetic oligonucleotide
aacaauuuccuuccuucc

SEQ ID NO: 17624 - RNA, 18 nt, Artificial Sequence
  Description of Artificial Sequence: Synthetic oligonucleotide
acaaaaacaauuuccuuc

SEQ ID NO: 17625 - RNA, 18 nt, Artificial Sequence
  Description of Artificial Sequence: Synthetic oligonucleotide
aaacaacaaaaacaauuu

SEQ ID NO: 17626 - RNA, 18 nt, Artificial Sequence
  Description of Artificial Sequence: Synthetic oligonucleotide
aucuuaaacaacaaaaac

SEQ ID NO: 17627 - RNA, 18 nt, Artificial Sequence
  Description of Artificial Sequence: Synthetic oligonucleotide
cuuccaucuuaaacaaca

SEQ ID NO: 17628 - RNA, 18 nt, Artificial Sequence
  Description of Artificial Sequence: Synthetic oligonucleotide
auuuccuuccaucuuaaa

SEQ ID NO: 17629 - RNA, 18 nt, Artificial Sequence
  Description of Artificial Sequence: Synthetic oligonucleotide
ccuauauuuccuuccauc

SEQ ID NO: 17630 - RNA, 18 nt, Artificial Sequence
  Description of Artificial Sequence: Synthetic oligonucleotide
augcaccuauauuuccuu

SEQ ID NO: 17631 - RNA, 18 nt, Artificial Sequence
  Description of Artificial Sequence: Synthetic oligonucleotide
uuuaaaugcaccuauauu

SEQ ID NO: 17632 - RNA, 18 nt, Artificial Sequence
  Description of Artificial Sequence: Synthetic oligonucleotide
cauuuuuuaaaugcaccu

SEQ ID NO: 17633 - RNA, 18 nt, Artificial Sequence
  Description of Artificial Sequence: Synthetic oligonucleotide
agcuccauuuuuuaaaug

SEQ ID NO: 17634 - RNA, 18 nt, Artificial Sequence
  Description of Artificial Sequence: Synthetic oligonucleotide
aaccaagcuccauuuuuu

SEQ ID NO: 17635 - RNA, 18 nt, Artificial Sequence
  Description of Artificial Sequence: Synthetic oligonucleotide
caugcaaccaagcuccau

SEQ ID NO: 17636 - RNA, 18 nt, Artificial Sequence
  Description of Artificial Sequence: Synthetic oligonucleotide
aaaaucaugcaaccaagc

SEQ ID NO: 17637 - RNA, 18 nt, Artificial Sequence
  Description of Artificial Sequence: Synthetic oligonucleotide
gagcgaaaaucaugcaac

SEQ ID NO: 17638 - RNA, 18 nt, Artificial Sequence
  Description of Artificial Sequence: Synthetic oligonucleotide
cucaagagcgaaaaucau

SEQ ID NO: 17639 - RNA, 18 nt, Artificial Sequence
  Description of Artificial Sequence: Synthetic oligonucleotide
gaugacucaagagcgaaa

SEQ ID NO: 17640 - RNA, 18 nt, Artificial Sequence
  Description of Artificial Sequence: Synthetic oligonucleotide
ggcuagaugacucaagag

SEQ ID NO: 17641 - RNA, 18 nt, Artificial Sequence
  Description of Artificial Sequence: Synthetic oligonucleotide
uagagggcuagaugacuc

SEQ ID NO: 17642 - RNA, 18 nt, Artificial Sequence
  Description of Artificial Sequence: Synthetic oligonucleotide
aucauuagagggcuagau

SEQ ID NO: 17643 - RNA, 18 nt, Artificial Sequence
  Description of Artificial Sequence: Synthetic oligonucleotide
aggcaaucauuagagggc

SEQ ID NO: 17644 - RNA, 18 nt, Artificial Sequence
  Description of Artificial Sequence: Synthetic oligonucleotide
guaugaggcaaucauuag

SEQ ID NO: 17645 - RNA, 18 nt, Artificial Sequence
  Description of Artificial Sequence: Synthetic oligonucleotide
caccgguaugaggcaauc

SEQ ID NO: 17646 - RNA, 18 nt, Artificial Sequence
  Description of Artificial Sequence: Synthetic oligonucleotide
guaaucaccgguaugagg

SEQ ID NO: 17647 - RNA, 18 nt, Artificial Sequence
  Description of Artificial Sequence: Synthetic oligonucleotide
cgcucguaaucaccggua

SEQ ID NO: 17648 - RNA, 18 nt, Artificial Sequence
  Description of Artificial Sequence: Synthetic oligonucleotide
aaagccgcucguaaucac

SEQ ID NO: 17649 - RNA, 18 nt, Artificial Sequence
  Description of Artificial Sequence: Synthetic oligonucleotide
caugaaaagccgcucgua

SEQ ID NO: 17650 - RNA, 18 nt, Artificial Sequence
  Description of Artificial Sequence: Synthetic oligonucleotide
gggucaugaaaagccgcu

SEQ ID NO: 17651 - RNA, 18 nt, Artificial Sequence
  Description of Artificial Sequence: Synthetic oligonucleotide
aaaugguacauauggaag

SEQ ID NO: 17652 - RNA, 18 nt, Artificial Sequence
  Description of Artificial Sequence: Synthetic oligonucleotide
uuuuaaaaugguacauau

SEQ ID NO: 17653 - RNA, 18 nt, Artificial Sequence
  Description of Artificial Sequence: Synthetic oligonucleotide
cagcauuuuaaaauggua

SEQ ID NO: 17654 - RNA, 18 nt, Artificial Sequence
  Description of Artificial Sequence: Synthetic oligonucleotide
guaaucagcauuuuaaaa

SEQ ID NO: 17655 - RNA, 18 nt, Artificial Sequence
  Description of Artificial Sequence: Synthetic oligonucleotide
aagaaguaaucagcauuu

SEQ ID NO: 17656 - RNA, 18 nt, Artificial Sequence
  Description of Artificial Sequence: Synthetic oligonucleotide
uucucaagaaguaaucag

SEQ ID NO: 17657 - RNA, 18 nt, Artificial Sequence
  Description of Artificial Sequence: Synthetic oligonucleotide
ucuuauucucaagaagua

SEQ ID NO: 17658 - RNA, 18 nt, Artificial Sequence
  Description of Artificial Sequence: Synthetic oligonucleotide
gcuucucuuauucucaag

SEQ ID NO: 17659 - RNA, 18 nt, Artificial Sequence
  Description of Artificial Sequence: Synthetic oligonucleotide
auuaggcuucucuuauuc

SEQ ID NO: 17660 - RNA, 18 nt, Artificial Sequence
  Description of Artificial Sequence: Synthetic oligonucleotide
cugaaauuaggcuucucu

SEQ ID NO: 17661 - RNA, 18 nt, Artificial Sequence
  Description of Artificial Sequence: Synthetic oligonucleotide
auauucugaaauuaggcu

SEQ ID NO: 17662 - RNA, 18 nt, Artificial Sequence
  Description of Artificial Sequence: Synthetic oligonucleotide
uaaugauauucugaaauu

SEQ ID NO: 17663 - RNA, 18 nt, Artificial Sequence
  Description of Artificial Sequence: Synthetic oligonucleotide
uacccuaaugauauucug

SEQ ID NO: 17664 - RNA, 18 nt, Artificial Sequence
  Description of Artificial Sequence: Synthetic oligonucleotide
auagguacccuaaugaua

SEQ ID NO: 17665 - RNA, 18 nt, Artificial Sequence
  Description of Artificial Sequence: Synthetic oligonucleotide
cuucaauagguacccuaa

SEQ ID NO: 17666 - RNA, 18 nt, Artificial Sequence
  Description of Artificial Sequence: Synthetic oligonucleotide
caagacuucaauagguac

SEQ ID NO: 17667 - RNA, 18 nt, Artificial Sequence
  Description of Artificial Sequence: Synthetic oligonucleotide
gcagucaagacuucaaua

SEQ ID NO: 17668 - RNA, 18 nt, Artificial Sequence
  Description of Artificial Sequence: Synthetic oligonucleotide
uaugugcagucaagacuu

SEQ ID NO: 17669 - RNA, 18 nt, Artificial Sequence
  Description of Artificial Sequence: Synthetic oligonucleotide
cuaaauaugugcagucaa

SEQ ID NO: 17670 - RNA, 18 nt, Artificial Sequence
  Description of Artificial Sequence: Synthetic oligonucleotide
guaugcuaaauaugugca

SEQ ID NO: 17671 - RNA, 18 nt, Artificial Sequence
  Description of Artificial Sequence: Synthetic oligonucleotide
agggaguaugcuaaauau

SEQ ID NO: 17672 - RNA, 18 nt, Artificial Sequence
  Description of Artificial Sequence: Synthetic oligonucleotide
uucccagggaguaugcua

SEQ ID NO: 17673 - RNA, 18 nt, Artificial Sequence
  Description of Artificial Sequence: Synthetic oligonucleotide
uauaauucccagggagua

SEQ ID NO: 17674 - RNA, 18 nt, Artificial Sequence
  Description of Artificial Sequence: Synthetic oligonucleotide
uaaaauauaauucccagg

SEQ ID NO: 17675 - RNA, 18 nt, Artificial Sequence
  Description of Artificial Sequence: Synthetic oligonucleotide
guccuuaaaauauaauuc

SEQ ID NO: 17676 - RNA, 18 nt, Artificial Sequence
  Description of Artificial Sequence: Synthetic oligonucleotide
aaaauguccuuaaaauau

SEQ ID NO: 17677 - RNA, 18 nt, Artificial Sequence
  Description of Artificial Sequence: Synthetic oligonucleotide
auagaaaaauguccuuaa

SEQ ID NO: 17678 - RNA, 18 nt, Artificial Sequence
  Description of Artificial Sequence: Synthetic oligonucleotide
auuuaauagaaaaauguc

SEQ ID NO: 17679 - RNA, 18 nt, Artificial Sequence
  Description of Artificial Sequence: Synthetic oligonucleotide
caaugauuuaauagaaaa

SEQ ID NO: 17680 - RNA, 18 nt, Artificial Sequence
  Description of Artificial Sequence: Synthetic oligonucleotide
auaugcaaugauuuaaua

SEQ ID NO: 17681 - RNA, 18 nt, Artificial Sequence
  Description of Artificial Sequence: Synthetic oligonucleotide
cuuccauaugcaaugauu

SEQ ID NO: 17682 - RNA, 18 nt, Artificial Sequence
  Description of Artificial Sequence: Synthetic oligonucleotide
aguuucuuccauaugcaa

SEQ ID NO: 17683 - RNA, 18 nt, Artificial Sequence
  Description of Artificial Sequence: Synthetic oligonucleotide
uauugaguuucuuccaua

SEQ ID NO: 17684 - RNA, 18 nt, Artificial Sequence
  Description of Artificial Sequence: Synthetic oligonucleotide
uauuauauugaguuucuu

SEQ ID NO: 17685 - RNA, 18 nt, Artificial Sequence
  Description of Artificial Sequence: Synthetic oligonucleotide
ucagcuauuauauugagu

SEQ ID NO: 17686 - RNA, 18 nt, Artificial Sequence
  Description of Artificial Sequence: Synthetic oligonucleotide
aaauaucagcuauuauau

SEQ ID NO: 17687 - RNA, 18 nt, Artificial Sequence
  Description of Artificial Sequence: Synthetic oligonucleotide
caaguaaauaucagcuau

SEQ ID NO: 17688 - RNA, 18 nt, Artificial Sequence
  Description of Artificial Sequence: Synthetic oligonucleotide
gaacccaaguaaauauca

SEQ ID NO: 17689 - RNA, 18 nt, Artificial Sequence
  Description of Artificial Sequence: Synthetic oligonucleotide
auuaagaacccaaguaaa

SEQ ID NO: 17690 - RNA, 18 nt, Artificial Sequence
  Description of Artificial Sequence: Synthetic oligonucleotide
uucugauuaagaacccaa

SEQ ID NO: 17691 - RNA, 18 nt, Artificial Sequence
  Description of Artificial Sequence: Synthetic oligonucleotide
caauguucugauuaagaa

SEQ ID NO: 17692 - RNA, 18 nt, Artificial Sequence
  Description of Artificial Sequence: Synthetic oligonucleotide
acagccaauguucugauu

SEQ ID NO: 17693 - RNA, 18 nt, Artificial Sequence
  Description of Artificial Sequence: Synthetic oligonucleotide
aucacacagccaauguuc

SEQ ID NO: 17694 - RNA, 18 nt, Artificial Sequence
  Description of Artificial Sequence: Synthetic oligonucleotide
ugaaaaucacacagccaa

SEQ ID NO: 17695 - RNA, 18 nt, Artificial Sequence
  Description of Artificial Sequence: Synthetic oligonucleotide
aaucaugaaaaucacaca

SEQ ID NO: 17696 - RNA, 18 nt, Artificial Sequence
  Description of Artificial Sequence: Synthetic oligonucleotide
aucauaaucaugaaaauc

SEQ ID NO: 17697 - RNA, 18 nt, Artificial Sequence
  Description of Artificial Sequence: Synthetic oligonucleotide
ugaaaaucauaaucauga

SEQ ID NO: 17698 - RNA, 18 nt, Artificial Sequence
  Description of Artificial Sequence: Synthetic oligonucleotide
ugcaaugaaaaucauaau

SEQ ID NO: 17699 - RNA, 18 nt, Artificial Sequence
  Description of Artificial Sequence: Synthetic oligonucleotide
uuaauugcaaugaaaauc

SEQ ID NO: 17700 - RNA, 18 nt, Artificial Sequence
  Description of Artificial Sequence: Synthetic oligonucleotide
ucaacuuaauugcaauga

SEQ ID NO: 17701 - RNA, 18 nt, Artificial Sequence
  Description of Artificial Sequence: Synthetic oligonucleotide
aaacaucaacuuaauugc

SEQ ID NO: 17702 - RNA, 18 nt, Artificial Sequence
  Description of Artificial Sequence: Synthetic oligonucleotide
cuacaaaacaucaacuua

SEQ ID NO: 17703 - RNA, 18 nt, Artificial Sequence
  Description of Artificial Sequence: Synthetic oligonucleotide
acugucuacaaaacauca

SEQ ID NO: 17704 - RNA, 18 nt, Artificial Sequence
  Description of Artificial Sequence: Synthetic oligonucleotide
auuucacugucuacaaaa

SEQ ID NO: 17705 - RNA, 18 nt, Artificial Sequence
  Description of Artificial Sequence: Synthetic oligonucleotide
ugguaauuucacugucua

SEQ ID NO: 17706 - RNA, 18 nt, Artificial Sequence
  Description of Artificial Sequence: Synthetic oligonucleotide
guagaugguaauuucacu

SEQ ID NO: 17707 - RNA, 18 nt, Artificial Sequence
  Description of Artificial Sequence: Synthetic oligonucleotide
uuggaguagaugguaauu

SEQ ID NO: 17708 - RNA, 18 nt, Artificial Sequence
  Description of Artificial Sequence: Synthetic oligonucleotide
aucuuuuggaguagaugg

SEQ ID NO: 17709 - RNA, 18 nt, Artificial Sequence
  Description of Artificial Sequence: Synthetic oligonucleotide
uugcaaucuuuuggagua

SEQ ID NO: 17710 - RNA, 18 nt, Artificial Sequence
  Description of Artificial Sequence: Synthetic oligonucleotide
cuauuuugcaaucuuuug

SEQ ID NO: 17711 - RNA, 18 nt, Artificial Sequence
  Description of Artificial Sequence: Synthetic oligonucleotide
aaauucuauuuugcaauc

SEQ ID NO: 17712 - RNA, 18 nt, Artificial Sequence
  Description of Artificial Sequence: Synthetic oligonucleotide
agguuaaauucuauuuug

SEQ ID NO: 17713 - RNA, 18 nt, Artificial Sequence
  Description of Artificial Sequence: Synthetic oligonucleotide
cucuaagguuaaauucua

SEQ ID NO: 17714 - RNA, 18 nt, Artificial Sequence
  Description of Artificial Sequence: Synthetic oligonucleotide
auuggcucuaagguuaaa

SEQ ID NO: 17715 - RNA, 18 nt, Artificial Sequence
  Description of Artificial Sequence: Synthetic oligonucleotide
ccugcauuggcucuaagg

SEQ ID NO: 17716 - RNA, 18 nt, Artificial Sequence
  Description of Artificial Sequence: Synthetic oligonucleotide
uuuucccugcauuggcuc

SEQ ID NO: 17717 - RNA, 18 nt, Artificial Sequence
  Description of Artificial Sequence: Synthetic oligonucleotide
acaaguuuucccugcauu

SEQ ID NO: 17718 - RNA, 18 nt, Artificial Sequence
  Description of Artificial Sequence: Synthetic oligonucleotide
cagaaacaaguuuucccu

SEQ ID NO: 17719 - RNA, 18 nt, Artificial Sequence
  Description of Artificial Sequence: Synthetic oligonucleotide
accugcagaaacaaguuu

SEQ ID NO: 17720 - RNA, 18 nt, Artificial Sequence
  Description of Artificial Sequence: Synthetic oligonucleotide
aaugcaccugcagaaaca

SEQ ID NO: 17721 - RNA, 18 nt, Artificial Sequence
  Description of Artificial Sequence: Synthetic oligonucleotide
caaaaaaugcaccugcag

SEQ ID NO: 17722 - RNA, 18 nt, Artificial Sequence
  Description of Artificial Sequence: Synthetic oligonucleotide
aguuucaaaaaaugcacc

SEQ ID NO: 17723 - RNA, 18 nt, Artificial Sequence
  Description of Artificial Sequence: Synthetic oligonucleotide
guugaaguuucaaaaaau

SEQ ID NO: 17724 - RNA, 18 nt, Artificial Sequence
  Description of Artificial Sequence: Synthetic oligonucleotide
uaucuguugaaguuucaa

SEQ ID NO: 17725 - RNA, 18 nt, Artificial Sequence
  Description of Artificial Sequence: Synthetic oligonucleotide
ccugcuaucuguugaagu

SEQ ID NO: 17726 - RNA, 18 nt, Artificial Sequence
  Description of Artificial Sequence: Synthetic oligonucleotide
uucccccugcuaucuguu

SEQ ID NO: 17727 - RNA, 18 nt, Artificial Sequence
  Description of Artificial Sequence: Synthetic oligonucleotide
uuuuuuucccccugcuau

SEQ ID NO: 17728 - RNA, 18 nt, Artificial Sequence
  Description of Artificial Sequence: Synthetic oligonucleotide
ucacuuuuuuuucccccu

SEQ ID NO: 17729 - RNA, 18 nt, Artificial Sequence
  Description of Artificial Sequence: Synthetic oligonucleotide
uucugucacuuuuuuuuc

SEQ ID NO: 17730 - RNA, 18 nt, Artificial Sequence
  Description of Artificial Sequence: Synthetic oligonucleotide
gauccuucugucacuuuu

SEQ ID NO: 17731 - RNA, 18 nt, Artificial Sequence
  Description of Artificial Sequence: Synthetic oligonucleotide
acugugauccuucuguca

SEQ ID NO: 17732 - RNA, 18 nt, Artificial Sequence
  Description of Artificial Sequence: Synthetic oligonucleotide
gcugaacugugauccuuc

SEQ ID NO: 17733 - RNA, 18 nt, Artificial Sequence
  Description of Artificial Sequence: Synthetic oligonucleotide
auacugcugaacugugau

SEQ ID NO: 17734 - RNA, 18 nt, Artificial Sequence
  Description of Artificial Sequence: Synthetic oligonucleotide
aauucauacugcugaacu

SEQ ID NO: 17735 - RNA, 18 nt, Artificial Sequence
  Description of Artificial Sequence: Synthetic oligonucleotide
cagacaauucauacugcu

SEQ ID NO: 17736 - RNA, 18 nt, Artificial Sequence
  Description of Artificial Sequence: Synthetic oligonucleotide
gccagcagacaauucaua

SEQ ID NO: 17737 - RNA, 18 nt, Artificial Sequence
  Description of Artificial Sequence: Synthetic oligonucleotide
aggcugccagcagacaau

SEQ ID NO: 17738 - RNA, 18 nt, Artificial Sequence
  Description of Artificial Sequence: Synthetic oligonucleotide
uugcaaggcugccagcag

SEQ ID NO: 17739 - RNA, 18 nt, Artificial Sequence
  Description of Artificial Sequence: Synthetic oligonucleotide
ccagauugcaaggcugcc

SEQ ID NO: 17740 - RNA, 18 nt, Artificial Sequence
  Description of Artificial Sequence: Synthetic oligonucleotide
gcacaccagauugcaagg

SEQ ID NO: 17741 - RNA, 18 nt, Artificial Sequence
  Description of Artificial Sequence: Synthetic oligonucleotide
ugccugcacaccagauug

SEQ ID NO: 17742 - RNA, 18 nt, Artificial Sequence
  Description of Artificial Sequence: Synthetic oligonucleotide
cucacugccugcacacca

SEQ ID NO: 17743 - RNA, 18 nt, Artificial Sequence
  Description of Artificial Sequence: Synthetic oligonucleotide
acaaucucacugccugca

SEQ ID NO: 17744 - RNA, 18 nt, Artificial Sequence
  Description of Artificial Sequence: Synthetic oligonucleotide
acaccacaaucucacugc

SEQ ID NO: 17745 - RNA, 18 nt, Artificial Sequence
  Description of Artificial Sequence: Synthetic oligonucleotide
cauguacaccacaaucuc

SEQ ID NO: 17746 - RNA, 18 nt, Artificial Sequence
  Description of Artificial Sequence: Synthetic oligonucleotide
ggugacauguacaccaca

SEQ ID NO: 17747 - RNA, 18 nt, Artificial Sequence
  Description of Artificial Sequence: Synthetic oligonucleotide
aaucaggugacauguaca

SEQ ID NO: 17748 - RNA, 18 nt, Artificial Sequence
  Description of Artificial Sequence: Synthetic oligonucleotide
uguaguccugguggcaug

SEQ ID NO: 17749 - RNA, 18 nt, Artificial Sequence
  Description of Artificial Sequence: Synthetic oligonucleotide
gccccuguaguccuggug

SEQ ID NO: 17750 - RNA, 18 nt, Artificial Sequence
  Description of Artificial Sequence: Synthetic oligonucleotide
acucugccccuguagucc

SEQ ID NO: 17751 - RNA, 18 nt, Artificial Sequence
  Description of Artificial Sequence: Synthetic oligonucleotide
gagacacucugccccugu

SEQ ID NO: 17752 - RNA, 18 nt, Artificial Sequence
  Description of Artificial Sequence: Synthetic oligonucleotide
cagaggagacacucugcc

SEQ ID NO: 17753 - RNA, 18 nt, Artificial Sequence
  Description of Artificial Sequence: Synthetic oligonucleotide
gcugccagaggagacacu

SEQ ID NO: 17754 - RNA, 18 nt, Artificial Sequence
  Description of Artificial Sequence: Synthetic oligonucleotide
ucagagcugccagaggag

SEQ ID NO: 17755 - RNA, 18 nt, Artificial Sequence
  Description of Artificial Sequence: Synthetic oligonucleotide
ugaucucagagcugccag

SEQ ID NO: 17756 - RNA, 18 nt, Artificial Sequence
  Description of Artificial Sequence: Synthetic oligonucleotide
ggauuugaucucagagcu

SEQ ID NO: 17757 - RNA, 18 nt, Artificial Sequence
  Description of Artificial Sequence: Synthetic oligonucleotide
ucaucggauuugaucuca

SEQ ID NO: 17758 - RNA, 18 nt, Artificial Sequence
  Description of Artificial Sequence: Synthetic oligonucleotide
ccucgucaucggauuuga

SEQ ID NO: 17759 - RNA, 18 nt, Artificial Sequence
  Description of Artificial Sequence: Synthetic oligonucleotide
aucacccucgucaucgga

SEQ ID NO: 17760 - RNA, 18 nt, Artificial Sequence
  Description of Artificial Sequence: Synthetic oligonucleotide
uucucaucacccucguca

SEQ ID NO: 17761 - RNA, 18 nt, Artificial Sequence
  Description of Artificial Sequence: Synthetic oligonucleotide
gcagguucucaucacccu

SEQ ID NO: 17762 - RNA, 18 nt, Artificial Sequence
  Description of Artificial Sequence: Synthetic oligonucleotide
gucuugcagguucucauc

SEQ ID NO: 17763 - RNA, 18 nt, Artificial Sequence
  Description of Artificial Sequence: Synthetic oligonucleotide
uucgugucuugcagguuc

SEQ ID NO: 17764 - RNA, 18 nt, Artificial Sequence
  Description of Artificial Sequence: Synthetic oligonucleotide
aagauuucgugucuugca

SEQ ID NO: 17765 - RNA, 18 nt, Artificial Sequence
  Description of Artificial Sequence: Synthetic oligonucleotide
cuccgaagauuucguguc

SEQ ID NO: 17766 - RNA, 18 nt, Artificial Sequence
  Description of Artificial Sequence: Synthetic oligonucleotide
uuguccuccgaagauuuc

SEQ ID NO: 17767 - RNA, 18 nt, Artificial Sequence
  Description of Artificial Sequence: Synthetic oligonucleotide
auuucuuguccuccgaag

SEQ ID NO: 17768 - RNA, 18 nt, Artificial Sequence
  Description of Artificial Sequence: Synthetic oligonucleotide
aucuaauuucuuguccuc

SEQ ID NO: 17769 - RNA, 18 nt, Artificial Sequence
  Description of Artificial Sequence: Synthetic oligonucleotide
ucgucaucuaauuucuug

SEQ ID NO: 17770 - RNA, 18 nt, Artificial Sequence
  Description of Artificial Sequence: Synthetic oligonucleotide
ucuugucgucaucuaauu

SEQ ID NO: 17771 - RNA, 18 nt, Artificial Sequence
  Description of Artificial Sequence: Synthetic oligonucleotide
auccuucuugucgucauc

SEQ ID NO: 17772 - RNA, 18 nt, Artificial Sequence
  Description of Artificial Sequence: Synthetic oligonucleotide
uugauauccuucuugucg

SEQ ID NO: 17773 - RNA, 18 nt, Artificial Sequence
  Description of Artificial Sequence: Synthetic oligonucleotide
uugauuugauauccuucu

SEQ ID NO: 17774 - RNA, 18 nt, Artificial Sequence
  Description of Artificial Sequence: Synthetic oligonucleotide
aguaauugauuugauauc

SEQ ID NO: 17775 - RNA, 18 nt, Artificial Sequence
  Description of Artificial Sequence: Synthetic oligonucleotide
uucacgauggguccccac

SEQ ID NO: 17776 - RNA, 18 nt, Artificial Sequence
  Description of Artificial Sequence: Synthetic oligonucleotide
ccaucuucacgauggguc

SEQ ID NO: 17777 - RNA, 18 nt, Artificial Sequence
  Description of Artificial Sequence: Synthetic oligonucleotide
ccacgccaucuucacgau

SEQ ID NO: 17778 - RNA, 18 nt, Artificial Sequence
  Description of Artificial Sequence: Synthetic oligonucleotide
cagggccacgccaucuuc

SEQ ID NO: 17779 - RNA, 18 nt, Artificial Sequence
  Description of Artificial Sequence: Synthetic oligonucleotide
ccucucagggccacgcca

SEQ ID NO: 17780 - RNA, 18 nt, Artificial Sequence
  Description of Artificial Sequence: Synthetic oligonucleotide
ggcugccucucagggcca

SEQ ID NO: 17781 - RNA, 18 nt, Artificial Sequence
  Description of Artificial Sequence: Synthetic oligonucleotide
agaauggcugccucucag

SEQ ID NO: 17782 - RNA, 18 nt, Artificial Sequence
  Description of Artificial Sequence: Synthetic oligonucleotide
agaagagaauggcugccu

SEQ ID NO: 17783 - RNA, 18 nt, Artificial Sequence
  Description of Artificial Sequence: Synthetic oligonucleotide
uuggcagaagagaauggc

SEQ ID NO: 17784 - RNA, 18 nt, Artificial Sequence
  Description of Artificial Sequence: Synthetic oligonucleotide
cugguuuggcagaagaga

SEQ ID NO: 17785 - RNA, 18 nt, Artificial Sequence
  Description of Artificial Sequence: Synthetic oligonucleotide
ggaaccugguuuggcaga

SEQ ID NO: 17786 - RNA, 18 nt, Artificial Sequence
  Description of Artificial Sequence: Synthetic oligonucleotide
gaaccggaaccugguuug

SEQ ID NO: 17787 - RNA, 18 nt, Artificial Sequence
  Description of Artificial Sequence: Synthetic oligonucleotide
cuguggaaccggaaccug

SEQ ID NO: 17788 - RNA, 18 nt, Artificial Sequence
  Description of Artificial Sequence: Synthetic oligonucleotide
ggaagcuguggaaccgga

SEQ ID NO: 17789 - RNA, 18 nt, Artificial Sequence
  Description of Artificial Sequence: Synthetic oligonucleotide
ggacaggaagcuguggaa

SEQ ID NO: 17790 - RNA, 18 nt, Artificial Sequence
  Description of Artificial Sequence: Synthetic oligonucleotide
agacuggacaggaagcug

SEQ ID NO: 17791 - RNA, 18 nt, Artificial Sequence
  Description of Artificial Sequence: Synthetic oligonucleotide
gucgcagacuggacagga

SEQ ID NO: 17792 - RNA, 18 nt, Artificial Sequence
  Description of Artificial Sequence: Synthetic oligonucleotide
gggaagucgcagacugga

SEQ ID NO: 17793 - RNA, 18 nt, Artificial Sequence
  Description of Artificial Sequence: Synthetic oligonucleotide
gguggguucaggucaggg

SEQ ID NO: 17794 - RNA, 18 nt, Artificial Sequence
  Description of Artificial Sequence: Synthetic oligonucleotide
ggguggguucaggucagg

SEQ ID NO: 17795 - RNA, 18 nt, Artificial Sequence
  Description of Artificial Sequence: Synthetic oligonucleotide
cucuguaaggguccuggg

SEQ ID NO: 17796 - RNA, 18 nt, Artificial Sequence
  Description of Artificial Sequence: Synthetic oligonucleotide
gugcccuggugaggccaa

SEQ ID NO: 17797 - RNA, 18 nt, Artificial Sequence
  Description of Artificial Sequence: Synthetic oligonucleotide
cagaagugcccuggugag

SEQ ID NO: 17798 - RNA, 18 nt, Artificial Sequence
  Description of Artificial Sequence: Synthetic oligonucleotide
gaggucagaagugcccug

SEQ ID NO: 17799 - RNA, 18 nt, Artificial Sequence
  Description of Artificial Sequence: Synthetic oligonucleotide
aaagugaggucagaagug

SEQ ID NO: 17800 - RNA, 18 nt, Artificial Sequence
  Description of Artificial Sequence: Synthetic oligonucleotide
uugugaaagugaggucag

SEQ ID NO: 17801 - RNA, 18 nt, Artificial Sequence
  Description of Artificial Sequence: Synthetic oligonucleotide
uccuauugugaaagugag

SEQ ID NO: 17802 - RNA, 18 nt, Artificial Sequence
  Description of Artificial Sequence: Synthetic oligonucleotide
acugguccuauugugaaa

SEQ ID NO: 17803 - RNA, 18 nt, Artificial Sequence
  Description of Artificial Sequence: Synthetic oligonucleotide
ucaacacugguccuauug

SEQ ID NO: 17804 - RNA, 18 nt, Artificial Sequence
  Description of Artificial Sequence: Synthetic oligonucleotide
ggguaucaacacuggucc

SEQ ID NO: 17805 - RNA, 18 nt, Artificial Sequence
  Description of Artificial Sequence: Synthetic oligonucleotide
aggcuggguaucaacacu

SEQ ID NO: 17806 - RNA, 18 nt, Artificial Sequence
  Description of Artificial Sequence: Synthetic oligonucleotide
ccaagaggcuggguauca

SEQ ID NO: 17807 - RNA, 18 nt, Artificial Sequence
  Description of Artificial Sequence: Synthetic oligonucleotide
gaacaccaagaggcuggg

SEQ ID NO: 17808 - RNA, 18 nt, Artificial Sequence
  Description of Artificial Sequence: Synthetic oligonucleotide
gggaugaacaccaagagg

SEQ ID NO: 17809 - RNA, 18 nt, Artificial Sequence
  Description of Artificial Sequence: Synthetic oligonucleotide
cuugagggaugaacacca

SEQ ID NO: 17810 - RNA, 18 nt, Artificial Sequence
  Description of Artificial Sequence: Synthetic oligonucleotide
ugcuucuugagggaugaa

SEQ ID NO: 17811 - RNA, 18 nt, Artificial Sequence
  Description of Artificial Sequence: Synthetic oligonucleotide
gccagugcuucuugaggg

SEQ ID NO: 17812 - RNA, 18 nt, Artificial Sequence
  Description of Artificial Sequence: Synthetic oligonucleotide
uuucugccagugcuucuu

SEQ ID NO: 17813 - RNA, 18 nt, Artificial Sequence
  Description of Artificial Sequence: Synthetic oligonucleotide
cuggguuucugccagugc

SEQ ID NO: 17814 - RNA, 18 nt, Artificial Sequence
  Description of Artificial Sequence: Synthetic oligonucleotide
gauuccuggguuucugcc

SEQ ID NO: 17815 - RNA, 18 nt, Artificial Sequence
  Description of Artificial Sequence: Synthetic oligonucleotide
aauuugauuccuggguuu

SEQ ID NO: 17816 - RNA, 18 nt, Artificial Sequence
  Description of Artificial Sequence: Synthetic oligonucleotide
ugcccaauuugauuccug

SEQ ID NO: 17817 - RNA, 18 nt, Artificial Sequence
  Description of Artificial Sequence: Synthetic oligonucleotide
uuuugugcccaauuugau

SEQ ID NO: 17818 - RNA, 18 nt, Artificial Sequence
  Description of Artificial Sequence: Synthetic oligonucleotide
accauuuuugugcccaau

SEQ ID NO: 17819 - RNA, 18 nt, Artificial Sequence
  Description of Artificial Sequence: Synthetic oligonucleotide
uccuuaccauuuuugugc

SEQ ID NO: 17820 - RNA, 18 nt, Artificial Sequence
  Description of Artificial Sequence: Synthetic oligonucleotide
ccauuuccuuaccauuuu

SEQ ID NO: 17821 - RNA, 18 nt, Artificial Sequence
  Description of Artificial Sequence: Synthetic oligonucleotide
cuuugccauuuccuuacc

SEQ ID NO: 17822 - RNA, 18 nt, Artificial Sequence
  Description of Artificial Sequence: Synthetic oligonucleotide
aaauacuuugccauuucc

SEQ ID NO: 17823 - RNA, 18 nt, Artificial Sequence
  Description of Artificial Sequence: Synthetic oligonucleotide
guucuaaauacuuugcca

SEQ ID NO: 17824 - RNA, 18 nt, Artificial Sequence
  Description of Artificial Sequence: Synthetic oligonucleotide
gcgaaguucuaaauacuu

SEQ ID NO: 17825 - RNA, 18 nt, Artificial Sequence
  Description of Artificial Sequence: Synthetic oligonucleotide
agcgggcgaaguucuaaa

SEQ ID NO: 17826 - RNA, 18 nt, Artificial Sequence
  Description of Artificial Sequence: Synthetic oligonucleotide
caauuagcgggcgaaguu

SEQ ID NO: 17827 - RNA, 18 nt, Artificial Sequence
  Description of Artificial Sequence: Synthetic oligonucleotide
aaacacaauuagcgggcg

SEQ ID NO: 17828 - RNA, 18 nt, Artificial Sequence
  Description of Artificial Sequence: Synthetic oligonucleotide
uggagaaacacaauuagc

SEQ ID NO: 17829 - RNA, 18 nt, Artificial Sequence
  Description of Artificial Sequence: Synthetic oligonucleotide
gucccuggagaaacacaa

SEQ ID NO: 17830 - RNA, 18 nt, Artificial Sequence
  Description of Artificial Sequence: Synthetic oligonucleotide
aaacagucccuggagaaa

SEQ ID NO: 17831 - RNA, 18 nt, Artificial Sequence
  Description of Artificial Sequence: Synthetic oligonucleotide
gaggaaaacagucccugg

SEQ ID NO: 17832 - RNA, 18 nt, Artificial Sequence
  Description of Artificial Sequence: Synthetic oligonucleotide
uguuugaggaaaacaguc

SEQ ID NO: 17833 - RNA, 18 nt, Artificial Sequence
  Description of Artificial Sequence: Synthetic oligonucleotide
gaggauguuugaggaaaa

SEQ ID NO: 17834 - RNA, 18 nt, Artificial Sequence
  Description of Artificial Sequence: Synthetic oligonucleotide
uuucagaggauguuugag

SEQ ID NO: 17835 - RNA, 18 nt, Artificial Sequence
  Description of Artificial Sequence: Synthetic oligonucleotide
caggauuucagaggaugu

SEQ ID NO: 17836 - RNA, 18 nt, Artificial Sequence
  Description of Artificial Sequence: Synthetic oligonucleotide
aggaccaggauuucagag

SEQ ID NO: 17837 - RNA, 18 nt, Artificial Sequence
  Description of Artificial Sequence: Synthetic oligonucleotide
gauauaggaccaggauuu

SEQ ID NO: 17838 - RNA, 18 nt, Artificial Sequence
  Description of Artificial Sequence: Synthetic oligonucleotide
cugcugauauaggaccag

SEQ ID NO: 17839 - RNA, 18 nt, Artificial Sequence
  Description of Artificial Sequence: Synthetic oligonucleotide
auucccugcugauauagg

SEQ ID NO: 17840 - RNA, 18 nt, Artificial Sequence
  Description of Artificial Sequence: Synthetic oligonucleotide
gccucauucccugcugau

SEQ ID NO: 17841 - RNA, 18 nt, Artificial Sequence
  Description of Artificial Sequence: Synthetic oligonucleotide
cuguggccucauucccug

SEQ ID NO: 17842 - RNA, 18 nt, Artificial Sequence
  Description of Artificial Sequence: Synthetic oligonucleotide
ucagucuguggccucauu

SEQ ID NO: 17843 - RNA, 18 nt, Artificial Sequence
  Description of Artificial Sequence: Synthetic oligonucleotide
ucucaucagucuguggcc

SEQ ID NO: 17844 - RNA, 18 nt, Artificial Sequence
  Description of Artificial Sequence: Synthetic oligonucleotide
uuuccucucaucagucug

SEQ ID NO: 17845 - RNA, 18 nt, Artificial Sequence
  Description of Artificial Sequence: Synthetic oligonucleotide
uaaaauuuccucucauca

SEQ ID NO: 17846 - RNA, 18 nt, Artificial Sequence
  Description of Artificial Sequence: Synthetic oligonucleotide
uaaaauaaaauuuccucu

SEQ ID NO: 17847 - RNA, 18 nt, Artificial Sequence
  Description of Artificial Sequence: Synthetic oligonucleotide
auagcuaaaauaaaauuu

SEQ ID NO: 17848 - RNA, 18 nt, Artificial Sequence
  Description of Artificial Sequence: Synthetic oligonucleotide
uggaaauagcuaaaauaa

SEQ ID NO: 17849 - RNA, 18 nt, Artificial Sequence
  Description of Artificial Sequence: Synthetic oligonucleotide
aaauguggaaauagcuaa

SEQ ID NO: 17850 - RNA, 18 nt, Artificial Sequence
  Description of Artificial Sequence: Synthetic oligonucleotide
gagaaaaauguggaaaua

SEQ ID NO: 17851 - RNA, 18 nt, Artificial Sequence
  Description of Artificial Sequence: Synthetic oligonucleotide
ugaaugagaaaaaugugg

SEQ ID NO: 17852 - RNA, 18 nt, Artificial Sequence
  Description of Artificial Sequence: Synthetic oligonucleotide
ggaccugaaugagaaaaa

SEQ ID NO: 17853 - RNA, 18 nt, Artificial Sequence
  Description of Artificial Sequence: Synthetic oligonucleotide
uuagaggaccugaaugag

SEQ ID NO: 17854 - RNA, 18 nt, Artificial Sequence
  Description of Artificial Sequence: Synthetic oligonucleotide
ccacauuagaggaccuga

SEQ ID NO: 17855 - RNA, 18 nt, Artificial Sequence
  Description of Artificial Sequence: Synthetic oligonucleotide
acuaaccacauuagagga

SEQ ID NO: 17856 - RNA, 18 nt, Artificial Sequence
  Description of Artificial Sequence: Synthetic oligonucleotide
ccacaacuaaccacauua

SEQ ID NO: 17857 - RNA, 18 nt, Artificial Sequence
  Description of Artificial Sequence: Synthetic oligonucleotide
ucaggccacaacuaacca

SEQ ID NO: 17858 - RNA, 18 nt, Artificial Sequence
  Description of Artificial Sequence: Synthetic oligonucleotide
cauuuucaggccacaacu

SEQ ID NO: 17859 - RNA, 18 nt, Artificial Sequence
  Description of Artificial Sequence: Synthetic oligonucleotide
aauaucauuuucaggcca

SEQ ID NO: 17860 - RNA, 18 nt, Artificial Sequence
  Description of Artificial Sequence: Synthetic oligonucleotide
uuggaaauaucauuuuca

SEQ ID NO: 17861 - RNA, 18 nt, Artificial Sequence
  Description of Artificial Sequence: Synthetic oligonucleotide
uucauuuggaaauaucau

SEQ ID NO: 17862 - RNA, 18 nt, Artificial Sequence
  Description of Artificial Sequence: Synthetic oligonucleotide
uccuauucauuuggaaau

SEQ ID NO: 17863 - RNA, 18 nt, Artificial Sequence
  Description of Artificial Sequence: Synthetic oligonucleotide
uuccuuccuauucauuug

SEQ ID NO: 17864 - RNA, 18 nt, Artificial Sequence
  Description of Artificial Sequence: Synthetic oligonucleotide
uuuccuuccuuccuauuc

SEQ ID NO: 17865 - RNA, 18 nt, Artificial Sequence
  Description of Artificial Sequence: Synthetic oligonucleotide
aacaauuuccuuccuucc

SEQ ID NO: 17866 - RNA, 18 nt, Artificial Sequence
  Description of Artificial Sequence: Synthetic oligonucleotide
acaaaaacaauuuccuuc

SEQ ID NO: 17867 - RNA, 18 nt, Artificial Sequence
  Description of Artificial Sequence: Synthetic oligonucleotide
aaacaacaaaaacaauuu

SEQ ID NO: 17868 - RNA, 18 nt, Artificial Sequence
  Description of Artificial Sequence: Synthetic oligonucleotide
aucuuaaacaacaaaaac

SEQ ID NO: 17869 - RNA, 18 nt, Artificial Sequence
  Description of Artificial Sequence: Synthetic oligonucleotide
cuuccaucuuaaacaaca

SEQ ID NO: 17870 - RNA, 18 nt, Artificial Sequence
  Description of Artificial Sequence: Synthetic oligonucleotide
auuuccuuccaucuuaaa

SEQ ID NO: 17871 - RNA, 18 nt, Artificial Sequence
  Description of Artificial Sequence: Synthetic oligonucleotide
ccuauauuuccuuccauc

SEQ ID NO: 17872 - RNA, 18 nt, Artificial Sequence
  Description of Artificial Sequence: Synthetic oligonucleotide
augcaccuauauuuccuu

SEQ ID NO: 17873 - RNA, 18 nt, Artificial Sequence
  Description of Artificial Sequence: Synthetic oligonucleotide
uuuaaaugcaccuauauu

SEQ ID NO: 17874 - RNA, 18 nt, Artificial Sequence
  Description of Artificial Sequence: Synthetic oligonucleotide
cauuuuuuaaaugcaccu

SEQ ID NO: 17875 - RNA, 18 nt, Artificial Sequence
  Description of Artificial Sequence: Synthetic oligonucleotide
agcuccauuuuuuaaaug

SEQ ID NO: 17876 - RNA, 18 nt, Artificial Sequence
  Description of Artificial Sequence: Synthetic oligonucleotide
aaccaagcuccauuuuuu

SEQ ID NO: 17877 - RNA, 18 nt, Artificial Sequence
  Description of Artificial Sequence: Synthetic oligonucleotide
caugcaaccaagcuccau

SEQ ID NO: 17878 - RNA, 18 nt, Artificial Sequence
  Description of Artificial Sequence: Synthetic oligonucleotide
aaaaucaugcaaccaagc

SEQ ID NO: 17879 - RNA, 18 nt, Artificial Sequence
  Description of Artificial Sequence: Synthetic oligonucleotide
gagcgaaaaucaugcaac

SEQ ID NO: 17880 - RNA, 18 nt, Artificial Sequence
  Description of Artificial Sequence: Synthetic oligonucleotide
cucaagagcgaaaaucau

SEQ ID NO: 17881 - RNA, 18 nt, Artificial Sequence
  Description of Artificial Sequence: Synthetic oligonucleotide
gaugacucaagagcgaaa

SEQ ID NO: 17882 - RNA, 18 nt, Artificial Sequence
  Description of Artificial Sequence: Synthetic oligonucleotide
ggcuagaugacucaagag

SEQ ID NO: 17883 - RNA, 18 nt, Artificial Sequence
  Description of Artificial Sequence: Synthetic oligonucleotide
uagagggcuagaugacuc

SEQ ID NO: 17884 - RNA, 18 nt, Artificial Sequence
  Description of Artificial Sequence: Synthetic oligonucleotide
aucauuagagggcuagau

SEQ ID NO: 17885 - RNA, 18 nt, Artificial Sequence
  Description of Artificial Sequence: Synthetic oligonucleotide
aggcaaucauuagagggc

SEQ ID NO: 17886 - RNA, 18 nt, Artificial Sequence
  Description of Artificial Sequence: Synthetic oligonucleotide
guaugaggcaaucauuag

SEQ ID NO: 17887 - RNA, 18 nt, Artificial Sequence
  Description of Artificial Sequence: Synthetic oligonucleotide
caccgguaugaggcaauc

SEQ ID NO: 17888 - RNA, 18 nt, Artificial Sequence
  Description of Artificial Sequence: Synthetic oligonucleotide
guaaucaccgguaugagg

SEQ ID NO: 17889 - RNA, 18 nt, Artificial Sequence
  Description of Artificial Sequence: Synthetic oligonucleotide
cgcucguaaucaccggua

SEQ ID NO: 17890 - RNA, 18 nt, Artificial Sequence
  Description of Artificial Sequence: Synthetic oligonucleotide
aaagccgcucguaaucac

SEQ ID NO: 17891 - RNA, 18 nt, Artificial Sequence
  Description of Artificial Sequence: Synthetic oligonucleotide
caugaaaagccgcucgua

SEQ ID NO: 17892 - RNA, 18 nt, Artificial Sequence
  Description of Artificial Sequence: Synthetic oligonucleotide
gggucaugaaaagccgcu

SEQ ID NO: 17893 - RNA, 18 nt, Artificial Sequence
  Description of Artificial Sequence: Synthetic oligonucleotide
aaaugguacauauggaag

SEQ ID NO: 17894 - RNA, 18 nt, Artificial Sequence
  Description of Artificial Sequence: Synthetic oligonucleotide
uuuuaaaaugguacauau

SEQ ID NO: 17895 - RNA, 18 nt, Artificial Sequence
  Description of Artificial Sequence: Synthetic oligonucleotide
cagcauuuuaaaauggua

SEQ ID NO: 17896 - RNA, 18 nt, Artificial Sequence
  Description of Artificial Sequence: Synthetic oligonucleotide
guaaucagcauuuuaaaa

SEQ ID NO: 17897 - RNA, 18 nt, Artificial Sequence
  Description of Artificial Sequence: Synthetic oligonucleotide
aagaaguaaucagcauuu

SEQ ID NO: 17898 - RNA, 18 nt, Artificial Sequence
  Description of Artificial Sequence: Synthetic oligonucleotide
uucucaagaaguaaucag

SEQ ID NO: 17899 - RNA, 18 nt, Artificial Sequence
  Description of Artificial Sequence: Synthetic oligonucleotide
ucuuauucucaagaagua

SEQ ID NO: 17900 - RNA, 18 nt, Artificial Sequence
  Description of Artificial Sequence: Synthetic oligonucleotide
gcuucucuuauucucaag

SEQ ID NO: 17901 - RNA, 18 nt, Artificial Sequence
  Description of Artificial Sequence: Synthetic oligonucleotide
auuaggcuucucuuauuc

SEQ ID NO: 17902 - RNA, 18 nt, Artificial Sequence
  Description of Artificial Sequence: Synthetic oligonucleotide
cugaaauuaggcuucucu

SEQ ID NO: 17903 - RNA, 18 nt, Artificial Sequence
  Description of Artificial Sequence: Synthetic oligonucleotide
auauucugaaauuaggcu

SEQ ID NO: 17904 - RNA, 18 nt, Artificial Sequence
  Description of Artificial Sequence: Synthetic oligonucleotide
uaaugauauucugaaauu

SEQ ID NO: 17905 - RNA, 18 nt, Artificial Sequence
  Description of Artificial Sequence: Synthetic oligonucleotide
uacccuaaugauauucug

SEQ ID NO: 17906 - RNA, 18 nt, Artificial Sequence
  Description of Artificial Sequence: Synthetic oligonucleotide
auagguacccuaaugaua

SEQ ID NO: 17907 - RNA, 18 nt, Artificial Sequence
  Description of Artificial Sequence: Synthetic oligonucleotide
cuucaauagguacccuaa

SEQ ID NO: 17908 - RNA, 18 nt, Artificial Sequence
  Description of Artificial Sequence: Synthetic oligonucleotide
caagacuucaauagguac

SEQ ID NO: 17909 - RNA, 18 nt, Artificial Sequence
  Description of Artificial Sequence: Synthetic oligonucleotide
gcagucaagacuucaaua

SEQ ID NO: 17910 - RNA, 18 nt, Artificial Sequence
  Description of Artificial Sequence: Synthetic oligonucleotide
uaugugcagucaagacuu

SEQ ID NO: 17911 - RNA, 18 nt, Artificial Sequence
  Description of Artificial Sequence: Synthetic oligonucleotide
cuaaauaugugcagucaa

SEQ ID NO: 17912 - RNA, 18 nt, Artificial Sequence
  Description of Artificial Sequence: Synthetic oligonucleotide
guaugcuaaauaugugca

SEQ ID NO: 17913 - RNA, 18 nt, Artificial Sequence
  Description of Artificial Sequence: Synthetic oligonucleotide
agggaguaugcuaaauau

SEQ ID NO: 17914 - RNA, 18 nt, Artificial Sequence
  Description of Artificial Sequence: Synthetic oligonucleotide
uucccagggaguaugcua

SEQ ID NO: 17915 - RNA, 18 nt, Artificial Sequence
  Description of Artificial Sequence: Synthetic oligonucleotide
uauaauucccagggagua

SEQ ID NO: 17916 - RNA, 18 nt, Artificial Sequence
  Description of Artificial Sequence: Synthetic oligonucleotide
uaaaauauaauucccagg

SEQ ID NO: 17917 - RNA, 18 nt, Artificial Sequence
  Description of Artificial Sequence: Synthetic oligonucleotide
guccuuaaaauauaauuc

SEQ ID NO: 17918 - RNA, 18 nt, Artificial Sequence
  Description of Artificial Sequence: Synthetic oligonucleotide
aaaauguccuuaaaauau

SEQ ID NO: 17919 - RNA, 18 nt, Artificial Sequence
  Description of Artificial Sequence: Synthetic oligonucleotide
auagaaaaauguccuuaa

SEQ ID NO: 17920 - RNA, 18 nt, Artificial Sequence
  Description of Artificial Sequence: Synthetic oligonucleotide
auuuaauagaaaaauguc

SEQ ID NO: 17921 - RNA, 18 nt, Artificial Sequence
  Description of Artificial Sequence: Synthetic oligonucleotide
caaugauuuaauagaaaa

SEQ ID NO: 17922 - RNA, 18 nt, Artificial Sequence
  Description of Artificial Sequence: Synthetic oligonucleotide
auaugcaaugauuuaaua

SEQ ID NO: 17923 - RNA, 18 nt, Artificial Sequence
  Description of Artificial Sequence: Synthetic oligonucleotide
cuuccauaugcaaugauu

SEQ ID NO: 17924 - RNA, 18 nt, Artificial Sequence
  Description of Artificial Sequence: Synthetic oligonucleotide
aguuucuuccauaugcaa

SEQ ID NO: 17925 - RNA, 18 nt, Artificial Sequence
  Description of Artificial Sequence: Synthetic oligonucleotide
uauugaguuucuuccaua

SEQ ID NO: 17926 - RNA, 18 nt, Artificial Sequence
  Description of Artificial Sequence: Synthetic oligonucleotide
uauuauauugaguuucuu

SEQ ID NO: 17927 - RNA, 18 nt, Artificial Sequence
  Description of Artificial Sequence: Synthetic oligonucleotide
ucagcuauuauauugagu

SEQ ID NO: 17928 - RNA, 18 nt, Artificial Sequence
  Description of Artificial Sequence: Synthetic oligonucleotide
aaauaucagcuauuauau

SEQ ID NO: 17929 - RNA, 18 nt, Artificial Sequence
  Description of Artificial Sequence: Synthetic oligonucleotide
caaguaaauaucagcuau

SEQ ID NO: 17930 - RNA, 18 nt, Artificial Sequence
  Description of Artificial Sequence: Synthetic oligonucleotide
gaacccaaguaaauauca

SEQ ID NO: 17931 - RNA, 18 nt, Artificial Sequence
  Description of Artificial Sequence: Synthetic oligonucleotide
auuaagaacccaaguaaa

SEQ ID NO: 17932 - RNA, 18 nt, Artificial Sequence
  Description of Artificial Sequence: Synthetic oligonucleotide
uucugauuaagaacccaa

SEQ ID NO: 17933 - RNA, 18 nt, Artificial Sequence
  Description of Artificial Sequence: Synthetic oligonucleotide
caauguucugauuaagaa

SEQ ID NO: 17934 - RNA, 18 nt, Artificial Sequence
  Description of Artificial Sequence: Synthetic oligonucleotide
acagccaauguucugauu

SEQ ID NO: 17935 - RNA, 18 nt, Artificial Sequence
  Description of Artificial Sequence: Synthetic oligonucleotide
aucacacagccaauguuc

SEQ ID NO: 17936 - RNA, 18 nt, Artificial Sequence
  Description of Artificial Sequence: Synthetic oligonucleotide
ugaaaaucacacagccaa

SEQ ID NO: 17937 - RNA, 18 nt, Artificial Sequence
  Description of Artificial Sequence: Synthetic oligonucleotide
aaucaugaaaaucacaca

SEQ ID NO: 17938 - RNA, 18 nt, Artificial Sequence
  Description of Artificial Sequence: Synthetic oligonucleotide
aucauaaucaugaaaauc

SEQ ID NO: 17939 - RNA, 18 nt, Artificial Sequence
  Description of Artificial Sequence: Synthetic oligonucleotide
ugaaaaucauaaucauga

SEQ ID NO: 17940 - RNA, 18 nt, Artificial Sequence
  Description of Artificial Sequence: Synthetic oligonucleotide
ugcaaugaaaaucauaau

SEQ ID NO: 17941 - RNA, 18 nt, Artificial Sequence
  Description of Artificial Sequence: Synthetic oligonucleotide
uuaauugcaaugaaaauc

SEQ ID NO: 17942 - RNA, 18 nt, Artificial Sequence
  Description of Artificial Sequence: Synthetic oligonucleotide
ucaacuuaauugcaauga

SEQ ID NO: 17943 - RNA, 18 nt, Artificial Sequence
  Description of Artificial Sequence: Synthetic oligonucleotide
aaacaucaacuuaauugc

SEQ ID NO: 17944 - RNA, 18 nt, Artificial Sequence
  Description of Artificial Sequence: Synthetic oligonucleotide
cuacaaaacaucaacuua

SEQ ID NO: 17945 - RNA, 18 nt, Artificial Sequence
  Description of Artificial Sequence: Synthetic oligonucleotide
acugucuacaaaacauca

SEQ ID NO: 17946 - RNA, 18 nt, Artificial Sequence
  Description of Artificial Sequence: Synthetic oligonucleotide
auuucacugucuacaaaa

SEQ ID NO: 17947 - RNA, 18 nt, Artificial Sequence
  Description of Artificial Sequence: Synthetic oligonucleotide
ugguaauuucacugucua

SEQ ID NO: 17948 - RNA, 18 nt, Artificial Sequence
  Description of Artificial Sequence: Synthetic oligonucleotide
guagaugguaauuucacu

SEQ ID NO: 17949 - RNA, 18 nt, Artificial Sequence
  Description of Artificial Sequence: Synthetic oligonucleotide
uuggaguagaugguaauu

SEQ ID NO: 17950 - RNA, 18 nt, Artificial Sequence
  Description of Artificial Sequence: Synthetic oligonucleotide
aucuuuuggaguagaugg

SEQ ID NO: 17951 - RNA, 18 nt, Artificial Sequence
  Description of Artificial Sequence: Synthetic oligonucleotide
uugcaaucuuuuggagua

SEQ ID NO: 17952 - RNA, 18 nt, Artificial Sequence
  Description of Artificial Sequence: Synthetic oligonucleotide
cuauuuugcaaucuuuug

SEQ ID NO: 17953 - RNA, 18 nt, Artificial Sequence
  Description of Artificial Sequence: Synthetic oligonucleotide
aaauucuauuuugcaauc

SEQ ID NO: 17954 - RNA, 18 nt, Artificial Sequence
  Description of Artificial Sequence: Synthetic oligonucleotide
agguuaaauucuauuuug

SEQ ID NO: 17955 - RNA, 18 nt, Artificial Sequence
  Description of Artificial Sequence: Synthetic oligonucleotide
cucuaagguuaaauucua

SEQ ID NO: 17956 - RNA, 18 nt, Artificial Sequence
  Description of Artificial Sequence: Synthetic oligonucleotide
auuggcucuaagguuaaa

SEQ ID NO: 17957 - RNA, 18 nt, Artificial Sequence
  Description of Artificial Sequence: Synthetic oligonucleotide
ccugcauuggcucuaagg

SEQ ID NO: 17958 - RNA, 18 nt, Artificial Sequence
  Description of Artificial Sequence: Synthetic oligonucleotide
uuuucccugcauuggcuc

SEQ ID NO: 17959 - RNA, 18 nt, Artificial Sequence
  Description of Artificial Sequence: Synthetic oligonucleotide
acaaguuuucccugcauu

SEQ ID NO: 17960 - RNA, 18 nt, Artificial Sequence
  Description of Artificial Sequence: Synthetic oligonucleotide
cagaaacaaguuuucccu

SEQ ID NO: 17961 - RNA, 18 nt, Artificial Sequence
  Description of Artificial Sequence: Synthetic oligonucleotide
accugcagaaacaaguuu

SEQ ID NO: 17962 - RNA, 18 nt, Artificial Sequence
  Description of Artificial Sequence: Synthetic oligonucleotide
aaugcaccugcagaaaca

SEQ ID NO: 17963 - RNA, 18 nt, Artificial Sequence
  Description of Artificial Sequence: Synthetic oligonucleotide
caaaaaaugcaccugcag

SEQ ID NO: 17964 - RNA, 18 nt, Artificial Sequence
  Description of Artificial Sequence: Synthetic oligonucleotide
aguuucaaaaaaugcacc

SEQ ID NO: 17965 - RNA, 18 nt, Artificial Sequence
  Description of Artificial Sequence: Synthetic oligonucleotide
guugaaguuucaaaaaau

SEQ ID NO: 17966 - RNA, 18 nt, Artificial Sequence
  Description of Artificial Sequence: Synthetic oligonucleotide
uaucuguugaaguuucaa

SEQ ID NO: 17967 - RNA, 18 nt, Artificial Sequence
  Description of Artificial Sequence: Synthetic oligonucleotide
ccugcuaucuguugaagu

SEQ ID NO: 17968 - RNA, 18 nt, Artificial Sequence
  Description of Artificial Sequence: Synthetic oligonucleotide
uucccccugcuaucuguu

SEQ ID NO: 17969 - RNA, 18 nt, Artificial Sequence
  Description of Artificial Sequence: Synthetic oligonucleotide
uuuuuuucccccugcuau

SEQ ID NO: 17970 - RNA, 18 nt, Artificial Sequence
  Description of Artificial Sequence: Synthetic oligonucleotide
ucacuuuuuuuucccccu

SEQ ID NO: 17971 - RNA, 18 nt, Artificial Sequence
  Description of Artificial Sequence: Synthetic oligonucleotide
uucugucacuuuuuuuuc

SEQ ID NO: 17972 - RNA, 18 nt, Artificial Sequence
  Description of Artificial Sequence: Synthetic oligonucleotide
gauccuucugucacuuuu

SEQ ID NO: 17973 - RNA, 18 nt, Artificial Sequence
  Description of Artificial Sequence: Synthetic oligonucleotide
acugugauccuucuguca

SEQ ID NO: 17974 - RNA, 18 nt, Artificial Sequence
  Description of Artificial Sequence: Synthetic oligonucleotide
gcugaacugugauccuuc

SEQ ID NO: 17975 - RNA, 18 nt, Artificial Sequence
  Description of Artificial Sequence: Synthetic oligonucleotide
auacugcugaacugugau

SEQ ID NO: 17976 - RNA, 18 nt, Artificial Sequence
  Description of Artificial Sequence: Synthetic oligonucleotide
aauucauacugcugaacu

SEQ ID NO: 17977 - RNA, 18 nt, Artificial Sequence
  Description of Artificial Sequence: Synthetic oligonucleotide
cagacaauucauacugcu

SEQ ID NO: 17978 - RNA, 18 nt, Artificial Sequence
  Description of Artificial Sequence: Synthetic oligonucleotide
gccagcagacaauucaua

SEQ ID NO: 17979 - RNA, 18 nt, Artificial Sequence
  Description of Artificial Sequence: Synthetic oligonucleotide
aggcugccagcagacaau

SEQ ID NO: 17980 - RNA, 18 nt, Artificial Sequence
  Description of Artificial Sequence: Synthetic oligonucleotide
uugcaaggcugccagcag

SEQ ID NO: 17981 - RNA, 18 nt, Artificial Sequence
  Description of Artificial Sequence: Synthetic oligonucleotide
ccagauugcaaggcugcc

SEQ ID NO: 17982 - RNA, 18 nt, Artificial Sequence
  Description of Artificial Sequence: Synthetic oligonucleotide
gcacaccagauugcaagg

SEQ ID NO: 17983 - RNA, 18 nt, Artificial Sequence
  Description of Artificial Sequence: Synthetic oligonucleotide
ugccugcacaccagauug

SEQ ID NO: 17984 - RNA, 18 nt, Artificial Sequence
  Description of Artificial Sequence: Synthetic oligonucleotide
cucacugccugcacacca

SEQ ID NO: 17985 - RNA, 18 nt, Artificial Sequence
  Description of Artificial Sequence: Synthetic oligonucleotide
acaaucucacugccugca

SEQ ID NO: 17986 - RNA, 18 nt, Artificial Sequence
  Description of Artificial Sequence: Synthetic oligonucleotide
acaccacaaucucacugc

SEQ ID NO: 17987 - RNA, 18 nt, Artificial Sequence
  Description of Artificial Sequence: Synthetic oligonucleotide
cauguacaccacaaucuc

SEQ ID NO: 17988 - RNA, 18 nt, Artificial Sequence
  Description of Artificial Sequence: Synthetic oligonucleotide
ggugacauguacaccaca

SEQ ID NO: 17989 - RNA, 18 nt, Artificial Sequence
  Description of Artificial Sequence: Synthetic oligonucleotide
aaucaggugacauguaca

SEQ ID NO: 17990 - RNA, 18 nt, Artificial Sequence
  Description of Artificial Sequence: Synthetic oligonucleotide
uguaguccugguggcaug

SEQ ID NO: 17991 - RNA, 18 nt, Artificial Sequence
  Description of Artificial Sequence: Synthetic oligonucleotide
gccccuguaguccuggug

SEQ ID NO: 17992 - RNA, 18 nt, Artificial Sequence
  Description of Artificial Sequence: Synthetic oligonucleotide
acucugccccuguagucc

SEQ ID NO: 17993 - RNA, 18 nt, Artificial Sequence
  Description of Artificial Sequence: Synthetic oligonucleotide
gagacacucugccccugu

SEQ ID NO: 17994 - RNA, 18 nt, Artificial Sequence
  Description of Artificial Sequence: Synthetic oligonucleotide
cagaggagacacucugcc

SEQ ID NO: 17995 - RNA, 18 nt, Artificial Sequence
  Description of Artificial Sequence: Synthetic oligonucleotide
gcugccagaggagacacu

SEQ ID NO: 17996 - RNA, 18 nt, Artificial Sequence
  Description of Artificial Sequence: Synthetic oligonucleotide
ucagagcugccagaggag

SEQ ID NO: 17997 - RNA, 18 nt, Artificial Sequence
  Description of Artificial Sequence: Synthetic oligonucleotide
ugaucucagagcugccag

SEQ ID NO: 17998 - RNA, 18 nt, Artificial Sequence
  Description of Artificial Sequence: Synthetic oligonucleotide
ggauuugaucucagagcu

SEQ ID NO: 17999 - RNA, 18 nt, Artificial Sequence
  Description of Artificial Sequence: Synthetic oligonucleotide
ucaucggauuugaucuca

SEQ ID NO: 18000 - RNA, 18 nt, Artificial Sequence
  Description of Artificial Sequence: Synthetic oligonucleotide
ccucgucaucggauuuga

SEQ ID NO: 18001 - RNA, 18 nt, Artificial Sequence
  Description of Artificial Sequence: Synthetic oligonucleotide
aucacccucgucaucgga

SEQ ID NO: 18002 - RNA, 18 nt, Artificial Sequence
  Description of Artificial Sequence: Synthetic oligonucleotide
uucucaucacccucguca

SEQ ID NO: 18003 - RNA, 18 nt, Artificial Sequence
  Description of Artificial Sequence: Synthetic oligonucleotide
gcagguucucaucacccu

SEQ ID NO: 18004 - RNA, 18 nt, Artificial Sequence
  Description of Artificial Sequence: Synthetic oligonucleotide
gucuugcagguucucauc

SEQ ID NO: 18005 - RNA, 18 nt, Artificial Sequence
  Description of Artificial Sequence: Synthetic oligonucleotide
uucgugucuugcagguuc

SEQ ID NO: 18006 - RNA, 18 nt, Artificial Sequence
  Description of Artificial Sequence: Synthetic oligonucleotide
aagauuucgugucuugca

SEQ ID NO: 18007 - RNA, 18 nt, Artificial Sequence
  Description of Artificial Sequence: Synthetic oligonucleotide
cuccgaagauuucguguc

SEQ ID NO: 18008 - RNA, 18 nt, Artificial Sequence
  Description of Artificial Sequence: Synthetic oligonucleotide
uuguccuccgaagauuuc

SEQ ID NO: 18009 - RNA, 18 nt, Artificial Sequence
  Description of Artificial Sequence: Synthetic oligonucleotide
auuucuuguccuccgaag

SEQ ID NO: 18010 - RNA, 18 nt, Artificial Sequence
  Description of Artificial Sequence: Synthetic oligonucleotide
aucuaauuucuuguccuc

SEQ ID NO: 18011 - RNA, 18 nt, Artificial Sequence
  Description of Artificial Sequence: Synthetic oligonucleotide
ucgucaucuaauuucuug

SEQ ID NO: 18012 - RNA, 18 nt, Artificial Sequence
  Description of Artificial Sequence: Synthetic oligonucleotide
ucuugucgucaucuaauu

SEQ ID NO: 18013 - RNA, 18 nt, Artificial Sequence
  Description of Artificial Sequence: Synthetic oligonucleotide
auccuucuugucgucauc

SEQ ID NO: 18014 - RNA, 18 nt, Artificial Sequence
  Description of Artificial Sequence: Synthetic oligonucleotide
uugauauccuucuugucg

SEQ ID NO: 18015 - RNA, 18 nt, Artificial Sequence
  Description of Artificial Sequence: Synthetic oligonucleotide
uugauuugauauccuucu

SEQ ID NO: 18016 - RNA, 18 nt, Artificial Sequence
  Description of Artificial Sequence: Synthetic oligonucleotide
aguaauugauuugauauc

SEQ ID NO: 18017 - RNA, 18 nt, Artificial Sequence
  Description of Artificial Sequence: Synthetic oligonucleotide
uucacgauggguccccac

SEQ ID NO: 18018 - RNA, 18 nt, Artificial Sequence
  Description of Artificial Sequence: Synthetic oligonucleotide
ccaucuucacgauggguc

SEQ ID NO: 18019 - RNA, 18 nt, Artificial Sequence
  Description of Artificial Sequence: Synthetic oligonucleotide
ccacgccaucuucacgau

SEQ ID NO: 18020 - RNA, 18 nt, Artificial Sequence
  Description of Artificial Sequence: Synthetic oligonucleotide
cagggccacgccaucuuc

SEQ ID NO: 18021 - RNA, 18 nt, Artificial Sequence
  Description of Artificial Sequence: Synthetic oligonucleotide
ccucucagggccacgcca

SEQ ID NO: 18022 - RNA, 18 nt, Artificial Sequence
  Description of Artificial Sequence: Synthetic oligonucleotide
ggcugccucucagggcca

SEQ ID NO: 18023 - RNA, 18 nt, Artificial Sequence
  Description of Artificial Sequence: Synthetic oligonucleotide
agaauggcugccucucag

SEQ ID NO: 18024 - RNA, 18 nt, Artificial Sequence
  Description of Artificial Sequence: Synthetic oligonucleotide
agaagagaauggcugccu

SEQ ID NO: 18025 - RNA, 18 nt, Artificial Sequence
  Description of Artificial Sequence: Synthetic oligonucleotide
uuggcagaagagaauggc

SEQ ID NO: 18026 - RNA, 18 nt, Artificial Sequence
  Description of Artificial Sequence: Synthetic oligonucleotide
cugguuuggcagaagaga

SEQ ID NO: 18027 - RNA, 18 nt, Artificial Sequence
  Description of Artificial Sequence: Synthetic oligonucleotide
ggaaccugguuuggcaga

SEQ ID NO: 18028 - RNA, 18 nt, Artificial Sequence
  Description of Artificial Sequence: Synthetic oligonucleotide
gaaccggaaccugguuug

SEQ ID NO: 18029 - RNA, 18 nt, Artificial Sequence
  Description of Artificial Sequence: Synthetic oligonucleotide
cuguggaaccggaaccug

SEQ ID NO: 18030 - RNA, 18 nt, Artificial Sequence
  Description of Artificial Sequence: Synthetic oligonucleotide
ggaagcuguggaaccgga

SEQ ID NO: 18031 - RNA, 18 nt, Artificial Sequence
  Description of Artificial Sequence: Synthetic oligonucleotide
ggacaggaagcuguggaa

SEQ ID NO: 18032 - RNA, 18 nt, Artificial Sequence
  Description of Artificial Sequence: Synthetic oligonucleotide
agacuggacaggaagcug

SEQ ID NO: 18033 - RNA, 18 nt, Artificial Sequence
  Description of Artificial Sequence: Synthetic oligonucleotide
gucgcagacuggacagga

SEQ ID NO: 18034 - RNA, 18 nt, Artificial Sequence
  Description of Artificial Sequence: Synthetic oligonucleotide
gggaagucgcagacugga

SEQ ID NO: 18035 - RNA, 18 nt, Artificial Sequence
  Description of Artificial Sequence: Synthetic oligonucleotide
gguggguucaggucaggg

SEQ ID NO: 18036 - RNA, 18 nt, Artificial Sequence
  Description of Artificial Sequence: Synthetic oligonucleotide
ggguggguucaggucagg

SEQ ID NO: 18037 - RNA, 18 nt, Artificial Sequence
  Description of Artificial Sequence: Synthetic oligonucleotide
cucuguaaggguccuggg

SEQ ID NO: 18038 - RNA, 18 nt, Artificial Sequence
  Description of Artificial Sequence: Synthetic oligonucleotide
gugcccuggugaggccaa

SEQ ID NO: 18039 - RNA, 18 nt, Artificial Sequence
  Description of Artificial Sequence: Synthetic oligonucleotide
cagaagugcccuggugag

SEQ ID NO: 18040 - RNA, 18 nt, Artificial Sequence
  Description of Artificial Sequence: Synthetic oligonucleotide
gaggucagaagugcccug

SEQ ID NO: 18041 - RNA, 18 nt, Artificial Sequence
  Description of Artificial Sequence: Synthetic oligonucleotide
aaagugaggucagaagug

SEQ ID NO: 18042 - RNA, 18 nt, Artificial Sequence
  Description of Artificial Sequence: Synthetic oligonucleotide
uugugaaagugaggucag

SEQ ID NO: 18043 - RNA, 18 nt, Artificial Sequence
  Description of Artificial Sequence: Synthetic oligonucleotide
uccuauugugaaagugag

SEQ ID NO: 18044 - RNA, 18 nt, Artificial Sequence
  Description of Artificial Sequence: Synthetic oligonucleotide
acugguccuauugugaaa

SEQ ID NO: 18045 - RNA, 18 nt, Artificial Sequence
  Description of Artificial Sequence: Synthetic oligonucleotide
ucaacacugguccuauug

SEQ ID NO: 18046 - RNA, 18 nt, Artificial Sequence
  Description of Artificial Sequence: Synthetic oligonucleotide
ggguaucaacacuggucc

SEQ ID NO: 18047 - RNA, 18 nt, Artificial Sequence
  Description of Artificial Sequence: Synthetic oligonucleotide
aggcuggguaucaacacu

SEQ ID NO: 18048 - RNA, 18 nt, Artificial Sequence
  Description of Artificial Sequence: Synthetic oligonucleotide
ccaagaggcuggguauca

SEQ ID NO: 18049 - RNA, 18 nt, Artificial Sequence
  Description of Artificial Sequence: Synthetic oligonucleotide
gaacaccaagaggcuggg

SEQ ID NO: 18050 - RNA, 18 nt, Artificial Sequence
  Description of Artificial Sequence: Synthetic oligonucleotide
gggaugaacaccaagagg

SEQ ID NO: 18051 - RNA, 18 nt, Artificial Sequence
  Description of Artificial Sequence: Synthetic oligonucleotide
cuugagggaugaacacca

SEQ ID NO: 18052 - RNA, 18 nt, Artificial Sequence
  Description of Artificial Sequence: Synthetic oligonucleotide
ugcuucuugagggaugaa

SEQ ID NO: 18053 - RNA, 18 nt, Artificial Sequence
  Description of Artificial Sequence: Synthetic oligonucleotide
gccagugcuucuugaggg

SEQ ID NO: 18054 - RNA, 18 nt, Artificial Sequence
  Description of Artificial Sequence: Synthetic oligonucleotide
uuucugccagugcuucuu

SEQ ID NO: 18055 - RNA, 18 nt, Artificial Sequence
  Description of Artificial Sequence: Synthetic oligonucleotide
cuggguuucugccagugc

SEQ ID NO: 18056 - RNA, 18 nt, Artificial Sequence
  Description of Artificial Sequence: Synthetic oligonucleotide
gauuccuggguuucugcc

SEQ ID NO: 18057 - RNA, 18 nt, Artificial Sequence
  Description of Artificial Sequence: Synthetic oligonucleotide
aauuugauuccuggguuu

SEQ ID NO: 18058 - RNA, 18 nt, Artificial Sequence
  Description of Artificial Sequence: Synthetic oligonucleotide
ugcccaauuugauuccug

SEQ ID NO: 18059 - RNA, 18 nt, Artificial Sequence
  Description of Artificial Sequence: Synthetic oligonucleotide
uuuugugcccaauuugau

SEQ ID NO: 18060 - RNA, 18 nt, Artificial Sequence
  Description of Artificial Sequence: Synthetic oligonucleotide
accauuuuugugcccaau

SEQ ID NO: 18061 - RNA, 18 nt, Artificial Sequence
  Description of Artificial Sequence: Synthetic oligonucleotide
uccuuaccauuuuugugc

SEQ ID NO: 18062 - RNA, 18 nt, Artificial Sequence
  Description of Artificial Sequence: Synthetic oligonucleotide
ccauuuccuuaccauuuu

SEQ ID NO: 18063 - RNA, 18 nt, Artificial Sequence
  Description of Artificial Sequence: Synthetic oligonucleotide
cuuugccauuuccuuacc

SEQ ID NO: 18064 - RNA, 18 nt, Artificial Sequence
  Description of Artificial Sequence: Synthetic oligonucleotide
aaauacuuugccauuucc

SEQ ID NO: 18065 - RNA, 18 nt, Artificial Sequence
  Description of Artificial Sequence: Synthetic oligonucleotide
guucuaaauacuuugcca

SEQ ID NO: 18066 - RNA, 18 nt, Artificial Sequence
  Description of Artificial Sequence: Synthetic oligonucleotide
gcgaaguucuaaauacuu

SEQ ID NO: 18067 - RNA, 18 nt, Artificial Sequence
  Description of Artificial Sequence: Synthetic oligonucleotide
agcgggcgaaguucuaaa

SEQ ID NO: 18068 - RNA, 18 nt, Artificial Sequence
  Description of Artificial Sequence: Synthetic oligonucleotide
caauuagcgggcgaaguu

SEQ ID NO: 18069 - RNA, 18 nt, Artificial Sequence
  Description of Artificial Sequence: Synthetic oligonucleotide
aaacacaauuagcgggcg

SEQ ID NO: 18070 - RNA, 18 nt, Artificial Sequence
  Description of Artificial Sequence: Synthetic oligonucleotide
uggagaaacacaauuagc

SEQ ID NO: 18071 - RNA, 18 nt, Artificial Sequence
  Description of Artificial Sequence: Synthetic oligonucleotide
gucccuggagaaacacaa

SEQ ID NO: 18072 - RNA, 18 nt, Artificial Sequence
  Description of Artificial Sequence: Synthetic oligonucleotide
aaacagucccuggagaaa

SEQ ID NO: 18073 - RNA, 18 nt, Artificial Sequence
  Description of Artificial Sequence: Synthetic oligonucleotide
gaggaaaacagucccugg

SEQ ID NO: 18074 - RNA, 18 nt, Artificial Sequence
  Description of Artificial Sequence: Synthetic oligonucleotide
uguuugaggaaaacaguc

SEQ ID NO: 18075 - RNA, 18 nt, Artificial Sequence
  Description of Artificial Sequence: Synthetic oligonucleotide
gaggauguuugaggaaaa

SEQ ID NO: 18076 - RNA, 18 nt, Artificial Sequence
  Description of Artificial Sequence: Synthetic oligonucleotide
uuucagaggauguuugag

SEQ ID NO: 18077 - RNA, 18 nt, Artificial Sequence
  Description of Artificial Sequence: Synthetic oligonucleotide
caggauuucagaggaugu

SEQ ID NO: 18078 - RNA, 18 nt, Artificial Sequence
  Description of Artificial Sequence: Synthetic oligonucleotide
aggaccaggauuucagag

SEQ ID NO: 18079 - RNA, 18 nt, Artificial Sequence
  Description of Artificial Sequence: Synthetic oligonucleotide
gauauaggaccaggauuu

SEQ ID NO: 18080 - RNA, 18 nt, Artificial Sequence
  Description of Artificial Sequence: Synthetic oligonucleotide
cugcugauauaggaccag

SEQ ID NO: 18081 - RNA, 18 nt, Artificial Sequence
  Description of Artificial Sequence: Synthetic oligonucleotide
auucccugcugauauagg

SEQ ID NO: 18082 - RNA, 18 nt, Artificial Sequence
  Description of Artificial Sequence: Synthetic oligonucleotide
gccucauucccugcugau

SEQ ID NO: 18083 - RNA, 18 nt, Artificial Sequence
  Description of Artificial Sequence: Synthetic oligonucleotide
cuguggccucauucccug

SEQ ID NO: 18084 - RNA, 18 nt, Artificial Sequence
  Description of Artificial Sequence: Synthetic oligonucleotide
ucagucuguggccucauu

SEQ ID NO: 18085 - RNA, 18 nt, Artificial Sequence
  Description of Artificial Sequence: Synthetic oligonucleotide
ucucaucagucuguggcc

SEQ ID NO: 18086 - RNA, 18 nt, Artificial Sequence
  Description of Artificial Sequence: Synthetic oligonucleotide
uuuccucucaucagucug

SEQ ID NO: 18087 - RNA, 18 nt, Artificial Sequence
  Description of Artificial Sequence: Synthetic oligonucleotide
uaaaauuuccucucauca

SEQ ID NO: 18088 - RNA, 18 nt, Artificial Sequence
  Description of Artificial Sequence: Synthetic oligonucleotide
uaaaauaaaauuuccucu

SEQ ID NO: 18089 - RNA, 18 nt, Artificial Sequence
  Description of Artificial Sequence: Synthetic oligonucleotide
auagcuaaaauaaaauuu

SEQ ID NO: 18090 - RNA, 18 nt, Artificial Sequence
  Description of Artificial Sequence: Synthetic oligonucleotide
uggaaauagcuaaaauaa

SEQ ID NO: 18091 - RNA, 18 nt, Artificial Sequence
  Description of Artificial Sequence: Synthetic oligonucleotide
aaauguggaaauagcuaa

SEQ ID NO: 18092 - RNA, 18 nt, Artificial Sequence
  Description of Artificial Sequence: Synthetic oligonucleotide
gagaaaaauguggaaaua

SEQ ID NO: 18093 - RNA, 18 nt, Artificial Sequence
  Description of Artificial Sequence: Synthetic oligonucleotide
ugaaugagaaaaaugugg

SEQ ID NO: 18094 - RNA, 18 nt, Artificial Sequence
  Description of Artificial Sequence: Synthetic oligonucleotide
ggaccugaaugagaaaaa

SEQ ID NO: 18095 - RNA, 18 nt, Artificial Sequence
  Description of Artificial Sequence: Synthetic oligonucleotide
uuagaggaccugaaugag

SEQ ID NO: 18096 - RNA, 18 nt, Artificial Sequence
  Description of Artificial Sequence: Synthetic oligonucleotide
ccacauuagaggaccuga

SEQ ID NO: 18097 - RNA, 18 nt, Artificial Sequence
  Description of Artificial Sequence: Synthetic oligonucleotide
acuaaccacauuagagga

SEQ ID NO: 18098 - RNA, 18 nt, Artificial Sequence
  Description of Artificial Sequence: Synthetic oligonucleotide
ccacaacuaaccacauua

SEQ ID NO: 18099 - RNA, 18 nt, Artificial Sequence
  Description of Artificial Sequence: Synthetic oligonucleotide
ucaggccacaacuaacca

SEQ ID NO: 18100 - RNA, 18 nt, Artificial Sequence
  Description of Artificial Sequence: Synthetic oligonucleotide
cauuuucaggccacaacu

SEQ ID NO: 18101 - RNA, 18 nt, Artificial Sequence
  Description of Artificial Sequence: Synthetic oligonucleotide
aauaucauuuucaggcca

SEQ ID NO: 18102 - RNA, 18 nt, Artificial Sequence
  Description of Artificial Sequence: Synthetic oligonucleotide
uuggaaauaucauuuuca

SEQ ID NO: 18103 - RNA, 18 nt, Artificial Sequence
  Description of Artificial Sequence: Synthetic oligonucleotide
uucauuuggaaauaucau

SEQ ID NO: 18104 - RNA, 18 nt, Artificial Sequence
  Description of Artificial Sequence: Synthetic oligonucleotide
uccuauucauuuggaaau

SEQ ID NO: 18105 - RNA, 18 nt, Artificial Sequence
  Description of Artificial Sequence: Synthetic oligonucleotide
uuccuuccuauucauuug

SEQ ID NO: 18106 - RNA, 18 nt, Artificial Sequence
  Description of Artificial Sequence: Synthetic oligonucleotide
uuuccuuccuuccuauuc

SEQ ID NO: 18107 - RNA, 18 nt, Artificial Sequence
  Description of Artificial Sequence: Synthetic oligonucleotide
aacaauuuccuuccuucc

SEQ ID NO: 18108 - RNA, 18 nt, Artificial Sequence
  Description of Artificial Sequence: Synthetic oligonucleotide
acaaaaacaauuuccuuc

SEQ ID NO: 18109 - RNA, 18 nt, Artificial Sequence
  Description of Artificial Sequence: Synthetic oligonucleotide
aaacaacaaaaacaauuu

SEQ ID NO: 18110 - RNA, 18 nt, Artificial Sequence
  Description of Artificial Sequence: Synthetic oligonucleotide
aucuuaaacaacaaaaac

SEQ ID NO: 18111 - RNA, 18 nt, Artificial Sequence
  Description of Artificial Sequence: Synthetic oligonucleotide
cuuccaucuuaaacaaca

SEQ ID NO: 18112 - RNA, 18 nt, Artificial Sequence
  Description of Artificial Sequence: Synthetic oligonucleotide
auuuccuuccaucuuaaa

SEQ ID NO: 18113 - RNA, 18 nt, Artificial Sequence
  Description of Artificial Sequence: Synthetic oligonucleotide
ccuauauuuccuuccauc

SEQ ID NO: 18114 - RNA, 18 nt, Artificial Sequence
  Description of Artificial Sequence: Synthetic oligonucleotide
augcaccuauauuuccuu

SEQ ID NO: 18115 - RNA, 18 nt, Artificial Sequence
  Description of Artificial Sequence: Synthetic oligonucleotide
uuuaaaugcaccuauauu

SEQ ID NO: 18116 - RNA, 18 nt, Artificial Sequence
  Description of Artificial Sequence: Synthetic oligonucleotide
cauuuuuuaaaugcaccu

SEQ ID NO: 18117 - RNA, 18 nt, Artificial Sequence
  Description of Artificial Sequence: Synthetic oligonucleotide
agcuccauuuuuuaaaug

SEQ ID NO: 18118 - RNA, 18 nt, Artificial Sequence
  Description of Artificial Sequence: Synthetic oligonucleotide
aaccaagcuccauuuuuu

SEQ ID NO: 18119 - RNA, 18 nt, Artificial Sequence
  Description of Artificial Sequence: Synthetic oligonucleotide
caugcaaccaagcuccau

SEQ ID NO: 18120 - RNA, 18 nt, Artificial Sequence
  Description of Artificial Sequence: Synthetic oligonucleotide
aaaaucaugcaaccaagc

SEQ ID NO: 18121 - RNA, 18 nt, Artificial Sequence
  Description of Artificial Sequence: Synthetic oligonucleotide
gagcgaaaaucaugcaac

SEQ ID NO: 18122 - RNA, 18 nt, Artificial Sequence
  Description of Artificial Sequence: Synthetic oligonucleotide
cucaagagcgaaaaucau

SEQ ID NO: 18123 - RNA, 18 nt, Artificial Sequence
  Description of Artificial Sequence: Synthetic oligonucleotide
gaugacucaagagcgaaa

SEQ ID NO: 18124 - RNA, 18 nt, Artificial Sequence
  Description of Artificial Sequence: Synthetic oligonucleotide
ggcuagaugacucaagag

SEQ ID NO: 18125 - RNA, 18 nt, Artificial Sequence
  Description of Artificial Sequence: Synthetic oligonucleotide
uagagggcuagaugacuc

SEQ ID NO: 18126 - RNA, 18 nt, Artificial Sequence
  Description of Artificial Sequence: Synthetic oligonucleotide
aucauuagagggcuagau

SEQ ID NO: 18127 - RNA, 18 nt, Artificial Sequence
  Description of Artificial Sequence: Synthetic oligonucleotide
aggcaaucauuagagggc

SEQ ID NO: 18128 - RNA, 18 nt, Artificial Sequence
  Description of Artificial Sequence: Synthetic oligonucleotide
guaugaggcaaucauuag

SEQ ID NO: 18129 - RNA, 18 nt, Artificial Sequence
  Description of Artificial Sequence: Synthetic oligonucleotide
caccgguaugaggcaauc

SEQ ID NO: 18130 - RNA, 18 nt, Artificial Sequence
  Description of Artificial Sequence: Synthetic oligonucleotide
guaaucaccgguaugagg

SEQ ID NO: 18131 - RNA, 18 nt, Artificial Sequence
  Description of Artificial Sequence: Synthetic oligonucleotide
cgcucguaaucaccggua

SEQ ID NO: 18132 - RNA, 18 nt, Artificial Sequence
  Description of Artificial Sequence: Synthetic oligonucleotide
aaagccgcucguaaucac

SEQ ID NO: 18133 - RNA, 18 nt, Artificial Sequence
  Description of Artificial Sequence: Synthetic oligonucleotide
caugaaaagccgcucgua

SEQ ID NO: 18134 - RNA, 18 nt, Artificial Sequence
  Description of Artificial Sequence: Synthetic oligonucleotide
gggucaugaaaagccgcu

SEQ ID NO: 18135 - RNA, 18 nt, Artificial Sequence
  Description of Artificial Sequence: Synthetic oligonucleotide
aaaugguacauauggaag

SEQ ID NO: 18136 - RNA, 18 nt, Artificial Sequence
  Description of Artificial Sequence: Synthetic oligonucleotide
uuuuaaaaugguacauau

SEQ ID NO: 18137 - RNA, 18 nt, Artificial Sequence
  Description of Artificial Sequence: Synthetic oligonucleotide
cagcauuuuaaaauggua

SEQ ID NO: 18138 - RNA, 18 nt, Artificial Sequence
  Description of Artificial Sequence: Synthetic oligonucleotide
guaaucagcauuuuaaaa

SEQ ID NO: 18139 - RNA, 18 nt, Artificial Sequence
  Description of Artificial Sequence: Synthetic oligonucleotide
aagaaguaaucagcauuu

SEQ ID NO: 18140 - RNA, 18 nt, Artificial Sequence
  Description of Artificial Sequence: Synthetic oligonucleotide
uucucaagaaguaaucag

SEQ ID NO: 18141 - RNA, 18 nt, Artificial Sequence
  Description of Artificial Sequence: Synthetic oligonucleotide
ucuuauucucaagaagua

SEQ ID NO: 18142 - RNA, 18 nt, Artificial Sequence
  Description of Artificial Sequence: Synthetic oligonucleotide
gcuucucuuauucucaag

SEQ ID NO: 18143 - RNA, 18 nt, Artificial Sequence
  Description of Artificial Sequence: Synthetic oligonucleotide
auuaggcuucucuuauuc

SEQ ID NO: 18144 - RNA, 18 nt, Artificial Sequence
  Description of Artificial Sequence: Synthetic oligonucleotide
cugaaauuaggcuucucu

SEQ ID NO: 18145 - RNA, 18 nt, Artificial Sequence
  Description of Artificial Sequence: Synthetic oligonucleotide
auauucugaaauuaggcu

SEQ ID NO: 18146 - RNA, 18 nt, Artificial Sequence
  Description of Artificial Sequence: Synthetic oligonucleotide
uaaugauauucugaaauu

SEQ ID NO: 18147 - RNA, 18 nt, Artificial Sequence
  Description of Artificial Sequence: Synthetic oligonucleotide
uacccuaaugauauucug

SEQ ID NO: 18148 - RNA, 18 nt, Artificial Sequence
  Description of Artificial Sequence: Synthetic oligonucleotide
auagguacccuaaugaua

SEQ ID NO: 18149 - RNA, 18 nt, Artificial Sequence
  Description of Artificial Sequence: Synthetic oligonucleotide
cuucaauagguacccuaa

SEQ ID NO: 18150 - RNA, 18 nt, Artificial Sequence
  Description of Artificial Sequence: Synthetic oligonucleotide
caagacuucaauagguac

SEQ ID NO: 18151 - RNA, 18 nt, Artificial Sequence
  Description of Artificial Sequence: Synthetic oligonucleotide
gcagucaagacuucaaua

SEQ ID NO: 18152 - RNA, 18 nt, Artificial Sequence
  Description of Artificial Sequence: Synthetic oligonucleotide
uaugugcagucaagacuu

SEQ ID NO: 18153 - RNA, 18 nt, Artificial Sequence
  Description of Artificial Sequence: Synthetic oligonucleotide
cuaaauaugugcagucaa

SEQ ID NO: 18154 - RNA, 18 nt, Artificial Sequence
  Description of Artificial Sequence: Synthetic oligonucleotide
guaugcuaaauaugugca

SEQ ID NO: 18155 - RNA, 18 nt, Artificial Sequence
  Description of Artificial Sequence: Synthetic oligonucleotide
agggaguaugcuaaauau

SEQ ID NO: 18156 - RNA, 18 nt, Artificial Sequence
  Description of Artificial Sequence: Synthetic oligonucleotide
uucccagggaguaugcua

SEQ ID NO: 18157 - RNA, 18 nt, Artificial Sequence
  Description of Artificial Sequence: Synthetic oligonucleotide
uauaauucccagggagua

SEQ ID NO: 18158 - RNA, 18 nt, Artificial Sequence
  Description of Artificial Sequence: Synthetic oligonucleotide
uaaaauauaauucccagg

SEQ ID NO: 18159 - RNA, 18 nt, Artificial Sequence
  Description of Artificial Sequence: Synthetic oligonucleotide
guccuuaaaauauaauuc

SEQ ID NO: 18160 - RNA, 18 nt, Artificial Sequence
  Description of Artificial Sequence: Synthetic oligonucleotide
aaaauguccuuaaaauau

SEQ ID NO: 18161 - RNA, 18 nt, Artificial Sequence
  Description of Artificial Sequence: Synthetic oligonucleotide
auagaaaaauguccuuaa

SEQ ID NO: 18162 - RNA, 18 nt, Artificial Sequence
  Description of Artificial Sequence: Synthetic oligonucleotide
auuuaauagaaaaauguc

SEQ ID NO: 18163 - RNA, 18 nt, Artificial Sequence
  Description of Artificial Sequence: Synthetic oligonucleotide
caaugauuuaauagaaaa

SEQ ID NO: 18164 - RNA, 18 nt, Artificial Sequence
  Description of Artificial Sequence: Synthetic oligonucleotide
auaugcaaugauuuaaua

SEQ ID NO: 18165 - RNA, 18 nt, Artificial Sequence
  Description of Artificial Sequence: Synthetic oligonucleotide
cuuccauaugcaaugauu

SEQ ID NO: 18166 - RNA, 18 nt, Artificial Sequence
  Description of Artificial Sequence: Synthetic oligonucleotide
aguuucuuccauaugcaa

SEQ ID NO: 18167 - RNA, 18 nt, Artificial Sequence
  Description of Artificial Sequence: Synthetic oligonucleotide
uauugaguuucuuccaua

SEQ ID NO: 18168 - RNA, 18 nt, Artificial Sequence
  Description of Artificial Sequence: Synthetic oligonucleotide
uauuauauugaguuucuu

SEQ ID NO: 18169 - RNA, 18 nt, Artificial Sequence
  Description of Artificial Sequence: Synthetic oligonucleotide
ucagcuauuauauugagu

SEQ ID NO: 18170 - RNA, 18 nt, Artificial Sequence
  Description of Artificial Sequence: Synthetic oligonucleotide
aaauaucagcuauuauau

SEQ ID NO: 18171 - RNA, 18 nt, Artificial Sequence
  Description of Artificial Sequence: Synthetic oligonucleotide
caaguaaauaucagcuau

SEQ ID NO: 18172 - RNA, 18 nt, Artificial Sequence
  Description of Artificial Sequence: Synthetic oligonucleotide
gaacccaaguaaauauca

SEQ ID NO: 18173 - RNA, 18 nt, Artificial Sequence
  Description of Artificial Sequence: Synthetic oligonucleotide
auuaagaacccaaguaaa

SEQ ID NO: 18174 - RNA, 18 nt, Artificial Sequence
  Description of Artificial Sequence: Synthetic oligonucleotide
uucugauuaagaacccaa

SEQ ID NO: 18175 - RNA, 18 nt, Artificial Sequence
  Description of Artificial Sequence: Synthetic oligonucleotide
caauguucugauuaagaa

SEQ ID NO: 18176 - RNA, 18 nt, Artificial Sequence
  Description of Artificial Sequence: Synthetic oligonucleotide
acagccaauguucugauu

SEQ ID NO: 18177 - RNA, 18 nt, Artificial Sequence
  Description of Artificial Sequence: Synthetic oligonucleotide
aucacacagccaauguuc

SEQ ID NO: 18178 - RNA, 18 nt, Artificial Sequence
  Description of Artificial Sequence: Synthetic oligonucleotide
ugaaaaucacacagccaa

SEQ ID NO: 18179 - RNA, 18 nt, Artificial Sequence
  Description of Artificial Sequence: Synthetic oligonucleotide
aaucaugaaaaucacaca

SEQ ID NO: 18180 - RNA, 18 nt, Artificial Sequence
  Description of Artificial Sequence: Synthetic oligonucleotide
aucauaaucaugaaaauc

SEQ ID NO: 18181 - RNA, 18 nt, Artificial Sequence
  Description of Artificial Sequence: Synthetic oligonucleotide
ugaaaaucauaaucauga

SEQ ID NO: 18182 - RNA, 18 nt, Artificial Sequence
  Description of Artificial Sequence: Synthetic oligonucleotide
ugcaaugaaaaucauaau

SEQ ID NO: 18183 - RNA, 18 nt, Artificial Sequence
  Description of Artificial Sequence: Synthetic oligonucleotide
uuaauugcaaugaaaauc

SEQ ID NO: 18184 - RNA, 18 nt, Artificial Sequence
  Description of Artificial Sequence: Synthetic oligonucleotide
ucaacuuaauugcaauga

SEQ ID NO: 18185 - RNA, 18 nt, Artificial Sequence
  Description of Artificial Sequence: Synthetic oligonucleotide
aaacaucaacuuaauugc

SEQ ID NO: 18186 - RNA, 18 nt, Artificial Sequence
  Description of Artificial Sequence: Synthetic oligonucleotide
cuacaaaacaucaacuua

SEQ ID NO: 18187 - RNA, 18 nt, Artificial Sequence
  Description of Artificial Sequence: Synthetic oligonucleotide
acugucuacaaaacauca

SEQ ID NO: 18188 - RNA, 18 nt, Artificial Sequence
  Description of Artificial Sequence: Synthetic oligonucleotide
auuucacugucuacaaaa

SEQ ID NO: 18189 - RNA, 18 nt, Artificial Sequence
  Description of Artificial Sequence: Synthetic oligonucleotide
ugguaauuucacugucua

SEQ ID NO: 18190 - RNA, 18 nt, Artificial Sequence
  Description of Artificial Sequence: Synthetic oligonucleotide
guagaugguaauuucacu

SEQ ID NO: 18191 - RNA, 18 nt, Artificial Sequence
  Description of Artificial Sequence: Synthetic oligonucleotide
uuggaguagaugguaauu

SEQ ID NO: 18192 - RNA, 18 nt, Artificial Sequence
  Description of Artificial Sequence: Synthetic oligonucleotide
aucuuuuggaguagaugg

SEQ ID NO: 18193 - RNA, 18 nt, Artificial Sequence
  Description of Artificial Sequence: Synthetic oligonucleotide
uugcaaucuuuuggagua

SEQ ID NO: 18194 - RNA, 18 nt, Artificial Sequence
  Description of Artificial Sequence: Synthetic oligonucleotide
cuauuuugcaaucuuuug

SEQ ID NO: 18195 - RNA, 18 nt, Artificial Sequence
  Description of Artificial Sequence: Synthetic oligonucleotide
aaauucuauuuugcaauc

SEQ ID NO: 18196 - RNA, 18 nt, Artificial Sequence
  Description of Artificial Sequence: Synthetic oligonucleotide
agguuaaauucuauuuug

SEQ ID NO: 18197 - RNA, 18 nt, Artificial Sequence
  Description of Artificial Sequence: Synthetic oligonucleotide
cucuaagguuaaauucua

SEQ ID NO: 18198 - RNA, 18 nt, Artificial Sequence
  Description of Artificial Sequence: Synthetic oligonucleotide
auuggcucuaagguuaaa

SEQ ID NO: 18199 - RNA, 18 nt, Artificial Sequence
  Description of Artificial Sequence: Synthetic oligonucleotide
ccugcauuggcucuaagg

SEQ ID NO: 18200 - RNA, 18 nt, Artificial Sequence
  Description of Artificial Sequence: Synthetic oligonucleotide
uuuucccugcauuggcuc

SEQ ID NO: 18201 - RNA, 18 nt, Artificial Sequence
  Description of Artificial Sequence: Synthetic oligonucleotide
acaaguuuucccugcauu

SEQ ID NO: 18202 - RNA, 18 nt, Artificial Sequence
  Description of Artificial Sequence: Synthetic oligonucleotide
cagaaacaaguuuucccu

SEQ ID NO: 18203 - RNA, 18 nt, Artificial Sequence
  Description of Artificial Sequence: Synthetic oligonucleotide
accugcagaaacaaguuu

SEQ ID NO: 18204 - RNA, 18 nt, Artificial Sequence
  Description of Artificial Sequence: Synthetic oligonucleotide
aaugcaccugcagaaaca

SEQ ID NO: 18205 - RNA, 18 nt, Artificial Sequence
  Description of Artificial Sequence: Synthetic oligonucleotide
caaaaaaugcaccugcag

SEQ ID NO: 18206 - RNA, 18 nt, Artificial Sequence
  Description of Artificial Sequence: Synthetic oligonucleotide
aguuucaaaaaaugcacc

SEQ ID NO: 18207 - RNA, 18 nt, Artificial Sequence
  Description of Artificial Sequence: Synthetic oligonucleotide
guugaaguuucaaaaaau

SEQ ID NO: 18208 - RNA, 18 nt, Artificial Sequence
  Description of Artificial Sequence: Synthetic oligonucleotide
uaucuguugaaguuucaa

SEQ ID NO: 18209 - RNA, 18 nt, Artificial Sequence
  Description of Artificial Sequence: Synthetic oligonucleotide
ccugcuaucuguugaagu

SEQ ID NO: 18210 - RNA, 18 nt, Artificial Sequence
  Description of Artificial Sequence: Synthetic oligonucleotide
uucccccugcuaucuguu

SEQ ID NO: 18211 - RNA, 18 nt, Artificial Sequence
  Description of Artificial Sequence: Synthetic oligonucleotide
uuuuuuucccccugcuau

SEQ ID NO: 18212 - RNA, 18 nt, Artificial Sequence
  Description of Artificial Sequence: Synthetic oligonucleotide
ucacuuuuuuuucccccu

SEQ ID NO: 18213 - RNA, 18 nt, Artificial Sequence
  Description of Artificial Sequence: Synthetic oligonucleotide
uucugucacuuuuuuuuc

SEQ ID NO: 18214 - RNA, 18 nt, Artificial Sequence
  Description of Artificial Sequence: Synthetic oligonucleotide
gauccuucugucacuuuu

SEQ ID NO: 18215 - RNA, 18 nt, Artificial Sequence
  Description of Artificial Sequence: Synthetic oligonucleotide
acugugauccuucuguca

SEQ ID NO: 18216 - RNA, 18 nt, Artificial Sequence
  Description of Artificial Sequence: Synthetic oligonucleotide
gcugaacugugauccuuc

SEQ ID NO: 18217 - RNA, 18 nt, Artificial Sequence
  Description of Artificial Sequence: Synthetic oligonucleotide
auacugcugaacugugau

SEQ ID NO: 18218 - RNA, 18 nt, Artificial Sequence
  Description of Artificial Sequence: Synthetic oligonucleotide
aauucauacugcugaacu

SEQ ID NO: 18219 - RNA, 18 nt, Artificial Sequence
  Description of Artificial Sequence: Synthetic oligonucleotide
cagacaauucauacugcu

SEQ ID NO: 18220 - RNA, 18 nt, Artificial Sequence
  Description of Artificial Sequence: Synthetic oligonucleotide
gccagcagacaauucaua

SEQ ID NO: 18221 - RNA, 18 nt, Artificial Sequence
  Description of Artificial Sequence: Synthetic oligonucleotide
aggcugccagcagacaau

SEQ ID NO: 18222 - RNA, 18 nt, Artificial Sequence
  Description of Artificial Sequence: Synthetic oligonucleotide
uugcaaggcugccagcag

SEQ ID NO: 18223 - RNA, 18 nt, Artificial Sequence
  Description of Artificial Sequence: Synthetic oligonucleotide
ccagauugcaaggcugcc

SEQ ID NO: 18224 - RNA, 18 nt, Artificial Sequence
  Description of Artificial Sequence: Synthetic oligonucleotide
gcacaccagauugcaagg

SEQ ID NO: 18225 - RNA, 18 nt, Artificial Sequence
  Description of Artificial Sequence: Synthetic oligonucleotide
ugccugcacaccagauug

SEQ ID NO: 18226 - RNA, 18 nt, Artificial Sequence
  Description of Artificial Sequence: Synthetic oligonucleotide
cucacugccugcacacca

SEQ ID NO: 18227 - RNA, 18 nt, Artificial Sequence
  Description of Artificial Sequence: Synthetic oligonucleotide
acaaucucacugccugca

SEQ ID NO: 18228 - RNA, 18 nt, Artificial Sequence
  Description of Artificial Sequence: Synthetic oligonucleotide
acaccacaaucucacugc

SEQ ID NO: 18229 - RNA, 18 nt, Artificial Sequence
  Description of Artificial Sequence: Synthetic oligonucleotide
cauguacaccacaaucuc

SEQ ID NO: 18230 - RNA, 18 nt, Artificial Sequence
  Description of Artificial Sequence: Synthetic oligonucleotide
ggugacauguacaccaca

SEQ ID NO: 18231 - RNA, 18 nt, Artificial Sequence
  Description of Artificial Sequence: Synthetic oligonucleotide
aaucaggugacauguaca

SEQ ID NO: 18232 - RNA, 18 nt, Artificial Sequence
  Description of Artificial Sequence: Synthetic oligonucleotide
uguaguccugguggcaug

SEQ ID NO: 18233 - RNA, 18 nt, Artificial Sequence
  Description of Artificial Sequence: Synthetic oligonucleotide
gccccuguaguccuggug

SEQ ID NO: 18234 - RNA, 18 nt, Artificial Sequence
  Description of Artificial Sequence: Synthetic oligonucleotide
acucugccccuguagucc

SEQ ID NO: 18235 - RNA, 18 nt, Artificial Sequence
  Description of Artificial Sequence: Synthetic oligonucleotide
gagacacucugccccugu

SEQ ID NO: 18236 - RNA, 18 nt, Artificial Sequence
  Description of Artificial Sequence: Synthetic oligonucleotide
cagaggagacacucugcc

SEQ ID NO: 18237 - RNA, 18 nt, Artificial Sequence
  Description of Artificial Sequence: Synthetic oligonucleotide
gcugccagaggagacacu

SEQ ID NO: 18238 - RNA, 18 nt, Artificial Sequence
  Description of Artificial Sequence: Synthetic oligonucleotide
ucagagcugccagaggag

SEQ ID NO: 18239 - RNA, 18 nt, Artificial Sequence
  Description of Artificial Sequence: Synthetic oligonucleotide
ugaucucagagcugccag

SEQ ID NO: 18240 - RNA, 18 nt, Artificial Sequence
  Description of Artificial Sequence: Synthetic oligonucleotide
ggauuugaucucagagcu

SEQ ID NO: 18241 - RNA, 18 nt, Artificial Sequence
  Description of Artificial Sequence: Synthetic oligonucleotide
ucaucggauuugaucuca

SEQ ID NO: 18242 - RNA, 18 nt, Artificial Sequence
  Description of Artificial Sequence: Synthetic oligonucleotide
ccucgucaucggauuuga

SEQ ID NO: 18243 - RNA, 18 nt, Artificial Sequence
  Description of Artificial Sequence: Synthetic oligonucleotide
aucacccucgucaucgga

SEQ ID NO: 18244 - RNA, 18 nt, Artificial Sequence
  Description of Artificial Sequence: Synthetic oligonucleotide
uucucaucacccucguca

SEQ ID NO: 18245 - RNA, 18 nt, Artificial Sequence
  Description of Artificial Sequence: Synthetic oligonucleotide
gcagguucucaucacccu

SEQ ID NO: 18246 - RNA, 18 nt, Artificial Sequence
  Description of Artificial Sequence: Synthetic oligonucleotide
gucuugcagguucucauc

SEQ ID NO: 18247 - RNA, 18 nt, Artificial Sequence
  Description of Artificial Sequence: Synthetic oligonucleotide
uucgugucuugcagguuc

SEQ ID NO: 18248 - RNA, 18 nt, Artificial Sequence
  Description of Artificial Sequence: Synthetic oligonucleotide
aagauuucgugucuugca

SEQ ID NO: 18249 - RNA, 18 nt, Artificial Sequence
  Description of Artificial Sequence: Synthetic oligonucleotide
cuccgaagauuucguguc

SEQ ID NO: 18250 - RNA, 18 nt, Artificial Sequence
  Description of Artificial Sequence: Synthetic oligonucleotide
uuguccuccgaagauuuc

SEQ ID NO: 18251 - RNA, 18 nt, Artificial Sequence
  Description of Artificial Sequence: Synthetic oligonucleotide
auuucuuguccuccgaag

SEQ ID NO: 18252 - RNA, 18 nt, Artificial Sequence
  Description of Artificial Sequence: Synthetic oligonucleotide
aucuaauuucuuguccuc

SEQ ID NO: 18253 - RNA, 18 nt, Artificial Sequence
  Description of Artificial Sequence: Synthetic oligonucleotide
ucgucaucuaauuucuug

SEQ ID NO: 18254 - RNA, 18 nt, Artificial Sequence
  Description of Artificial Sequence: Synthetic oligonucleotide
ucuugucgucaucuaauu

SEQ ID NO: 18255 - RNA, 18 nt, Artificial Sequence
  Description of Artificial Sequence: Synthetic oligonucleotide
auccuucuugucgucauc

SEQ ID NO: 18256 - RNA, 18 nt, Artificial Sequence
  Description of Artificial Sequence: Synthetic oligonucleotide
uugauauccuucuugucg

SEQ ID NO: 18257 - RNA, 18 nt, Artificial Sequence
  Description of Artificial Sequence: Synthetic oligonucleotide
uugauuugauauccuucu

SEQ ID NO: 18258 - RNA, 18 nt, Artificial Sequence
  Description of Artificial Sequence: Synthetic oligonucleotide
aguaauugauuugauauc

SEQ ID NO: 18259 - RNA, 18 nt, Artificial Sequence
  Description of Artificial Sequence: Synthetic oligonucleotide
uucacgauggguccccac

SEQ ID NO: 18260 - RNA, 18 nt, Artificial Sequence
  Description of Artificial Sequence: Synthetic oligonucleotide
ccaucuucacgauggguc

SEQ ID NO: 18261 - RNA, 18 nt, Artificial Sequence
  Description of Artificial Sequence: Synthetic oligonucleotide
ccacgccaucuucacgau

SEQ ID NO: 18262 - RNA, 18 nt, Artificial Sequence
  Description of Artificial Sequence: Synthetic oligonucleotide
cagggccacgccaucuuc

SEQ ID NO: 18263 - RNA, 18 nt, Artificial Sequence
  Description of Artificial Sequence: Synthetic oligonucleotide
ccucucagggccacgcca

SEQ ID NO: 18264 - RNA, 18 nt, Artificial Sequence
  Description of Artificial Sequence: Synthetic oligonucleotide
ggcugccucucagggcca

SEQ ID NO: 18265 - RNA, 18 nt, Artificial Sequence
  Description of Artificial Sequence: Synthetic oligonucleotide
agaauggcugccucucag

SEQ ID NO: 18266 - RNA, 18 nt, Artificial Sequence
  Description of Artificial Sequence: Synthetic oligonucleotide
agaagagaauggcugccu

SEQ ID NO: 18267 - RNA, 18 nt, Artificial Sequence
  Description of Artificial Sequence: Synthetic oligonucleotide
uuggcagaagagaauggc

SEQ ID NO: 18268 - RNA, 18 nt, Artificial Sequence
  Description of Artificial Sequence: Synthetic oligonucleotide
cugguuuggcagaagaga

SEQ ID NO: 18269 - RNA, 18 nt, Artificial Sequence
  Description of Artificial Sequence: Synthetic oligonucleotide
ggaaccugguuuggcaga

SEQ ID NO: 18270 - RNA, 18 nt, Artificial Sequence
  Description of Artificial Sequence: Synthetic oligonucleotide
gaaccggaaccugguuug

SEQ ID NO: 18271 - RNA, 18 nt, Artificial Sequence
  Description of Artificial Sequence: Synthetic oligonucleotide
cuguggaaccggaaccug

SEQ ID NO: 18272 - RNA, 18 nt, Artificial Sequence
  Description of Artificial Sequence: Synthetic oligonucleotide
ggaagcuguggaaccgga

SEQ ID NO: 18273 - RNA, 18 nt, Artificial Sequence
  Description of Artificial Sequence: Synthetic oligonucleotide
ggacaggaagcuguggaa

SEQ ID NO: 18274 - RNA, 18 nt, Artificial Sequence
  Description of Artificial Sequence: Synthetic oligonucleotide
agacuggacaggaagcug

SEQ ID NO: 18275 - RNA, 18 nt, Artificial Sequence
  Description of Artificial Sequence: Synthetic oligonucleotide
gucgcagacuggacagga

SEQ ID NO: 18276 - RNA, 18 nt, Artificial Sequence
  Description of Artificial Sequence: Synthetic oligonucleotide
gggaagucgcagacugga

SEQ ID NO: 18277 - RNA, 18 nt, Artificial Sequence
  Description of Artificial Sequence: Synthetic oligonucleotide
gguggguucaggucaggg

SEQ ID NO: 18278 - RNA, 18 nt, Artificial Sequence
  Description of Artificial Sequence: Synthetic oligonucleotide
ggguggguucaggucagg

SEQ ID NO: 18279 - RNA, 18 nt, Artificial Sequence
  Description of Artificial Sequence: Synthetic oligonucleotide
cucuguaaggguccuggg

SEQ ID NO: 18280 - RNA, 18 nt, Artificial Sequence
  Description of Artificial Sequence: Synthetic oligonucleotide
gugcccuggugaggccaa

SEQ ID NO: 18281 - RNA, 18 nt, Artificial Sequence
  Description of Artificial Sequence: Synthetic oligonucleotide
cagaagugcccuggugag

SEQ ID NO: 18282 - RNA, 18 nt, Artificial Sequence
  Description of Artificial Sequence: Synthetic oligonucleotide
gaggucagaagugcccug

SEQ ID NO: 18283 - RNA, 18 nt, Artificial Sequence
  Description of Artificial Sequence: Synthetic oligonucleotide
aaagugaggucagaagug

SEQ ID NO: 18284 - RNA, 18 nt, Artificial Sequence
  Description of Artificial Sequence: Synthetic oligonucleotide
uugugaaagugaggucag

SEQ ID NO: 18285 - RNA, 18 nt, Artificial Sequence
  Description of Artificial Sequence: Synthetic oligonucleotide
uccuauugugaaagugag

SEQ ID NO: 18286 - RNA, 18 nt, Artificial Sequence
  Description of Artificial Sequence: Synthetic oligonucleotide
acugguccuauugugaaa

SEQ ID NO: 18287 - RNA, 18 nt, Artificial Sequence
  Description of Artificial Sequence: Synthetic oligonucleotide
ucaacacugguccuauug

SEQ ID NO: 18288 - RNA, 18 nt, Artificial Sequence
  Description of Artificial Sequence: Synthetic oligonucleotide
ggguaucaacacuggucc

SEQ ID NO: 18289 - RNA, 18 nt, Artificial Sequence
  Description of Artificial Sequence: Synthetic oligonucleotide
aggcuggguaucaacacu

SEQ ID NO: 18290 - RNA, 18 nt, Artificial Sequence
  Description of Artificial Sequence: Synthetic oligonucleotide
ccaagaggcuggguauca

SEQ ID NO: 18291 - RNA, 18 nt, Artificial Sequence
  Description of Artificial Sequence: Synthetic oligonucleotide
gaacaccaagaggcuggg

SEQ ID NO: 18292 - RNA, 18 nt, Artificial Sequence
  Description of Artificial Sequence: Synthetic oligonucleotide
gggaugaacaccaagagg

SEQ ID NO: 18293 - RNA, 18 nt, Artificial Sequence
  Description of Artificial Sequence: Synthetic oligonucleotide
cuugagggaugaacacca

SEQ ID NO: 18294 - RNA, 18 nt, Artificial Sequence
  Description of Artificial Sequence: Synthetic oligonucleotide
ugcuucuugagggaugaa

SEQ ID NO: 18295 - RNA, 18 nt, Artificial Sequence
  Description of Artificial Sequence: Synthetic oligonucleotide
gccagugcuucuugaggg

SEQ ID NO: 18296 - RNA, 18 nt, Artificial Sequence
  Description of Artificial Sequence: Synthetic oligonucleotide
uuucugccagugcuucuu

SEQ ID NO: 18297 - RNA, 18 nt, Artificial Sequence
  Description of Artificial Sequence: Synthetic oligonucleotide
cuggguuucugccagugc

SEQ ID NO: 18298 - RNA, 18 nt, Artificial Sequence
  Description of Artificial Sequence: Synthetic oligonucleotide
gauuccuggguuucugcc

SEQ ID NO: 18299 - RNA, 18 nt, Artificial Sequence
  Description of Artificial Sequence: Synthetic oligonucleotide
aauuugauuccuggguuu

SEQ ID NO: 18300 - RNA, 18 nt, Artificial Sequence
  Description of Artificial Sequence: Synthetic oligonucleotide
ugcccaauuugauuccug

SEQ ID NO: 18301 - RNA, 18 nt, Artificial Sequence
  Description of Artificial Sequence: Synthetic oligonucleotide
uuuugugcccaauuugau

SEQ ID NO: 18302 - RNA, 18 nt, Artificial Sequence
  Description of Artificial Sequence: Synthetic oligonucleotide
accauuuuugugcccaau

SEQ ID NO: 18303 - RNA, 18 nt, Artificial Sequence
  Description of Artificial Sequence: Synthetic oligonucleotide
uccuuaccauuuuugugc

SEQ ID NO: 18304 - RNA, 18 nt, Artificial Sequence
  Description of Artificial Sequence: Synthetic oligonucleotide
ccauuuccuuaccauuuu

SEQ ID NO: 18305 - RNA, 18 nt, Artificial Sequence
  Description of Artificial Sequence: Synthetic oligonucleotide
cuuugccauuuccuuacc

SEQ ID NO: 18306 - RNA, 18 nt, Artificial Sequence
  Description of Artificial Sequence: Synthetic oligonucleotide
aaauacuuugccauuucc

SEQ ID NO: 18307 - RNA, 18 nt, Artificial Sequence
  Description of Artificial Sequence: Synthetic oligonucleotide
guucuaaauacuuugcca

SEQ ID NO: 18308 - RNA, 18 nt, Artificial Sequence
  Description of Artificial Sequence: Synthetic oligonucleotide
gcgaaguucuaaauacuu

SEQ ID NO: 18309 - RNA, 18 nt, Artificial Sequence
  Description of Artificial Sequence: Synthetic oligonucleotide
agcgggcgaaguucuaaa

SEQ ID NO: 18310 - RNA, 18 nt, Artificial Sequence
  Description of Artificial Sequence: Synthetic oligonucleotide
caauuagcgggcgaaguu

SEQ ID NO: 18311 - RNA, 18 nt, Artificial Sequence
  Description of Artificial Sequence: Synthetic oligonucleotide
aaacacaauuagcgggcg

SEQ ID NO: 18312 - RNA, 18 nt, Artificial Sequence
  Description of Artificial Sequence: Synthetic oligonucleotide
uggagaaacacaauuagc

SEQ ID NO: 18313 - RNA, 18 nt, Artificial Sequence
  Description of Artificial Sequence: Synthetic oligonucleotide
gucccuggagaaacacaa

SEQ ID NO: 18314 - RNA, 18 nt, Artificial Sequence
  Description of Artificial Sequence: Synthetic oligonucleotide
aaacagucccuggagaaa

SEQ ID NO: 18315 - RNA, 18 nt, Artificial Sequence
  Description of Artificial Sequence: Synthetic oligonucleotide
gaggaaaacagucccugg

SEQ ID NO: 18316 - RNA, 18 nt, Artificial Sequence
  Description of Artificial Sequence: Synthetic oligonucleotide
uguuugaggaaaacaguc

SEQ ID NO: 18317 - RNA, 18 nt, Artificial Sequence
  Description of Artificial Sequence: Synthetic oligonucleotide
gaggauguuugaggaaaa

SEQ ID NO: 18318 - RNA, 18 nt, Artificial Sequence
  Description of Artificial Sequence: Synthetic oligonucleotide
uuucagaggauguuugag

SEQ ID NO: 18319 - RNA, 18 nt, Artificial Sequence
  Description of Artificial Sequence: Synthetic oligonucleotide
caggauuucagaggaugu

SEQ ID NO: 18320 - RNA, 18 nt, Artificial Sequence
  Description of Artificial Sequence: Synthetic oligonucleotide
aggaccaggauuucagag

SEQ ID NO: 18321 - RNA, 18 nt, Artificial Sequence
  Description of Artificial Sequence: Synthetic oligonucleotide
gauauaggaccaggauuu

SEQ ID NO: 18322 - RNA, 18 nt, Artificial Sequence
  Description of Artificial Sequence: Synthetic oligonucleotide
cugcugauauaggaccag

SEQ ID NO: 18323 - RNA, 18 nt, Artificial Sequence
  Description of Artificial Sequence: Synthetic oligonucleotide
auucccugcugauauagg

SEQ ID NO: 18324 - RNA, 18 nt, Artificial Sequence
  Description of Artificial Sequence: Synthetic oligonucleotide
gccucauucccugcugau

SEQ ID NO: 18325 - RNA, 18 nt, Artificial Sequence
  Description of Artificial Sequence: Synthetic oligonucleotide
cuguggccucauucccug

SEQ ID NO: 18326 - RNA, 18 nt, Artificial Sequence
  Description of Artificial Sequence: Synthetic oligonucleotide
ucagucuguggccucauu

SEQ ID NO: 18327 - RNA, 18 nt, Artificial Sequence
  Description of Artificial Sequence: Synthetic oligonucleotide
ucucaucagucuguggcc

SEQ ID NO: 18328 - RNA, 18 nt, Artificial Sequence
  Description of Artificial Sequence: Synthetic oligonucleotide
uuuccucucaucagucug

SEQ ID NO: 18329 - RNA, 18 nt, Artificial Sequence
  Description of Artificial Sequence: Synthetic oligonucleotide
uaaaauuuccucucauca

SEQ ID NO: 18330 - RNA, 18 nt, Artificial Sequence
  Description of Artificial Sequence: Synthetic oligonucleotide
uaaaauaaaauuuccucu

SEQ ID NO: 18331 - RNA, 18 nt, Artificial Sequence
  Description of Artificial Sequence: Synthetic oligonucleotide
auagcuaaaauaaaauuu

SEQ ID NO: 18332 - RNA, 18 nt, Artificial Sequence
  Description of Artificial Sequence: Synthetic oligonucleotide
uggaaauagcuaaaauaa

SEQ ID NO: 18333 - RNA, 18 nt, Artificial Sequence
  Description of Artificial Sequence: Synthetic oligonucleotide
aaauguggaaauagcuaa

SEQ ID NO: 18334 - RNA, 18 nt, Artificial Sequence
  Description of Artificial Sequence: Synthetic oligonucleotide
gagaaaaauguggaaaua

SEQ ID NO: 18335 - RNA, 18 nt, Artificial Sequence
  Description of Artificial Sequence: Synthetic oligonucleotide
ugaaugagaaaaaugugg

SEQ ID NO: 18336 - RNA, 18 nt, Artificial Sequence
  Description of Artificial Sequence: Synthetic oligonucleotide
ggaccugaaugagaaaaa

SEQ ID NO: 18337 - RNA, 18 nt, Artificial Sequence
  Description of Artificial Sequence: Synthetic oligonucleotide
uuagaggaccugaaugag

SEQ ID NO: 18338 - RNA, 18 nt, Artificial Sequence
  Description of Artificial Sequence: Synthetic oligonucleotide
ccacauuagaggaccuga

SEQ ID NO: 18339 - RNA, 18 nt, Artificial Sequence
  Description of Artificial Sequence: Synthetic oligonucleotide
acuaaccacauuagagga

SEQ ID NO: 18340 - RNA, 18 nt, Artificial Sequence
  Description of Artificial Sequence: Synthetic oligonucleotide
ccacaacuaaccacauua

SEQ ID NO: 18341 - RNA, 18 nt, Artificial Sequence
  Description of Artificial Sequence: Synthetic oligonucleotide
ucaggccacaacuaacca

SEQ ID NO: 18342 - RNA, 18 nt, Artificial Sequence
  Description of Artificial Sequence: Synthetic oligonucleotide
cauuuucaggccacaacu

SEQ ID NO: 18343 - RNA, 18 nt, Artificial Sequence
  Description of Artificial Sequence: Synthetic oligonucleotide
aauaucauuuucaggcca

SEQ ID NO: 18344 - RNA, 18 nt, Artificial Sequence
  Description of Artificial Sequence: Synthetic oligonucleotide
uuggaaauaucauuuuca

SEQ ID NO: 18345 - RNA, 18 nt, Artificial Sequence
  Description of Artificial Sequence: Synthetic oligonucleotide
uucauuuggaaauaucau

SEQ ID NO: 18346 - RNA, 18 nt, Artificial Sequence
  Description of Artificial Sequence: Synthetic oligonucleotide
uccuauucauuuggaaau

SEQ ID NO: 18347 - RNA, 18 nt, Artificial Sequence
  Description of Artificial Sequence: Synthetic oligonucleotide
uuccuuccuauucauuug

SEQ ID NO: 18348 - RNA, 18 nt, Artificial Sequence
  Description of Artificial Sequence: Synthetic oligonucleotide
uuuccuuccuuccuauuc

SEQ ID NO: 18349 - RNA, 18 nt, Artificial Sequence
  Description of Artificial Sequence: Synthetic oligonucleotide
aacaauuuccuuccuucc

SEQ ID NO: 18350 - RNA, 18 nt, Artificial Sequence
  Description of Artificial Sequence: Synthetic oligonucleotide
acaaaaacaauuuccuuc

SEQ ID NO: 18351 - RNA, 18 nt, Artificial Sequence
  Description of Artificial Sequence: Synthetic oligonucleotide
aaacaacaaaaacaauuu

SEQ ID NO: 18352 - RNA, 18 nt, Artificial Sequence
  Description of Artificial Sequence: Synthetic oligonucleotide
aucuuaaacaacaaaaac

SEQ ID NO: 18353 - RNA, 18 nt, Artificial Sequence
  Description of Artificial Sequence: Synthetic oligonucleotide
cuuccaucuuaaacaaca

SEQ ID NO: 18354 - RNA, 18 nt, Artificial Sequence
  Description of Artificial Sequence: Synthetic oligonucleotide
auuuccuuccaucuuaaa

SEQ ID NO: 18355 - RNA, 18 nt, Artificial Sequence
  Description of Artificial Sequence: Synthetic oligonucleotide
ccuauauuuccuuccauc

SEQ ID NO: 18356 - RNA, 18 nt, Artificial Sequence
  Description of Artificial Sequence: Synthetic oligonucleotide
augcaccuauauuuccuu

SEQ ID NO: 18357 - RNA, 18 nt, Artificial Sequence
  Description of Artificial Sequence: Synthetic oligonucleotide
uuuaaaugcaccuauauu

SEQ ID NO: 18358 - RNA, 18 nt, Artificial Sequence
  Description of Artificial Sequence: Synthetic oligonucleotide
cauuuuuuaaaugcaccu

SEQ ID NO: 18359 - RNA, 18 nt, Artificial Sequence
  Description of Artificial Sequence: Synthetic oligonucleotide
agcuccauuuuuuaaaug

SEQ ID NO: 18360 - RNA, 18 nt, Artificial Sequence
  Description of Artificial Sequence: Synthetic oligonucleotide
aaccaagcuccauuuuuu

SEQ ID NO: 18361 - RNA, 18 nt, Artificial Sequence
  Description of Artificial Sequence: Synthetic oligonucleotide
caugcaaccaagcuccau

SEQ ID NO: 18362 - RNA, 18 nt, Artificial Sequence
  Description of Artificial Sequence: Synthetic oligonucleotide
aaaaucaugcaaccaagc

SEQ ID NO: 18363 - RNA, 18 nt, Artificial Sequence
  Description of Artificial Sequence: Synthetic oligonucleotide
gagcgaaaaucaugcaac

SEQ ID NO: 18364 - RNA, 18 nt, Artificial Sequence
  Description of Artificial Sequence: Synthetic oligonucleotide
cucaagagcgaaaaucau

SEQ ID NO: 18365 - RNA, 18 nt, Artificial Sequence
  Description of Artificial Sequence: Synthetic oligonucleotide
gaugacucaagagcgaaa

SEQ ID NO: 18366 - RNA, 18 nt, Artificial Sequence
  Description of Artificial Sequence: Synthetic oligonucleotide
ggcuagaugacucaagag

SEQ ID NO: 18367 - RNA, 18 nt, Artificial Sequence
  Description of Artificial Sequence: Synthetic oligonucleotide
uagagggcuagaugacuc

SEQ ID NO: 18368 - RNA, 18 nt, Artificial Sequence
  Description of Artificial Sequence: Synthetic oligonucleotide
aucauuagagggcuagau

SEQ ID NO: 18369 - RNA, 18 nt, Artificial Sequence
  Description of Artificial Sequence: Synthetic oligonucleotide
aggcaaucauuagagggc

SEQ ID NO: 18370 - RNA, 18 nt, Artificial Sequence
  Description of Artificial Sequence: Synthetic oligonucleotide
guaugaggcaaucauuag

SEQ ID NO: 18371 - RNA, 18 nt, Artificial Sequence
  Description of Artificial Sequence: Synthetic oligonucleotide
caccgguaugaggcaauc

SEQ ID NO: 18372 - RNA, 18 nt, Artificial Sequence
  Description of Artificial Sequence: Synthetic oligonucleotide
guaaucaccgguaugagg

SEQ ID NO: 18373 - RNA, 18 nt, Artificial Sequence
  Description of Artificial Sequence: Synthetic oligonucleotide
cgcucguaaucaccggua

SEQ ID NO: 18374 - RNA, 18 nt, Artificial Sequence
  Description of Artificial Sequence: Synthetic oligonucleotide
aaagccgcucguaaucac

SEQ ID NO: 18375 - RNA, 18 nt, Artificial Sequence
  Description of Artificial Sequence: Synthetic oligonucleotide
caugaaaagccgcucgua

SEQ ID NO: 18376 - RNA, 18 nt, Artificial Sequence
  Description of Artificial Sequence: Synthetic oligonucleotide
gggucaugaaaagccgcu

SEQ ID NO: 18377 - RNA, 18 nt, Artificial Sequence
  Description of Artificial Sequence: Synthetic oligonucleotide
aaaugguacauauggaag

SEQ ID NO: 18378 - RNA, 18 nt, Artificial Sequence
  Description of Artificial Sequence: Synthetic oligonucleotide
uuuuaaaaugguacauau

SEQ ID NO: 18379 - RNA, 18 nt, Artificial Sequence
  Description of Artificial Sequence: Synthetic oligonucleotide
cagcauuuuaaaauggua

SEQ ID NO: 18380 - RNA, 18 nt, Artificial Sequence
  Description of Artificial Sequence: Synthetic oligonucleotide
guaaucagcauuuuaaaa

SEQ ID NO: 18381 - RNA, 18 nt, Artificial Sequence
  Description of Artificial Sequence: Synthetic oligonucleotide
aagaaguaaucagcauuu

SEQ ID NO: 18382 - RNA, 18 nt, Artificial Sequence
  Description of Artificial Sequence: Synthetic oligonucleotide
uucucaagaaguaaucag

SEQ ID NO: 18383 - RNA, 18 nt, Artificial Sequence
  Description of Artificial Sequence: Synthetic oligonucleotide
ucuuauucucaagaagua

SEQ ID NO: 18384 - RNA, 18 nt, Artificial Sequence
  Description of Artificial Sequence: Synthetic oligonucleotide
gcuucucuuauucucaag

SEQ ID NO: 18385 - RNA, 18 nt, Artificial Sequence
  Description of Artificial Sequence: Synthetic oligonucleotide
auuaggcuucucuuauuc

SEQ ID NO: 18386 - RNA, 18 nt, Artificial Sequence
  Description of Artificial Sequence: Synthetic oligonucleotide
cugaaauuaggcuucucu

SEQ ID NO: 18387 - RNA, 18 nt, Artificial Sequence
  Description of Artificial Sequence: Synthetic oligonucleotide
auauucugaaauuaggcu

SEQ ID NO: 18388 - RNA, 18 nt, Artificial Sequence
  Description of Artificial Sequence: Synthetic oligonucleotide
uaaugauauucugaaauu

SEQ ID NO: 18389 - RNA, 18 nt, Artificial Sequence
  Description of Artificial Sequence: Synthetic oligonucleotide
uacccuaaugauauucug

SEQ ID NO: 18390 - RNA, 18 nt, Artificial Sequence
  Description of Artificial Sequence: Synthetic oligonucleotide
auagguacccuaaugaua

SEQ ID NO: 18391 - RNA, 18 nt, Artificial Sequence
  Description of Artificial Sequence: Synthetic oligonucleotide
cuucaauagguacccuaa

SEQ ID NO: 18392 - RNA, 18 nt, Artificial Sequence
  Description of Artificial Sequence: Synthetic oligonucleotide
caagacuucaauagguac

SEQ ID NO: 18393 - RNA, 18 nt, Artificial Sequence
  Description of Artificial Sequence: Synthetic oligonucleotide
gcagucaagacuucaaua

SEQ ID NO: 18394 - RNA, 18 nt, Artificial Sequence
  Description of Artificial Sequence: Synthetic oligonucleotide
uaugugcagucaagacuu

SEQ ID NO: 18395 - RNA, 18 nt, Artificial Sequence
  Description of Artificial Sequence: Synthetic oligonucleotide
cuaaauaugugcagucaa

SEQ ID NO: 18396 - RNA, 18 nt, Artificial Sequence
  Description of Artificial Sequence: Synthetic oligonucleotide
guaugcuaaauaugugca

SEQ ID NO: 18397 - RNA, 18 nt, Artificial Sequence
  Description of Artificial Sequence: Synthetic oligonucleotide
agggaguaugcuaaauau

SEQ ID NO: 18398 - RNA, 18 nt, Artificial Sequence
  Description of Artificial Sequence: Synthetic oligonucleotide
uucccagggaguaugcua

SEQ ID NO: 18399 - RNA, 18 nt, Artificial Sequence
  Description of Artificial Sequence: Synthetic oligonucleotide
uauaauucccagggagua

SEQ ID NO: 18400 - RNA, 18 nt, Artificial Sequence
  Description of Artificial Sequence: Synthetic oligonucleotide
uaaaauauaauucccagg

SEQ ID NO: 18401 - RNA, 18 nt, Artificial Sequence
  Description of Artificial Sequence: Synthetic oligonucleotide
guccuuaaaauauaauuc

SEQ ID NO: 18402 - RNA, 18 nt, Artificial Sequence
  Description of Artificial Sequence: Synthetic oligonucleotide
aaaauguccuuaaaauau

SEQ ID NO: 18403 - RNA, 18 nt, Artificial Sequence
  Description of Artificial Sequence: Synthetic oligonucleotide
auagaaaaauguccuuaa

SEQ ID NO: 18404 - RNA, 18 nt, Artificial Sequence
  Description of Artificial Sequence: Synthetic oligonucleotide
auuuaauagaaaaauguc

SEQ ID NO: 18405 - RNA, 18 nt, Artificial Sequence
  Description of Artificial Sequence: Synthetic oligonucleotide
caaugauuuaauagaaaa

SEQ ID NO: 18406 - RNA, 18 nt, Artificial Sequence
  Description of Artificial Sequence: Synthetic oligonucleotide
auaugcaaugauuuaaua

SEQ ID NO: 18407 - RNA, 18 nt, Artificial Sequence
  Description of Artificial Sequence: Synthetic oligonucleotide
cuuccauaugcaaugauu

SEQ ID NO: 18408 - RNA, 18 nt, Artificial Sequence
  Description of Artificial Sequence: Synthetic oligonucleotide
aguuucuuccauaugcaa

SEQ ID NO: 18409 - RNA, 18 nt, Artificial Sequence
  Description of Artificial Sequence: Synthetic oligonucleotide
uauugaguuucuuccaua

SEQ ID NO: 18410 - RNA, 18 nt, Artificial Sequence
  Description of Artificial Sequence: Synthetic oligonucleotide
uauuauauugaguuucuu

SEQ ID NO: 18411 - RNA, 18 nt, Artificial Sequence
  Description of Artificial Sequence: Synthetic oligonucleotide
ucagcuauuauauugagu

SEQ ID NO: 18412 - RNA, 18 nt, Artificial Sequence
  Description of Artificial Sequence: Synthetic oligonucleotide
aaauaucagcuauuauau

SEQ ID NO: 18413 - RNA, 18 nt, Artificial Sequence
  Description of Artificial Sequence: Synthetic oligonucleotide
caaguaaauaucagcuau

SEQ ID NO: 18414 - RNA, 18 nt, Artificial Sequence
  Description of Artificial Sequence: Synthetic oligonucleotide
gaacccaaguaaauauca

SEQ ID NO: 18415 - RNA, 18 nt, Artificial Sequence
  Description of Artificial Sequence: Synthetic oligonucleotide
auuaagaacccaaguaaa

SEQ ID NO: 18416 - RNA, 18 nt, Artificial Sequence
  Description of Artificial Sequence: Synthetic oligonucleotide
uucugauuaagaacccaa

SEQ ID NO: 18417 - RNA, 18 nt, Artificial Sequence
  Description of Artificial Sequence: Synthetic oligonucleotide
caauguucugauuaagaa

SEQ ID NO: 18418 - RNA, 18 nt, Artificial Sequence
  Description of Artificial Sequence: Synthetic oligonucleotide
acagccaauguucugauu

SEQ ID NO: 18419 - RNA, 18 nt, Artificial Sequence
  Description of Artificial Sequence: Synthetic oligonucleotide
aucacacagccaauguuc

SEQ ID NO: 18420 - RNA, 18 nt, Artificial Sequence
  Description of Artificial Sequence: Synthetic oligonucleotide
ugaaaaucacacagccaa

SEQ ID NO: 18421 - RNA, 18 nt, Artificial Sequence
  Description of Artificial Sequence: Synthetic oligonucleotide
aaucaugaaaaucacaca

SEQ ID NO: 18422 - RNA, 18 nt, Artificial Sequence
  Description of Artificial Sequence: Synthetic oligonucleotide
aucauaaucaugaaaauc

SEQ ID NO: 18423 - RNA, 18 nt, Artificial Sequence
  Description of Artificial Sequence: Synthetic oligonucleotide
ugaaaaucauaaucauga

SEQ ID NO: 18424 - RNA, 18 nt, Artificial Sequence
  Description of Artificial Sequence: Synthetic oligonucleotide
ugcaaugaaaaucauaau

SEQ ID NO: 18425 - RNA, 18 nt, Artificial Sequence
  Description of Artificial Sequence: Synthetic oligonucleotide
uuaauugcaaugaaaauc

SEQ ID NO: 18426 - RNA, 18 nt, Artificial Sequence
  Description of Artificial Sequence: Synthetic oligonucleotide
ucaacuuaauugcaauga

SEQ ID NO: 18427 - RNA, 18 nt, Artificial Sequence
  Description of Artificial Sequence: Synthetic oligonucleotide
aaacaucaacuuaauugc

SEQ ID NO: 18428 - RNA, 18 nt, Artificial Sequence
  Description of Artificial Sequence: Synthetic oligonucleotide
cuacaaaacaucaacuua

SEQ ID NO: 18429 - RNA, 18 nt, Artificial Sequence
  Description of Artificial Sequence: Synthetic oligonucleotide
acugucuacaaaacauca

SEQ ID NO: 18430 - RNA, 18 nt, Artificial Sequence
  Description of Artificial Sequence: Synthetic oligonucleotide
auuucacugucuacaaaa

SEQ ID NO: 18431 - RNA, 18 nt, Artificial Sequence
  Description of Artificial Sequence: Synthetic oligonucleotide
ugguaauuucacugucua

SEQ ID NO: 18432 - RNA, 18 nt, Artificial Sequence
  Description of Artificial Sequence: Synthetic oligonucleotide
guagaugguaauuucacu

SEQ ID NO: 18433 - RNA, 18 nt, Artificial Sequence
  Description of Artificial Sequence: Synthetic oligonucleotide
uuggaguagaugguaauu

SEQ ID NO: 18434 - RNA, 18 nt, Artificial Sequence
  Description of Artificial Sequence: Synthetic oligonucleotide
aucuuuuggaguagaugg

SEQ ID NO: 18435 - RNA, 18 nt, Artificial Sequence
  Description of Artificial Sequence: Synthetic oligonucleotide
uugcaaucuuuuggagua

SEQ ID NO: 18436 - RNA, 18 nt, Artificial Sequence
  Description of Artificial Sequence: Synthetic oligonucleotide
cuauuuugcaaucuuuug

SEQ ID NO: 18437 - RNA, 18 nt, Artificial Sequence
  Description of Artificial Sequence: Synthetic oligonucleotide
aaauucuauuuugcaauc

SEQ ID NO: 18438 - RNA, 18 nt, Artificial Sequence
  Description of Artificial Sequence: Synthetic oligonucleotide
agguuaaauucuauuuug

SEQ ID NO: 18439 - RNA, 18 nt, Artificial Sequence
  Description of Artificial Sequence: Synthetic oligonucleotide
cucuaagguuaaauucua

SEQ ID NO: 18440 - RNA, 18 nt, Artificial Sequence
  Description of Artificial Sequence: Synthetic oligonucleotide
auuggcucuaagguuaaa

SEQ ID NO: 18441 - RNA, 18 nt, Artificial Sequence
  Description of Artificial Sequence: Synthetic oligonucleotide
ccugcauuggcucuaagg

SEQ ID NO: 18442 - RNA, 18 nt, Artificial Sequence
  Description of Artificial Sequence: Synthetic oligonucleotide
uuuucccugcauuggcuc

SEQ ID NO: 18443 - RNA, 18 nt, Artificial Sequence
  Description of Artificial Sequence: Synthetic oligonucleotide
acaaguuuucccugcauu

SEQ ID NO: 18444 - RNA, 18 nt, Artificial Sequence
  Description of Artificial Sequence: Synthetic oligonucleotide
cagaaacaaguuuucccu

SEQ ID NO: 18445 - RNA, 18 nt, Artificial Sequence
  Description of Artificial Sequence: Synthetic oligonucleotide
accugcagaaacaaguuu

SEQ ID NO: 18446 - RNA, 18 nt, Artificial Sequence
  Description of Artificial Sequence: Synthetic oligonucleotide
aaugcaccugcagaaaca

SEQ ID NO: 18447 - RNA, 18 nt, Artificial Sequence
  Description of Artificial Sequence: Synthetic oligonucleotide
caaaaaaugcaccugcag

SEQ ID NO: 18448 - RNA, 18 nt, Artificial Sequence
  Description of Artificial Sequence: Synthetic oligonucleotide
aguuucaaaaaaugcacc

SEQ ID NO: 18449 - RNA, 18 nt, Artificial Sequence
  Description of Artificial Sequence: Synthetic oligonucleotide
guugaaguuucaaaaaau

SEQ ID NO: 18450 - RNA, 18 nt, Artificial Sequence
  Description of Artificial Sequence: Synthetic oligonucleotide
uaucuguugaaguuucaa

SEQ ID NO: 18451 - RNA, 18 nt, Artificial Sequence
  Description of Artificial Sequence: Synthetic oligonucleotide
ccugcuaucuguugaagu

SEQ ID NO: 18452 - RNA, 18 nt, Artificial Sequence
  Description of Artificial Sequence: Synthetic oligonucleotide
uucccccugcuaucuguu

SEQ ID NO: 18453 - RNA, 18 nt, Artificial Sequence
  Description of Artificial Sequence: Synthetic oligonucleotide
uuuuuuucccccugcuau

SEQ ID NO: 18454 - RNA, 18 nt, Artificial Sequence
  Description of Artificial Sequence: Synthetic oligonucleotide
ucacuuuuuuuucccccu

SEQ ID NO: 18455 - RNA, 18 nt, Artificial Sequence
  Description of Artificial Sequence: Synthetic oligonucleotide
uucugucacuuuuuuuuc

SEQ ID NO: 18456 - RNA, 18 nt, Artificial Sequence
  Description of Artificial Sequence: Synthetic oligonucleotide
gauccuucugucacuuuu

SEQ ID NO: 18457 - RNA, 18 nt, Artificial Sequence
  Description of Artificial Sequence: Synthetic oligonucleotide
acugugauccuucuguca

SEQ ID NO: 18458 - RNA, 18 nt, Artificial Sequence
  Description of Artificial Sequence: Synthetic oligonucleotide
gcugaacugugauccuuc

SEQ ID NO: 18459 - RNA, 18 nt, Artificial Sequence
  Description of Artificial Sequence: Synthetic oligonucleotide
auacugcugaacugugau

SEQ ID NO: 18460 - RNA, 18 nt, Artificial Sequence
  Description of Artificial Sequence: Synthetic oligonucleotide
aauucauacugcugaacu

SEQ ID NO: 18461 - RNA, 18 nt, Artificial Sequence
  Description of Artificial Sequence: Synthetic oligonucleotide
cagacaauucauacugcu

SEQ ID NO: 18462 - RNA, 18 nt, Artificial Sequence
  Description of Artificial Sequence: Synthetic oligonucleotide
gccagcagacaauucaua

SEQ ID NO: 18463 - RNA, 18 nt, Artificial Sequence
  Description of Artificial Sequence: Synthetic oligonucleotide
aggcugccagcagacaau

SEQ ID NO: 18464 - RNA, 18 nt, Artificial Sequence
  Description of Artificial Sequence: Synthetic oligonucleotide
uugcaaggcugccagcag

SEQ ID NO: 18465 - RNA, 18 nt, Artificial Sequence
  Description of Artificial Sequence: Synthetic oligonucleotide
ccagauugcaaggcugcc

SEQ ID NO: 18466 - RNA, 18 nt, Artificial Sequence
  Description of Artificial Sequence: Synthetic oligonucleotide
gcacaccagauugcaagg

SEQ ID NO: 18467 - RNA, 18 nt, Artificial Sequence
  Description of Artificial Sequence: Synthetic oligonucleotide
ugccugcacaccagauug

SEQ ID NO: 18468 - RNA, 18 nt, Artificial Sequence
  Description of Artificial Sequence: Synthetic oligonucleotide
cucacugccugcacacca

SEQ ID NO: 18469 - RNA, 18 nt, Artificial Sequence
  Description of Artificial Sequence: Synthetic oligonucleotide
acaaucucacugccugca

SEQ ID NO: 18470 - RNA, 18 nt, Artificial Sequence
  Description of Artificial Sequence: Synthetic oligonucleotide
acaccacaaucucacugc

SEQ ID NO: 18471 - RNA, 18 nt, Artificial Sequence
  Description of Artificial Sequence: Synthetic oligonucleotide
cauguacaccacaaucuc

SEQ ID NO: 18472 - RNA, 18 nt, Artificial Sequence
  Description of Artificial Sequence: Synthetic oligonucleotide
ggugacauguacaccaca

SEQ ID NO: 18473 - RNA, 18 nt, Artificial Sequence
  Description of Artificial Sequence: Synthetic oligonucleotide
aaucaggugacauguaca

SEQ ID NO: 18474 - RNA, 18 nt, Artificial Sequence
  Description of Artificial Sequence: Synthetic oligonucleotide
uguaguccugguggcaug

SEQ ID NO: 18475 - RNA, 18 nt, Artificial Sequence
  Description of Artificial Sequence: Synthetic oligonucleotide
gccccuguaguccuggug

SEQ ID NO: 18476 - RNA, 18 nt, Artificial Sequence
  Description of Artificial Sequence: Synthetic oligonucleotide
acucugccccuguagucc

SEQ ID NO: 18477 - RNA, 18 nt, Artificial Sequence
  Description of Artificial Sequence: Synthetic oligonucleotide
gagacacucugccccugu

SEQ ID NO: 18478 - RNA, 18 nt, Artificial Sequence
  Description of Artificial Sequence: Synthetic oligonucleotide
cagaggagacacucugcc

SEQ ID NO: 18479 - RNA, 18 nt, Artificial Sequence
  Description of Artificial Sequence: Synthetic oligonucleotide
gcugccagaggagacacu

SEQ ID NO: 18480 - RNA, 18 nt, Artificial Sequence
  Description of Artificial Sequence: Synthetic oligonucleotide
ucagagcugccagaggag

SEQ ID NO: 18481 - RNA, 18 nt, Artificial Sequence
  Description of Artificial Sequence: Synthetic oligonucleotide
ugaucucagagcugccag

SEQ ID NO: 18482 - RNA, 18 nt, Artificial Sequence
  Description of Artificial Sequence: Synthetic oligonucleotide
ggauuugaucucagagcu

SEQ ID NO: 18483 - RNA, 18 nt, Artificial Sequence
  Description of Artificial Sequence: Synthetic oligonucleotide
ucaucggauuugaucuca

SEQ ID NO: 18484 - RNA, 18 nt, Artificial Sequence
  Description of Artificial Sequence: Synthetic oligonucleotide
ccucgucaucggauuuga

SEQ ID NO: 18485 - RNA, 18 nt, Artificial Sequence
  Description of Artificial Sequence: Synthetic oligonucleotide
aucacccucgucaucgga

SEQ ID NO: 18486 - RNA, 18 nt, Artificial Sequence
  Description of Artificial Sequence: Synthetic oligonucleotide
uucucaucacccucguca

SEQ ID NO: 18487 - RNA, 18 nt, Artificial Sequence
  Description of Artificial Sequence: Synthetic oligonucleotide
gcagguucucaucacccu

SEQ ID NO: 18488 - RNA, 18 nt, Artificial Sequence
  Description of Artificial Sequence: Synthetic oligonucleotide
gucuugcagguucucauc

SEQ ID NO: 18489 - RNA, 18 nt, Artificial Sequence
  Description of Artificial Sequence: Synthetic oligonucleotide
uucgugucuugcagguuc

SEQ ID NO: 18490 - RNA, 18 nt, Artificial Sequence
  Description of Artificial Sequence: Synthetic oligonucleotide
aagauuucgugucuugca

SEQ ID NO: 18491 - RNA, 18 nt, Artificial Sequence
  Description of Artificial Sequence: Synthetic oligonucleotide
cuccgaagauuucguguc

SEQ ID NO: 18492 - RNA, 18 nt, Artificial Sequence
  Description of Artificial Sequence: Synthetic oligonucleotide
uuguccuccgaagauuuc

SEQ ID NO: 18493 - RNA, 18 nt, Artificial Sequence
  Description of Artificial Sequence: Synthetic oligonucleotide
auuucuuguccuccgaag

SEQ ID NO: 18494 - RNA, 18 nt, Artificial Sequence
  Description of Artificial Sequence: Synthetic oligonucleotide
aucuaauuucuuguccuc

SEQ ID NO: 18495 - RNA, 18 nt, Artificial Sequence
  Description of Artificial Sequence: Synthetic oligonucleotide
ucgucaucuaauuucuug

SEQ ID NO: 18496 - RNA, 18 nt, Artificial Sequence
  Description of Artificial Sequence: Synthetic oligonucleotide
ucuugucgucaucuaauu

SEQ ID NO: 18497 - RNA, 18 nt, Artificial Sequence
  Description of Artificial Sequence: Synthetic oligonucleotide
auccuucuugucgucauc

SEQ ID NO: 18498 - RNA, 18 nt, Artificial Sequence
  Description of Artificial Sequence: Synthetic oligonucleotide
uugauauccuucuugucg

SEQ ID NO: 18499 - RNA, 18 nt, Artificial Sequence
  Description of Artificial Sequence: Synthetic oligonucleotide
uugauuugauauccuucu

SEQ ID NO: 18500 - RNA, 18 nt, Artificial Sequence
  Description of Artificial Sequence: Synthetic oligonucleotide
aguaauugauuugauauc

SEQ ID NO: 18501 - RNA, 18 nt, Artificial Sequence
  Description of Artificial Sequence: Synthetic oligonucleotide
gaccuaguaauugauuug

SEQ ID NO: 18502 - RNA, 18 nt, Artificial Sequence
  Description of Artificial Sequence: Synthetic oligonucleotide
aucuugaccuaguaauug

SEQ ID NO: 18503 - RNA, 18 nt, Artificial Sequence
  Description of Artificial Sequence: Synthetic oligonucleotide
uucacgauggguccccac

SEQ ID NO: 18504 - RNA, 18 nt, Artificial Sequence
  Description of Artificial Sequence: Synthetic oligonucleotide
ccaucuucacgauggguc

SEQ ID NO: 18505 - RNA, 18 nt, Artificial Sequence
  Description of Artificial Sequence: Synthetic oligonucleotide
ccacgccaucuucacgau

SEQ ID NO: 18506 - RNA, 18 nt, Artificial Sequence
  Description of Artificial Sequence: Synthetic oligonucleotide
cagggccacgccaucuuc

SEQ ID NO: 18507 - RNA, 18 nt, Artificial Sequence
  Description of Artificial Sequence: Synthetic oligonucleotide
ccucucagggccacgcca

SEQ ID NO: 18508 - RNA, 18 nt, Artificial Sequence
  Description of Artificial Sequence: Synthetic oligonucleotide
ggcugccucucagggcca

SEQ ID NO: 18509 - RNA, 18 nt, Artificial Sequence
  Description of Artificial Sequence: Synthetic oligonucleotide
agaauggcugccucucag

SEQ ID NO: 18510 - RNA, 18 nt, Artificial Sequence
  Description of Artificial Sequence: Synthetic oligonucleotide
agaagagaauggcugccu

SEQ ID NO: 18511 - RNA, 18 nt, Artificial Sequence
  Description of Artificial Sequence: Synthetic oligonucleotide
uuggcagaagagaauggc

SEQ ID NO: 18512 - RNA, 18 nt, Artificial Sequence
  Description of Artificial Sequence: Synthetic oligonucleotide
cugguuuggcagaagaga

SEQ ID NO: 18513 - RNA, 18 nt, Artificial Sequence
  Description of Artificial Sequence: Synthetic oligonucleotide
ggaaccugguuuggcaga

SEQ ID NO: 18514 - RNA, 18 nt, Artificial Sequence
  Description of Artificial Sequence: Synthetic oligonucleotide
gaaccggaaccugguuug

SEQ ID NO: 18515 - RNA, 18 nt, Artificial Sequence
  Description of Artificial Sequence: Synthetic oligonucleotide
cuguggaaccggaaccug

SEQ ID NO: 18516 - RNA, 18 nt, Artificial Sequence
  Description of Artificial Sequence: Synthetic oligonucleotide
ggaagcuguggaaccgga

SEQ ID NO: 18517 - RNA, 18 nt, Artificial Sequence
  Description of Artificial Sequence: Synthetic oligonucleotide
ggacaggaagcuguggaa

SEQ ID NO: 18518 - RNA, 18 nt, Artificial Sequence
  Description of Artificial Sequence: Synthetic oligonucleotide
agacuggacaggaagcug

SEQ ID NO: 18519 - RNA, 18 nt, Artificial Sequence
  Description of Artificial Sequence: Synthetic oligonucleotide
gucgcagacuggacagga

SEQ ID NO: 18520 - RNA, 18 nt, Artificial Sequence
  Description of Artificial Sequence: Synthetic oligonucleotide
gggaagucgcagacugga

SEQ ID NO: 18521 - RNA, 18 nt, Artificial Sequence
  Description of Artificial Sequence: Synthetic oligonucleotide
gguggguucaggucaggg

SEQ ID NO: 18522 - RNA, 18 nt, Artificial Sequence
  Description of Artificial Sequence: Synthetic oligonucleotide
ggguggguucaggucagg

SEQ ID NO: 18523 - RNA, 18 nt, Artificial Sequence
  Description of Artificial Sequence: Synthetic oligonucleotide
cucuguaaggguccuggg

SEQ ID NO: 18524 - RNA, 18 nt, Artificial Sequence
  Description of Artificial Sequence: Synthetic oligonucleotide
gugcccuggugaggccaa

SEQ ID NO: 18525 - RNA, 18 nt, Artificial Sequence
  Description of Artificial Sequence: Synthetic oligonucleotide
cagaagugcccuggugag

SEQ ID NO: 18526 - RNA, 18 nt, Artificial Sequence
  Description of Artificial Sequence: Synthetic oligonucleotide
gaggucagaagugcccug

SEQ ID NO: 18527 - RNA, 18 nt, Artificial Sequence
  Description of Artificial Sequence: Synthetic oligonucleotide
aaagugaggucagaagug

SEQ ID NO: 18528 - RNA, 18 nt, Artificial Sequence
  Description of Artificial Sequence: Synthetic oligonucleotide
uugugaaagugaggucag

SEQ ID NO: 18529 - RNA, 18 nt, Artificial Sequence
  Description of Artificial Sequence: Synthetic oligonucleotide
uccuauugugaaagugag

SEQ ID NO: 18530 - RNA, 18 nt, Artificial Sequence
  Description of Artificial Sequence: Synthetic oligonucleotide
acugguccuauugugaaa

SEQ ID NO: 18531 - RNA, 18 nt, Artificial Sequence
  Description of Artificial Sequence: Synthetic oligonucleotide
ucaacacugguccuauug

SEQ ID NO: 18532 - RNA, 18 nt, Artificial Sequence
  Description of Artificial Sequence: Synthetic oligonucleotide
ggguaucaacacuggucc

SEQ ID NO: 18533 - RNA, 18 nt, Artificial Sequence
  Description of Artificial Sequence: Synthetic oligonucleotide
aggcuggguaucaacacu

SEQ ID NO: 18534 - RNA, 18 nt, Artificial Sequence
  Description of Artificial Sequence: Synthetic oligonucleotide
ccaagaggcuggguauca

SEQ ID NO: 18535 - RNA, 18 nt, Artificial Sequence
  Description of Artificial Sequence: Synthetic oligonucleotide
gaacaccaagaggcuggg

SEQ ID NO: 18536 - RNA, 18 nt, Artificial Sequence
  Description of Artificial Sequence: Synthetic oligonucleotide
gggaugaacaccaagagg

SEQ ID NO: 18537 - RNA, 18 nt, Artificial Sequence
  Description of Artificial Sequence: Synthetic oligonucleotide
cuugagggaugaacacca

SEQ ID NO: 18538 - RNA, 18 nt, Artificial Sequence
  Description of Artificial Sequence: Synthetic oligonucleotide
ugcuucuugagggaugaa

SEQ ID NO: 18539 - RNA, 18 nt, Artificial Sequence
  Description of Artificial Sequence: Synthetic oligonucleotide
gccagugcuucuugaggg

SEQ ID NO: 18540 - RNA, 18 nt, Artificial Sequence
  Description of Artificial Sequence: Synthetic oligonucleotide
uuucugccagugcuucuu

SEQ ID NO: 18541 - RNA, 18 nt, Artificial Sequence
  Description of Artificial Sequence: Synthetic oligonucleotide
cuggguuucugccagugc

SEQ ID NO: 18542 - RNA, 18 nt, Artificial Sequence
  Description of Artificial Sequence: Synthetic oligonucleotide
gauuccuggguuucugcc

SEQ ID NO: 18543 - RNA, 18 nt, Artificial Sequence
  Description of Artificial Sequence: Synthetic oligonucleotide
aauuugauuccuggguuu

SEQ ID NO: 18544 - RNA, 18 nt, Artificial Sequence
  Description of Artificial Sequence: Synthetic oligonucleotide
ugcccaauuugauuccug

SEQ ID NO: 18545 - RNA, 18 nt, Artificial Sequence
  Description of Artificial Sequence: Synthetic oligonucleotide
uuuugugcccaauuugau

SEQ ID NO: 18546 - RNA, 18 nt, Artificial Sequence
  Description of Artificial Sequence: Synthetic oligonucleotide
accauuuuugugcccaau

SEQ ID NO: 18547 - RNA, 18 nt, Artificial Sequence
  Description of Artificial Sequence: Synthetic oligonucleotide
uccuuaccauuuuugugc

SEQ ID NO: 18548 - RNA, 18 nt, Artificial Sequence
  Description of Artificial Sequence: Synthetic oligonucleotide
ccauuuccuuaccauuuu

SEQ ID NO: 18549 - RNA, 18 nt, Artificial Sequence
  Description of Artificial Sequence: Synthetic oligonucleotide
cuuugccauuuccuuacc

SEQ ID NO: 18550 - RNA, 18 nt, Artificial Sequence
  Description of Artificial Sequence: Synthetic oligonucleotide
aaauacuuugccauuucc

SEQ ID NO: 18551 - RNA, 18 nt, Artificial Sequence
  Description of Artificial Sequence: Synthetic oligonucleotide
guucuaaauacuuugcca

SEQ ID NO: 18552 - RNA, 18 nt, Artificial Sequence
  Description of Artificial Sequence: Synthetic oligonucleotide
gcgaaguucuaaauacuu

SEQ ID NO: 18553 - RNA, 18 nt, Artificial Sequence
  Description of Artificial Sequence: Synthetic oligonucleotide
agcgggcgaaguucuaaa

SEQ ID NO: 18554 - RNA, 18 nt, Artificial Sequence
  Description of Artificial Sequence: Synthetic oligonucleotide
caauuagcgggcgaaguu

SEQ ID NO: 18555 - RNA, 18 nt, Artificial Sequence
  Description of Artificial Sequence: Synthetic oligonucleotide
aaacacaauuagcgggcg

SEQ ID NO: 18556 - RNA, 18 nt, Artificial Sequence
  Description of Artificial Sequence: Synthetic oligonucleotide
uggagaaacacaauuagc

SEQ ID NO: 18557 - RNA, 18 nt, Artificial Sequence
  Description of Artificial Sequence: Synthetic oligonucleotide
gucccuggagaaacacaa

SEQ ID NO: 18558 - RNA, 18 nt, Artificial Sequence
  Description of Artificial Sequence: Synthetic oligonucleotide
aaacagucccuggagaaa

SEQ ID NO: 18559 - RNA, 18 nt, Artificial Sequence
  Description of Artificial Sequence: Synthetic oligonucleotide
gaggaaaacagucccugg

SEQ ID NO: 18560 - RNA, 18 nt, Artificial Sequence
  Description of Artificial Sequence: Synthetic oligonucleotide
uguuugaggaaaacaguc

SEQ ID NO: 18561 - RNA, 18 nt, Artificial Sequence
  Description of Artificial Sequence: Synthetic oligonucleotide
gaggauguuugaggaaaa

SEQ ID NO: 18562 - RNA, 18 nt, Artificial Sequence
  Description of Artificial Sequence: Synthetic oligonucleotide
uuucagaggauguuugag

SEQ ID NO: 18563 - RNA, 18 nt, Artificial Sequence
  Description of Artificial Sequence: Synthetic oligonucleotide
caggauuucagaggaugu

SEQ ID NO: 18564 - RNA, 18 nt, Artificial Sequence
  Description of Artificial Sequence: Synthetic oligonucleotide
aggaccaggauuucagag

SEQ ID NO: 18565 - RNA, 18 nt, Artificial Sequence
  Description of Artificial Sequence: Synthetic oligonucleotide
gauauaggaccaggauuu

SEQ ID NO: 18566 - RNA, 18 nt, Artificial Sequence
  Description of Artificial Sequence: Synthetic oligonucleotide
cugcugauauaggaccag

SEQ ID NO: 18567 - RNA, 18 nt, Artificial Sequence
  Description of Artificial Sequence: Synthetic oligonucleotide
auucccugcugauauagg

SEQ ID NO: 18568 - RNA, 18 nt, Artificial Sequence
  Description of Artificial Sequence: Synthetic oligonucleotide
gccucauucccugcugau

SEQ ID NO: 18569 - RNA, 18 nt, Artificial Sequence
  Description of Artificial Sequence: Synthetic oligonucleotide
cuguggccucauucccug

SEQ ID NO: 18570 - RNA, 18 nt, Artificial Sequence
  Description of Artificial Sequence: Synthetic oligonucleotide
ucagucuguggccucauu

SEQ ID NO: 18571 - RNA, 18 nt, Artificial Sequence
  Description of Artificial Sequence: Synthetic oligonucleotide
ucucaucagucuguggcc

SEQ ID NO: 18572 - RNA, 18 nt, Artificial Sequence
  Description of Artificial Sequence: Synthetic oligonucleotide
uuuccucucaucagucug

SEQ ID NO: 18573 - RNA, 18 nt, Artificial Sequence
  Description of Artificial Sequence: Synthetic oligonucleotide
uaaaauuuccucucauca

SEQ ID NO: 18574 - RNA, 18 nt, Artificial Sequence
  Description of Artificial Sequence: Synthetic oligonucleotide
uaaaauaaaauuuccucu

SEQ ID NO: 18575 - RNA, 18 nt, Artificial Sequence
  Description of Artificial Sequence: Synthetic oligonucleotide
auagcuaaaauaaaauuu

SEQ ID NO: 18576 - RNA, 18 nt, Artificial Sequence
  Description of Artificial Sequence: Synthetic oligonucleotide
uggaaauagcuaaaauaa

SEQ ID NO: 18577 - RNA, 18 nt, Artificial Sequence
  Description of Artificial Sequence: Synthetic oligonucleotide
aaauguggaaauagcuaa

SEQ ID NO: 18578 - RNA, 18 nt, Artificial Sequence
  Description of Artificial Sequence: Synthetic oligonucleotide
gagaaaaauguggaaaua

SEQ ID NO: 18579 - RNA, 18 nt, Artificial Sequence
  Description of Artificial Sequence: Synthetic oligonucleotide
ugaaugagaaaaaugugg

SEQ ID NO: 18580 - RNA, 18 nt, Artificial Sequence
  Description of Artificial Sequence: Synthetic oligonucleotide
ggaccugaaugagaaaaa

SEQ ID NO: 18581 - RNA, 18 nt, Artificial Sequence
  Description of Artificial Sequence: Synthetic oligonucleotide
uuagaggaccugaaugag

SEQ ID NO: 18582 - RNA, 18 nt, Artificial Sequence
  Description of Artificial Sequence: Synthetic oligonucleotide
ccacauuagaggaccuga

SEQ ID NO: 18583 - RNA, 18 nt, Artificial Sequence
  Description of Artificial Sequence: Synthetic oligonucleotide
acuaaccacauuagagga

SEQ ID NO: 18584 - RNA, 18 nt, Artificial Sequence
  Description of Artificial Sequence: Synthetic oligonucleotide
ccacaacuaaccacauua

SEQ ID NO: 18585 - RNA, 18 nt, Artificial Sequence
  Description of Artificial Sequence: Synthetic oligonucleotide
ucaggccacaacuaacca

SEQ ID NO: 18586 - RNA, 18 nt, Artificial Sequence
  Description of Artificial Sequence: Synthetic oligonucleotide
cauuuucaggccacaacu

SEQ ID NO: 18587 - RNA, 18 nt, Artificial Sequence
  Description of Artificial Sequence: Synthetic oligonucleotide
aauaucauuuucaggcca

SEQ ID NO: 18588 - RNA, 18 nt, Artificial Sequence
  Description of Artificial Sequence: Synthetic oligonucleotide
uuggaaauaucauuuuca

SEQ ID NO: 18589 - RNA, 18 nt, Artificial Sequence
  Description of Artificial Sequence: Synthetic oligonucleotide
uucauuuggaaauaucau

SEQ ID NO: 18590 - RNA, 18 nt, Artificial Sequence
  Description of Artificial Sequence: Synthetic oligonucleotide
uccuauucauuuggaaau

SEQ ID NO: 18591 - RNA, 18 nt, Artificial Sequence
  Description of Artificial Sequence: Synthetic oligonucleotide
uuccuuccuauucauuug

SEQ ID NO: 18592 - RNA, 18 nt, Artificial Sequence
  Description of Artificial Sequence: Synthetic oligonucleotide
uuuccuuccuuccuauuc

SEQ ID NO: 18593 - RNA, 18 nt, Artificial Sequence
  Description of Artificial Sequence: Synthetic oligonucleotide
aacaauuuccuuccuucc

SEQ ID NO: 18594 - RNA, 18 nt, Artificial Sequence
  Description of Artificial Sequence: Synthetic oligonucleotide
acaaaaacaauuuccuuc

SEQ ID NO: 18595 - RNA, 18 nt, Artificial Sequence
  Description of Artificial Sequence: Synthetic oligonucleotide
aaacaacaaaaacaauuu

SEQ ID NO: 18596 - RNA, 18 nt, Artificial Sequence
  Description of Artificial Sequence: Synthetic oligonucleotide
aucuuaaacaacaaaaac

SEQ ID NO: 18597 - RNA, 18 nt, Artificial Sequence
  Description of Artificial Sequence: Synthetic oligonucleotide
cuuccaucuuaaacaaca

SEQ ID NO: 18598 - RNA, 18 nt, Artificial Sequence
  Description of Artificial Sequence: Synthetic oligonucleotide
auuuccuuccaucuuaaa

SEQ ID NO: 18599 - RNA, 18 nt, Artificial Sequence
  Description of Artificial Sequence: Synthetic oligonucleotide
ccuauauuuccuuccauc

SEQ ID NO: 18600 - RNA, 18 nt, Artificial Sequence
  Description of Artificial Sequence: Synthetic oligonucleotide
augcaccuauauuuccuu

SEQ ID NO: 18601 - RNA, 18 nt, Artificial Sequence
  Description of Artificial Sequence: Synthetic oligonucleotide
uuuaaaugcaccuauauu

SEQ ID NO: 18602 - RNA, 18 nt, Artificial Sequence
  Description of Artificial Sequence: Synthetic oligonucleotide
cauuuuuuaaaugcaccu

SEQ ID NO: 18603 - RNA, 18 nt, Artificial Sequence
  Description of Artificial Sequence: Synthetic oligonucleotide
agcuccauuuuuuaaaug

SEQ ID NO: 18604 - RNA, 18 nt, Artificial Sequence
  Description of Artificial Sequence: Synthetic oligonucleotide
aaccaagcuccauuuuuu

SEQ ID NO: 18605 - RNA, 18 nt, Artificial Sequence
  Description of Artificial Sequence: Synthetic oligonucleotide
caugcaaccaagcuccau

SEQ ID NO: 18606 - RNA, 18 nt, Artificial Sequence
  Description of Artificial Sequence: Synthetic oligonucleotide
aaaaucaugcaaccaagc

SEQ ID NO: 18607 - RNA, 18 nt, Artificial Sequence
  Description of Artificial Sequence: Synthetic oligonucleotide
gagcgaaaaucaugcaac

SEQ ID NO: 18608 - RNA, 18 nt, Artificial Sequence
  Description of Artificial Sequence: Synthetic oligonucleotide
cucaagagcgaaaaucau

SEQ ID NO: 18609 - RNA, 18 nt, Artificial Sequence
  Description of Artificial Sequence: Synthetic oligonucleotide
gaugacucaagagcgaaa

SEQ ID NO: 18610 - RNA, 18 nt, Artificial Sequence
  Description of Artificial Sequence: Synthetic oligonucleotide
ggcuagaugacucaagag

SEQ ID NO: 18611 - RNA, 18 nt, Artificial Sequence
  Description of Artificial Sequence: Synthetic oligonucleotide
uagagggcuagaugacuc

SEQ ID NO: 18612 - RNA, 18 nt, Artificial Sequence
  Description of Artificial Sequence: Synthetic oligonucleotide
aucauuagagggcuagau

SEQ ID NO: 18613 - RNA, 18 nt, Artificial Sequence
  Description of Artificial Sequence: Synthetic oligonucleotide
aggcaaucauuagagggc

SEQ ID NO: 18614 - RNA, 18 nt, Artificial Sequence
  Description of Artificial Sequence: Synthetic oligonucleotide
guaugaggcaaucauuag

SEQ ID NO: 18615 - RNA, 18 nt, Artificial Sequence
  Description of Artificial Sequence: Synthetic oligonucleotide
caccgguaugaggcaauc

SEQ ID NO: 18616 - RNA, 18 nt, Artificial Sequence
  Description of Artificial Sequence: Synthetic oligonucleotide
guaaucaccgguaugagg

SEQ ID NO: 18617 - RNA, 18 nt, Artificial Sequence
  Description of Artificial Sequence: Synthetic oligonucleotide
cgcucguaaucaccggua

SEQ ID NO: 18618 - RNA, 18 nt, Artificial Sequence
  Description of Artificial Sequence: Synthetic oligonucleotide
aaagccgcucguaaucac

SEQ ID NO: 18619 - RNA, 18 nt, Artificial Sequence
  Description of Artificial Sequence: Synthetic oligonucleotide
caugaaaagccgcucgua

SEQ ID NO: 18620 - RNA, 18 nt, Artificial Sequence
  Description of Artificial Sequence: Synthetic oligonucleotide
gggucaugaaaagccgcu

SEQ ID NO: 18621 - RNA, 18 nt, Artificial Sequence
  Description of Artificial Sequence: Synthetic oligonucleotide
aaaugguacauauggaag

SEQ ID NO: 18622 - RNA, 18 nt, Artificial Sequence
  Description of Artificial Sequence: Synthetic oligonucleotide
uuuuaaaaugguacauau

SEQ ID NO: 18623 - RNA, 18 nt, Artificial Sequence
  Description of Artificial Sequence: Synthetic oligonucleotide
cagcauuuuaaaauggua

SEQ ID NO: 18624 - RNA, 18 nt, Artificial Sequence
  Description of Artificial Sequence: Synthetic oligonucleotide
guaaucagcauuuuaaaa

SEQ ID NO: 18625 - RNA, 18 nt, Artificial Sequence
  Description of Artificial Sequence: Synthetic oligonucleotide
aagaaguaaucagcauuu

SEQ ID NO: 18626 - RNA, 18 nt, Artificial Sequence
  Description of Artificial Sequence: Synthetic oligonucleotide
uucucaagaaguaaucag

SEQ ID NO: 18627 - RNA, 18 nt, Artificial Sequence
  Description of Artificial Sequence: Synthetic oligonucleotide
ucuuauucucaagaagua

SEQ ID NO: 18628 - RNA, 18 nt, Artificial Sequence
  Description of Artificial Sequence: Synthetic oligonucleotide
gcuucucuuauucucaag

SEQ ID NO: 18629 - RNA, 18 nt, Artificial Sequence
  Description of Artificial Sequence: Synthetic oligonucleotide
auuaggcuucucuuauuc

SEQ ID NO: 18630 - RNA, 18 nt, Artificial Sequence
  Description of Artificial Sequence: Synthetic oligonucleotide
cugaaauuaggcuucucu

SEQ ID NO: 18631 - RNA, 18 nt, Artificial Sequence
  Description of Artificial Sequence: Synthetic oligonucleotide
auauucugaaauuaggcu

SEQ ID NO: 18632 - RNA, 18 nt, Artificial Sequence
  Description of Artificial Sequence: Synthetic oligonucleotide
uaaugauauucugaaauu

SEQ ID NO: 18633 - RNA, 18 nt, Artificial Sequence
  Description of Artificial Sequence: Synthetic oligonucleotide
uacccuaaugauauucug

SEQ ID NO: 18634 - RNA, 18 nt, Artificial Sequence
  Description of Artificial Sequence: Synthetic oligonucleotide
auagguacccuaaugaua

SEQ ID NO: 18635 - RNA, 18 nt, Artificial Sequence
  Description of Artificial Sequence: Synthetic oligonucleotide
cuucaauagguacccuaa

SEQ ID NO: 18636 - RNA, 18 nt, Artificial Sequence
  Description of Artificial Sequence: Synthetic oligonucleotide
caagacuucaauagguac

SEQ ID NO: 18637 - RNA, 18 nt, Artificial Sequence
  Description of Artificial Sequence: Synthetic oligonucleotide
gcagucaagacuucaaua

SEQ ID NO: 18638 - RNA, 18 nt, Artificial Sequence
  Description of Artificial Sequence: Synthetic oligonucleotide
uaugugcagucaagacuu

SEQ ID NO: 18639 - RNA, 18 nt, Artificial Sequence
  Description of Artificial Sequence: Synthetic oligonucleotide
cuaaauaugugcagucaa

SEQ ID NO: 18640 - RNA, 18 nt, Artificial Sequence
  Description of Artificial Sequence: Synthetic oligonucleotide
guaugcuaaauaugugca

SEQ ID NO: 18641 - RNA, 18 nt, Artificial Sequence
  Description of Artificial Sequence: Synthetic oligonucleotide
agggaguaugcuaaauau

SEQ ID NO: 18642 - RNA, 18 nt, Artificial Sequence
  Description of Artificial Sequence: Synthetic oligonucleotide
uucccagggaguaugcua

SEQ ID NO: 18643 - RNA, 18 nt, Artificial Sequence
  Description of Artificial Sequence: Synthetic oligonucleotide
uauaauucccagggagua

SEQ ID NO: 18644 - RNA, 18 nt, Artificial Sequence
  Description of Artificial Sequence: Synthetic oligonucleotide
uaaaauauaauucccagg

SEQ ID NO: 18645 - RNA, 18 nt, Artificial Sequence
  Description of Artificial Sequence: Synthetic oligonucleotide
guccuuaaaauauaauuc

SEQ ID NO: 18646 - RNA, 18 nt, Artificial Sequence
  Description of Artificial Sequence: Synthetic oligonucleotide
aaaauguccuuaaaauau

SEQ ID NO: 18647 - RNA, 18 nt, Artificial Sequence
  Description of Artificial Sequence: Synthetic oligonucleotide
auagaaaaauguccuuaa

SEQ ID NO: 18648 - RNA, 18 nt, Artificial Sequence
  Description of Artificial Sequence: Synthetic oligonucleotide
auuuaauagaaaaauguc

SEQ ID NO: 18649 - RNA, 18 nt, Artificial Sequence
  Description of Artificial Sequence: Synthetic oligonucleotide
caaugauuuaauagaaaa

SEQ ID NO: 18650 - RNA, 18 nt, Artificial Sequence
  Description of Artificial Sequence: Synthetic oligonucleotide
auaugcaaugauuuaaua

SEQ ID NO: 18651 - RNA, 18 nt, Artificial Sequence
  Description of Artificial Sequence: Synthetic oligonucleotide
cuuccauaugcaaugauu

SEQ ID NO: 18652 - RNA, 18 nt, Artificial Sequence
  Description of Artificial Sequence: Synthetic oligonucleotide
aguuucuuccauaugcaa

SEQ ID NO: 18653 - RNA, 18 nt, Artificial Sequence
  Description of Artificial Sequence: Synthetic oligonucleotide
uauugaguuucuuccaua

SEQ ID NO: 18654 - RNA, 18 nt, Artificial Sequence
  Description of Artificial Sequence: Synthetic oligonucleotide
uauuauauugaguuucuu

SEQ ID NO: 18655 - RNA, 18 nt, Artificial Sequence
  Description of Artificial Sequence: Synthetic oligonucleotide
ucagcuauuauauugagu

SEQ ID NO: 18656 - RNA, 18 nt, Artificial Sequence
  Description of Artificial Sequence: Synthetic oligonucleotide
aaauaucagcuauuauau

SEQ ID NO: 18657 - RNA, 18 nt, Artificial Sequence
  Description of Artificial Sequence: Synthetic oligonucleotide
caaguaaauaucagcuau

SEQ ID NO: 18658 - RNA, 18 nt, Artificial Sequence
  Description of Artificial Sequence: Synthetic oligonucleotide
gaacccaaguaaauauca

SEQ ID NO: 18659 - RNA, 18 nt, Artificial Sequence
  Description of Artificial Sequence: Synthetic oligonucleotide
auuaagaacccaaguaaa

SEQ ID NO: 18660 - RNA, 18 nt, Artificial Sequence
  Description of Artificial Sequence: Synthetic oligonucleotide
uucugauuaagaacccaa

SEQ ID NO: 18661 - RNA, 18 nt, Artificial Sequence
  Description of Artificial Sequence: Synthetic oligonucleotide
caauguucugauuaagaa

SEQ ID NO: 18662 - RNA, 18 nt, Artificial Sequence
  Description of Artificial Sequence: Synthetic oligonucleotide
acagccaauguucugauu

SEQ ID NO: 18663 - RNA, 18 nt, Artificial Sequence
  Description of Artificial Sequence: Synthetic oligonucleotide
aucacacagccaauguuc

SEQ ID NO: 18664 - RNA, 18 nt, Artificial Sequence
  Description of Artificial Sequence: Synthetic oligonucleotide
ugaaaaucacacagccaa

SEQ ID NO: 18665 - RNA, 18 nt, Artificial Sequence
  Description of Artificial Sequence: Synthetic oligonucleotide
aaucaugaaaaucacaca

SEQ ID NO: 18666 - RNA, 18 nt, Artificial Sequence
  Description of Artificial Sequence: Synthetic oligonucleotide
aucauaaucaugaaaauc

SEQ ID NO: 18667 - RNA, 18 nt, Artificial Sequence
  Description of Artificial Sequence: Synthetic oligonucleotide
ugaaaaucauaaucauga

SEQ ID NO: 18668 - RNA, 18 nt, Artificial Sequence
  Description of Artificial Sequence: Synthetic oligonucleotide
ugcaaugaaaaucauaau

SEQ ID NO: 18669 - RNA, 18 nt, Artificial Sequence
  Description of Artificial Sequence: Synthetic oligonucleotide
uuaauugcaaugaaaauc

SEQ ID NO: 18670 - RNA, 18 nt, Artificial Sequence
  Description of Artificial Sequence: Synthetic oligonucleotide
ucaacuuaauugcaauga

SEQ ID NO: 18671 - RNA, 18 nt, Artificial Sequence
  Description of Artificial Sequence: Synthetic oligonucleotide
aaacaucaacuuaauugc

SEQ ID NO: 18672 - RNA, 18 nt, Artificial Sequence
  Description of Artificial Sequence: Synthetic oligonucleotide
cuacaaaacaucaacuua

SEQ ID NO: 18673 - RNA, 18 nt, Artificial Sequence
  Description of Artificial Sequence: Synthetic oligonucleotide
acugucuacaaaacauca

SEQ ID NO: 18674 - RNA, 18 nt, Artificial Sequence
  Description of Artificial Sequence: Synthetic oligonucleotide
auuucacugucuacaaaa

SEQ ID NO: 18675 - RNA, 18 nt, Artificial Sequence
  Description of Artificial Sequence: Synthetic oligonucleotide
ugguaauuucacugucua

SEQ ID NO: 18676 - RNA, 18 nt, Artificial Sequence
  Description of Artificial Sequence: Synthetic oligonucleotide
guagaugguaauuucacu

SEQ ID NO: 18677 - RNA, 18 nt, Artificial Sequence
  Description of Artificial Sequence: Synthetic oligonucleotide
uuggaguagaugguaauu

SEQ ID NO: 18678 - RNA, 18 nt, Artificial Sequence
  Description of Artificial Sequence: Synthetic oligonucleotide
aucuuuuggaguagaugg

SEQ ID NO: 18679 - RNA, 18 nt, Artificial Sequence
  Description of Artificial Sequence: Synthetic oligonucleotide
uugcaaucuuuuggagua

SEQ ID NO: 18680 - RNA, 18 nt, Artificial Sequence
  Description of Artificial Sequence: Synthetic oligonucleotide
cuauuuugcaaucuuuug

SEQ ID NO: 18681 - RNA, 18 nt, Artificial Sequence
  Description of Artificial Sequence: Synthetic oligonucleotide
aaauucuauuuugcaauc

SEQ ID NO: 18682 - RNA, 18 nt, Artificial Sequence
  Description of Artificial Sequence: Synthetic oligonucleotide
agguuaaauucuauuuug

SEQ ID NO: 18683 - RNA, 18 nt, Artificial Sequence
  Description of Artificial Sequence: Synthetic oligonucleotide
cucuaagguuaaauucua

SEQ ID NO: 18684 - RNA, 18 nt, Artificial Sequence
  Description of Artificial Sequence: Synthetic oligonucleotide
auuggcucuaagguuaaa

SEQ ID NO: 18685 - RNA, 18 nt, Artificial Sequence
  Description of Artificial Sequence: Synthetic oligonucleotide
ccugcauuggcucuaagg

SEQ ID NO: 18686 - RNA, 18 nt, Artificial Sequence
  Description of Artificial Sequence: Synthetic oligonucleotide
uuuucccugcauuggcuc

SEQ ID NO: 18687 - RNA, 18 nt, Artificial Sequence
  Description of Artificial Sequence: Synthetic oligonucleotide
acaaguuuucccugcauu

SEQ ID NO: 18688 - RNA, 18 nt, Artificial Sequence
  Description of Artificial Sequence: Synthetic oligonucleotide
cagaaacaaguuuucccu

SEQ ID NO: 18689 - RNA, 18 nt, Artificial Sequence
  Description of Artificial Sequence: Synthetic oligonucleotide
accugcagaaacaaguuu

SEQ ID NO: 18690 - RNA, 18 nt, Artificial Sequence
  Description of Artificial Sequence: Synthetic oligonucleotide
aaugcaccugcagaaaca

SEQ ID NO: 18691 - RNA, 18 nt, Artificial Sequence
  Description of Artificial Sequence: Synthetic oligonucleotide
caaaaaaugcaccugcag

SEQ ID NO: 18692 - RNA, 18 nt, Artificial Sequence
  Description of Artificial Sequence: Synthetic oligonucleotide
aguuucaaaaaaugcacc

SEQ ID NO: 18693 - RNA, 18 nt, Artificial Sequence
  Description of Artificial Sequence: Synthetic oligonucleotide
guugaaguuucaaaaaau

SEQ ID NO: 18694 - RNA, 18 nt, Artificial Sequence
  Description of Artificial Sequence: Synthetic oligonucleotide
uaucuguugaaguuucaa

SEQ ID NO: 18695 - RNA, 18 nt, Artificial Sequence
  Description of Artificial Sequence: Synthetic oligonucleotide
ccugcuaucuguugaagu

SEQ ID NO: 18696 - RNA, 18 nt, Artificial Sequence
  Description of Artificial Sequence: Synthetic oligonucleotide
uucccccugcuaucuguu

SEQ ID NO: 18697 - RNA, 18 nt, Artificial Sequence
  Description of Artificial Sequence: Synthetic oligonucleotide
uuuuuuucccccugcuau

SEQ ID NO: 18698 - RNA, 18 nt, Artificial Sequence
  Description of Artificial Sequence: Synthetic oligonucleotide
ucacuuuuuuuucccccu

SEQ ID NO: 18699 - RNA, 18 nt, Artificial Sequence
  Description of Artificial Sequence: Synthetic oligonucleotide
uucugucacuuuuuuuuc

SEQ ID NO: 18700 - RNA, 18 nt, Artificial Sequence
  Description of Artificial Sequence: Synthetic oligonucleotide
gauccuucugucacuuuu

SEQ ID NO: 18701 - RNA, 18 nt, Artificial Sequence
  Description of Artificial Sequence: Synthetic oligonucleotide
acugugauccuucuguca

SEQ ID NO: 18702 - RNA, 18 nt, Artificial Sequence
  Description of Artificial Sequence: Synthetic oligonucleotide
gcugaacugugauccuuc

SEQ ID NO: 18703 - RNA, 18 nt, Artificial Sequence
  Description of Artificial Sequence: Synthetic oligonucleotide
auacugcugaacugugau

SEQ ID NO: 18704 - RNA, 18 nt, Artificial Sequence
  Description of Artificial Sequence: Synthetic oligonucleotide
aauucauacugcugaacu

SEQ ID NO: 18705 - RNA, 18 nt, Artificial Sequence
  Description of Artificial Sequence: Synthetic oligonucleotide
cagacaauucauacugcu

SEQ ID NO: 18706 - RNA, 18 nt, Artificial Sequence
  Description of Artificial Sequence: Synthetic oligonucleotide
gccagcagacaauucaua

SEQ ID NO: 18707 - RNA, 18 nt, Artificial Sequence
  Description of Artificial Sequence: Synthetic oligonucleotide
aggcugccagcagacaau

SEQ ID NO: 18708 - RNA, 18 nt, Artificial Sequence
  Description of Artificial Sequence: Synthetic oligonucleotide
uugcaaggcugccagcag

SEQ ID NO: 18709 - RNA, 18 nt, Artificial Sequence
  Description of Artificial Sequence: Synthetic oligonucleotide
ccagauugcaaggcugcc

SEQ ID NO: 18710 - RNA, 18 nt, Artificial Sequence
  Description of Artificial Sequence: Synthetic oligonucleotide
gcacaccagauugcaagg

SEQ ID NO: 18711 - RNA, 18 nt, Artificial Sequence
  Description of Artificial Sequence: Synthetic oligonucleotide
ugccugcacaccagauug

SEQ ID NO: 18712 - RNA, 18 nt, Artificial Sequence
  Description of Artificial Sequence: Synthetic oligonucleotide
cucacugccugcacacca

SEQ ID NO: 18713 - RNA, 18 nt, Artificial Sequence
  Description of Artificial Sequence: Synthetic oligonucleotide
acaaucucacugccugca

SEQ ID NO: 18714 - RNA, 18 nt, Artificial Sequence
  Description of Artificial Sequence: Synthetic oligonucleotide
acaccacaaucucacugc

SEQ ID NO: 18715 - RNA, 18 nt, Artificial Sequence
  Description of Artificial Sequence: Synthetic oligonucleotide
cauguacaccacaaucuc

SEQ ID NO: 18716 - RNA, 18 nt, Artificial Sequence
  Description of Artificial Sequence: Synthetic oligonucleotide
ggugacauguacaccaca

SEQ ID NO: 18717 - RNA, 18 nt, Artificial Sequence
  Description of Artificial Sequence: Synthetic oligonucleotide
aaucaggugacauguaca

SEQ ID NO: 18718 - RNA, 18 nt, Artificial Sequence
  Description of Artificial Sequence: Synthetic oligonucleotide
uguaguccugguggcaug

SEQ ID NO: 18719 - RNA, 18 nt, Artificial Sequence
  Description of Artificial Sequence: Synthetic oligonucleotide
gccccuguaguccuggug

SEQ ID NO: 18720 - RNA, 18 nt, Artificial Sequence
  Description of Artificial Sequence: Synthetic oligonucleotide
acucugccccuguagucc

SEQ ID NO: 18721 - RNA, 18 nt, Artificial Sequence
  Description of Artificial Sequence: Synthetic oligonucleotide
gagacacucugccccugu

SEQ ID NO: 18722 - RNA, 18 nt, Artificial Sequence
  Description of Artificial Sequence: Synthetic oligonucleotide
cagaggagacacucugcc

SEQ ID NO: 18723 - RNA, 18 nt, Artificial Sequence
  Description of Artificial Sequence: Synthetic oligonucleotide
gcugccagaggagacacu

SEQ ID NO: 18724 - RNA, 18 nt, Artificial Sequence
  Description of Artificial Sequence: Synthetic oligonucleotide
ucagagcugccagaggag

SEQ ID NO: 18725 - RNA, 18 nt, Artificial Sequence
  Description of Artificial Sequence: Synthetic oligonucleotide
ugaucucagagcugccag

SEQ ID NO: 18726 - RNA, 18 nt, Artificial Sequence
  Description of Artificial Sequence: Synthetic oligonucleotide
ggauuugaucucagagcu

SEQ ID NO: 18727 - RNA, 18 nt, Artificial Sequence
  Description of Artificial Sequence: Synthetic oligonucleotide
ucaucggauuugaucuca

SEQ ID NO: 18728 - RNA, 18 nt, Artificial Sequence
  Description of Artificial Sequence: Synthetic oligonucleotide
ccucgucaucggauuuga

SEQ ID NO: 18729 - RNA, 18 nt, Artificial Sequence
  Description of Artificial Sequence: Synthetic oligonucleotide
aucacccucgucaucgga

SEQ ID NO: 18730 - RNA, 18 nt, Artificial Sequence
  Description of Artificial Sequence: Synthetic oligonucleotide
uucucaucacccucguca

SEQ ID NO: 18731 - RNA, 18 nt, Artificial Sequence
  Description of Artificial Sequence: Synthetic oligonucleotide
gcagguucucaucacccu

SEQ ID NO: 18732 - RNA, 18 nt, Artificial Sequence
  Description of Artificial Sequence: Synthetic oligonucleotide
gucuugcagguucucauc

SEQ ID NO: 18733 - RNA, 18 nt, Artificial Sequence
  Description of Artificial Sequence: Synthetic oligonucleotide
uucgugucuugcagguuc

SEQ ID NO: 18734 - RNA, 18 nt, Artificial Sequence
  Description of Artificial Sequence: Synthetic oligonucleotide
aagauuucgugucuugca

SEQ ID NO: 18735 - RNA, 18 nt, Artificial Sequence
  Description of Artificial Sequence: Synthetic oligonucleotide
cuccgaagauuucguguc

SEQ ID NO: 18736 - RNA, 18 nt, Artificial Sequence
  Description of Artificial Sequence: Synthetic oligonucleotide
uuguccuccgaagauuuc

SEQ ID NO: 18737 - RNA, 18 nt, Artificial Sequence
  Description of Artificial Sequence: Synthetic oligonucleotide
auuucuuguccuccgaag

SEQ ID NO: 18738 - RNA, 18 nt, Artificial Sequence
  Description of Artificial Sequence: Synthetic oligonucleotide
aucuaauuucuuguccuc

SEQ ID NO: 18739 - RNA, 18 nt, Artificial Sequence
  Description of Artificial Sequence: Synthetic oligonucleotide
ucgucaucuaauuucuug

SEQ ID NO: 18740 - RNA, 18 nt, Artificial Sequence
  Description of Artificial Sequence: Synthetic oligonucleotide
ucuugucgucaucuaauu

SEQ ID NO: 18741 - RNA, 18 nt, Artificial Sequence
  Description of Artificial Sequence: Synthetic oligonucleotide
auccuucuugucgucauc

SEQ ID NO: 18742 - RNA, 18 nt, Artificial Sequence
  Description of Artificial Sequence: Synthetic oligonucleotide
uugauauccuucuugucg

SEQ ID NO: 18743 - RNA, 18 nt, Artificial Sequence
  Description of Artificial Sequence: Synthetic oligonucleotide
uugauuugauauccuucu

SEQ ID NO: 18744 - RNA, 18 nt, Artificial Sequence
  Description of Artificial Sequence: Synthetic oligonucleotide
aguaauugauuugauauc

SEQ ID NO: 18745 - RNA, 18 nt, Artificial Sequence
  Description of Artificial Sequence: Synthetic oligonucleotide
gaccuaguaauugauuug

SEQ ID NO: 18746 - RNA, 18 nt, Artificial Sequence
  Description of Artificial Sequence: Synthetic oligonucleotide
aucuugaccuaguaauug

SEQ ID NO: 18747 - RNA, 18 nt, Artificial Sequence
  Description of Artificial Sequence: Synthetic oligonucleotide
uucacgauggguccccac

SEQ ID NO: 18748 - RNA, 18 nt, Artificial Sequence
  Description of Artificial Sequence: Synthetic oligonucleotide
ccaucuucacgauggguc

SEQ ID NO: 18749 - RNA, 18 nt, Artificial Sequence
  Description of Artificial Sequence: Synthetic oligonucleotide
ccacgccaucuucacgau

SEQ ID NO: 18750 - RNA, 18 nt, Artificial Sequence
  Description of Artificial Sequence: Synthetic oligonucleotide
cagggccacgccaucuuc

SEQ ID NO: 18751 - RNA, 18 nt, Artificial Sequence
  Description of Artificial Sequence: Synthetic oligonucleotide
ccucucagggccacgcca

SEQ ID NO: 18752 - RNA, 18 nt, Artificial Sequence
  Description of Artificial Sequence: Synthetic oligonucleotide
ggcugccucucagggcca

SEQ ID NO: 18753 - RNA, 18 nt, Artificial Sequence
  Description of Artificial Sequence: Synthetic oligonucleotide
agaauggcugccucucag

SEQ ID NO: 18754 - RNA, 18 nt, Artificial Sequence
  Description of Artificial Sequence: Synthetic oligonucleotide
agaagagaauggcugccu

SEQ ID NO: 18755 - RNA, 18 nt, Artificial Sequence
  Description of Artificial Sequence: Synthetic oligonucleotide
uuggcagaagagaauggc

SEQ ID NO: 18756 - RNA, 18 nt, Artificial Sequence
  Description of Artificial Sequence: Synthetic oligonucleotide
cugguuuggcagaagaga

SEQ ID NO: 18757 - RNA, 18 nt, Artificial Sequence
  Description of Artificial Sequence: Synthetic oligonucleotide
ggaaccugguuuggcaga

SEQ ID NO: 18758 - RNA, 18 nt, Artificial Sequence
  Description of Artificial Sequence: Synthetic oligonucleotide
gaaccggaaccugguuug

SEQ ID NO: 18759 - RNA, 18 nt, Artificial Sequence
  Description of Artificial Sequence: Synthetic oligonucleotide
cuguggaaccggaaccug

SEQ ID NO: 18760 - RNA, 18 nt, Artificial Sequence
  Description of Artificial Sequence: Synthetic oligonucleotide
ggaagcuguggaaccgga

SEQ ID NO: 18761 - RNA, 18 nt, Artificial Sequence
  Description of Artificial Sequence: Synthetic oligonucleotide
ggacaggaagcuguggaa

SEQ ID NO: 18762 - RNA, 18 nt, Artificial Sequence
  Description of Artificial Sequence: Synthetic oligonucleotide
agacuggacaggaagcug

SEQ ID NO: 18763 - RNA, 18 nt, Artificial Sequence
  Description of Artificial Sequence: Synthetic oligonucleotide
gucgcagacuggacagga

SEQ ID NO: 18764 - RNA, 18 nt, Artificial Sequence
  Description of Artificial Sequence: Synthetic oligonucleotide
gggaagucgcagacugga

SEQ ID NO: 18765 - RNA, 18 nt, Artificial Sequence
  Description of Artificial Sequence: Synthetic oligonucleotide
gguggguucaggucaggg

SEQ ID NO: 18766 - RNA, 18 nt, Artificial Sequence
  Description of Artificial Sequence: Synthetic oligonucleotide
ggguggguucaggucagg

SEQ ID NO: 18767 - RNA, 18 nt, Artificial Sequence
  Description of Artificial Sequence: Synthetic oligonucleotide
cucuguaaggguccuggg

SEQ ID NO: 18768 - RNA, 18 nt, Artificial Sequence
  Description of Artificial Sequence: Synthetic oligonucleotide
gugcccuggugaggccaa

SEQ ID NO: 18769 - RNA, 18 nt, Artificial Sequence
  Description of Artificial Sequence: Synthetic oligonucleotide
cagaagugcccuggugag

SEQ ID NO: 18770 - RNA, 18 nt, Artificial Sequence
  Description of Artificial Sequence: Synthetic oligonucleotide
gaggucagaagugcccug

SEQ ID NO: 18771 - RNA, 18 nt, Artificial Sequence
  Description of Artificial Sequence: Synthetic oligonucleotide
aaagugaggucagaagug

SEQ ID NO: 18772 - RNA, 18 nt, Artificial Sequence
  Description of Artificial Sequence: Synthetic oligonucleotide
uugugaaagugaggucag

SEQ ID NO: 18773 - RNA, 18 nt, Artificial Sequence
  Description of Artificial Sequence: Synthetic oligonucleotide
uccuauugugaaagugag

SEQ ID NO: 18774 - RNA, 18 nt, Artificial Sequence
  Description of Artificial Sequence: Synthetic oligonucleotide
acugguccuauugugaaa

SEQ ID NO: 18775 - RNA, 18 nt, Artificial Sequence
  Description of Artificial Sequence: Synthetic oligonucleotide
ucaacacugguccuauug

SEQ ID NO: 18776 - RNA, 18 nt, Artificial Sequence
  Description of Artificial Sequence: Synthetic oligonucleotide
ggguaucaacacuggucc

SEQ ID NO: 18777 - RNA, 18 nt, Artificial Sequence
  Description of Artificial Sequence: Synthetic oligonucleotide
aggcuggguaucaacacu

SEQ ID NO: 18778 - RNA, 18 nt, Artificial Sequence
  Description of Artificial Sequence: Synthetic oligonucleotide
ccaagaggcuggguauca

SEQ ID NO: 18779 - RNA, 18 nt, Artificial Sequence
  Description of Artificial Sequence: Synthetic oligonucleotide
gaacaccaagaggcuggg

SEQ ID NO: 18780 - RNA, 18 nt, Artificial Sequence
  Description of Artificial Sequence: Synthetic oligonucleotide
gggaugaacaccaagagg

SEQ ID NO: 18781 - RNA, 18 nt, Artificial Sequence
  Description of Artificial Sequence: Synthetic oligonucleotide
cuugagggaugaacacca

SEQ ID NO: 18782 - RNA, 18 nt, Artificial Sequence
  Description of Artificial Sequence: Synthetic oligonucleotide
ugcuucuugagggaugaa

SEQ ID NO: 18783 - RNA, 18 nt, Artificial Sequence
  Description of Artificial Sequence: Synthetic oligonucleotide
gccagugcuucuugaggg

SEQ ID NO: 18784 - RNA, 18 nt, Artificial Sequence
  Description of Artificial Sequence: Synthetic oligonucleotide
uuucugccagugcuucuu

SEQ ID NO: 18785 - RNA, 18 nt, Artificial Sequence
  Description of Artificial Sequence: Synthetic oligonucleotide
cuggguuucugccagugc

SEQ ID NO: 18786 - RNA, 18 nt, Artificial Sequence
  Description of Artificial Sequence: Synthetic oligonucleotide
gauuccuggguuucugcc

SEQ ID NO: 18787 - RNA, 18 nt, Artificial Sequence
  Description of Artificial Sequence: Synthetic oligonucleotide
aauuugauuccuggguuu

SEQ ID NO: 18788 - RNA, 18 nt, Artificial Sequence
  Description of Artificial Sequence: Synthetic oligonucleotide
ugcccaauuugauuccug

SEQ ID NO: 18789 - RNA, 18 nt, Artificial Sequence
  Description of Artificial Sequence: Synthetic oligonucleotide
uuuugugcccaauuugau

SEQ ID NO: 18790 - RNA, 18 nt, Artificial Sequence
  Description of Artificial Sequence: Synthetic oligonucleotide
accauuuuugugcccaau

SEQ ID NO: 18791 - RNA, 18 nt, Artificial Sequence
  Description of Artificial Sequence: Synthetic oligonucleotide
uccuuaccauuuuugugc

SEQ ID NO: 18792 - RNA, 18 nt, Artificial Sequence
  Description of Artificial Sequence: Synthetic oligonucleotide
ccauuuccuuaccauuuu

SEQ ID NO: 18793 - RNA, 18 nt, Artificial Sequence
  Description of Artificial Sequence: Synthetic oligonucleotide
cuuugccauuuccuuacc

SEQ ID NO: 18794 - RNA, 18 nt, Artificial Sequence
  Description of Artificial Sequence: Synthetic oligonucleotide
aaauacuuugccauuucc

SEQ ID NO: 18795 - RNA, 18 nt, Artificial Sequence
  Description of Artificial Sequence: Synthetic oligonucleotide
guucuaaauacuuugcca

SEQ ID NO: 18796 - RNA, 18 nt, Artificial Sequence
  Description of Artificial Sequence: Synthetic oligonucleotide
gcgaaguucuaaauacuu

SEQ ID NO: 18797 - RNA, 18 nt, Artificial Sequence
  Description of Artificial Sequence: Synthetic oligonucleotide
agcgggcgaaguucuaaa

SEQ ID NO: 18798 - RNA, 18 nt, Artificial Sequence
  Description of Artificial Sequence: Synthetic oligonucleotide
caauuagcgggcgaaguu

SEQ ID NO: 18799 - RNA, 18 nt, Artificial Sequence
  Description of Artificial Sequence: Synthetic oligonucleotide
aaacacaauuagcgggcg

SEQ ID NO: 18800 - RNA, 18 nt, Artificial Sequence
  Description of Artificial Sequence: Synthetic oligonucleotide
uggagaaacacaauuagc

SEQ ID NO: 18801 - RNA, 18 nt, Artificial Sequence
  Description of Artificial Sequence: Synthetic oligonucleotide
gucccuggagaaacacaa

SEQ ID NO: 18802 - RNA, 18 nt, Artificial Sequence
  Description of Artificial Sequence: Synthetic oligonucleotide
aaacagucccuggagaaa

SEQ ID NO: 18803 - RNA, 18 nt, Artificial Sequence
  Description of Artificial Sequence: Synthetic oligonucleotide
gaggaaaacagucccugg

SEQ ID NO: 18804 - RNA, 18 nt, Artificial Sequence
  Description of Artificial Sequence: Synthetic oligonucleotide
uguuugaggaaaacaguc

SEQ ID NO: 18805 - RNA, 18 nt, Artificial Sequence
  Description of Artificial Sequence: Synthetic oligonucleotide
gaggauguuugaggaaaa

SEQ ID NO: 18806 - RNA, 18 nt, Artificial Sequence
  Description of Artificial Sequence: Synthetic oligonucleotide
uuucagaggauguuugag

SEQ ID NO: 18807 - RNA, 18 nt, Artificial Sequence
  Description of Artificial Sequence: Synthetic oligonucleotide
caggauuucagaggaugu

SEQ ID NO: 18808 - RNA, 18 nt, Artificial Sequence
  Description of Artificial Sequence: Synthetic oligonucleotide
aggaccaggauuucagag

SEQ ID NO: 18809 - RNA, 18 nt, Artificial Sequence
  Description of Artificial Sequence: Synthetic oligonucleotide
gauauaggaccaggauuu

SEQ ID NO: 18810 - RNA, 18 nt, Artificial Sequence
  Description of Artificial Sequence: Synthetic oligonucleotide
cugcugauauaggaccag

SEQ ID NO: 18811 - RNA, 18 nt, Artificial Sequence
  Description of Artificial Sequence: Synthetic oligonucleotide
auucccugcugauauagg

SEQ ID NO: 18812 - RNA, 18 nt, Artificial Sequence
  Description of Artificial Sequence: Synthetic oligonucleotide
gccucauucccugcugau

SEQ ID NO: 18813 - RNA, 18 nt, Artificial Sequence
  Description of Artificial Sequence: Synthetic oligonucleotide
cuguggccucauucccug

SEQ ID NO: 18814 - RNA, 18 nt, Artificial Sequence
  Description of Artificial Sequence: Synthetic oligonucleotide
ucagucuguggccucauu

SEQ ID NO: 18815 - RNA, 18 nt, Artificial Sequence
  Description of Artificial Sequence: Synthetic oligonucleotide
ucucaucagucuguggcc

SEQ ID NO: 18816 - RNA, 18 nt, Artificial Sequence
  Description of Artificial Sequence: Synthetic oligonucleotide
uuuccucucaucagucug

SEQ ID NO: 18817 - RNA, 18 nt, Artificial Sequence
  Description of Artificial Sequence: Synthetic oligonucleotide
uaaaauuuccucucauca

SEQ ID NO: 18818 - RNA, 18 nt, Artificial Sequence
  Description of Artificial Sequence: Synthetic oligonucleotide
uaaaauaaaauuuccucu

SEQ ID NO: 18819 - RNA, 18 nt, Artificial Sequence
  Description of Artificial Sequence: Synthetic oligonucleotide
auagcuaaaauaaaauuu

SEQ ID NO: 18820 - RNA, 18 nt, Artificial Sequence
  Description of Artificial Sequence: Synthetic oligonucleotide
uggaaauagcuaaaauaa

SEQ ID NO: 18821 - RNA, 18 nt, Artificial Sequence
  Description of Artificial Sequence: Synthetic oligonucleotide
aaauguggaaauagcuaa

SEQ ID NO: 18822 - RNA, 18 nt, Artificial Sequence
  Description of Artificial Sequence: Synthetic oligonucleotide
gagaaaaauguggaaaua

SEQ ID NO: 18823 - RNA, 18 nt, Artificial Sequence
  Description of Artificial Sequence: Synthetic oligonucleotide
ugaaugagaaaaaugugg

SEQ ID NO: 18824 - RNA, 18 nt, Artificial Sequence
  Description of Artificial Sequence: Synthetic oligonucleotide
ggaccugaaugagaaaaa

SEQ ID NO: 18825 - RNA, 18 nt, Artificial Sequence
  Description of Artificial Sequence: Synthetic oligonucleotide
uuagaggaccugaaugag

SEQ ID NO: 18826 - RNA, 18 nt, Artificial Sequence
  Description of Artificial Sequence: Synthetic oligonucleotide
ccacauuagaggaccuga

SEQ ID NO: 18827 - RNA, 18 nt, Artificial Sequence
  Description of Artificial Sequence: Synthetic oligonucleotide
acuaaccacauuagagga

SEQ ID NO: 18828 - RNA, 18 nt, Artificial Sequence
  Description of Artificial Sequence: Synthetic oligonucleotide
ccacaacuaaccacauua

SEQ ID NO: 18829 - RNA, 18 nt, Artificial Sequence
  Description of Artificial Sequence: Synthetic oligonucleotide
ucaggccacaacuaacca

SEQ ID NO: 18830 - RNA, 18 nt, Artificial Sequence
  Description of Artificial Sequence: Synthetic oligonucleotide
cauuuucaggccacaacu

SEQ ID NO: 18831 - RNA, 18 nt, Artificial Sequence
  Description of Artificial Sequence: Synthetic oligonucleotide
aauaucauuuucaggcca

SEQ ID NO: 18832 - RNA, 18 nt, Artificial Sequence
  Description of Artificial Sequence: Synthetic oligonucleotide
uuggaaauaucauuuuca

SEQ ID NO: 18833 - RNA, 18 nt, Artificial Sequence
  Description of Artificial Sequence: Synthetic oligonucleotide
uucauuuggaaauaucau

SEQ ID NO: 18834 - RNA, 18 nt, Artificial Sequence
  Description of Artificial Sequence: Synthetic oligonucleotide
uccuauucauuuggaaau

SEQ ID NO: 18835 - RNA, 18 nt, Artificial Sequence
  Description of Artificial Sequence: Synthetic oligonucleotide
uuccuuccuauucauuug

SEQ ID NO: 18836 - RNA, 18 nt, Artificial Sequence
  Description of Artificial Sequence: Synthetic oligonucleotide
uuuccuuccuuccuauuc

SEQ ID NO: 18837 - RNA, 18 nt, Artificial Sequence
  Description of Artificial Sequence: Synthetic oligonucleotide
aacaauuuccuuccuucc

SEQ ID NO: 18838 - RNA, 18 nt, Artificial Sequence
  Description of Artificial Sequence: Synthetic oligonucleotide
acaaaaacaauuuccuuc

SEQ ID NO: 18839 - RNA, 18 nt, Artificial Sequence
  Description of Artificial Sequence: Synthetic oligonucleotide
aaacaacaaaaacaauuu

SEQ ID NO: 18840 - RNA, 18 nt, Artificial Sequence
  Description of Artificial Sequence: Synthetic oligonucleotide
aucuuaaacaacaaaaac

SEQ ID NO: 18841 - RNA, 18 nt, Artificial Sequence
  Description of Artificial Sequence: Synthetic oligonucleotide
cuuccaucuuaaacaaca

SEQ ID NO: 18842 - RNA, 18 nt, Artificial Sequence
  Description of Artificial Sequence: Synthetic oligonucleotide
auuuccuuccaucuuaaa

SEQ ID NO: 18843 - RNA, 18 nt, Artificial Sequence
  Description of Artificial Sequence: Synthetic oligonucleotide
ccuauauuuccuuccauc

SEQ ID NO: 18844 - RNA, 18 nt, Artificial Sequence
  Description of Artificial Sequence: Synthetic oligonucleotide
augcaccuauauuuccuu

SEQ ID NO: 18845 - RNA, 18 nt, Artificial Sequence
  Description of Artificial Sequence: Synthetic oligonucleotide
uuuaaaugcaccuauauu

SEQ ID NO: 18846 - RNA, 18 nt, Artificial Sequence
  Description of Artificial Sequence: Synthetic oligonucleotide
cauuuuuuaaaugcaccu

SEQ ID NO: 18847 - RNA, 18 nt, Artificial Sequence
  Description of Artificial Sequence: Synthetic oligonucleotide
agcuccauuuuuuaaaug

SEQ ID NO: 18848 - RNA, 18 nt, Artificial Sequence
  Description of Artificial Sequence: Synthetic oligonucleotide
aaccaagcuccauuuuuu

SEQ ID NO: 18849 - RNA, 18 nt, Artificial Sequence
  Description of Artificial Sequence: Synthetic oligonucleotide
caugcaaccaagcuccau

SEQ ID NO: 18850 - RNA, 18 nt, Artificial Sequence
  Description of Artificial Sequence: Synthetic oligonucleotide
aaaaucaugcaaccaagc

SEQ ID NO: 18851 - RNA, 18 nt, Artificial Sequence
  Description of Artificial Sequence: Synthetic oligonucleotide
gagcgaaaaucaugcaac

SEQ ID NO: 18852 - RNA, 18 nt, Artificial Sequence
  Description of Artificial Sequence: Synthetic oligonucleotide
cucaagagcgaaaaucau

SEQ ID NO: 18853 - RNA, 18 nt, Artificial Sequence
  Description of Artificial Sequence: Synthetic oligonucleotide
gaugacucaagagcgaaa

SEQ ID NO: 18854 - RNA, 18 nt, Artificial Sequence
  Description of Artificial Sequence: Synthetic oligonucleotide
ggcuagaugacucaagag

SEQ ID NO: 18855 - RNA, 18 nt, Artificial Sequence
  Description of Artificial Sequence: Synthetic oligonucleotide
uagagggcuagaugacuc

SEQ ID NO: 18856 - RNA, 18 nt, Artificial Sequence
  Description of Artificial Sequence: Synthetic oligonucleotide
aucauuagagggcuagau

SEQ ID NO: 18857 - RNA, 18 nt, Artificial Sequence
  Description of Artificial Sequence: Synthetic oligonucleotide
aggcaaucauuagagggc

SEQ ID NO: 18858 - RNA, 18 nt, Artificial Sequence
  Description of Artificial Sequence: Synthetic oligonucleotide
guaugaggcaaucauuag

SEQ ID NO: 18859 - RNA, 18 nt, Artificial Sequence
  Description of Artificial Sequence: Synthetic oligonucleotide
caccgguaugaggcaauc

SEQ ID NO: 18860 - RNA, 18 nt, Artificial Sequence
  Description of Artificial Sequence: Synthetic oligonucleotide
guaaucaccgguaugagg

SEQ ID NO: 18861 - RNA, 18 nt, Artificial Sequence
  Description of Artificial Sequence: Synthetic oligonucleotide
cgcucguaaucaccggua

SEQ ID NO: 18862 - RNA, 18 nt, Artificial Sequence
  Description of Artificial Sequence: Synthetic oligonucleotide
aaagccgcucguaaucac

SEQ ID NO: 18863 - RNA, 18 nt, Artificial Sequence
  Description of Artificial Sequence: Synthetic oligonucleotide
caugaaaagccgcucgua

SEQ ID NO: 18864 - RNA, 18 nt, Artificial Sequence
  Description of Artificial Sequence: Synthetic oligonucleotide
gggucaugaaaagccgcu

SEQ ID NO: 18865 - RNA, 18 nt, Artificial Sequence
  Description of Artificial Sequence: Synthetic oligonucleotide
aaaugguacauauggaag

SEQ ID NO: 18866 - RNA, 18 nt, Artificial Sequence
  Description of Artificial Sequence: Synthetic oligonucleotide
uuuuaaaaugguacauau

SEQ ID NO: 18867 - RNA, 18 nt, Artificial Sequence
  Description of Artificial Sequence: Synthetic oligonucleotide
cagcauuuuaaaauggua

SEQ ID NO: 18868 - RNA, 18 nt, Artificial Sequence
  Description of Artificial Sequence: Synthetic oligonucleotide
guaaucagcauuuuaaaa

SEQ ID NO: 18869 - RNA, 18 nt, Artificial Sequence
  Description of Artificial Sequence: Synthetic oligonucleotide
aagaaguaaucagcauuu

SEQ ID NO: 18870 - RNA, 18 nt, Artificial Sequence
  Description of Artificial Sequence: Synthetic oligonucleotide
uucucaagaaguaaucag

SEQ ID NO: 18871 - RNA, 18 nt, Artificial Sequence
  Description of Artificial Sequence: Synthetic oligonucleotide
ucuuauucucaagaagua

SEQ ID NO: 18872 - RNA, 18 nt, Artificial Sequence
  Description of Artificial Sequence: Synthetic oligonucleotide
gcuucucuuauucucaag

SEQ ID NO: 18873 - RNA, 18 nt, Artificial Sequence
  Description of Artificial Sequence: Synthetic oligonucleotide
auuaggcuucucuuauuc

SEQ ID NO: 18874 - RNA, 18 nt, Artificial Sequence
  Description of Artificial Sequence: Synthetic oligonucleotide
cugaaauuaggcuucucu

SEQ ID NO: 18875 - RNA, 18 nt, Artificial Sequence
  Description of Artificial Sequence: Synthetic oligonucleotide
auauucugaaauuaggcu

SEQ ID NO: 18876 - RNA, 18 nt, Artificial Sequence
  Description of Artificial Sequence: Synthetic oligonucleotide
uaaugauauucugaaauu

SEQ ID NO: 18877 - RNA, 18 nt, Artificial Sequence
  Description of Artificial Sequence: Synthetic oligonucleotide
uacccuaaugauauucug

SEQ ID NO: 18878 - RNA, 18 nt, Artificial Sequence
  Description of Artificial Sequence: Synthetic oligonucleotide
auagguacccuaaugaua

SEQ ID NO: 18879 - RNA, 18 nt, Artificial Sequence
  Description of Artificial Sequence: Synthetic oligonucleotide
cuucaauagguacccuaa

SEQ ID NO: 18880 - RNA, 18 nt, Artificial Sequence
  Description of Artificial Sequence: Synthetic oligonucleotide
caagacuucaauagguac

SEQ ID NO: 18881 - RNA, 18 nt, Artificial Sequence
  Description of Artificial Sequence: Synthetic oligonucleotide
gcagucaagacuucaaua

SEQ ID NO: 18882 - RNA, 18 nt, Artificial Sequence
  Description of Artificial Sequence: Synthetic oligonucleotide
uaugugcagucaagacuu

SEQ ID NO: 18883 - RNA, 18 nt, Artificial Sequence
  Description of Artificial Sequence: Synthetic oligonucleotide
cuaaauaugugcagucaa

SEQ ID NO: 18884 - RNA, 18 nt, Artificial Sequence
  Description of Artificial Sequence: Synthetic oligonucleotide
guaugcuaaauaugugca

SEQ ID NO: 18885 - RNA, 18 nt, Artificial Sequence
  Description of Artificial Sequence: Synthetic oligonucleotide
agggaguaugcuaaauau

SEQ ID NO: 18886 - RNA, 18 nt, Artificial Sequence
  Description of Artificial Sequence: Synthetic oligonucleotide
uucccagggaguaugcua

SEQ ID NO: 18887 - RNA, 18 nt, Artificial Sequence
  Description of Artificial Sequence: Synthetic oligonucleotide
uauaauucccagggagua

SEQ ID NO: 18888 - RNA, 18 nt, Artificial Sequence
  Description of Artificial Sequence: Synthetic oligonucleotide
uaaaauauaauucccagg

SEQ ID NO: 18889 - RNA, 18 nt, Artificial Sequence
  Description of Artificial Sequence: Synthetic oligonucleotide
guccuuaaaauauaauuc

SEQ ID NO: 18890 - RNA, 18 nt, Artificial Sequence
  Description of Artificial Sequence: Synthetic oligonucleotide
aaaauguccuuaaaauau

SEQ ID NO: 18891 - RNA, 18 nt, Artificial Sequence
  Description of Artificial Sequence: Synthetic oligonucleotide
auagaaaaauguccuuaa

SEQ ID NO: 18892 - RNA, 18 nt, Artificial Sequence
  Description of Artificial Sequence: Synthetic oligonucleotide
auuuaauagaaaaauguc

SEQ ID NO: 18893 - RNA, 18 nt, Artificial Sequence
  Description of Artificial Sequence: Synthetic oligonucleotide
caaugauuuaauagaaaa

SEQ ID NO: 18894 - RNA, 18 nt, Artificial Sequence
  Description of Artificial Sequence: Synthetic oligonucleotide
auaugcaaugauuuaaua

SEQ ID NO: 18895 - RNA, 18 nt, Artificial Sequence
  Description of Artificial Sequence: Synthetic oligonucleotide
cuuccauaugcaaugauu

SEQ ID NO: 18896 - RNA, 18 nt, Artificial Sequence
  Description of Artificial Sequence: Synthetic oligonucleotide
aguuucuuccauaugcaa

SEQ ID NO: 18897 - RNA, 18 nt, Artificial Sequence
  Description of Artificial Sequence: Synthetic oligonucleotide
uauugaguuucuuccaua

SEQ ID NO: 18898 - RNA, 18 nt, Artificial Sequence
  Description of Artificial Sequence: Synthetic oligonucleotide
uauuauauugaguuucuu

SEQ ID NO: 18899 - RNA, 18 nt, Artificial Sequence
  Description of Artificial Sequence: Synthetic oligonucleotide
ucagcuauuauauugagu

SEQ ID NO: 18900 - RNA, 18 nt, Artificial Sequence
  Description of Artificial Sequence: Synthetic oligonucleotide
aaauaucagcuauuauau

SEQ ID NO: 18901 - RNA, 18 nt, Artificial Sequence
  Description of Artificial Sequence: Synthetic oligonucleotide
caaguaaauaucagcuau

SEQ ID NO: 18902 - RNA, 18 nt, Artificial Sequence
  Description of Artificial Sequence: Synthetic oligonucleotide
gaacccaaguaaauauca

SEQ ID NO: 18903 - RNA, 18 nt, Artificial Sequence
  Description of Artificial Sequence: Synthetic oligonucleotide
auuaagaacccaaguaaa

SEQ ID NO: 18904 - RNA, 18 nt, Artificial Sequence
  Description of Artificial Sequence: Synthetic oligonucleotide
uucugauuaagaacccaa

SEQ ID NO: 18905 - RNA, 18 nt, Artificial Sequence
  Description of Artificial Sequence: Synthetic oligonucleotide
caauguucugauuaagaa

SEQ ID NO: 18906 - RNA, 18 nt, Artificial Sequence
  Description of Artificial Sequence: Synthetic oligonucleotide
acagccaauguucugauu

SEQ ID NO: 18907 - RNA, 18 nt, Artificial Sequence
  Description of Artificial Sequence: Synthetic oligonucleotide
aucacacagccaauguuc

SEQ ID NO: 18908 - RNA, 18 nt, Artificial Sequence
  Description of Artificial Sequence: Synthetic oligonucleotide
ugaaaaucacacagccaa

SEQ ID NO: 18909 - RNA, 18 nt, Artificial Sequence
  Description of Artificial Sequence: Synthetic oligonucleotide
aaucaugaaaaucacaca

SEQ ID NO: 18910 - RNA, 18 nt, Artificial Sequence
  Description of Artificial Sequence: Synthetic oligonucleotide
aucauaaucaugaaaauc

SEQ ID NO: 18911 - RNA, 18 nt, Artificial Sequence
  Description of Artificial Sequence: Synthetic oligonucleotide
ugaaaaucauaaucauga

SEQ ID NO: 18912 - RNA, 18 nt, Artificial Sequence
  Description of Artificial Sequence: Synthetic oligonucleotide
ugcaaugaaaaucauaau

SEQ ID NO: 18913 - RNA, 18 nt, Artificial Sequence
  Description of Artificial Sequence: Synthetic oligonucleotide
uuaauugcaaugaaaauc

SEQ ID NO: 18914 - RNA, 18 nt, Artificial Sequence
  Description of Artificial Sequence: Synthetic oligonucleotide
ucaacuuaauugcaauga

SEQ ID NO: 18915 - RNA, 18 nt, Artificial Sequence
  Description of Artificial Sequence: Synthetic oligonucleotide
aaacaucaacuuaauugc

SEQ ID NO: 18916 - RNA, 18 nt, Artificial Sequence
  Description of Artificial Sequence: Synthetic oligonucleotide
cuacaaaacaucaacuua

SEQ ID NO: 18917 - RNA, 18 nt, Artificial Sequence
  Description of Artificial Sequence: Synthetic oligonucleotide
acugucuacaaaacauca

SEQ ID NO: 18918 - RNA, 18 nt, Artificial Sequence
  Description of Artificial Sequence: Synthetic oligonucleotide
auuucacugucuacaaaa

SEQ ID NO: 18919 - RNA, 18 nt, Artificial Sequence
  Description of Artificial Sequence: Synthetic oligonucleotide
ugguaauuucacugucua

SEQ ID NO: 18920 - RNA, 18 nt, Artificial Sequence
  Description of Artificial Sequence: Synthetic oligonucleotide
guagaugguaauuucacu

SEQ ID NO: 18921 - RNA, 18 nt, Artificial Sequence
  Description of Artificial Sequence: Synthetic oligonucleotide
uuggaguagaugguaauu

SEQ ID NO: 18922 - RNA, 18 nt, Artificial Sequence
  Description of Artificial Sequence: Synthetic oligonucleotide
aucuuuuggaguagaugg

SEQ ID NO: 18923 - RNA, 18 nt, Artificial Sequence
  Description of Artificial Sequence: Synthetic oligonucleotide
uugcaaucuuuuggagua

SEQ ID NO: 18924 - RNA, 18 nt, Artificial Sequence
  Description of Artificial Sequence: Synthetic oligonucleotide
cuauuuugcaaucuuuug

SEQ ID NO: 18925 - RNA, 18 nt, Artificial Sequence
  Description of Artificial Sequence: Synthetic oligonucleotide
aaauucuauuuugcaauc

SEQ ID NO: 18926 - RNA, 18 nt, Artificial Sequence
  Description of Artificial Sequence: Synthetic oligonucleotide
agguuaaauucuauuuug

SEQ ID NO: 18927 - RNA, 18 nt, Artificial Sequence
  Description of Artificial Sequence: Synthetic oligonucleotide
cucuaagguuaaauucua

SEQ ID NO: 18928 - RNA, 18 nt, Artificial Sequence
  Description of Artificial Sequence: Synthetic oligonucleotide
auuggcucuaagguuaaa

SEQ ID NO: 18929 - RNA, 18 nt, Artificial Sequence
  Description of Artificial Sequence: Synthetic oligonucleotide
ccugcauuggcucuaagg

SEQ ID NO: 18930 - RNA, 18 nt, Artificial Sequence
  Description of Artificial Sequence: Synthetic oligonucleotide
uuuucccugcauuggcuc

SEQ ID NO: 18931 - RNA, 18 nt, Artificial Sequence
  Description of Artificial Sequence: Synthetic oligonucleotide
acaaguuuucccugcauu

SEQ ID NO: 18932 - RNA, 18 nt, Artificial Sequence
  Description of Artificial Sequence: Synthetic oligonucleotide
cagaaacaaguuuucccu

SEQ ID NO: 18933 - RNA, 18 nt, Artificial Sequence
  Description of Artificial Sequence: Synthetic oligonucleotide
accugcagaaacaaguuu

SEQ ID NO: 18934 - RNA, 18 nt, Artificial Sequence
  Description of Artificial Sequence: Synthetic oligonucleotide
aaugcaccugcagaaaca

SEQ ID NO: 18935 - RNA, 18 nt, Artificial Sequence
  Description of Artificial Sequence: Synthetic oligonucleotide
caaaaaaugcaccugcag

SEQ ID NO: 18936 - RNA, 18 nt, Artificial Sequence
  Description of Artificial Sequence: Synthetic oligonucleotide
aguuucaaaaaaugcacc

SEQ ID NO: 18937 - RNA, 18 nt, Artificial Sequence
  Description of Artificial Sequence: Synthetic oligonucleotide
guugaaguuucaaaaaau

SEQ ID NO: 18938 - RNA, 18 nt, Artificial Sequence
  Description of Artificial Sequence: Synthetic oligonucleotide
uaucuguugaaguuucaa

SEQ ID NO: 18939 - RNA, 18 nt, Artificial Sequence
  Description of Artificial Sequence: Synthetic oligonucleotide
ccugcuaucuguugaagu

SEQ ID NO: 18940 - RNA, 18 nt, Artificial Sequence
  Description of Artificial Sequence: Synthetic oligonucleotide
uucccccugcuaucuguu

SEQ ID NO: 18941 - RNA, 18 nt, Artificial Sequence
  Description of Artificial Sequence: Synthetic oligonucleotide
uuuuuuucccccugcuau

SEQ ID NO: 18942 - RNA, 18 nt, Artificial Sequence
  Description of Artificial Sequence: Synthetic oligonucleotide
ucacuuuuuuuucccccu

SEQ ID NO: 18943 - RNA, 18 nt, Artificial Sequence
  Description of Artificial Sequence: Synthetic oligonucleotide
uucugucacuuuuuuuuc

SEQ ID NO: 18944 - RNA, 18 nt, Artificial Sequence
  Description of Artificial Sequence: Synthetic oligonucleotide
gauccuucugucacuuuu

SEQ ID NO: 18945 - RNA, 18 nt, Artificial Sequence
  Description of Artificial Sequence: Synthetic oligonucleotide
acugugauccuucuguca

SEQ ID NO: 18946 - RNA, 18 nt, Artificial Sequence
  Description of Artificial Sequence: Synthetic oligonucleotide
gcugaacugugauccuuc

SEQ ID NO: 18947 - RNA, 18 nt, Artificial Sequence
  Description of Artificial Sequence: Synthetic oligonucleotide
auacugcugaacugugau

SEQ ID NO: 18948 - RNA, 18 nt, Artificial Sequence
  Description of Artificial Sequence: Synthetic oligonucleotide
aauucauacugcugaacu

SEQ ID NO: 18949 - RNA, 18 nt, Artificial Sequence
  Description of Artificial Sequence: Synthetic oligonucleotide
cagacaauucauacugcu

SEQ ID NO: 18950 - RNA, 18 nt, Artificial Sequence
  Description of Artificial Sequence: Synthetic oligonucleotide
gccagcagacaauucaua

SEQ ID NO: 18951 - RNA, 18 nt, Artificial Sequence
  Description of Artificial Sequence: Synthetic oligonucleotide
aggcugccagcagacaau

SEQ ID NO: 18952 - RNA, 18 nt, Artificial Sequence
  Description of Artificial Sequence: Synthetic oligonucleotide
uugcaaggcugccagcag

SEQ ID NO: 18953 - RNA, 18 nt, Artificial Sequence
  Description of Artificial Sequence: Synthetic oligonucleotide
ccagauugcaaggcugcc

SEQ ID NO: 18954 - RNA, 18 nt, Artificial Sequence
  Description of Artificial Sequence: Synthetic oligonucleotide
gcacaccagauugcaagg

SEQ ID NO: 18955 - RNA, 18 nt, Artificial Sequence
  Description of Artificial Sequence: Synthetic oligonucleotide
ugccugcacaccagauug

SEQ ID NO: 18956 - RNA, 18 nt, Artificial Sequence
  Description of Artificial Sequence: Synthetic oligonucleotide
cucacugccugcacacca

SEQ ID NO: 18957 - RNA, 18 nt, Artificial Sequence
  Description of Artificial Sequence: Synthetic oligonucleotide
acaaucucacugccugca

SEQ ID NO: 18958 - RNA, 18 nt, Artificial Sequence
  Description of Artificial Sequence: Synthetic oligonucleotide
acaccacaaucucacugc

SEQ ID NO: 18959 - RNA, 18 nt, Artificial Sequence
  Description of Artificial Sequence: Synthetic oligonucleotide
cauguacaccacaaucuc

SEQ ID NO: 18960 - RNA, 18 nt, Artificial Sequence
  Description of Artificial Sequence: Synthetic oligonucleotide
ggugacauguacaccaca

SEQ ID NO: 18961 - RNA, 18 nt, Artificial Sequence
  Description of Artificial Sequence: Synthetic oligonucleotide
aaucaggugacauguaca

SEQ ID NO: 18962 - RNA, 18 nt, Artificial Sequence
  Description of Artificial Sequence: Synthetic oligonucleotide
uguaguccugguggcaug

SEQ ID NO: 18963 - RNA, 18 nt, Artificial Sequence
  Description of Artificial Sequence: Synthetic oligonucleotide
gccccuguaguccuggug

SEQ ID NO: 18964 - RNA, 18 nt, Artificial Sequence
  Description of Artificial Sequence: Synthetic oligonucleotide
acucugccccuguagucc

SEQ ID NO: 18965 - RNA, 18 nt, Artificial Sequence
  Description of Artificial Sequence: Synthetic oligonucleotide
gagacacucugccccugu

SEQ ID NO: 18966 - RNA, 18 nt, Artificial Sequence
  Description of Artificial Sequence: Synthetic oligonucleotide
cagaggagacacucugcc

SEQ ID NO: 18967 - RNA, 18 nt, Artificial Sequence
  Description of Artificial Sequence: Synthetic oligonucleotide
gcugccagaggagacacu

SEQ ID NO: 18968 - RNA, 18 nt, Artificial Sequence
  Description of Artificial Sequence: Synthetic oligonucleotide
ucagagcugccagaggag

SEQ ID NO: 18969 - RNA, 18 nt, Artificial Sequence
  Description of Artificial Sequence: Synthetic oligonucleotide
ugaucucagagcugccag

SEQ ID NO: 18970 - RNA, 18 nt, Artificial Sequence
  Description of Artificial Sequence: Synthetic oligonucleotide
ggauuugaucucagagcu

SEQ ID NO: 18971 - RNA, 18 nt, Artificial Sequence
  Description of Artificial Sequence: Synthetic oligonucleotide
ucaucggauuugaucuca

SEQ ID NO: 18972 - RNA, 18 nt, Artificial Sequence
  Description of Artificial Sequence: Synthetic oligonucleotide
ccucgucaucggauuuga

SEQ ID NO: 18973 - RNA, 18 nt, Artificial Sequence
  Description of Artificial Sequence: Synthetic oligonucleotide
aucacccucgucaucgga

SEQ ID NO: 18974 - RNA, 18 nt, Artificial Sequence
  Description of Artificial Sequence: Synthetic oligonucleotide
uucucaucacccucguca

SEQ ID NO: 18975 - RNA, 18 nt, Artificial Sequence
  Description of Artificial Sequence: Synthetic oligonucleotide
gcagguucucaucacccu

SEQ ID NO: 18976 - RNA, 18 nt, Artificial Sequence
  Description of Artificial Sequence: Synthetic oligonucleotide
gucuugcagguucucauc

SEQ ID NO: 18977 - RNA, 18 nt, Artificial Sequence
  Description of Artificial Sequence: Synthetic oligonucleotide
uucgugucuugcagguuc

SEQ ID NO: 18978 - RNA, 18 nt, Artificial Sequence
  Description of Artificial Sequence: Synthetic oligonucleotide
aagauuucgugucuugca

SEQ ID NO: 18979 - RNA, 18 nt, Artificial Sequence
  Description of Artificial Sequence: Synthetic oligonucleotide
cuccgaagauuucguguc

SEQ ID NO: 18980 - RNA, 18 nt, Artificial Sequence
  Description of Artificial Sequence: Synthetic oligonucleotide
uuguccuccgaagauuuc

SEQ ID NO: 18981 - RNA, 18 nt, Artificial Sequence
  Description of Artificial Sequence: Synthetic oligonucleotide
auuucuuguccuccgaag

SEQ ID NO: 18982 - RNA, 18 nt, Artificial Sequence
  Description of Artificial Sequence: Synthetic oligonucleotide
aucuaauuucuuguccuc

SEQ ID NO: 18983 - RNA, 18 nt, Artificial Sequence
  Description of Artificial Sequence: Synthetic oligonucleotide
ucgucaucuaauuucuug

SEQ ID NO: 18984 - RNA, 18 nt, Artificial Sequence
  Description of Artificial Sequence: Synthetic oligonucleotide
ucuugucgucaucuaauu

SEQ ID NO: 18985 - RNA, 18 nt, Artificial Sequence
  Description of Artificial Sequence: Synthetic oligonucleotide
auccuucuugucgucauc

SEQ ID NO: 18986 - RNA, 18 nt, Artificial Sequence
  Description of Artificial Sequence: Synthetic oligonucleotide
uugauauccuucuugucg

SEQ ID NO: 18987 - RNA, 18 nt, Artificial Sequence
  Description of Artificial Sequence: Synthetic oligonucleotide
uugauuugauauccuucu

SEQ ID NO: 18988 - RNA, 18 nt, Artificial Sequence
  Description of Artificial Sequence: Synthetic oligonucleotide
aguaauugauuugauauc

SEQ ID NO: 18989 - RNA, 18 nt, Artificial Sequence
  Description of Artificial Sequence: Synthetic oligonucleotide
uucacgauggguccccac

SEQ ID NO: 18990 - RNA, 18 nt, Artificial Sequence
  Description of Artificial Sequence: Synthetic oligonucleotide
ccaucuucacgauggguc

SEQ ID NO: 18991 - RNA, 18 nt, Artificial Sequence
  Description of Artificial Sequence: Synthetic oligonucleotide
ccacgccaucuucacgau

SEQ ID NO: 18992 - RNA, 18 nt, Artificial Sequence
  Description of Artificial Sequence: Synthetic oligonucleotide
cagggccacgccaucuuc

SEQ ID NO: 18993 - RNA, 18 nt, Artificial Sequence
  Description of Artificial Sequence: Synthetic oligonucleotide
ccucucagggccacgcca

SEQ ID NO: 18994 - RNA, 18 nt, Artificial Sequence
  Description of Artificial Sequence: Synthetic oligonucleotide
ggcugccucucagggcca

SEQ ID NO: 18995 - RNA, 18 nt, Artificial Sequence
  Description of Artificial Sequence: Synthetic oligonucleotide
agaauggcugccucucag

SEQ ID NO: 18996 - RNA, 18 nt, Artificial Sequence
  Description of Artificial Sequence: Synthetic oligonucleotide
agaagagaauggcugccu

SEQ ID NO: 18997 - RNA, 18 nt, Artificial Sequence
  Description of Artificial Sequence: Synthetic oligonucleotide
uuggcagaagagaauggc

SEQ ID NO: 18998 - RNA, 18 nt, Artificial Sequence
  Description of Artificial Sequence: Synthetic oligonucleotide
cugguuuggcagaagaga

SEQ ID NO: 18999 - RNA, 18 nt, Artificial Sequence
  Description of Artificial Sequence: Synthetic oligonucleotide
ggaaccugguuuggcaga

SEQ ID NO: 19000 - RNA, 18 nt, Artificial Sequence
  Description of Artificial Sequence: Synthetic oligonucleotide
gaaccggaaccugguuug

SEQ ID NO: 19001 - RNA, 18 nt, Artificial Sequence
  Description of Artificial Sequence: Synthetic oligonucleotide
cuguggaaccggaaccug

SEQ ID NO: 19002 - RNA, 18 nt, Artificial Sequence
  Description of Artificial Sequence: Synthetic oligonucleotide
ggaagcuguggaaccgga

SEQ ID NO: 19003 - RNA, 18 nt, Artificial Sequence
  Description of Artificial Sequence: Synthetic oligonucleotide
ggacaggaagcuguggaa

SEQ ID NO: 19004 - RNA, 18 nt, Artificial Sequence
  Description of Artificial Sequence: Synthetic oligonucleotide
agacuggacaggaagcug

SEQ ID NO: 19005 - RNA, 18 nt, Artificial Sequence
  Description of Artificial Sequence: Synthetic oligonucleotide
gucgcagacuggacagga

SEQ ID NO: 19006 - RNA, 18 nt, Artificial Sequence
  Description of Artificial Sequence: Synthetic oligonucleotide
gggaagucgcagacugga

SEQ ID NO: 19007 - RNA, 18 nt, Artificial Sequence
  Description of Artificial Sequence: Synthetic oligonucleotide
gguggguucaggucaggg

SEQ ID NO: 19008 - RNA, 18 nt, Artificial Sequence
  Description of Artificial Sequence: Synthetic oligonucleotide
ggguggguucaggucagg

SEQ ID NO: 19009 - RNA, 18 nt, Artificial Sequence
  Description of Artificial Sequence: Synthetic oligonucleotide
cucuguaaggguccuggg

SEQ ID NO: 19010 - RNA, 18 nt, Artificial Sequence
  Description of Artificial Sequence: Synthetic oligonucleotide
gugcccuggugaggccaa

SEQ ID NO: 19011 - RNA, 18 nt, Artificial Sequence
  Description of Artificial Sequence: Synthetic oligonucleotide
cagaagugcccuggugag

SEQ ID NO: 19012 - RNA, 18 nt, Artificial Sequence
  Description of Artificial Sequence: Synthetic oligonucleotide
gaggucagaagugcccug

SEQ ID NO: 19013 - RNA, 18 nt, Artificial Sequence
  Description of Artificial Sequence: Synthetic oligonucleotide
aaagugaggucagaagug

SEQ ID NO: 19014 - RNA, 18 nt, Artificial Sequence
  Description of Artificial Sequence: Synthetic oligonucleotide
uugugaaagugaggucag

SEQ ID NO: 19015 - RNA, 18 nt, Artificial Sequence
  Description of Artificial Sequence: Synthetic oligonucleotide
uccuauugugaaagugag

SEQ ID NO: 19016 - RNA, 18 nt, Artificial Sequence
  Description of Artificial Sequence: Synthetic oligonucleotide
acugguccuauugugaaa

SEQ ID NO: 19017 - RNA, 18 nt, Artificial Sequence
  Description of Artificial Sequence: Synthetic oligonucleotide
ucaacacugguccuauug

SEQ ID NO: 19018 - RNA, 18 nt, Artificial Sequence
  Description of Artificial Sequence: Synthetic oligonucleotide
ggguaucaacacuggucc

SEQ ID NO: 19019 - RNA, 18 nt, Artificial Sequence
  Description of Artificial Sequence: Synthetic oligonucleotide
aggcuggguaucaacacu

SEQ ID NO: 19020 - RNA, 18 nt, Artificial Sequence
  Description of Artificial Sequence: Synthetic oligonucleotide
ccaagaggcuggguauca

SEQ ID NO: 19021 - RNA, 18 nt, Artificial Sequence
  Description of Artificial Sequence: Synthetic oligonucleotide
gaacaccaagaggcuggg

SEQ ID NO: 19022 - RNA, 18 nt, Artificial Sequence
  Description of Artificial Sequence: Synthetic oligonucleotide
gggaugaacaccaagagg

SEQ ID NO: 19023 - RNA, 18 nt, Artificial Sequence
  Description of Artificial Sequence: Synthetic oligonucleotide
cuugagggaugaacacca

SEQ ID NO: 19024 - RNA, 18 nt, Artificial Sequence
  Description of Artificial Sequence: Synthetic oligonucleotide
ugcuucuugagggaugaa

SEQ ID NO: 19025 - RNA, 18 nt, Artificial Sequence
  Description of Artificial Sequence: Synthetic oligonucleotide
gccagugcuucuugaggg

SEQ ID NO: 19026 - RNA, 18 nt, Artificial Sequence
  Description of Artificial Sequence: Synthetic oligonucleotide
uuucugccagugcuucuu

SEQ ID NO: 19027 - RNA, 18 nt, Artificial Sequence
  Description of Artificial Sequence: Synthetic oligonucleotide
cuggguuucugccagugc

SEQ ID NO: 19028 - RNA, 18 nt, Artificial Sequence
  Description of Artificial Sequence: Synthetic oligonucleotide
gauuccuggguuucugcc

SEQ ID NO: 19029 - RNA, 18 nt, Artificial Sequence
  Description of Artificial Sequence: Synthetic oligonucleotide
aauuugauuccuggguuu

SEQ ID NO: 19030 - RNA, 18 nt, Artificial Sequence
  Description of Artificial Sequence: Synthetic oligonucleotide
ugcccaauuugauuccug

SEQ ID NO: 19031 - RNA, 18 nt, Artificial Sequence
  Description of Artificial Sequence: Synthetic oligonucleotide
uuuugugcccaauuugau

SEQ ID NO: 19032 - RNA, 18 nt, Artificial Sequence
  Description of Artificial Sequence: Synthetic oligonucleotide
accauuuuugugcccaau

SEQ ID NO: 19033 - RNA, 18 nt, Artificial Sequence
  Description of Artificial Sequence: Synthetic oligonucleotide
uccuuaccauuuuugugc

SEQ ID NO: 19034 - RNA, 18 nt, Artificial Sequence
  Description of Artificial Sequence: Synthetic oligonucleotide
ccauuuccuuaccauuuu

SEQ ID NO: 19035 - RNA, 18 nt, Artificial Sequence
  Description of Artificial Sequence: Synthetic oligonucleotide
cuuugccauuuccuuacc

SEQ ID NO: 19036 - RNA, 18 nt, Artificial Sequence
  Description of Artificial Sequence: Synthetic oligonucleotide
aaauacuuugccauuucc

SEQ ID NO: 19037 - RNA, 18 nt, Artificial Sequence
  Description of Artificial Sequence: Synthetic oligonucleotide
guucuaaauacuuugcca

SEQ ID NO: 19038 - RNA, 18 nt, Artificial Sequence
  Description of Artificial Sequence: Synthetic oligonucleotide
gcgaaguucuaaauacuu

SEQ ID NO: 19039 - RNA, 18 nt, Artificial Sequence
  Description of Artificial Sequence: Synthetic oligonucleotide
agcgggcgaaguucuaaa

SEQ ID NO: 19040 - RNA, 18 nt, Artificial Sequence
  Description of Artificial Sequence: Synthetic oligonucleotide
caauuagcgggcgaaguu

SEQ ID NO: 19041 - RNA, 18 nt, Artificial Sequence
  Description of Artificial Sequence: Synthetic oligonucleotide
aaacacaauuagcgggcg

SEQ ID NO: 19042 - RNA, 18 nt, Artificial Sequence
  Description of Artificial Sequence: Synthetic oligonucleotide
uggagaaacacaauuagc

SEQ ID NO: 19043 - RNA, 18 nt, Artificial Sequence
  Description of Artificial Sequence: Synthetic oligonucleotide
gucccuggagaaacacaa

SEQ ID NO: 19044 - RNA, 18 nt, Artificial Sequence
  Description of Artificial Sequence: Synthetic oligonucleotide
aaacagucccuggagaaa

SEQ ID NO: 19045 - RNA, 18 nt, Artificial Sequence
  Description of Artificial Sequence: Synthetic oligonucleotide
gaggaaaacagucccugg

SEQ ID NO: 19046 - RNA, 18 nt, Artificial Sequence
  Description of Artificial Sequence: Synthetic oligonucleotide
uguuugaggaaaacaguc

SEQ ID NO: 19047 - RNA, 18 nt, Artificial Sequence
  Description of Artificial Sequence: Synthetic oligonucleotide
gaggauguuugaggaaaa

SEQ ID NO: 19048 - RNA, 18 nt, Artificial Sequence
  Description of Artificial Sequence: Synthetic oligonucleotide
uuucagaggauguuugag

SEQ ID NO: 19049 - RNA, 18 nt, Artificial Sequence
  Description of Artificial Sequence: Synthetic oligonucleotide
caggauuucagaggaugu

SEQ ID NO: 19050 - RNA, 18 nt, Artificial Sequence
  Description of Artificial Sequence: Synthetic oligonucleotide
aggaccaggauuucagag

SEQ ID NO: 19051 - RNA, 18 nt, Artificial Sequence
  Description of Artificial Sequence: Synthetic oligonucleotide
gauauaggaccaggauuu

SEQ ID NO: 19052 - RNA, 18 nt, Artificial Sequence
  Description of Artificial Sequence: Synthetic oligonucleotide
cugcugauauaggaccag

SEQ ID NO: 19053 - RNA, 18 nt, Artificial Sequence
  Description of Artificial Sequence: Synthetic oligonucleotide
auucccugcugauauagg

SEQ ID NO: 19054 - RNA, 18 nt, Artificial Sequence
  Description of Artificial Sequence: Synthetic oligonucleotide
gccucauucccugcugau

SEQ ID NO: 19055 - RNA, 18 nt, Artificial Sequence
  Description of Artificial Sequence: Synthetic oligonucleotide
cuguggccucauucccug

SEQ ID NO: 19056 - RNA, 18 nt, Artificial Sequence
  Description of Artificial Sequence: Synthetic oligonucleotide
ucagucuguggccucauu

SEQ ID NO: 19057 - RNA, 18 nt, Artificial Sequence
  Description of Artificial Sequence: Synthetic oligonucleotide
ucucaucagucuguggcc

SEQ ID NO: 19058 - RNA, 18 nt, Artificial Sequence
  Description of Artificial Sequence: Synthetic oligonucleotide
uuuccucucaucagucug

SEQ ID NO: 19059 - RNA, 18 nt, Artificial Sequence
  Description of Artificial Sequence: Synthetic oligonucleotide
uaaaauuuccucucauca

SEQ ID NO: 19060 - RNA, 18 nt, Artificial Sequence
  Description of Artificial Sequence: Synthetic oligonucleotide
uaaaauaaaauuuccucu

SEQ ID NO: 19061 - RNA, 18 nt, Artificial Sequence
  Description of Artificial Sequence: Synthetic oligonucleotide
auagcuaaaauaaaauuu

SEQ ID NO: 19062 - RNA, 18 nt, Artificial Sequence
  Description of Artificial Sequence: Synthetic oligonucleotide
uggaaauagcuaaaauaa

SEQ ID NO: 19063 - RNA, 18 nt, Artificial Sequence
  Description of Artificial Sequence: Synthetic oligonucleotide
aaauguggaaauagcuaa

SEQ ID NO: 19064 - RNA, 18 nt, Artificial Sequence
  Description of Artificial Sequence: Synthetic oligonucleotide
gagaaaaauguggaaaua

SEQ ID NO: 19065 - RNA, 18 nt, Artificial Sequence
  Description of Artificial Sequence: Synthetic oligonucleotide
ugaaugagaaaaaugugg

SEQ ID NO: 19066 - RNA, 18 nt, Artificial Sequence
  Description of Artificial Sequence: Synthetic oligonucleotide
ggaccugaaugagaaaaa

SEQ ID NO: 19067 - RNA, 18 nt, Artificial Sequence
  Description of Artificial Sequence: Synthetic oligonucleotide
uuagaggaccugaaugag

SEQ ID NO: 19068 - RNA, 18 nt, Artificial Sequence
  Description of Artificial Sequence: Synthetic oligonucleotide
ccacauuagaggaccuga

SEQ ID NO: 19069 - RNA, 18 nt, Artificial Sequence
  Description of Artificial Sequence: Synthetic oligonucleotide
acuaaccacauuagagga

SEQ ID NO: 19070 - RNA, 18 nt, Artificial Sequence
  Description of Artificial Sequence: Synthetic oligonucleotide
ccacaacuaaccacauua

SEQ ID NO: 19071 - RNA, 18 nt, Artificial Sequence
  Description of Artificial Sequence: Synthetic oligonucleotide
ucaggccacaacuaacca

SEQ ID NO: 19072 - RNA, 18 nt, Artificial Sequence
  Description of Artificial Sequence: Synthetic oligonucleotide
cauuuucaggccacaacu

SEQ ID NO: 19073 - RNA, 18 nt, Artificial Sequence
  Description of Artificial Sequence: Synthetic oligonucleotide
aauaucauuuucaggcca

SEQ ID NO: 19074 - RNA, 18 nt, Artificial Sequence
  Description of Artificial Sequence: Synthetic oligonucleotide
uuggaaauaucauuuuca

SEQ ID NO: 19075 - RNA, 18 nt, Artificial Sequence
  Description of Artificial Sequence: Synthetic oligonucleotide
uucauuuggaaauaucau

SEQ ID NO: 19076 - RNA, 18 nt, Artificial Sequence
  Description of Artificial Sequence: Synthetic oligonucleotide
uccuauucauuuggaaau

SEQ ID NO: 19077 - RNA, 18 nt, Artificial Sequence
  Description of Artificial Sequence: Synthetic oligonucleotide
uuccuuccuauucauuug

SEQ ID NO: 19078 - RNA, 18 nt, Artificial Sequence
  Description of Artificial Sequence: Synthetic oligonucleotide
uuuccuuccuuccuauuc

SEQ ID NO: 19079 - RNA, 18 nt, Artificial Sequence
  Description of Artificial Sequence: Synthetic oligonucleotide
aacaauuuccuuccuucc

SEQ ID NO: 19080 - RNA, 18 nt, Artificial Sequence
  Description of Artificial Sequence: Synthetic oligonucleotide
acaaaaacaauuuccuuc

SEQ ID NO: 19081 - RNA, 18 nt, Artificial Sequence
  Description of Artificial Sequence: Synthetic oligonucleotide
aaacaacaaaaacaauuu

SEQ ID NO: 19082 - RNA, 18 nt, Artificial Sequence
  Description of Artificial Sequence: Synthetic oligonucleotide
aucuuaaacaacaaaaac

SEQ ID NO: 19083 - RNA, 18 nt, Artificial Sequence
  Description of Artificial Sequence: Synthetic oligonucleotide
cuuccaucuuaaacaaca

SEQ ID NO: 19084 - RNA, 18 nt, Artificial Sequence
  Description of Artificial Sequence: Synthetic oligonucleotide
auuuccuuccaucuuaaa

SEQ ID NO: 19085 - RNA, 18 nt, Artificial Sequence
  Description of Artificial Sequence: Synthetic oligonucleotide
ccuauauuuccuuccauc

SEQ ID NO: 19086 - RNA, 18 nt, Artificial Sequence
  Description of Artificial Sequence: Synthetic oligonucleotide
augcaccuauauuuccuu

SEQ ID NO: 19087 - RNA, 18 nt, Artificial Sequence
  Description of Artificial Sequence: Synthetic oligonucleotide
uuuaaaugcaccuauauu

SEQ ID NO: 19088 - RNA, 18 nt, Artificial Sequence
  Description of Artificial Sequence: Synthetic oligonucleotide
cauuuuuuaaaugcaccu

SEQ ID NO: 19089 - RNA, 18 nt, Artificial Sequence
  Description of Artificial Sequence: Synthetic oligonucleotide
agcuccauuuuuuaaaug

SEQ ID NO: 19090 - RNA, 18 nt, Artificial Sequence
  Description of Artificial Sequence: Synthetic oligonucleotide
aaccaagcuccauuuuuu

SEQ ID NO: 19091 - RNA, 18 nt, Artificial Sequence
  Description of Artificial Sequence: Synthetic oligonucleotide
caugcaaccaagcuccau

SEQ ID NO: 19092 - RNA, 18 nt, Artificial Sequence
  Description of Artificial Sequence: Synthetic oligonucleotide
aaaaucaugcaaccaagc

SEQ ID NO: 19093 - RNA, 18 nt, Artificial Sequence
  Description of Artificial Sequence: Synthetic oligonucleotide
gagcgaaaaucaugcaac

SEQ ID NO: 19094 - RNA, 18 nt, Artificial Sequence
  Description of Artificial Sequence: Synthetic oligonucleotide
cucaagagcgaaaaucau

SEQ ID NO: 19095 - RNA, 18 nt, Artificial Sequence
  Description of Artificial Sequence: Synthetic oligonucleotide
gaugacucaagagcgaaa

SEQ ID NO: 19096 - RNA, 18 nt, Artificial Sequence
  Description of Artificial Sequence: Synthetic oligonucleotide
ggcuagaugacucaagag

SEQ ID NO: 19097 - RNA, 18 nt, Artificial Sequence
  Description of Artificial Sequence: Synthetic oligonucleotide
uagagggcuagaugacuc

SEQ ID NO: 19098 - RNA, 18 nt, Artificial Sequence
  Description of Artificial Sequence: Synthetic oligonucleotide
aucauuagagggcuagau

SEQ ID NO: 19099 - RNA, 18 nt, Artificial Sequence
  Description of Artificial Sequence: Synthetic oligonucleotide
aggcaaucauuagagggc

SEQ ID NO: 19100 - RNA, 18 nt, Artificial Sequence
  Description of Artificial Sequence: Synthetic oligonucleotide
guaugaggcaaucauuag

SEQ ID NO: 19101 - RNA, 18 nt, Artificial Sequence
  Description of Artificial Sequence: Synthetic oligonucleotide
caccgguaugaggcaauc

SEQ ID NO: 19102 - RNA, 18 nt, Artificial Sequence
  Description of Artificial Sequence: Synthetic oligonucleotide
guaaucaccgguaugagg

SEQ ID NO: 19103 - RNA, 18 nt, Artificial Sequence
  Description of Artificial Sequence: Synthetic oligonucleotide
cgcucguaaucaccggua

SEQ ID NO: 19104 - RNA, 18 nt, Artificial Sequence
  Description of Artificial Sequence: Synthetic oligonucleotide
aaagccgcucguaaucac

SEQ ID NO: 19105 - RNA, 18 nt, Artificial Sequence
  Description of Artificial Sequence: Synthetic oligonucleotide
caugaaaagccgcucgua

SEQ ID NO: 19106 - RNA, 18 nt, Artificial Sequence
  Description of Artificial Sequence: Synthetic oligonucleotide
gggucaugaaaagccgcu

SEQ ID NO: 19107 - RNA, 18 nt, Artificial Sequence
  Description of Artificial Sequence: Synthetic oligonucleotide
aaaugguacauauggaag

SEQ ID NO: 19108 - RNA, 18 nt, Artificial Sequence
  Description of Artificial Sequence: Synthetic oligonucleotide
uuuuaaaaugguacauau

SEQ ID NO: 19109 - RNA, 18 nt, Artificial Sequence
  Description of Artificial Sequence: Synthetic oligonucleotide
cagcauuuuaaaauggua

SEQ ID NO: 19110 - RNA, 18 nt, Artificial Sequence
  Description of Artificial Sequence: Synthetic oligonucleotide
guaaucagcauuuuaaaa

SEQ ID NO: 19111 - RNA, 18 nt, Artificial Sequence
  Description of Artificial Sequence: Synthetic oligonucleotide
aagaaguaaucagcauuu

SEQ ID NO: 19112 - RNA, 18 nt, Artificial Sequence
  Description of Artificial Sequence: Synthetic oligonucleotide
uucucaagaaguaaucag

SEQ ID NO: 19113 - RNA, 18 nt, Artificial Sequence
  Description of Artificial Sequence: Synthetic oligonucleotide
ucuuauucucaagaagua

SEQ ID NO: 19114 - RNA, 18 nt, Artificial Sequence
  Description of Artificial Sequence: Synthetic oligonucleotide
gcuucucuuauucucaag

SEQ ID NO: 19115 - RNA, 18 nt, Artificial Sequence
  Description of Artificial Sequence: Synthetic oligonucleotide
auuaggcuucucuuauuc

SEQ ID NO: 19116 - RNA, 18 nt, Artificial Sequence
  Description of Artificial Sequence: Synthetic oligonucleotide
cugaaauuaggcuucucu

SEQ ID NO: 19117 - RNA, 18 nt, Artificial Sequence
  Description of Artificial Sequence: Synthetic oligonucleotide
auauucugaaauuaggcu

SEQ ID NO: 19118 - RNA, 18 nt, Artificial Sequence
  Description of Artificial Sequence: Synthetic oligonucleotide
uaaugauauucugaaauu

SEQ ID NO: 19119 - RNA, 18 nt, Artificial Sequence
  Description of Artificial Sequence: Synthetic oligonucleotide
uacccuaaugauauucug

SEQ ID NO: 19120 - RNA, 18 nt, Artificial Sequence
  Description of Artificial Sequence: Synthetic oligonucleotide
auagguacccuaaugaua

SEQ ID NO: 19121 - RNA, 18 nt, Artificial Sequence
  Description of Artificial Sequence: Synthetic oligonucleotide
cuucaauagguacccuaa

SEQ ID NO: 19122 - RNA, 18 nt, Artificial Sequence
  Description of Artificial Sequence: Synthetic oligonucleotide
caagacuucaauagguac

SEQ ID NO: 19123 - RNA, 18 nt, Artificial Sequence
  Description of Artificial Sequence: Synthetic oligonucleotide
gcagucaagacuucaaua

SEQ ID NO: 19124 - RNA, 18 nt, Artificial Sequence
  Description of Artificial Sequence: Synthetic oligonucleotide
uaugugcagucaagacuu

SEQ ID NO: 19125 - RNA, 18 nt, Artificial Sequence
  Description of Artificial Sequence: Synthetic oligonucleotide
cuaaauaugugcagucaa

SEQ ID NO: 19126 - RNA, 18 nt, Artificial Sequence
  Description of Artificial Sequence: Synthetic oligonucleotide
guaugcuaaauaugugca

SEQ ID NO: 19127 - RNA, 18 nt, Artificial Sequence
  Description of Artificial Sequence: Synthetic oligonucleotide
agggaguaugcuaaauau

SEQ ID NO: 19128 - RNA, 18 nt, Artificial Sequence
  Description of Artificial Sequence: Synthetic oligonucleotide
uucccagggaguaugcua

SEQ ID NO: 19129 - RNA, 18 nt, Artificial Sequence
  Description of Artificial Sequence: Synthetic oligonucleotide
uauaauucccagggagua

SEQ ID NO: 19130 - RNA, 18 nt, Artificial Sequence
  Description of Artificial Sequence: Synthetic oligonucleotide
uaaaauauaauucccagg

SEQ ID NO: 19131 - RNA, 18 nt, Artificial Sequence
  Description of Artificial Sequence: Synthetic oligonucleotide
guccuuaaaauauaauuc

SEQ ID NO: 19132 - RNA, 18 nt, Artificial Sequence
  Description of Artificial Sequence: Synthetic oligonucleotide
aaaauguccuuaaaauau

SEQ ID NO: 19133 - RNA, 18 nt, Artificial Sequence
  Description of Artificial Sequence: Synthetic oligonucleotide
auagaaaaauguccuuaa

SEQ ID NO: 19134 - RNA, 18 nt, Artificial Sequence
  Description of Artificial Sequence: Synthetic oligonucleotide
auuuaauagaaaaauguc

SEQ ID NO: 19135 - RNA, 18 nt, Artificial Sequence
  Description of Artificial Sequence: Synthetic oligonucleotide
caaugauuuaauagaaaa

SEQ ID NO: 19136 - RNA, 18 nt, Artificial Sequence
  Description of Artificial Sequence: Synthetic oligonucleotide
auaugcaaugauuuaaua

SEQ ID NO: 19137 - RNA, 18 nt, Artificial Sequence
  Description of Artificial Sequence: Synthetic oligonucleotide
cuuccauaugcaaugauu

SEQ ID NO: 19138 - RNA, 18 nt, Artificial Sequence
  Description of Artificial Sequence: Synthetic oligonucleotide
aguuucuuccauaugcaa

SEQ ID NO: 19139 - RNA, 18 nt, Artificial Sequence
  Description of Artificial Sequence: Synthetic oligonucleotide
uauugaguuucuuccaua

SEQ ID NO: 19140 - RNA, 18 nt, Artificial Sequence
  Description of Artificial Sequence: Synthetic oligonucleotide
uauuauauugaguuucuu

SEQ ID NO: 19141 - RNA, 18 nt, Artificial Sequence
  Description of Artificial Sequence: Synthetic oligonucleotide
ucagcuauuauauugagu

SEQ ID NO: 19142 - RNA, 18 nt, Artificial Sequence
  Description of Artificial Sequence: Synthetic oligonucleotide
aaauaucagcuauuauau

SEQ ID NO: 19143 - RNA, 18 nt, Artificial Sequence
  Description of Artificial Sequence: Synthetic oligonucleotide
caaguaaauaucagcuau

SEQ ID NO: 19144 - RNA, 18 nt, Artificial Sequence
  Description of Artificial Sequence: Synthetic oligonucleotide
gaacccaaguaaauauca

SEQ ID NO: 19145 - RNA, 18 nt, Artificial Sequence
  Description of Artificial Sequence: Synthetic oligonucleotide
auuaagaacccaaguaaa

SEQ ID NO: 19146 - RNA, 18 nt, Artificial Sequence
  Description of Artificial Sequence: Synthetic oligonucleotide
uucugauuaagaacccaa

SEQ ID NO: 19147 - RNA, 18 nt, Artificial Sequence
  Description of Artificial Sequence: Synthetic oligonucleotide
caauguucugauuaagaa

SEQ ID NO: 19148 - RNA, 18 nt, Artificial Sequence
  Description of Artificial Sequence: Synthetic oligonucleotide
acagccaauguucugauu

SEQ ID NO: 19149 - RNA, 18 nt, Artificial Sequence
  Description of Artificial Sequence: Synthetic oligonucleotide
aucacacagccaauguuc

SEQ ID NO: 19150 - RNA, 18 nt, Artificial Sequence
  Description of Artificial Sequence: Synthetic oligonucleotide
ugaaaaucacacagccaa

SEQ ID NO: 19151 - RNA, 18 nt, Artificial Sequence
  Description of Artificial Sequence: Synthetic oligonucleotide
aaucaugaaaaucacaca

SEQ ID NO: 19152 - RNA, 18 nt, Artificial Sequence
  Description of Artificial Sequence: Synthetic oligonucleotide
aucauaaucaugaaaauc

SEQ ID NO: 19153 - RNA, 18 nt, Artificial Sequence
  Description of Artificial Sequence: Synthetic oligonucleotide
ugaaaaucauaaucauga

SEQ ID NO: 19154 - RNA, 18 nt, Artificial Sequence
  Description of Artificial Sequence: Synthetic oligonucleotide
ugcaaugaaaaucauaau

SEQ ID NO: 19155 - RNA, 18 nt, Artificial Sequence
  Description of Artificial Sequence: Synthetic oligonucleotide
uuaauugcaaugaaaauc

SEQ ID NO: 19156 - RNA, 18 nt, Artificial Sequence
  Description of Artificial Sequence: Synthetic oligonucleotide
ucaacuuaauugcaauga

SEQ ID NO: 19157 - RNA, 18 nt, Artificial Sequence
  Description of Artificial Sequence: Synthetic oligonucleotide
aaacaucaacuuaauugc

SEQ ID NO: 19158 - RNA, 18 nt, Artificial Sequence
  Description of Artificial Sequence: Synthetic oligonucleotide
cuacaaaacaucaacuua

SEQ ID NO: 19159 - RNA, 18 nt, Artificial Sequence
  Description of Artificial Sequence: Synthetic oligonucleotide
acugucuacaaaacauca

SEQ ID NO: 19160 - RNA, 18 nt, Artificial Sequence
  Description of Artificial Sequence: Synthetic oligonucleotide
auuucacugucuacaaaa

SEQ ID NO: 19161 - RNA, 18 nt, Artificial Sequence
  Description of Artificial Sequence: Synthetic oligonucleotide
ugguaauuucacugucua

SEQ ID NO: 19162 - RNA, 18 nt, Artificial Sequence
  Description of Artificial Sequence: Synthetic oligonucleotide
guagaugguaauuucacu

SEQ ID NO: 19163 - RNA, 18 nt, Artificial Sequence
  Description of Artificial Sequence: Synthetic oligonucleotide
uuggaguagaugguaauu

SEQ ID NO: 19164 - RNA, 18 nt, Artificial Sequence
  Description of Artificial Sequence: Synthetic oligonucleotide
aucuuuuggaguagaugg

SEQ ID NO: 19165 - RNA, 18 nt, Artificial Sequence
  Description of Artificial Sequence: Synthetic oligonucleotide
uugcaaucuuuuggagua

SEQ ID NO: 19166 - RNA, 18 nt, Artificial Sequence
  Description of Artificial Sequence: Synthetic oligonucleotide
cuauuuugcaaucuuuug

SEQ ID NO: 19167 - RNA, 18 nt, Artificial Sequence
  Description of Artificial Sequence: Synthetic oligonucleotide
aaauucuauuuugcaauc

SEQ ID NO: 19168 - RNA, 18 nt, Artificial Sequence
  Description of Artificial Sequence: Synthetic oligonucleotide
agguuaaauucuauuuug

SEQ ID NO: 19169 - RNA, 18 nt, Artificial Sequence
  Description of Artificial Sequence: Synthetic oligonucleotide
cucuaagguuaaauucua

SEQ ID NO: 19170 - RNA, 18 nt, Artificial Sequence
  Description of Artificial Sequence: Synthetic oligonucleotide
auuggcucuaagguuaaa

SEQ ID NO: 19171 - RNA, 18 nt, Artificial Sequence
  Description of Artificial Sequence: Synthetic oligonucleotide
ccugcauuggcucuaagg

SEQ ID NO: 19172 - RNA, 18 nt, Artificial Sequence
  Description of Artificial Sequence: Synthetic oligonucleotide
uuuucccugcauuggcuc

SEQ ID NO: 19173 - RNA, 18 nt, Artificial Sequence
  Description of Artificial Sequence: Synthetic oligonucleotide
acaaguuuucccugcauu

SEQ ID NO: 19174 - RNA, 18 nt, Artificial Sequence
  Description of Artificial Sequence: Synthetic oligonucleotide
cagaaacaaguuuucccu

SEQ ID NO: 19175 - RNA, 18 nt, Artificial Sequence
  Description of Artificial Sequence: Synthetic oligonucleotide
accugcagaaacaaguuu

SEQ ID NO: 19176 - RNA, 18 nt, Artificial Sequence
  Description of Artificial Sequence: Synthetic oligonucleotide
aaugcaccugcagaaaca

SEQ ID NO: 19177 - RNA, 18 nt, Artificial Sequence
  Description of Artificial Sequence: Synthetic oligonucleotide
caaaaaaugcaccugcag

SEQ ID NO: 19178 - RNA, 18 nt, Artificial Sequence
  Description of Artificial Sequence: Synthetic oligonucleotide
aguuucaaaaaaugcacc

SEQ ID NO: 19179 - RNA, 18 nt, Artificial Sequence
  Description of Artificial Sequence: Synthetic oligonucleotide
guugaaguuucaaaaaau

SEQ ID NO: 19180 - RNA, 18 nt, Artificial Sequence
  Description of Artificial Sequence: Synthetic oligonucleotide
uaucuguugaaguuucaa

SEQ ID NO: 19181 - RNA, 18 nt, Artificial Sequence
  Description of Artificial Sequence: Synthetic oligonucleotide
ccugcuaucuguugaagu

SEQ ID NO: 19182 - RNA, 18 nt, Artificial Sequence
  Description of Artificial Sequence: Synthetic oligonucleotide
uucccccugcuaucuguu

SEQ ID NO: 19183 - RNA, 18 nt, Artificial Sequence
  Description of Artificial Sequence: Synthetic oligonucleotide
uuuuuuucccccugcuau

SEQ ID NO: 19184 - RNA, 18 nt, Artificial Sequence
  Description of Artificial Sequence: Synthetic oligonucleotide
ucacuuuuuuuucccccu

SEQ ID NO: 19185 - RNA, 18 nt, Artificial Sequence
  Description of Artificial Sequence: Synthetic oligonucleotide
uucugucacuuuuuuuuc

SEQ ID NO: 19186 - RNA, 18 nt, Artificial Sequence
  Description of Artificial Sequence: Synthetic oligonucleotide
gauccuucugucacuuuu

SEQ ID NO: 19187 - RNA, 18 nt, Artificial Sequence
  Description of Artificial Sequence: Synthetic oligonucleotide
acugugauccuucuguca

SEQ ID NO: 19188 - RNA, 18 nt, Artificial Sequence
  Description of Artificial Sequence: Synthetic oligonucleotide
gcugaacugugauccuuc

SEQ ID NO: 19189 - RNA, 18 nt, Artificial Sequence
  Description of Artificial Sequence: Synthetic oligonucleotide
auacugcugaacugugau

SEQ ID NO: 19190 - RNA, 18 nt, Artificial Sequence
  Description of Artificial Sequence: Synthetic oligonucleotide
aauucauacugcugaacu

SEQ ID NO: 19191 - RNA, 18 nt, Artificial Sequence
  Description of Artificial Sequence: Synthetic oligonucleotide
cagacaauucauacugcu

SEQ ID NO: 19192 - RNA, 18 nt, Artificial Sequence
  Description of Artificial Sequence: Synthetic oligonucleotide
gccagcagacaauucaua

SEQ ID NO: 19193 - RNA, 18 nt, Artificial Sequence
  Description of Artificial Sequence: Synthetic oligonucleotide
aggcugccagcagacaau

SEQ ID NO: 19194 - RNA, 18 nt, Artificial Sequence
  Description of Artificial Sequence: Synthetic oligonucleotide
uugcaaggcugccagcag

SEQ ID NO: 19195 - RNA, 18 nt, Artificial Sequence
  Description of Artificial Sequence: Synthetic oligonucleotide
ccagauugcaaggcugcc

SEQ ID NO: 19196 - RNA, 18 nt, Artificial Sequence
  Description of Artificial Sequence: Synthetic oligonucleotide
gcacaccagauugcaagg

SEQ ID NO: 19197 - RNA, 18 nt, Artificial Sequence
  Description of Artificial Sequence: Synthetic oligonucleotide
ugccugcacaccagauug

SEQ ID NO: 19198 - RNA, 18 nt, Artificial Sequence
  Description of Artificial Sequence: Synthetic oligonucleotide
cucacugccugcacacca

SEQ ID NO: 19199 - RNA, 18 nt, Artificial Sequence
  Description of Artificial Sequence: Synthetic oligonucleotide
acaaucucacugccugca

SEQ ID NO: 19200 - RNA, 18 nt, Artificial Sequence
  Description of Artificial Sequence: Synthetic oligonucleotide
acaccacaaucucacugc

SEQ ID NO: 19201 - RNA, 18 nt, Artificial Sequence
  Description of Artificial Sequence: Synthetic oligonucleotide
cauguacaccacaaucuc

SEQ ID NO: 19202 - RNA, 18 nt, Artificial Sequence
  Description of Artificial Sequence: Synthetic oligonucleotide
ggugacauguacaccaca

SEQ ID NO: 19203 - RNA, 18 nt, Artificial Sequence
  Description of Artificial Sequence: Synthetic oligonucleotide
aaucaggugacauguaca

SEQ ID NO: 19204 - RNA, 18 nt, Artificial Sequence
  Description of Artificial Sequence: Synthetic oligonucleotide
uguaguccugguggcaug

SEQ ID NO: 19205 - RNA, 18 nt, Artificial Sequence
  Description of Artificial Sequence: Synthetic oligonucleotide
gccccuguaguccuggug

SEQ ID NO: 19206 - RNA, 18 nt, Artificial Sequence
  Description of Artificial Sequence: Synthetic oligonucleotide
acucugccccuguagucc

SEQ ID NO: 19207 - RNA, 18 nt, Artificial Sequence
  Description of Artificial Sequence: Synthetic oligonucleotide
gagacacucugccccugu

SEQ ID NO: 19208 - RNA, 18 nt, Artificial Sequence
  Description of Artificial Sequence: Synthetic oligonucleotide
cagaggagacacucugcc

SEQ ID NO: 19209 - RNA, 18 nt, Artificial Sequence
  Description of Artificial Sequence: Synthetic oligonucleotide
gcugccagaggagacacu

SEQ ID NO: 19210 - RNA, 18 nt, Artificial Sequence
  Description of Artificial Sequence: Synthetic oligonucleotide
ucagagcugccagaggag

SEQ ID NO: 19211 - RNA, 18 nt, Artificial Sequence
  Description of Artificial Sequence: Synthetic oligonucleotide
ugaucucagagcugccag

SEQ ID NO: 19212 - RNA, 18 nt, Artificial Sequence
  Description of Artificial Sequence: Synthetic oligonucleotide
ggauuugaucucagagcu

SEQ ID NO: 19213 - RNA, 18 nt, Artificial Sequence
  Description of Artificial Sequence: Synthetic oligonucleotide
ucaucggauuugaucuca

SEQ ID NO: 19214 - RNA, 18 nt, Artificial Sequence
  Description of Artificial Sequence: Synthetic oligonucleotide
ccucgucaucggauuuga

SEQ ID NO: 19215 - RNA, 18 nt, Artificial Sequence
  Description of Artificial Sequence: Synthetic oligonucleotide
aucacccucgucaucgga

SEQ ID NO: 19216 - RNA, 18 nt, Artificial Sequence
  Description of Artificial Sequence: Synthetic oligonucleotide
uucucaucacccucguca

SEQ ID NO: 19217 - RNA, 18 nt, Artificial Sequence
  Description of Artificial Sequence: Synthetic oligonucleotide
gcagguucucaucacccu

SEQ ID NO: 19218 - RNA, 18 nt, Artificial Sequence
  Description of Artificial Sequence: Synthetic oligonucleotide
gucuugcagguucucauc

SEQ ID NO: 19219 - RNA, 18 nt, Artificial Sequence
  Description of Artificial Sequence: Synthetic oligonucleotide
uucgugucuugcagguuc

SEQ ID NO: 19220 - RNA, 18 nt, Artificial Sequence
  Description of Artificial Sequence: Synthetic oligonucleotide
aagauuucgugucuugca

SEQ ID NO: 19221 - RNA, 18 nt, Artificial Sequence
  Description of Artificial Sequence: Synthetic oligonucleotide
cuccgaagauuucguguc

SEQ ID NO: 19222 - RNA, 18 nt, Artificial Sequence
  Description of Artificial Sequence: Synthetic oligonucleotide
uuguccuccgaagauuuc

SEQ ID NO: 19223 - RNA, 18 nt, Artificial Sequence
  Description of Artificial Sequence: Synthetic oligonucleotide
auuucuuguccuccgaag

SEQ ID NO: 19224 - RNA, 18 nt, Artificial Sequence
  Description of Artificial Sequence: Synthetic oligonucleotide
aucuaauuucuuguccuc

SEQ ID NO: 19225 - RNA, 18 nt, Artificial Sequence
  Description of Artificial Sequence: Synthetic oligonucleotide
ucgucaucuaauuucuug

SEQ ID NO: 19226 - RNA, 18 nt, Artificial Sequence
  Description of Artificial Sequence: Synthetic oligonucleotide
ucuugucgucaucuaauu

SEQ ID NO: 19227 - RNA, 18 nt, Artificial Sequence
  Description of Artificial Sequence: Synthetic oligonucleotide
auccuucuugucgucauc

SEQ ID NO: 19228 - RNA, 18 nt, Artificial Sequence
  Description of Artificial Sequence: Synthetic oligonucleotide
uugauauccuucuugucg

SEQ ID NO: 19229 - RNA, 18 nt, Artificial Sequence
  Description of Artificial Sequence: Synthetic oligonucleotide
uugauuugauauccuucu

SEQ ID NO: 19230 - RNA, 18 nt, Artificial Sequence
  Description of Artificial Sequence: Synthetic oligonucleotide
aguaauugauuugauauc

SEQ ID NO: 19231 - RNA, 18 nt, Artificial Sequence
  Description of Artificial Sequence: Synthetic oligonucleotide
gaccuaguaauugauuug

SEQ ID NO: 19232 - RNA, 18 nt, Artificial Sequence
  Description of Artificial Sequence: Synthetic oligonucleotide
aucuugaccuaguaauug

SEQ ID NO: 19233 - RNA, 18 nt, Artificial Sequence
  Description of Artificial Sequence: Synthetic oligonucleotide
uucacgauggguccccac

SEQ ID NO: 19234 - RNA, 18 nt, Artificial Sequence
  Description of Artificial Sequence: Synthetic oligonucleotide
ccaucuucacgauggguc

SEQ ID NO: 19235 - RNA, 18 nt, Artificial Sequence
  Description of Artificial Sequence: Synthetic oligonucleotide
ccacgccaucuucacgau

SEQ ID NO: 19236 - RNA, 18 nt, Artificial Sequence
  Description of Artificial Sequence: Synthetic oligonucleotide
cagggccacgccaucuuc

SEQ ID NO: 19237 - RNA, 18 nt, Artificial Sequence
  Description of Artificial Sequence: Synthetic oligonucleotide
ccucucagggccacgcca

SEQ ID NO: 19238 - RNA, 18 nt, Artificial Sequence
  Description of Artificial Sequence: Synthetic oligonucleotide
ggcugccucucagggcca

SEQ ID NO: 19239 - RNA, 18 nt, Artificial Sequence
  Description of Artificial Sequence: Synthetic oligonucleotide
agaauggcugccucucag

SEQ ID NO: 19240 - RNA, 18 nt, Artificial Sequence
  Description of Artificial Sequence: Synthetic oligonucleotide
agaagagaauggcugccu

SEQ ID NO: 19241 - RNA, 18 nt, Artificial Sequence
  Description of Artificial Sequence: Synthetic oligonucleotide
uuggcagaagagaauggc

SEQ ID NO: 19242 - RNA, 18 nt, Artificial Sequence
  Description of Artificial Sequence: Synthetic oligonucleotide
cugguuuggcagaagaga

SEQ ID NO: 19243 - RNA, 18 nt, Artificial Sequence
  Description of Artificial Sequence: Synthetic oligonucleotide
ggaaccugguuuggcaga

SEQ ID NO: 19244 - RNA, 18 nt, Artificial Sequence
  Description of Artificial Sequence: Synthetic oligonucleotide
gaaccggaaccugguuug

SEQ ID NO: 19245 - RNA, 18 nt, Artificial Sequence
  Description of Artificial Sequence: Synthetic oligonucleotide
cuguggaaccggaaccug

SEQ ID NO: 19246 - RNA, 18 nt, Artificial Sequence
  Description of Artificial Sequence: Synthetic oligonucleotide
ggaagcuguggaaccgga

SEQ ID NO: 19247 - RNA, 18 nt, Artificial Sequence
  Description of Artificial Sequence: Synthetic oligonucleotide
ggacaggaagcuguggaa

SEQ ID NO: 19248 - RNA, 18 nt, Artificial Sequence
  Description of Artificial Sequence: Synthetic oligonucleotide
agacuggacaggaagcug

SEQ ID NO: 19249 - RNA, 18 nt, Artificial Sequence
  Description of Artificial Sequence: Synthetic oligonucleotide
gucgcagacuggacagga

SEQ ID NO: 19250 - RNA, 18 nt, Artificial Sequence
  Description of Artificial Sequence: Synthetic oligonucleotide
gggaagucgcagacugga

SEQ ID NO: 19251 - RNA, 18 nt, Artificial Sequence
  Description of Artificial Sequence: Synthetic oligonucleotide
gguggguucaggucaggg

SEQ ID NO: 19252 - RNA, 18 nt, Artificial Sequence
  Description of Artificial Sequence: Synthetic oligonucleotide
ggguggguucaggucagg

SEQ ID NO: 19253 - RNA, 18 nt, Artificial Sequence
  Description of Artificial Sequence: Synthetic oligonucleotide
cucuguaaggguccuggg

SEQ ID NO: 19254 - RNA, 18 nt, Artificial Sequence
  Description of Artificial Sequence: Synthetic oligonucleotide
gugcccuggugaggccaa

SEQ ID NO: 19255 - RNA, 18 nt, Artificial Sequence
  Description of Artificial Sequence: Synthetic oligonucleotide
cagaagugcccuggugag

SEQ ID NO: 19256 - RNA, 18 nt, Artificial Sequence
  Description of Artificial Sequence: Synthetic oligonucleotide
gaggucagaagugcccug

SEQ ID NO: 19257 - RNA, 18 nt, Artificial Sequence
  Description of Artificial Sequence: Synthetic oligonucleotide
aaagugaggucagaagug

SEQ ID NO: 19258 - RNA, 18 nt, Artificial Sequence
  Description of Artificial Sequence: Synthetic oligonucleotide
uugugaaagugaggucag

SEQ ID NO: 19259 - RNA, 18 nt, Artificial Sequence
  Description of Artificial Sequence: Synthetic oligonucleotide
uccuauugugaaagugag

SEQ ID NO: 19260 - RNA, 18 nt, Artificial Sequence
  Description of Artificial Sequence: Synthetic oligonucleotide
acugguccuauugugaaa

SEQ ID NO: 19261 - RNA, 18 nt, Artificial Sequence
  Description of Artificial Sequence: Synthetic oligonucleotide
ucaacacugguccuauug

SEQ ID NO: 19262 - RNA, 18 nt, Artificial Sequence
  Description of Artificial Sequence: Synthetic oligonucleotide
ggguaucaacacuggucc

SEQ ID NO: 19263 - RNA, 18 nt, Artificial Sequence
  Description of Artificial Sequence: Synthetic oligonucleotide
aggcuggguaucaacacu

SEQ ID NO: 19264 - RNA, 18 nt, Artificial Sequence
  Description of Artificial Sequence: Synthetic oligonucleotide
ccaagaggcuggguauca

SEQ ID NO: 19265 - RNA, 18 nt, Artificial Sequence
  Description of Artificial Sequence: Synthetic oligonucleotide
gaacaccaagaggcuggg

SEQ ID NO: 19266 - RNA, 18 nt, Artificial Sequence
  Description of Artificial Sequence: Synthetic oligonucleotide
gggaugaacaccaagagg

SEQ ID NO: 19267 - RNA, 18 nt, Artificial Sequence
  Description of Artificial Sequence: Synthetic oligonucleotide
cuugagggaugaacacca

SEQ ID NO: 19268 - RNA, 18 nt, Artificial Sequence
  Description of Artificial Sequence: Synthetic oligonucleotide
ugcuucuugagggaugaa

SEQ ID NO: 19269 - RNA, 18 nt, Artificial Sequence
  Description of Artificial Sequence: Synthetic oligonucleotide
gccagugcuucuugaggg

SEQ ID NO: 19270 - RNA, 18 nt, Artificial Sequence
  Description of Artificial Sequence: Synthetic oligonucleotide
uuucugccagugcuucuu

SEQ ID NO: 19271 - RNA, 18 nt, Artificial Sequence
  Description of Artificial Sequence: Synthetic oligonucleotide
cuggguuucugccagugc

SEQ ID NO: 19272 - RNA, 18 nt, Artificial Sequence
  Description of Artificial Sequence: Synthetic oligonucleotide
gauuccuggguuucugcc

SEQ ID NO: 19273 - RNA, 18 nt, Artificial Sequence
  Description of Artificial Sequence: Synthetic oligonucleotide
aauuugauuccuggguuu

SEQ ID NO: 19274 - RNA, 18 nt, Artificial Sequence
  Description of Artificial Sequence: Synthetic oligonucleotide
ugcccaauuugauuccug

SEQ ID NO: 19275 - RNA, 18 nt, Artificial Sequence
  Description of Artificial Sequence: Synthetic oligonucleotide
uuuugugcccaauuugau

SEQ ID NO: 19276 - RNA, 18 nt, Artificial Sequence
  Description of Artificial Sequence: Synthetic oligonucleotide
accauuuuugugcccaau

SEQ ID NO: 19277 - RNA, 18 nt, Artificial Sequence
  Description of Artificial Sequence: Synthetic oligonucleotide
uccuuaccauuuuugugc

SEQ ID NO: 19278 - RNA, 18 nt, Artificial Sequence
  Description of Artificial Sequence: Synthetic oligonucleotide
ccauuuccuuaccauuuu

SEQ ID NO: 19279 - RNA, 18 nt, Artificial Sequence
  Description of Artificial Sequence: Synthetic oligonucleotide
cuuugccauuuccuuacc

SEQ ID NO: 19280 - RNA, 18 nt, Artificial Sequence
  Description of Artificial Sequence: Synthetic oligonucleotide
aaauacuuugccauuucc

SEQ ID NO: 19281 - RNA, 18 nt, Artificial Sequence
  Description of Artificial Sequence: Synthetic oligonucleotide
guucuaaauacuuugcca

SEQ ID NO: 19282 - RNA, 18 nt, Artificial Sequence
  Description of Artificial Sequence: Synthetic oligonucleotide
gcgaaguucuaaauacuu

SEQ ID NO: 19283 - RNA, 18 nt, Artificial Sequence
  Description of Artificial Sequence: Synthetic oligonucleotide
agcgggcgaaguucuaaa

SEQ ID NO: 19284 - RNA, 18 nt, Artificial Sequence
  Description of Artificial Sequence: Synthetic oligonucleotide
caauuagcgggcgaaguu

SEQ ID NO: 19285 - RNA, 18 nt, Artificial Sequence
  Description of Artificial Sequence: Synthetic oligonucleotide
aaacacaauuagcgggcg

SEQ ID NO: 19286 - RNA, 18 nt, Artificial Sequence
  Description of Artificial Sequence: Synthetic oligonucleotide
uggagaaacacaauuagc

SEQ ID NO: 19287 - RNA, 18 nt, Artificial Sequence
  Description of Artificial Sequence: Synthetic oligonucleotide
gucccuggagaaacacaa

SEQ ID NO: 19288 - RNA, 18 nt, Artificial Sequence
  Description of Artificial Sequence: Synthetic oligonucleotide
aaacagucccuggagaaa

SEQ ID NO: 19289 - RNA, 18 nt, Artificial Sequence
  Description of Artificial Sequence: Synthetic oligonucleotide
gaggaaaacagucccugg

SEQ ID NO: 19290 - RNA, 18 nt, Artificial Sequence
  Description of Artificial Sequence: Synthetic oligonucleotide
uguuugaggaaaacaguc

SEQ ID NO: 19291 - RNA, 18 nt, Artificial Sequence
  Description of Artificial Sequence: Synthetic oligonucleotide
gaggauguuugaggaaaa

SEQ ID NO: 19292 - RNA, 18 nt, Artificial Sequence
  Description of Artificial Sequence: Synthetic oligonucleotide
uuucagaggauguuugag

SEQ ID NO: 19293 - RNA, 18 nt, Artificial Sequence
  Description of Artificial Sequence: Synthetic oligonucleotide
caggauuucagaggaugu

SEQ ID NO: 19294 - RNA, 18 nt, Artificial Sequence
  Description of Artificial Sequence: Synthetic oligonucleotide
aggaccaggauuucagag

SEQ ID NO: 19295 - RNA, 18 nt, Artificial Sequence
  Description of Artificial Sequence: Synthetic oligonucleotide
gauauaggaccaggauuu

SEQ ID NO: 19296 - RNA, 18 nt, Artificial Sequence
  Description of Artificial Sequence: Synthetic oligonucleotide
cugcugauauaggaccag

SEQ ID NO: 19297 - RNA, 18 nt, Artificial Sequence
  Description of Artificial Sequence: Synthetic oligonucleotide
auucccugcugauauagg

SEQ ID NO: 19298 - RNA, 18 nt, Artificial Sequence
  Description of Artificial Sequence: Synthetic oligonucleotide
gccucauucccugcugau

SEQ ID NO: 19299 - RNA, 18 nt, Artificial Sequence
  Description of Artificial Sequence: Synthetic oligonucleotide
cuguggccucauucccug

SEQ ID NO: 19300 - RNA, 18 nt, Artificial Sequence
  Description of Artificial Sequence: Synthetic oligonucleotide
ucagucuguggccucauu

SEQ ID NO: 19301 - RNA, 18 nt, Artificial Sequence
  Description of Artificial Sequence: Synthetic oligonucleotide
ucucaucagucuguggcc

SEQ ID NO: 19302 - RNA, 18 nt, Artificial Sequence
  Description of Artificial Sequence: Synthetic oligonucleotide
uuuccucucaucagucug

SEQ ID NO: 19303 - RNA, 18 nt, Artificial Sequence
  Description of Artificial Sequence: Synthetic oligonucleotide
uaaaauuuccucucauca

SEQ ID NO: 19304 - RNA, 18 nt, Artificial Sequence
  Description of Artificial Sequence: Synthetic oligonucleotide
uaaaauaaaauuuccucu

SEQ ID NO: 19305 - RNA, 18 nt, Artificial Sequence
  Description of Artificial Sequence: Synthetic oligonucleotide
auagcuaaaauaaaauuu

SEQ ID NO: 19306 - RNA, 18 nt, Artificial Sequence
  Description of Artificial Sequence: Synthetic oligonucleotide
uggaaauagcuaaaauaa

SEQ ID NO: 19307 - RNA, 18 nt, Artificial Sequence
  Description of Artificial Sequence: Synthetic oligonucleotide
aaauguggaaauagcuaa

SEQ ID NO: 19308 - RNA, 18 nt, Artificial Sequence
  Description of Artificial Sequence: Synthetic oligonucleotide
gagaaaaauguggaaaua

SEQ ID NO: 19309 - RNA, 18 nt, Artificial Sequence
  Description of Artificial Sequence: Synthetic oligonucleotide
ugaaugagaaaaaugugg

SEQ ID NO: 19310 - RNA, 18 nt, Artificial Sequence
  Description of Artificial Sequence: Synthetic oligonucleotide
ggaccugaaugagaaaaa

SEQ ID NO: 19311 - RNA, 18 nt, Artificial Sequence
  Description of Artificial Sequence: Synthetic oligonucleotide
uuagaggaccugaaugag

SEQ ID NO: 19312 - RNA, 18 nt, Artificial Sequence
  Description of Artificial Sequence: Synthetic oligonucleotide
ccacauuagaggaccuga

SEQ ID NO: 19313 - RNA, 18 nt, Artificial Sequence
  Description of Artificial Sequence: Synthetic oligonucleotide
acuaaccacauuagagga

SEQ ID NO: 19314 - RNA, 18 nt, Artificial Sequence
  Description of Artificial Sequence: Synthetic oligonucleotide
ccacaacuaaccacauua

SEQ ID NO: 19315 - RNA, 18 nt, Artificial Sequence
  Description of Artificial Sequence: Synthetic oligonucleotide
ucaggccacaacuaacca

SEQ ID NO: 19316 - RNA, 18 nt, Artificial Sequence
  Description of Artificial Sequence: Synthetic oligonucleotide
cauuuucaggccacaacu

SEQ ID NO: 19317 - RNA, 18 nt, Artificial Sequence
  Description of Artificial Sequence: Synthetic oligonucleotide
aauaucauuuucaggcca

SEQ ID NO: 19318 - RNA, 18 nt, Artificial Sequence
  Description of Artificial Sequence: Synthetic oligonucleotide
uuggaaauaucauuuuca

SEQ ID NO: 19319 - RNA, 18 nt, Artificial Sequence
  Description of Artificial Sequence: Synthetic oligonucleotide
uucauuuggaaauaucau

SEQ ID NO: 19320 - RNA, 18 nt, Artificial Sequence
  Description of Artificial Sequence: Synthetic oligonucleotide
uccuauucauuuggaaau

SEQ ID NO: 19321 - RNA, 18 nt, Artificial Sequence
  Description of Artificial Sequence: Synthetic oligonucleotide
uuccuuccuauucauuug

SEQ ID NO: 19322 - RNA, 18 nt, Artificial Sequence
  Description of Artificial Sequence: Synthetic oligonucleotide
uuuccuuccuuccuauuc

SEQ ID NO: 19323 - RNA, 18 nt, Artificial Sequence
  Description of Artificial Sequence: Synthetic oligonucleotide
aacaauuuccuuccuucc

SEQ ID NO: 19324 - RNA, 18 nt, Artificial Sequence
  Description of Artificial Sequence: Synthetic oligonucleotide
acaaaaacaauuuccuuc

SEQ ID NO: 19325 - RNA, 18 nt, Artificial Sequence
  Description of Artificial Sequence: Synthetic oligonucleotide
aaacaacaaaaacaauuu

SEQ ID NO: 19326 - RNA, 18 nt, Artificial Sequence
  Description of Artificial Sequence: Synthetic oligonucleotide
aucuuaaacaacaaaaac

SEQ ID NO: 19327 - RNA, 18 nt, Artificial Sequence
  Description of Artificial Sequence: Synthetic oligonucleotide
cuuccaucuuaaacaaca

SEQ ID NO: 19328 - RNA, 18 nt, Artificial Sequence
  Description of Artificial Sequence: Synthetic oligonucleotide
auuuccuuccaucuuaaa

SEQ ID NO: 19329 - RNA, 18 nt, Artificial Sequence
  Description of Artificial Sequence: Synthetic oligonucleotide
ccuauauuuccuuccauc

SEQ ID NO: 19330 - RNA, 18 nt, Artificial Sequence
  Description of Artificial Sequence: Synthetic oligonucleotide
augcaccuauauuuccuu

SEQ ID NO: 19331 - RNA, 18 nt, Artificial Sequence
  Description of Artificial Sequence: Synthetic oligonucleotide
uuuaaaugcaccuauauu

SEQ ID NO: 19332 - RNA, 18 nt, Artificial Sequence
  Description of Artificial Sequence: Synthetic oligonucleotide
cauuuuuuaaaugcaccu

SEQ ID NO: 19333 - RNA, 18 nt, Artificial Sequence
  Description of Artificial Sequence: Synthetic oligonucleotide
agcuccauuuuuuaaaug

SEQ ID NO: 19334 - RNA, 18 nt, Artificial Sequence
  Description of Artificial Sequence: Synthetic oligonucleotide
aaccaagcuccauuuuuu

SEQ ID NO: 19335 - RNA, 18 nt, Artificial Sequence
  Description of Artificial Sequence: Synthetic oligonucleotide
caugcaaccaagcuccau

SEQ ID NO: 19336 - RNA, 18 nt, Artificial Sequence
  Description of Artificial Sequence: Synthetic oligonucleotide
aaaaucaugcaaccaagc

SEQ ID NO: 19337 - RNA, 18 nt, Artificial Sequence
  Description of Artificial Sequence: Synthetic oligonucleotide
gagcgaaaaucaugcaac

SEQ ID NO: 19338 - RNA, 18 nt, Artificial Sequence
  Description of Artificial Sequence: Synthetic oligonucleotide
cucaagagcgaaaaucau

SEQ ID NO: 19339 - RNA, 18 nt, Artificial Sequence
  Description of Artificial Sequence: Synthetic oligonucleotide
gaugacucaagagcgaaa

SEQ ID NO: 19340 - RNA, 18 nt, Artificial Sequence
  Description of Artificial Sequence: Synthetic oligonucleotide
ggcuagaugacucaagag

SEQ ID NO: 19341 - RNA, 18 nt, Artificial Sequence
  Description of Artificial Sequence: Synthetic oligonucleotide
uagagggcuagaugacuc

SEQ ID NO: 19342 - RNA, 18 nt, Artificial Sequence
  Description of Artificial Sequence: Synthetic oligonucleotide
aucauuagagggcuagau

SEQ ID NO: 19343 - RNA, 18 nt, Artificial Sequence
  Description of Artificial Sequence: Synthetic oligonucleotide
aggcaaucauuagagggc

SEQ ID NO: 19344 - RNA, 18 nt, Artificial Sequence
  Description of Artificial Sequence: Synthetic oligonucleotide
guaugaggcaaucauuag

SEQ ID NO: 19345 - RNA, 18 nt, Artificial Sequence
  Description of Artificial Sequence: Synthetic oligonucleotide
caccgguaugaggcaauc

SEQ ID NO: 19346 - RNA, 18 nt, Artificial Sequence
  Description of Artificial Sequence: Synthetic oligonucleotide
guaaucaccgguaugagg

SEQ ID NO: 19347 - RNA, 18 nt, Artificial Sequence
  Description of Artificial Sequence: Synthetic oligonucleotide
cgcucguaaucaccggua

SEQ ID NO: 19348 - RNA, 18 nt, Artificial Sequence
  Description of Artificial Sequence: Synthetic oligonucleotide
aaagccgcucguaaucac

SEQ ID NO: 19349 - RNA, 18 nt, Artificial Sequence
  Description of Artificial Sequence: Synthetic oligonucleotide
caugaaaagccgcucgua

SEQ ID NO: 19350 - RNA, 18 nt, Artificial Sequence
  Description of Artificial Sequence: Synthetic oligonucleotide
gggucaugaaaagccgcu

SEQ ID NO: 19351 - RNA, 18 nt, Artificial Sequence
  Description of Artificial Sequence: Synthetic oligonucleotide
aaaugguacauauggaag

SEQ ID NO: 19352 - RNA, 18 nt, Artificial Sequence
  Description of Artificial Sequence: Synthetic oligonucleotide
uuuuaaaaugguacauau

SEQ ID NO: 19353 - RNA, 18 nt, Artificial Sequence
  Description of Artificial Sequence: Synthetic oligonucleotide
cagcauuuuaaaauggua

SEQ ID NO: 19354 - RNA, 18 nt, Artificial Sequence
  Description of Artificial Sequence: Synthetic oligonucleotide
guaaucagcauuuuaaaa

SEQ ID NO: 19355 - RNA, 18 nt, Artificial Sequence
  Description of Artificial Sequence: Synthetic oligonucleotide
aagaaguaaucagcauuu

SEQ ID NO: 19356 - RNA, 18 nt, Artificial Sequence
  Description of Artificial Sequence: Synthetic oligonucleotide
uucucaagaaguaaucag

SEQ ID NO: 19357 - RNA, 18 nt, Artificial Sequence
  Description of Artificial Sequence: Synthetic oligonucleotide
ucuuauucucaagaagua

SEQ ID NO: 19358 - RNA, 18 nt, Artificial Sequence
  Description of Artificial Sequence: Synthetic oligonucleotide
gcuucucuuauucucaag

SEQ ID NO: 19359 - RNA, 18 nt, Artificial Sequence
  Description of Artificial Sequence: Synthetic oligonucleotide
auuaggcuucucuuauuc

SEQ ID NO: 19360 - RNA, 18 nt, Artificial Sequence
  Description of Artificial Sequence: Synthetic oligonucleotide
cugaaauuaggcuucucu

SEQ ID NO: 19361 - RNA, 18 nt, Artificial Sequence
  Description of Artificial Sequence: Synthetic oligonucleotide
auauucugaaauuaggcu

SEQ ID NO: 19362 - RNA, 18 nt, Artificial Sequence
  Description of Artificial Sequence: Synthetic oligonucleotide
uaaugauauucugaaauu

SEQ ID NO: 19363 - RNA, 18 nt, Artificial Sequence
  Description of Artificial Sequence: Synthetic oligonucleotide
uacccuaaugauauucug

SEQ ID NO: 19364 - RNA, 18 nt, Artificial Sequence
  Description of Artificial Sequence: Synthetic oligonucleotide
auagguacccuaaugaua

SEQ ID NO: 19365 - RNA, 18 nt, Artificial Sequence
  Description of Artificial Sequence: Synthetic oligonucleotide
cuucaauagguacccuaa

SEQ ID NO: 19366 - RNA, 18 nt, Artificial Sequence
  Description of Artificial Sequence: Synthetic oligonucleotide
caagacuucaauagguac

SEQ ID NO: 19367 - RNA, 18 nt, Artificial Sequence
  Description of Artificial Sequence: Synthetic oligonucleotide
gcagucaagacuucaaua

SEQ ID NO: 19368 - RNA, 18 nt, Artificial Sequence
  Description of Artificial Sequence: Synthetic oligonucleotide
uaugugcagucaagacuu

SEQ ID NO: 19369 - RNA, 18 nt, Artificial Sequence
  Description of Artificial Sequence: Synthetic oligonucleotide
cuaaauaugugcagucaa

SEQ ID NO: 19370 - RNA, 18 nt, Artificial Sequence
  Description of Artificial Sequence: Synthetic oligonucleotide
guaugcuaaauaugugca

SEQ ID NO: 19371 - RNA, 18 nt, Artificial Sequence
  Description of Artificial Sequence: Synthetic oligonucleotide
agggaguaugcuaaauau

SEQ ID NO: 19372 - RNA, 18 nt, Artificial Sequence
  Description of Artificial Sequence: Synthetic oligonucleotide
uucccagggaguaugcua

SEQ ID NO: 19373 - RNA, 18 nt, Artificial Sequence
  Description of Artificial Sequence: Synthetic oligonucleotide
uauaauucccagggagua

SEQ ID NO: 19374 - RNA, 18 nt, Artificial Sequence
  Description of Artificial Sequence: Synthetic oligonucleotide
uaaaauauaauucccagg

SEQ ID NO: 19375 - RNA, 18 nt, Artificial Sequence
  Description of Artificial Sequence: Synthetic oligonucleotide
guccuuaaaauauaauuc

SEQ ID NO: 19376 - RNA, 18 nt, Artificial Sequence
  Description of Artificial Sequence: Synthetic oligonucleotide
aaaauguccuuaaaauau

SEQ ID NO: 19377 - RNA, 18 nt, Artificial Sequence
  Description of Artificial Sequence: Synthetic oligonucleotide
auagaaaaauguccuuaa

SEQ ID NO: 19378 - RNA, 18 nt, Artificial Sequence
  Description of Artificial Sequence: Synthetic oligonucleotide
auuuaauagaaaaauguc

SEQ ID NO: 19379 - RNA, 18 nt, Artificial Sequence
  Description of Artificial Sequence: Synthetic oligonucleotide
caaugauuuaauagaaaa

SEQ ID NO: 19380 - RNA, 18 nt, Artificial Sequence
  Description of Artificial Sequence: Synthetic oligonucleotide
auaugcaaugauuuaaua

SEQ ID NO: 19381 - RNA, 18 nt, Artificial Sequence
  Description of Artificial Sequence: Synthetic oligonucleotide
cuuccauaugcaaugauu

SEQ ID NO: 19382 - RNA, 18 nt, Artificial Sequence
  Description of Artificial Sequence: Synthetic oligonucleotide
aguuucuuccauaugcaa

SEQ ID NO: 19383 - RNA, 18 nt, Artificial Sequence
  Description of Artificial Sequence: Synthetic oligonucleotide
uauugaguuucuuccaua

SEQ ID NO: 19384 - RNA, 18 nt, Artificial Sequence
  Description of Artificial Sequence: Synthetic oligonucleotide
uauuauauugaguuucuu

SEQ ID NO: 19385 - RNA, 18 nt, Artificial Sequence
  Description of Artificial Sequence: Synthetic oligonucleotide
ucagcuauuauauugagu

SEQ ID NO: 19386 - RNA, 18 nt, Artificial Sequence
  Description of Artificial Sequence: Synthetic oligonucleotide
aaauaucagcuauuauau

SEQ ID NO: 19387 - RNA, 18 nt, Artificial Sequence
  Description of Artificial Sequence: Synthetic oligonucleotide
caaguaaauaucagcuau

SEQ ID NO: 19388 - RNA, 18 nt, Artificial Sequence
  Description of Artificial Sequence: Synthetic oligonucleotide
gaacccaaguaaauauca

SEQ ID NO: 19389 - RNA, 18 nt, Artificial Sequence
  Description of Artificial Sequence: Synthetic oligonucleotide
auuaagaacccaaguaaa

SEQ ID NO: 19390 - RNA, 18 nt, Artificial Sequence
  Description of Artificial Sequence: Synthetic oligonucleotide
uucugauuaagaacccaa

SEQ ID NO: 19391 - RNA, 18 nt, Artificial Sequence
  Description of Artificial Sequence: Synthetic oligonucleotide
caauguucugauuaagaa

SEQ ID NO: 19392 - RNA, 18 nt, Artificial Sequence
  Description of Artificial Sequence: Synthetic oligonucleotide
acagccaauguucugauu

SEQ ID NO: 19393 - RNA, 18 nt, Artificial Sequence
  Description of Artificial Sequence: Synthetic oligonucleotide
aucacacagccaauguuc

SEQ ID NO: 19394 - RNA, 18 nt, Artificial Sequence
  Description of Artificial Sequence: Synthetic oligonucleotide
ugaaaaucacacagccaa

SEQ ID NO: 19395 - RNA, 18 nt, Artificial Sequence
  Description of Artificial Sequence: Synthetic oligonucleotide
aaucaugaaaaucacaca

SEQ ID NO: 19396 - RNA, 18 nt, Artificial Sequence
  Description of Artificial Sequence: Synthetic oligonucleotide
aucauaaucaugaaaauc

SEQ ID NO: 19397 - RNA, 18 nt, Artificial Sequence
  Description of Artificial Sequence: Synthetic oligonucleotide
ugaaaaucauaaucauga

SEQ ID NO: 19398 - RNA, 18 nt, Artificial Sequence
  Description of Artificial Sequence: Synthetic oligonucleotide
ugcaaugaaaaucauaau

SEQ ID NO: 19399 - RNA, 18 nt, Artificial Sequence
  Description of Artificial Sequence: Synthetic oligonucleotide
uuaauugcaaugaaaauc

SEQ ID NO: 19400 - RNA, 18 nt, Artificial Sequence
  Description of Artificial Sequence: Synthetic oligonucleotide
ucaacuuaauugcaauga

SEQ ID NO: 19401 - RNA, 18 nt, Artificial Sequence
  Description of Artificial Sequence: Synthetic oligonucleotide
aaacaucaacuuaauugc

SEQ ID NO: 19402 - RNA, 18 nt, Artificial Sequence
  Description of Artificial Sequence: Synthetic oligonucleotide
cuacaaaacaucaacuua

SEQ ID NO: 19403 - RNA, 18 nt, Artificial Sequence
  Description of Artificial Sequence: Synthetic oligonucleotide
acugucuacaaaacauca

SEQ ID NO: 19404 - RNA, 18 nt, Artificial Sequence
  Description of Artificial Sequence: Synthetic oligonucleotide
auuucacugucuacaaaa

SEQ ID NO: 19405 - RNA, 18 nt, Artificial Sequence
  Description of Artificial Sequence: Synthetic oligonucleotide
ugguaauuucacugucua

SEQ ID NO: 19406 - RNA, 18 nt, Artificial Sequence
  Description of Artificial Sequence: Synthetic oligonucleotide
guagaugguaauuucacu

SEQ ID NO: 19407 - RNA, 18 nt, Artificial Sequence
  Description of Artificial Sequence: Synthetic oligonucleotide
uuggaguagaugguaauu

SEQ ID NO: 19408 - RNA, 18 nt, Artificial Sequence
  Description of Artificial Sequence: Synthetic oligonucleotide
aucuuuuggaguagaugg

SEQ ID NO: 19409 - RNA, 18 nt, Artificial Sequence
  Description of Artificial Sequence: Synthetic oligonucleotide
uugcaaucuuuuggagua

SEQ ID NO: 19410 - RNA, 18 nt, Artificial Sequence
  Description of Artificial Sequence: Synthetic oligonucleotide
cuauuuugcaaucuuuug

SEQ ID NO: 19411 - RNA, 18 nt, Artificial Sequence
  Description of Artificial Sequence: Synthetic oligonucleotide
aaauucuauuuugcaauc

SEQ ID NO: 19412 - RNA, 18 nt, Artificial Sequence
  Description of Artificial Sequence: Synthetic oligonucleotide
agguuaaauucuauuuug

SEQ ID NO: 19413 - RNA, 18 nt, Artificial Sequence
  Description of Artificial Sequence: Synthetic oligonucleotide
cucuaagguuaaauucua

SEQ ID NO: 19414 - RNA, 18 nt, Artificial Sequence
  Description of Artificial Sequence: Synthetic oligonucleotide
auuggcucuaagguuaaa

SEQ ID NO: 19415 - RNA, 18 nt, Artificial Sequence
  Description of Artificial Sequence: Synthetic oligonucleotide
ccugcauuggcucuaagg

SEQ ID NO: 19416 - RNA, 18 nt, Artificial Sequence
  Description of Artificial Sequence: Synthetic oligonucleotide
uuuucccugcauuggcuc

SEQ ID NO: 19417 - RNA, 18 nt, Artificial Sequence
  Description of Artificial Sequence: Synthetic oligonucleotide
acaaguuuucccugcauu

SEQ ID NO: 19418 - RNA, 18 nt, Artificial Sequence
  Description of Artificial Sequence: Synthetic oligonucleotide
cagaaacaaguuuucccu

SEQ ID NO: 19419 - RNA, 18 nt, Artificial Sequence
  Description of Artificial Sequence: Synthetic oligonucleotide
accugcagaaacaaguuu

SEQ ID NO: 19420 - RNA, 18 nt, Artificial Sequence
  Description of Artificial Sequence: Synthetic oligonucleotide
aaugcaccugcagaaaca

SEQ ID NO: 19421 - RNA, 18 nt, Artificial Sequence
  Description of Artificial Sequence: Synthetic oligonucleotide
caaaaaaugcaccugcag

SEQ ID NO: 19422 - RNA, 18 nt, Artificial Sequence
  Description of Artificial Sequence: Synthetic oligonucleotide
aguuucaaaaaaugcacc

SEQ ID NO: 19423 - RNA, 18 nt, Artificial Sequence
  Description of Artificial Sequence: Synthetic oligonucleotide
guugaaguuucaaaaaau

SEQ ID NO: 19424 - RNA, 18 nt, Artificial Sequence
  Description of Artificial Sequence: Synthetic oligonucleotide
uaucuguugaaguuucaa

SEQ ID NO: 19425 - RNA, 18 nt, Artificial Sequence
  Description of Artificial Sequence: Synthetic oligonucleotide
ccugcuaucuguugaagu

SEQ ID NO: 19426 - RNA, 18 nt, Artificial Sequence
  Description of Artificial Sequence: Synthetic oligonucleotide
uucccccugcuaucuguu

SEQ ID NO: 19427 - RNA, 18 nt, Artificial Sequence
  Description of Artificial Sequence: Synthetic oligonucleotide
uuuuuuucccccugcuau

SEQ ID NO: 19428 - RNA, 18 nt, Artificial Sequence
  Description of Artificial Sequence: Synthetic oligonucleotide
ucacuuuuuuuucccccu

SEQ ID NO: 19429 - RNA, 18 nt, Artificial Sequence
  Description of Artificial Sequence: Synthetic oligonucleotide
uucugucacuuuuuuuuc

SEQ ID NO: 19430 - RNA, 18 nt, Artificial Sequence
  Description of Artificial Sequence: Synthetic oligonucleotide
gauccuucugucacuuuu

SEQ ID NO: 19431 - RNA, 18 nt, Artificial Sequence
  Description of Artificial Sequence: Synthetic oligonucleotide
acugugauccuucuguca

SEQ ID NO: 19432 - RNA, 18 nt, Artificial Sequence
  Description of Artificial Sequence: Synthetic oligonucleotide
gcugaacugugauccuuc

SEQ ID NO: 19433 - RNA, 18 nt, Artificial Sequence
  Description of Artificial Sequence: Synthetic oligonucleotide
auacugcugaacugugau

SEQ ID NO: 19434 - RNA, 18 nt, Artificial Sequence
  Description of Artificial Sequence: Synthetic oligonucleotide
aauucauacugcugaacu

SEQ ID NO: 19435 - RNA, 18 nt, Artificial Sequence
  Description of Artificial Sequence: Synthetic oligonucleotide
cagacaauucauacugcu

SEQ ID NO: 19436 - RNA, 18 nt, Artificial Sequence
  Description of Artificial Sequence: Synthetic oligonucleotide
gccagcagacaauucaua

SEQ ID NO: 19437 - RNA, 18 nt, Artificial Sequence
  Description of Artificial Sequence: Synthetic oligonucleotide
aggcugccagcagacaau

SEQ ID NO: 19438 - RNA, 18 nt, Artificial Sequence
  Description of Artificial Sequence: Synthetic oligonucleotide
uugcaaggcugccagcag

SEQ ID NO: 19439 - RNA, 18 nt, Artificial Sequence
  Description of Artificial Sequence: Synthetic oligonucleotide
ccagauugcaaggcugcc

SEQ ID NO: 19440 - RNA, 18 nt, Artificial Sequence
  Description of Artificial Sequence: Synthetic oligonucleotide
gcacaccagauugcaagg

SEQ ID NO: 19441 - RNA, 18 nt, Artificial Sequence
  Description of Artificial Sequence: Synthetic oligonucleotide
ugccugcacaccagauug

SEQ ID NO: 19442 - RNA, 18 nt, Artificial Sequence
  Description of Artificial Sequence: Synthetic oligonucleotide
cucacugccugcacacca

SEQ ID NO: 19443 - RNA, 18 nt, Artificial Sequence
  Description of Artificial Sequence: Synthetic oligonucleotide
acaaucucacugccugca

SEQ ID NO: 19444 - RNA, 18 nt, Artificial Sequence
  Description of Artificial Sequence: Synthetic oligonucleotide
acaccacaaucucacugc

SEQ ID NO: 19445 - RNA, 18 nt, Artificial Sequence
  Description of Artificial Sequence: Synthetic oligonucleotide
cauguacaccacaaucuc

SEQ ID NO: 19446 - RNA, 18 nt, Artificial Sequence
  Description of Artificial Sequence: Synthetic oligonucleotide
ggugacauguacaccaca

SEQ ID NO: 19447 - RNA, 18 nt, Artificial Sequence
  Description of Artificial Sequence: Synthetic oligonucleotide
aaucaggugacauguaca

SEQ ID NO: 19448 - RNA, 18 nt, Artificial Sequence
  Description of Artificial Sequence: Synthetic oligonucleotide
uguaguccugguggcaug

SEQ ID NO: 19449 - RNA, 18 nt, Artificial Sequence
  Description of Artificial Sequence: Synthetic oligonucleotide
gccccuguaguccuggug

SEQ ID NO: 19450 - RNA, 18 nt, Artificial Sequence
  Description of Artificial Sequence: Synthetic oligonucleotide
acucugccccuguagucc

SEQ ID NO: 19451 - RNA, 18 nt, Artificial Sequence
  Description of Artificial Sequence: Synthetic oligonucleotide
gagacacucugccccugu

SEQ ID NO: 19452 - RNA, 18 nt, Artificial Sequence
  Description of Artificial Sequence: Synthetic oligonucleotide
cagaggagacacucugcc

SEQ ID NO: 19453 - RNA, 18 nt, Artificial Sequence
  Description of Artificial Sequence: Synthetic oligonucleotide
gcugccagaggagacacu

SEQ ID NO: 19454 - RNA, 18 nt, Artificial Sequence
  Description of Artificial Sequence: Synthetic oligonucleotide
ucagagcugccagaggag

SEQ ID NO: 19455 - RNA, 18 nt, Artificial Sequence
  Description of Artificial Sequence: Synthetic oligonucleotide
ugaucucagagcugccag

SEQ ID NO: 19456 - RNA, 18 nt, Artificial Sequence
  Description of Artificial Sequence: Synthetic oligonucleotide
ggauuugaucucagagcu

SEQ ID NO: 19457 - RNA, 18 nt, Artificial Sequence
  Description of Artificial Sequence: Synthetic oligonucleotide
ucaucggauuugaucuca

SEQ ID NO: 19458 - RNA, 18 nt, Artificial Sequence
  Description of Artificial Sequence: Synthetic oligonucleotide
ccucgucaucggauuuga

SEQ ID NO: 19459 - RNA, 18 nt, Artificial Sequence
  Description of Artificial Sequence: Synthetic oligonucleotide
aucacccucgucaucgga

SEQ ID NO: 19460 - RNA, 18 nt, Artificial Sequence
  Description of Artificial Sequence: Synthetic oligonucleotide
uucucaucacccucguca

SEQ ID NO: 19461 - RNA, 18 nt, Artificial Sequence
  Description of Artificial Sequence: Synthetic oligonucleotide
gcagguucucaucacccu

SEQ ID NO: 19462 - RNA, 18 nt, Artificial Sequence
  Description of Artificial Sequence: Synthetic oligonucleotide
gucuugcagguucucauc

SEQ ID NO: 19463 - RNA, 18 nt, Artificial Sequence
  Description of Artificial Sequence: Synthetic oligonucleotide
uucgugucuugcagguuc

SEQ ID NO: 19464 - RNA, 18 nt, Artificial Sequence
  Description of Artificial Sequence: Synthetic oligonucleotide
aagauuucgugucuugca

SEQ ID NO: 19465 - RNA, 18 nt, Artificial Sequence
  Description of Artificial Sequence: Synthetic oligonucleotide
cuccgaagauuucguguc

SEQ ID NO: 19466 - RNA, 18 nt, Artificial Sequence
  Description of Artificial Sequence: Synthetic oligonucleotide
uuguccuccgaagauuuc

SEQ ID NO: 19467 - RNA, 18 nt, Artificial Sequence
  Description of Artificial Sequence: Synthetic oligonucleotide
auuucuuguccuccgaag

SEQ ID NO: 19468 - RNA, 18 nt, Artificial Sequence
  Description of Artificial Sequence: Synthetic oligonucleotide
aucuaauuucuuguccuc

SEQ ID NO: 19469 - RNA, 18 nt, Artificial Sequence
  Description of Artificial Sequence: Synthetic oligonucleotide
ucgucaucuaauuucuug

SEQ ID NO: 19470 - RNA, 18 nt, Artificial Sequence
  Description of Artificial Sequence: Synthetic oligonucleotide
ucuugucgucaucuaauu

SEQ ID NO: 19471 - RNA, 18 nt, Artificial Sequence
  Description of Artificial Sequence: Synthetic oligonucleotide
auccuucuugucgucauc

SEQ ID NO: 19472 - RNA, 18 nt, Artificial Sequence
  Description of Artificial Sequence: Synthetic oligonucleotide
uugauauccuucuugucg

SEQ ID NO: 19473 - RNA, 18 nt, Artificial Sequence
  Description of Artificial Sequence: Synthetic oligonucleotide
uugauuugauauccuucu

SEQ ID NO: 19474 - RNA, 18 nt, Artificial Sequence
  Description of Artificial Sequence: Synthetic oligonucleotide
aguaauugauuugauauc

SEQ ID NO: 19475 - RNA, 18 nt, Artificial Sequence
  Description of Artificial Sequence: Synthetic oligonucleotide
gaccuaguaauugauuug

SEQ ID NO: 19476 - RNA, 18 nt, Artificial Sequence
  Description of Artificial Sequence: Synthetic oligonucleotide
aucuugaccuaguaauug

SEQ ID NO: 19477 - RNA, 18 nt, Artificial Sequence
  Description of Artificial Sequence: Synthetic oligonucleotide
uucacgauggguccccac

SEQ ID NO: 19478 - RNA, 18 nt, Artificial Sequence
  Description of Artificial Sequence: Synthetic oligonucleotide
ccaucuucacgauggguc

SEQ ID NO: 19479 - RNA, 18 nt, Artificial Sequence
  Description of Artificial Sequence: Synthetic oligonucleotide
ccacgccaucuucacgau

SEQ ID NO: 19480 - RNA, 18 nt, Artificial Sequence
  Description of Artificial Sequence: Synthetic oligonucleotide
cagggccacgccaucuuc

SEQ ID NO: 19481 - RNA, 18 nt, Artificial Sequence
  Description of Artificial Sequence: Synthetic oligonucleotide
ccucucagggccacgcca

SEQ ID NO: 19482 - RNA, 18 nt, Artificial Sequence
  Description of Artificial Sequence: Synthetic oligonucleotide
ggcugccucucagggcca

SEQ ID NO: 19483 - RNA, 18 nt, Artificial Sequence
  Description of Artificial Sequence: Synthetic oligonucleotide
agaauggcugccucucag

SEQ ID NO: 19484 - RNA, 18 nt, Artificial Sequence
  Description of Artificial Sequence: Synthetic oligonucleotide
agaagagaauggcugccu

SEQ ID NO: 19485 - RNA, 18 nt, Artificial Sequence
  Description of Artificial Sequence: Synthetic oligonucleotide
uuggcagaagagaauggc

SEQ ID NO: 19486 - RNA, 18 nt, Artificial Sequence
  Description of Artificial Sequence: Synthetic oligonucleotide
cugguuuggcagaagaga

SEQ ID NO: 19487 - RNA, 18 nt, Artificial Sequence
  Description of Artificial Sequence: Synthetic oligonucleotide
ggaaccugguuuggcaga

SEQ ID NO: 19488 - RNA, 18 nt, Artificial Sequence
  Description of Artificial Sequence: Synthetic oligonucleotide
gaaccggaaccugguuug

SEQ ID NO: 19489 - RNA, 18 nt, Artificial Sequence
  Description of Artificial Sequence: Synthetic oligonucleotide
cuguggaaccggaaccug

SEQ ID NO: 19490 - RNA, 18 nt, Artificial Sequence
  Description of Artificial Sequence: Synthetic oligonucleotide
ggaagcuguggaaccgga

SEQ ID NO: 19491 - RNA, 18 nt, Artificial Sequence
  Description of Artificial Sequence: Synthetic oligonucleotide
ggacaggaagcuguggaa

SEQ ID NO: 19492 - RNA, 18 nt, Artificial Sequence
  Description of Artificial Sequence: Synthetic oligonucleotide
agacuggacaggaagcug

SEQ ID NO: 19493 - RNA, 18 nt, Artificial Sequence
  Description of Artificial Sequence: Synthetic oligonucleotide
gucgcagacuggacagga

SEQ ID NO: 19494 - RNA, 18 nt, Artificial Sequence
  Description of Artificial Sequence: Synthetic oligonucleotide
gggaagucgcagacugga

SEQ ID NO: 19495 - RNA, 18 nt, Artificial Sequence
  Description of Artificial Sequence: Synthetic oligonucleotide
gguggguucaggucaggg

SEQ ID NO: 19496 - RNA, 18 nt, Artificial Sequence
  Description of Artificial Sequence: Synthetic oligonucleotide
ggguggguucaggucagg

SEQ ID NO: 19497 - RNA, 18 nt, Artificial Sequence
  Description of Artificial Sequence: Synthetic oligonucleotide
cucuguaaggguccuggg

SEQ ID NO: 19498 - RNA, 18 nt, Artificial Sequence
  Description of Artificial Sequence: Synthetic oligonucleotide
gugcccuggugaggccaa

SEQ ID NO: 19499 - RNA, 18 nt, Artificial Sequence
  Description of Artificial Sequence: Synthetic oligonucleotide
cagaagugcccuggugag

SEQ ID NO: 19500 - RNA, 18 nt, Artificial Sequence
  Description of Artificial Sequence: Synthetic oligonucleotide
gaggucagaagugcccug

SEQ ID NO: 19501 - RNA, 18 nt, Artificial Sequence
  Description of Artificial Sequence: Synthetic oligonucleotide
aaagugaggucagaagug

SEQ ID NO: 19502 - RNA, 18 nt, Artificial Sequence
  Description of Artificial Sequence: Synthetic oligonucleotide
uugugaaagugaggucag

SEQ ID NO: 19503 - RNA, 18 nt, Artificial Sequence
  Description of Artificial Sequence: Synthetic oligonucleotide
uccuauugugaaagugag

SEQ ID NO: 19504 - RNA, 18 nt, Artificial Sequence
  Description of Artificial Sequence: Synthetic oligonucleotide
acugguccuauugugaaa

SEQ ID NO: 19505 - RNA, 18 nt, Artificial Sequence
  Description of Artificial Sequence: Synthetic oligonucleotide
ucaacacugguccuauug

SEQ ID NO: 19506 - RNA, 18 nt, Artificial Sequence
  Description of Artificial Sequence: Synthetic oligonucleotide
ggguaucaacacuggucc

SEQ ID NO: 19507 - RNA, 18 nt, Artificial Sequence
  Description of Artificial Sequence: Synthetic oligonucleotide
aggcuggguaucaacacu

SEQ ID NO: 19508 - RNA, 18 nt, Artificial Sequence
  Description of Artificial Sequence: Synthetic oligonucleotide
ccaagaggcuggguauca

SEQ ID NO: 19509 - RNA, 18 nt, Artificial Sequence
  Description of Artificial Sequence: Synthetic oligonucleotide
gaacaccaagaggcuggg

SEQ ID NO: 19510 - RNA, 18 nt, Artificial Sequence
  Description of Artificial Sequence: Synthetic oligonucleotide
gggaugaacaccaagagg

SEQ ID NO: 19511 - RNA, 18 nt, Artificial Sequence
  Description of Artificial Sequence: Synthetic oligonucleotide
cuugagggaugaacacca

SEQ ID NO: 19512 - RNA, 18 nt, Artificial Sequence
  Description of Artificial Sequence: Synthetic oligonucleotide
ugcuucuugagggaugaa

SEQ ID NO: 19513 - RNA, 18 nt, Artificial Sequence
  Description of Artificial Sequence: Synthetic oligonucleotide
gccagugcuucuugaggg

SEQ ID NO: 19514 - RNA, 18 nt, Artificial Sequence
  Description of Artificial Sequence: Synthetic oligonucleotide
uuucugccagugcuucuu

SEQ ID NO: 19515 - RNA, 18 nt, Artificial Sequence
  Description of Artificial Sequence: Synthetic oligonucleotide
cuggguuucugccagugc

SEQ ID NO: 19516 - RNA, 18 nt, Artificial Sequence
  Description of Artificial Sequence: Synthetic oligonucleotide
gauuccuggguuucugcc

SEQ ID NO: 19517 - RNA, 18 nt, Artificial Sequence
  Description of Artificial Sequence: Synthetic oligonucleotide
aauuugauuccuggguuu

SEQ ID NO: 19518 - RNA, 18 nt, Artificial Sequence
  Description of Artificial Sequence: Synthetic oligonucleotide
ugcccaauuugauuccug

SEQ ID NO: 19519 - RNA, 18 nt, Artificial Sequence
  Description of Artificial Sequence: Synthetic oligonucleotide
uuuugugcccaauuugau

SEQ ID NO: 19520 - RNA, 18 nt, Artificial Sequence
  Description of Artificial Sequence: Synthetic oligonucleotide
accauuuuugugcccaau

SEQ ID NO: 19521 - RNA, 18 nt, Artificial Sequence
  Description of Artificial Sequence: Synthetic oligonucleotide
uccuuaccauuuuugugc

SEQ ID NO: 19522 - RNA, 18 nt, Artificial Sequence
  Description of Artificial Sequence: Synthetic oligonucleotide
ccauuuccuuaccauuuu

SEQ ID NO: 19523 - RNA, 18 nt, Artificial Sequence
  Description of Artificial Sequence: Synthetic oligonucleotide
cuuugccauuuccuuacc

SEQ ID NO: 19524 - RNA, 18 nt, Artificial Sequence
  Description of Artificial Sequence: Synthetic oligonucleotide
aaauacuuugccauuucc

SEQ ID NO: 19525 - RNA, 18 nt, Artificial Sequence
  Description of Artificial Sequence: Synthetic oligonucleotide
guucuaaauacuuugcca

SEQ ID NO: 19526 - RNA, 18 nt, Artificial Sequence
  Description of Artificial Sequence: Synthetic oligonucleotide
gcgaaguucuaaauacuu

SEQ ID NO: 19527 - RNA, 18 nt, Artificial Sequence
  Description of Artificial Sequence: Synthetic oligonucleotide
agcgggcgaaguucuaaa

SEQ ID NO: 19528 - RNA, 18 nt, Artificial Sequence
  Description of Artificial Sequence: Synthetic oligonucleotide
caauuagcgggcgaaguu

SEQ ID NO: 19529 - RNA, 18 nt, Artificial Sequence
  Description of Artificial Sequence: Synthetic oligonucleotide
aaacacaauuagcgggcg

SEQ ID NO: 19530 - RNA, 18 nt, Artificial Sequence
  Description of Artificial Sequence: Synthetic oligonucleotide
uggagaaacacaauuagc

SEQ ID NO: 19531 - RNA, 18 nt, Artificial Sequence
  Description of Artificial Sequence: Synthetic oligonucleotide
gucccuggagaaacacaa

SEQ ID NO: 19532 - RNA, 18 nt, Artificial Sequence
  Description of Artificial Sequence: Synthetic oligonucleotide
aaacagucccuggagaaa

SEQ ID NO: 19533 - RNA, 18 nt, Artificial Sequence
  Description of Artificial Sequence: Synthetic oligonucleotide
gaggaaaacagucccugg

SEQ ID NO: 19534 - RNA, 18 nt, Artificial Sequence
  Description of Artificial Sequence: Synthetic oligonucleotide
uguuugaggaaaacaguc

SEQ ID NO: 19535 - RNA, 18 nt, Artificial Sequence
  Description of Artificial Sequence: Synthetic oligonucleotide
gaggauguuugaggaaaa

SEQ ID NO: 19536 - RNA, 18 nt, Artificial Sequence
  Description of Artificial Sequence: Synthetic oligonucleotide
uuucagaggauguuugag

SEQ ID NO: 19537 - RNA, 18 nt, Artificial Sequence
  Description of Artificial Sequence: Synthetic oligonucleotide
caggauuucagaggaugu

SEQ ID NO: 19538 - RNA, 18 nt, Artificial Sequence
  Description of Artificial Sequence: Synthetic oligonucleotide
aggaccaggauuucagag

SEQ ID NO: 19539 - RNA, 18 nt, Artificial Sequence
  Description of Artificial Sequence: Synthetic oligonucleotide
gauauaggaccaggauuu

SEQ ID NO: 19540 - RNA, 18 nt, Artificial Sequence
  Description of Artificial Sequence: Synthetic oligonucleotide
cugcugauauaggaccag

SEQ ID NO: 19541 - RNA, 18 nt, Artificial Sequence
  Description of Artificial Sequence: Synthetic oligonucleotide
auucccugcugauauagg

SEQ ID NO: 19542 - RNA, 18 nt, Artificial Sequence
  Description of Artificial Sequence: Synthetic oligonucleotide
gccucauucccugcugau

SEQ ID NO: 19543 - RNA, 18 nt, Artificial Sequence
  Description of Artificial Sequence: Synthetic oligonucleotide
cuguggccucauucccug

SEQ ID NO: 19544 - RNA, 18 nt, Artificial Sequence
  Description of Artificial Sequence: Synthetic oligonucleotide
ucagucuguggccucauu

SEQ ID NO: 19545 - RNA, 18 nt, Artificial Sequence
  Description of Artificial Sequence: Synthetic oligonucleotide
ucucaucagucuguggcc

SEQ ID NO: 19546 - RNA, 18 nt, Artificial Sequence
  Description of Artificial Sequence: Synthetic oligonucleotide
uuuccucucaucagucug

SEQ ID NO: 19547 - RNA, 18 nt, Artificial Sequence
  Description of Artificial Sequence: Synthetic oligonucleotide
uaaaauuuccucucauca

SEQ ID NO: 19548 - RNA, 18 nt, Artificial Sequence
  Description of Artificial Sequence: Synthetic oligonucleotide
uaaaauaaaauuuccucu

SEQ ID NO: 19549 - RNA, 18 nt, Artificial Sequence
  Description of Artificial Sequence: Synthetic oligonucleotide
auagcuaaaauaaaauuu

SEQ ID NO: 19550 - RNA, 18 nt, Artificial Sequence
  Description of Artificial Sequence: Synthetic oligonucleotide
uggaaauagcuaaaauaa

SEQ ID NO: 19551 - RNA, 18 nt, Artificial Sequence
  Description of Artificial Sequence: Synthetic oligonucleotide
aaauguggaaauagcuaa

SEQ ID NO: 19552 - RNA, 18 nt, Artificial Sequence
  Description of Artificial Sequence: Synthetic oligonucleotide
gagaaaaauguggaaaua

SEQ ID NO: 19553 - RNA, 18 nt, Artificial Sequence
  Description of Artificial Sequence: Synthetic oligonucleotide
ugaaugagaaaaaugugg

SEQ ID NO: 19554 - RNA, 18 nt, Artificial Sequence
  Description of Artificial Sequence: Synthetic oligonucleotide
ggaccugaaugagaaaaa

SEQ ID NO: 19555 - RNA, 18 nt, Artificial Sequence
  Description of Artificial Sequence: Synthetic oligonucleotide
uuagaggaccugaaugag

SEQ ID NO: 19556 - RNA, 18 nt, Artificial Sequence
  Description of Artificial Sequence: Synthetic oligonucleotide
ccacauuagaggaccuga

SEQ ID NO: 19557 - RNA, 18 nt, Artificial Sequence
  Description of Artificial Sequence: Synthetic oligonucleotide
acuaaccacauuagagga

SEQ ID NO: 19558 - RNA, 18 nt, Artificial Sequence
  Description of Artificial Sequence: Synthetic oligonucleotide
ccacaacuaaccacauua

SEQ ID NO: 19559 - RNA, 18 nt, Artificial Sequence
  Description of Artificial Sequence: Synthetic oligonucleotide
ucaggccacaacuaacca

SEQ ID NO: 19560 - RNA, 18 nt, Artificial Sequence
  Description of Artificial Sequence: Synthetic oligonucleotide
cauuuucaggccacaacu

SEQ ID NO: 19561 - RNA, 18 nt, Artificial Sequence
  Description of Artificial Sequence: Synthetic oligonucleotide
aauaucauuuucaggcca

SEQ ID NO: 19562 - RNA, 18 nt, Artificial Sequence
  Description of Artificial Sequence: Synthetic oligonucleotide
uuggaaauaucauuuuca

SEQ ID NO: 19563 - RNA, 18 nt, Artificial Sequence
  Description of Artificial Sequence: Synthetic oligonucleotide
uucauuuggaaauaucau

SEQ ID NO: 19564 - RNA, 18 nt, Artificial Sequence
  Description of Artificial Sequence: Synthetic oligonucleotide
uccuauucauuuggaaau

SEQ ID NO: 19565 - RNA, 18 nt, Artificial Sequence
  Description of Artificial Sequence: Synthetic oligonucleotide
uuccuuccuauucauuug

SEQ ID NO: 19566 - RNA, 18 nt, Artificial Sequence
  Description of Artificial Sequence: Synthetic oligonucleotide
uuuccuuccuuccuauuc

SEQ ID NO: 19567 - RNA, 18 nt, Artificial Sequence
  Description of Artificial Sequence: Synthetic oligonucleotide
aacaauuuccuuccuucc

SEQ ID NO: 19568 - RNA, 18 nt, Artificial Sequence
  Description of Artificial Sequence: Synthetic oligonucleotide
acaaaaacaauuuccuuc

SEQ ID NO: 19569 - RNA, 18 nt, Artificial Sequence
  Description of Artificial Sequence: Synthetic oligonucleotide
aaacaacaaaaacaauuu

SEQ ID NO: 19570 - RNA, 18 nt, Artificial Sequence
  Description of Artificial Sequence: Synthetic oligonucleotide
aucuuaaacaacaaaaac

SEQ ID NO: 19571 - RNA, 18 nt, Artificial Sequence
  Description of Artificial Sequence: Synthetic oligonucleotide
cuuccaucuuaaacaaca

SEQ ID NO: 19572 - RNA, 18 nt, Artificial Sequence
  Description of Artificial Sequence: Synthetic oligonucleotide
auuuccuuccaucuuaaa

SEQ ID NO: 19573 - RNA, 18 nt, Artificial Sequence
  Description of Artificial Sequence: Synthetic oligonucleotide
ccuauauuuccuuccauc

SEQ ID NO: 19574 - RNA, 18 nt, Artificial Sequence
  Description of Artificial Sequence: Synthetic oligonucleotide
augcaccuauauuuccuu

SEQ ID NO: 19575 - RNA, 18 nt, Artificial Sequence
  Description of Artificial Sequence: Synthetic oligonucleotide
uuuaaaugcaccuauauu

SEQ ID NO: 19576 - RNA, 18 nt, Artificial Sequence
  Description of Artificial Sequence: Synthetic oligonucleotide
cauuuuuuaaaugcaccu

SEQ ID NO: 19577 - RNA, 18 nt, Artificial Sequence
  Description of Artificial Sequence: Synthetic oligonucleotide
agcuccauuuuuuaaaug

SEQ ID NO: 19578 - RNA, 18 nt, Artificial Sequence
  Description of Artificial Sequence: Synthetic oligonucleotide
aaccaagcuccauuuuuu

SEQ ID NO: 19579 - RNA, 18 nt, Artificial Sequence
  Description of Artificial Sequence: Synthetic oligonucleotide
caugcaaccaagcuccau

SEQ ID NO: 19580 - RNA, 18 nt, Artificial Sequence
  Description of Artificial Sequence: Synthetic oligonucleotide
aaaaucaugcaaccaagc

SEQ ID NO: 19581 - RNA, 18 nt, Artificial Sequence
  Description of Artificial Sequence: Synthetic oligonucleotide
gagcgaaaaucaugcaac

SEQ ID NO: 19582 - RNA, 18 nt, Artificial Sequence
  Description of Artificial Sequence: Synthetic oligonucleotide
cucaagagcgaaaaucau

SEQ ID NO: 19583 - RNA, 18 nt, Artificial Sequence
  Description of Artificial Sequence: Synthetic oligonucleotide
gaugacucaagagcgaaa

SEQ ID NO: 19584 - RNA, 18 nt, Artificial Sequence
  Description of Artificial Sequence: Synthetic oligonucleotide
ggcuagaugacucaagag

SEQ ID NO: 19585 - RNA, 18 nt, Artificial Sequence
  Description of Artificial Sequence: Synthetic oligonucleotide
uagagggcuagaugacuc

SEQ ID NO: 19586 - RNA, 18 nt, Artificial Sequence
  Description of Artificial Sequence: Synthetic oligonucleotide
aucauuagagggcuagau

SEQ ID NO: 19587 - RNA, 18 nt, Artificial Sequence
  Description of Artificial Sequence: Synthetic oligonucleotide
aggcaaucauuagagggc

SEQ ID NO: 19588 - RNA, 18 nt, Artificial Sequence
  Description of Artificial Sequence: Synthetic oligonucleotide
guaugaggcaaucauuag

SEQ ID NO: 19589 - RNA, 18 nt, Artificial Sequence
  Description of Artificial Sequence: Synthetic oligonucleotide
caccgguaugaggcaauc

SEQ ID NO: 19590 - RNA, 18 nt, Artificial Sequence
  Description of Artificial Sequence: Synthetic oligonucleotide
guaaucaccgguaugagg

SEQ ID NO: 19591 - RNA, 18 nt, Artificial Sequence
  Description of Artificial Sequence: Synthetic oligonucleotide
cgcucguaaucaccggua

SEQ ID NO: 19592 - RNA, 18 nt, Artificial Sequence
  Description of Artificial Sequence: Synthetic oligonucleotide
aaagccgcucguaaucac

SEQ ID NO: 19593 - RNA, 18 nt, Artificial Sequence
  Description of Artificial Sequence: Synthetic oligonucleotide
caugaaaagccgcucgua

SEQ ID NO: 19594 - RNA, 18 nt, Artificial Sequence
  Description of Artificial Sequence: Synthetic oligonucleotide
gggucaugaaaagccgcu

SEQ ID NO: 19595 - RNA, 18 nt, Artificial Sequence
  Description of Artificial Sequence: Synthetic oligonucleotide
aaaugguacauauggaag

SEQ ID NO: 19596 - RNA, 18 nt, Artificial Sequence
  Description of Artificial Sequence: Synthetic oligonucleotide
uuuuaaaaugguacauau

SEQ ID NO: 19597 - RNA, 18 nt, Artificial Sequence
  Description of Artificial Sequence: Synthetic oligonucleotide
cagcauuuuaaaauggua

SEQ ID NO: 19598 - RNA, 18 nt, Artificial Sequence
  Description of Artificial Sequence: Synthetic oligonucleotide
guaaucagcauuuuaaaa

SEQ ID NO: 19599 - RNA, 18 nt, Artificial Sequence
  Description of Artificial Sequence: Synthetic oligonucleotide
aagaaguaaucagcauuu

SEQ ID NO: 19600 - RNA, 18 nt, Artificial Sequence
  Description of Artificial Sequence: Synthetic oligonucleotide
uucucaagaaguaaucag

SEQ ID NO: 19601 - RNA, 18 nt, Artificial Sequence
  Description of Artificial Sequence: Synthetic oligonucleotide
ucuuauucucaagaagua

SEQ ID NO: 19602 - RNA, 18 nt, Artificial Sequence
  Description of Artificial Sequence: Synthetic oligonucleotide
gcuucucuuauucucaag

SEQ ID NO: 19603 - RNA, 18 nt, Artificial Sequence
  Description of Artificial Sequence: Synthetic oligonucleotide
auuaggcuucucuuauuc

SEQ ID NO: 19604 - RNA, 18 nt, Artificial Sequence
  Description of Artificial Sequence: Synthetic oligonucleotide
cugaaauuaggcuucucu

SEQ ID NO: 19605 - RNA, 18 nt, Artificial Sequence
  Description of Artificial Sequence: Synthetic oligonucleotide
auauucugaaauuaggcu

SEQ ID NO: 19606 - RNA, 18 nt, Artificial Sequence
  Description of Artificial Sequence: Synthetic oligonucleotide
uaaugauauucugaaauu

SEQ ID NO: 19607 - RNA, 18 nt, Artificial Sequence
  Description of Artificial Sequence: Synthetic oligonucleotide
uacccuaaugauauucug

SEQ ID NO: 19608 - RNA, 18 nt, Artificial Sequence
  Description of Artificial Sequence: Synthetic oligonucleotide
auagguacccuaaugaua

SEQ ID NO: 19609 - RNA, 18 nt, Artificial Sequence
  Description of Artificial Sequence: Synthetic oligonucleotide
cuucaauagguacccuaa

SEQ ID NO: 19610 - RNA, 18 nt, Artificial Sequence
  Description of Artificial Sequence: Synthetic oligonucleotide
caagacuucaauagguac

SEQ ID NO: 19611 - RNA, 18 nt, Artificial Sequence
  Description of Artificial Sequence: Synthetic oligonucleotide
gcagucaagacuucaaua

SEQ ID NO: 19612 - RNA, 18 nt, Artificial Sequence
  Description of Artificial Sequence: Synthetic oligonucleotide
uaugugcagucaagacuu

SEQ ID NO: 19613 - RNA, 18 nt, Artificial Sequence
  Description of Artificial Sequence: Synthetic oligonucleotide
cuaaauaugugcagucaa

SEQ ID NO: 19614 - RNA, 18 nt, Artificial Sequence
  Description of Artificial Sequence: Synthetic oligonucleotide
guaugcuaaauaugugca

SEQ ID NO: 19615 - RNA, 18 nt, Artificial Sequence
  Description of Artificial Sequence: Synthetic oligonucleotide
agggaguaugcuaaauau

SEQ ID NO: 19616 - RNA, 18 nt, Artificial Sequence
  Description of Artificial Sequence: Synthetic oligonucleotide
uucccagggaguaugcua

SEQ ID NO: 19617 - RNA, 18 nt, Artificial Sequence
  Description of Artificial Sequence: Synthetic oligonucleotide
uauaauucccagggagua

SEQ ID NO: 19618 - RNA, 18 nt, Artificial Sequence
  Description of Artificial Sequence: Synthetic oligonucleotide
uaaaauauaauucccagg

SEQ ID NO: 19619 - RNA, 18 nt, Artificial Sequence
  Description of Artificial Sequence: Synthetic oligonucleotide
guccuuaaaauauaauuc

SEQ ID NO: 19620 - RNA, 18 nt, Artificial Sequence
  Description of Artificial Sequence: Synthetic oligonucleotide
aaaauguccuuaaaauau

SEQ ID NO: 19621 - RNA, 18 nt, Artificial Sequence
  Description of Artificial Sequence: Synthetic oligonucleotide
auagaaaaauguccuuaa

SEQ ID NO: 19622 - RNA, 18 nt, Artificial Sequence
  Description of Artificial Sequence: Synthetic oligonucleotide
auuuaauagaaaaauguc

SEQ ID NO: 19623 - RNA, 18 nt, Artificial Sequence
  Description of Artificial Sequence: Synthetic oligonucleotide
caaugauuuaauagaaaa

SEQ ID NO: 19624 - RNA, 18 nt, Artificial Sequence
  Description of Artificial Sequence: Synthetic oligonucleotide
auaugcaaugauuuaaua

SEQ ID NO: 19625 - RNA, 18 nt, Artificial Sequence
  Description of Artificial Sequence: Synthetic oligonucleotide
cuuccauaugcaaugauu

SEQ ID NO: 19626 - RNA, 18 nt, Artificial Sequence
  Description of Artificial Sequence: Synthetic oligonucleotide
aguuucuuccauaugcaa

SEQ ID NO: 19627 - RNA, 18 nt, Artificial Sequence
  Description of Artificial Sequence: Synthetic oligonucleotide
uauugaguuucuuccaua

SEQ ID NO: 19628 - RNA, 18 nt, Artificial Sequence
  Description of Artificial Sequence: Synthetic oligonucleotide
uauuauauugaguuucuu

SEQ ID NO: 19629 - RNA, 18 nt, Artificial Sequence
  Description of Artificial Sequence: Synthetic oligonucleotide
ucagcuauuauauugagu

SEQ ID NO: 19630 - RNA, 18 nt, Artificial Sequence
  Description of Artificial Sequence: Synthetic oligonucleotide
aaauaucagcuauuauau

SEQ ID NO: 19631 - RNA, 18 nt, Artificial Sequence
  Description of Artificial Sequence: Synthetic oligonucleotide
caaguaaauaucagcuau

SEQ ID NO: 19632 - RNA, 18 nt, Artificial Sequence
  Description of Artificial Sequence: Synthetic oligonucleotide
gaacccaaguaaauauca

SEQ ID NO: 19633 - RNA, 18 nt, Artificial Sequence
  Description of Artificial Sequence: Synthetic oligonucleotide
auuaagaacccaaguaaa

SEQ ID NO: 19634 - RNA, 18 nt, Artificial Sequence
  Description of Artificial Sequence: Synthetic oligonucleotide
uucugauuaagaacccaa

SEQ ID NO: 19635 - RNA, 18 nt, Artificial Sequence
  Description of Artificial Sequence: Synthetic oligonucleotide
caauguucugauuaagaa

SEQ ID NO: 19636 - RNA, 18 nt, Artificial Sequence
  Description of Artificial Sequence: Synthetic oligonucleotide
acagccaauguucugauu

SEQ ID NO: 19637 - RNA, 18 nt, Artificial Sequence
  Description of Artificial Sequence: Synthetic oligonucleotide
aucacacagccaauguuc

SEQ ID NO: 19638 - RNA, 18 nt, Artificial Sequence
  Description of Artificial Sequence: Synthetic oligonucleotide
ugaaaaucacacagccaa

SEQ ID NO: 19639 - RNA, 18 nt, Artificial Sequence
  Description of Artificial Sequence: Synthetic oligonucleotide
aaucaugaaaaucacaca

SEQ ID NO: 19640 - RNA, 18 nt, Artificial Sequence
  Description of Artificial Sequence: Synthetic oligonucleotide
aucauaaucaugaaaauc

SEQ ID NO: 19641 - RNA, 18 nt, Artificial Sequence
  Description of Artificial Sequence: Synthetic oligonucleotide
ugaaaaucauaaucauga

SEQ ID NO: 19642 - RNA, 18 nt, Artificial Sequence
  Description of Artificial Sequence: Synthetic oligonucleotide
ugcaaugaaaaucauaau

SEQ ID NO: 19643 - RNA, 18 nt, Artificial Sequence
  Description of Artificial Sequence: Synthetic oligonucleotide
uuaauugcaaugaaaauc

SEQ ID NO: 19644 - RNA, 18 nt, Artificial Sequence
  Description of Artificial Sequence: Synthetic oligonucleotide
ucaacuuaauugcaauga

SEQ ID NO: 19645 - RNA, 18 nt, Artificial Sequence
  Description of Artificial Sequence: Synthetic oligonucleotide
aaacaucaacuuaauugc

SEQ ID NO: 19646 - RNA, 18 nt, Artificial Sequence
  Description of Artificial Sequence: Synthetic oligonucleotide
cuacaaaacaucaacuua

SEQ ID NO: 19647 - RNA, 18 nt, Artificial Sequence
  Description of Artificial Sequence: Synthetic oligonucleotide
acugucuacaaaacauca

SEQ ID NO: 19648 - RNA, 18 nt, Artificial Sequence
  Description of Artificial Sequence: Synthetic oligonucleotide
auuucacugucuacaaaa

SEQ ID NO: 19649 - RNA, 18 nt, Artificial Sequence
  Description of Artificial Sequence: Synthetic oligonucleotide
ugguaauuucacugucua

SEQ ID NO: 19650 - RNA, 18 nt, Artificial Sequence
  Description of Artificial Sequence: Synthetic oligonucleotide
guagaugguaauuucacu

SEQ ID NO: 19651 - RNA, 18 nt, Artificial Sequence
  Description of Artificial Sequence: Synthetic oligonucleotide
uuggaguagaugguaauu

SEQ ID NO: 19652 - RNA, 18 nt, Artificial Sequence
  Description of Artificial Sequence: Synthetic oligonucleotide
aucuuuuggaguagaugg

SEQ ID NO: 19653 - RNA, 18 nt, Artificial Sequence
  Description of Artificial Sequence: Synthetic oligonucleotide
uugcaaucuuuuggagua

SEQ ID NO: 19654 - RNA, 18 nt, Artificial Sequence
  Description of Artificial Sequence: Synthetic oligonucleotide
cuauuuugcaaucuuuug

SEQ ID NO: 19655 - RNA, 18 nt, Artificial Sequence
  Description of Artificial Sequence: Synthetic oligonucleotide
aaauucuauuuugcaauc

SEQ ID NO: 19656 - RNA, 18 nt, Artificial Sequence
  Description of Artificial Sequence: Synthetic oligonucleotide
agguuaaauucuauuuug

SEQ ID NO: 19657 - RNA, 18 nt, Artificial Sequence
  Description of Artificial Sequence: Synthetic oligonucleotide
cucuaagguuaaauucua

SEQ ID NO: 19658 - RNA, 18 nt, Artificial Sequence
  Description of Artificial Sequence: Synthetic oligonucleotide
auuggcucuaagguuaaa

SEQ ID NO: 19659 - RNA, 18 nt, Artificial Sequence
  Description of Artificial Sequence: Synthetic oligonucleotide
ccugcauuggcucuaagg

SEQ ID NO: 19660 - RNA, 18 nt, Artificial Sequence
  Description of Artificial Sequence: Synthetic oligonucleotide
uuuucccugcauuggcuc

SEQ ID NO: 19661 - RNA, 18 nt, Artificial Sequence
  Description of Artificial Sequence: Synthetic oligonucleotide
acaaguuuucccugcauu

SEQ ID NO: 19662 - RNA, 18 nt, Artificial Sequence
  Description of Artificial Sequence: Synthetic oligonucleotide
cagaaacaaguuuucccu

SEQ ID NO: 19663 - RNA, 18 nt, Artificial Sequence
  Description of Artificial Sequence: Synthetic oligonucleotide
accugcagaaacaaguuu

SEQ ID NO: 19664 - RNA, 18 nt, Artificial Sequence
  Description of Artificial Sequence: Synthetic oligonucleotide
aaugcaccugcagaaaca

SEQ ID NO: 19665 - RNA, 18 nt, Artificial Sequence
  Description of Artificial Sequence: Synthetic oligonucleotide
caaaaaaugcaccugcag

SEQ ID NO: 19666 - RNA, 18 nt, Artificial Sequence
  Description of Artificial Sequence: Synthetic oligonucleotide
aguuucaaaaaaugcacc

SEQ ID NO: 19667 - RNA, 18 nt, Artificial Sequence
  Description of Artificial Sequence: Synthetic oligonucleotide
guugaaguuucaaaaaau

SEQ ID NO: 19668 - RNA, 18 nt, Artificial Sequence
  Description of Artificial Sequence: Synthetic oligonucleotide
uaucuguugaaguuucaa

SEQ ID NO: 19669 - RNA, 18 nt, Artificial Sequence
  Description of Artificial Sequence: Synthetic oligonucleotide
ccugcuaucuguugaagu

SEQ ID NO: 19670 - RNA, 18 nt, Artificial Sequence
  Description of Artificial Sequence: Synthetic oligonucleotide
uucccccugcuaucuguu

SEQ ID NO: 19671 - RNA, 18 nt, Artificial Sequence
  Description of Artificial Sequence: Synthetic oligonucleotide
uuuuuuucccccugcuau

SEQ ID NO: 19672 - RNA, 18 nt, Artificial Sequence
  Description of Artificial Sequence: Synthetic oligonucleotide
ucacuuuuuuuucccccu

SEQ ID NO: 19673 - RNA, 18 nt, Artificial Sequence
  Description of Artificial Sequence: Synthetic oligonucleotide
uucugucacuuuuuuuuc

SEQ ID NO: 19674 - RNA, 18 nt, Artificial Sequence
  Description of Artificial Sequence: Synthetic oligonucleotide
gauccuucugucacuuuu

SEQ ID NO: 19675 - RNA, 18 nt, Artificial Sequence
  Description of Artificial Sequence: Synthetic oligonucleotide
acugugauccuucuguca

SEQ ID NO: 19676 - RNA, 18 nt, Artificial Sequence
  Description of Artificial Sequence: Synthetic oligonucleotide
gcugaacugugauccuuc

SEQ ID NO: 19677 - RNA, 18 nt, Artificial Sequence
  Description of Artificial Sequence: Synthetic oligonucleotide
auacugcugaacugugau

SEQ ID NO: 19678 - RNA, 18 nt, Artificial Sequence
  Description of Artificial Sequence: Synthetic oligonucleotide
aauucauacugcugaacu

SEQ ID NO: 19679 - RNA, 18 nt, Artificial Sequence
  Description of Artificial Sequence: Synthetic oligonucleotide
cagacaauucauacugcu

SEQ ID NO: 19680 - RNA, 18 nt, Artificial Sequence
  Description of Artificial Sequence: Synthetic oligonucleotide
gccagcagacaauucaua

SEQ ID NO: 19681 - RNA, 18 nt, Artificial Sequence
  Description of Artificial Sequence: Synthetic oligonucleotide
aggcugccagcagacaau

SEQ ID NO: 19682 - RNA, 18 nt, Artificial Sequence
  Description of Artificial Sequence: Synthetic oligonucleotide
uugcaaggcugccagcag

SEQ ID NO: 19683 - RNA, 18 nt, Artificial Sequence
  Description of Artificial Sequence: Synthetic oligonucleotide
ccagauugcaaggcugcc

SEQ ID NO: 19684 - RNA, 18 nt, Artificial Sequence
  Description of Artificial Sequence: Synthetic oligonucleotide
gcacaccagauugcaagg

SEQ ID NO: 19685 - RNA, 18 nt, Artificial Sequence
  Description of Artificial Sequence: Synthetic oligonucleotide
ugccugcacaccagauug

SEQ ID NO: 19686 - RNA, 18 nt, Artificial Sequence
  Description of Artificial Sequence: Synthetic oligonucleotide
cucacugccugcacacca

SEQ ID NO: 19687 - RNA, 18 nt, Artificial Sequence
  Description of Artificial Sequence: Synthetic oligonucleotide
acaaucucacugccugca

SEQ ID NO: 19688 - RNA, 18 nt, Artificial Sequence
  Description of Artificial Sequence: Synthetic oligonucleotide
acaccacaaucucacugc

SEQ ID NO: 19689 - RNA, 18 nt, Artificial Sequence
  Description of Artificial Sequence: Synthetic oligonucleotide
cauguacaccacaaucuc

SEQ ID NO: 19690 - RNA, 18 nt, Artificial Sequence
  Description of Artificial Sequence: Synthetic oligonucleotide
ggugacauguacaccaca

SEQ ID NO: 19691 - RNA, 18 nt, Artificial Sequence
  Description of Artificial Sequence: Synthetic oligonucleotide
aaucaggugacauguaca

SEQ ID NO: 19692 - RNA, 18 nt, Artificial Sequence
  Description of Artificial Sequence: Synthetic oligonucleotide
uguaguccugguggcaug

SEQ ID NO: 19693 - RNA, 18 nt, Artificial Sequence
  Description of Artificial Sequence: Synthetic oligonucleotide
gccccuguaguccuggug

SEQ ID NO: 19694 - RNA, 18 nt, Artificial Sequence
  Description of Artificial Sequence: Synthetic oligonucleotide
acucugccccuguagucc

SEQ ID NO: 19695 - RNA, 18 nt, Artificial Sequence
  Description of Artificial Sequence: Synthetic oligonucleotide
gagacacucugccccugu

SEQ ID NO: 19696 - RNA, 18 nt, Artificial Sequence
  Description of Artificial Sequence: Synthetic oligonucleotide
cagaggagacacucugcc

SEQ ID NO: 19697 - RNA, 18 nt, Artificial Sequence
  Description of Artificial Sequence: Synthetic oligonucleotide
gcugccagaggagacacu

SEQ ID NO: 19698 - RNA, 18 nt, Artificial Sequence
  Description of Artificial Sequence: Synthetic oligonucleotide
ucagagcugccagaggag

SEQ ID NO: 19699 - RNA, 18 nt, Artificial Sequence
  Description of Artificial Sequence: Synthetic oligonucleotide
ugaucucagagcugccag

SEQ ID NO: 19700 - RNA, 18 nt, Artificial Sequence
  Description of Artificial Sequence: Synthetic oligonucleotide
ggauuugaucucagagcu

SEQ ID NO: 19701 - RNA, 18 nt, Artificial Sequence
  Description of Artificial Sequence: Synthetic oligonucleotide
ucaucggauuugaucuca

SEQ ID NO: 19702 - RNA, 18 nt, Artificial Sequence
  Description of Artificial Sequence: Synthetic oligonucleotide
ccucgucaucggauuuga

SEQ ID NO: 19703 - RNA, 18 nt, Artificial Sequence
  Description of Artificial Sequence: Synthetic oligonucleotide
aucacccucgucaucgga

SEQ ID NO: 19704 - RNA, 18 nt, Artificial Sequence
  Description of Artificial Sequence: Synthetic oligonucleotide
uucucaucacccucguca

SEQ ID NO: 19705 - RNA, 18 nt, Artificial Sequence
  Description of Artificial Sequence: Synthetic oligonucleotide
gcagguucucaucacccu

SEQ ID NO: 19706 - RNA, 18 nt, Artificial Sequence
  Description of Artificial Sequence: Synthetic oligonucleotide
gucuugcagguucucauc

SEQ ID NO: 19707 - RNA, 18 nt, Artificial Sequence
  Description of Artificial Sequence: Synthetic oligonucleotide
uucgugucuugcagguuc

SEQ ID NO: 19708 - RNA, 18 nt, Artificial Sequence
  Description of Artificial Sequence: Synthetic oligonucleotide
aagauuucgugucuugca

SEQ ID NO: 19709 - RNA, 18 nt, Artificial Sequence
  Description of Artificial Sequence: Synthetic oligonucleotide
cuccgaagauuucguguc

SEQ ID NO: 19710 - RNA, 18 nt, Artificial Sequence
  Description of Artificial Sequence: Synthetic oligonucleotide
uuguccuccgaagauuuc

SEQ ID NO: 19711 - RNA, 18 nt, Artificial Sequence
  Description of Artificial Sequence: Synthetic oligonucleotide
auuucuuguccuccgaag

SEQ ID NO: 19712 - RNA, 18 nt, Artificial Sequence
  Description of Artificial Sequence: Synthetic oligonucleotide
aucuaauuucuuguccuc

SEQ ID NO: 19713 - RNA, 18 nt, Artificial Sequence
  Description of Artificial Sequence: Synthetic oligonucleotide
ucgucaucuaauuucuug

SEQ ID NO: 19714 - RNA, 18 nt, Artificial Sequence
  Description of Artificial Sequence: Synthetic oligonucleotide
ucuugucgucaucuaauu

SEQ ID NO: 19715 - RNA, 18 nt, Artificial Sequence
  Description of Artificial Sequence: Synthetic oligonucleotide
auccuucuugucgucauc

SEQ ID NO: 19716 - RNA, 18 nt, Artificial Sequence
  Description of Artificial Sequence: Synthetic oligonucleotide
uugauauccuucuugucg

SEQ ID NO: 19717 - RNA, 18 nt, Artificial Sequence
  Description of Artificial Sequence: Synthetic oligonucleotide
uugauuugauauccuucu

SEQ ID NO: 19718 - RNA, 18 nt, Artificial Sequence
  Description of Artificial Sequence: Synthetic oligonucleotide
aguaauugauuugauauc

SEQ ID NO: 19719 - RNA, 18 nt, Artificial Sequence
  Description of Artificial Sequence: Synthetic oligonucleotide
gaccuaguaauugauuug

SEQ ID NO: 19720 - RNA, 18 nt, Artificial Sequence
  Description of Artificial Sequence: Synthetic oligonucleotide
aucuugaccuaguaauug

SEQ ID NO: 19721 - RNA, 18 nt, Artificial Sequence
  Description of Artificial Sequence: Synthetic oligonucleotide
uucacgauggguccccac

SEQ ID NO: 19722 - RNA, 18 nt, Artificial Sequence
  Description of Artificial Sequence: Synthetic oligonucleotide
ccaucuucacgauggguc

SEQ ID NO: 19723 - RNA, 18 nt, Artificial Sequence
  Description of Artificial Sequence: Synthetic oligonucleotide
ccacgccaucuucacgau

SEQ ID NO: 19724 - RNA, 18 nt, Artificial Sequence
  Description of Artificial Sequence: Synthetic oligonucleotide
cagggccacgccaucuuc

SEQ ID NO: 19725 - RNA, 18 nt, Artificial Sequence
  Description of Artificial Sequence: Synthetic oligonucleotide
ccucucagggccacgcca

SEQ ID NO: 19726 - RNA, 18 nt, Artificial Sequence
  Description of Artificial Sequence: Synthetic oligonucleotide
ggcugccucucagggcca

SEQ ID NO: 19727 - RNA, 18 nt, Artificial Sequence
  Description of Artificial Sequence: Synthetic oligonucleotide
agaauggcugccucucag

SEQ ID NO: 19728 - RNA, 18 nt, Artificial Sequence
  Description of Artificial Sequence: Synthetic oligonucleotide
agaagagaauggcugccu

SEQ ID NO: 19729 - RNA, 18 nt, Artificial Sequence
  Description of Artificial Sequence: Synthetic oligonucleotide
uuggcagaagagaauggc

SEQ ID NO: 19730 - RNA, 18 nt, Artificial Sequence
  Description of Artificial Sequence: Synthetic oligonucleotide
cugguuuggcagaagaga

SEQ ID NO: 19731 - RNA, 18 nt, Artificial Sequence
  Description of Artificial Sequence: Synthetic oligonucleotide
ggaaccugguuuggcaga

SEQ ID NO: 19732 - RNA, 18 nt, Artificial Sequence
  Description of Artificial Sequence: Synthetic oligonucleotide
gaaccggaaccugguuug

SEQ ID NO: 19733 - RNA, 18 nt, Artificial Sequence
  Description of Artificial Sequence: Synthetic oligonucleotide
cuguggaaccggaaccug

SEQ ID NO: 19734 - RNA, 18 nt, Artificial Sequence
  Description of Artificial Sequence: Synthetic oligonucleotide
ggaagcuguggaaccgga

SEQ ID NO: 19735 - RNA, 18 nt, Artificial Sequence
  Description of Artificial Sequence: Synthetic oligonucleotide
ggacaggaagcuguggaa

SEQ ID NO: 19736 - RNA, 18 nt, Artificial Sequence
  Description of Artificial Sequence: Synthetic oligonucleotide
agacuggacaggaagcug

SEQ ID NO: 19737 - RNA, 18 nt, Artificial Sequence
  Description of Artificial Sequence: Synthetic oligonucleotide
gucgcagacuggacagga

SEQ ID NO: 19738 - RNA, 18 nt, Artificial Sequence
  Description of Artificial Sequence: Synthetic oligonucleotide
gggaagucgcagacugga

SEQ ID NO: 19739 - RNA, 18 nt, Artificial Sequence
  Description of Artificial Sequence: Synthetic oligonucleotide
gguggguucaggucaggg

SEQ ID NO: 19740 - RNA, 18 nt, Artificial Sequence
  Description of Artificial Sequence: Synthetic oligonucleotide
ggguggguucaggucagg

SEQ ID NO: 19741 - RNA, 18 nt, Artificial Sequence
  Description of Artificial Sequence: Synthetic oligonucleotide
cucuguaaggguccuggg

SEQ ID NO: 19742 - RNA, 18 nt, Artificial Sequence
  Description of Artificial Sequence: Synthetic oligonucleotide
gugcccuggugaggccaa

SEQ ID NO: 19743 - RNA, 18 nt, Artificial Sequence
  Description of Artificial Sequence: Synthetic oligonucleotide
cagaagugcccuggugag

SEQ ID NO: 19744 - RNA, 18 nt, Artificial Sequence
  Description of Artificial Sequence: Synthetic oligonucleotide
gaggucagaagugcccug

SEQ ID NO: 19745 - RNA, 18 nt, Artificial Sequence
  Description of Artificial Sequence: Synthetic oligonucleotide
aaagugaggucagaagug

SEQ ID NO: 19746 - RNA, 18 nt, Artificial Sequence
  Description of Artificial Sequence: Synthetic oligonucleotide
uugugaaagugaggucag

SEQ ID NO: 19747 - RNA, 18 nt, Artificial Sequence
  Description of Artificial Sequence: Synthetic oligonucleotide
uccuauugugaaagugag

SEQ ID NO: 19748 - RNA, 18 nt, Artificial Sequence
  Description of Artificial Sequence: Synthetic oligonucleotide
acugguccuauugugaaa

SEQ ID NO: 19749 - RNA, 18 nt, Artificial Sequence
  Description of Artificial Sequence: Synthetic oligonucleotide
ucaacacugguccuauug

SEQ ID NO: 19750 - RNA, 18 nt, Artificial Sequence
  Description of Artificial Sequence: Synthetic oligonucleotide
ggguaucaacacuggucc

SEQ ID NO: 19751 - RNA, 18 nt, Artificial Sequence
  Description of Artificial Sequence: Synthetic oligonucleotide
aggcuggguaucaacacu

SEQ ID NO: 19752 - RNA, 18 nt, Artificial Sequence
  Description of Artificial Sequence: Synthetic oligonucleotide
ccaagaggcuggguauca

SEQ ID NO: 19753 - RNA, 18 nt, Artificial Sequence
  Description of Artificial Sequence: Synthetic oligonucleotide
gaacaccaagaggcuggg

SEQ ID NO: 19754 - RNA, 18 nt, Artificial Sequence
  Description of Artificial Sequence: Synthetic oligonucleotide
gggaugaacaccaagagg

SEQ ID NO: 19755 - RNA, 18 nt, Artificial Sequence
  Description of Artificial Sequence: Synthetic oligonucleotide
cuugagggaugaacacca

SEQ ID NO: 19756 - RNA, 18 nt, Artificial Sequence
  Description of Artificial Sequence: Synthetic oligonucleotide
ugcuucuugagggaugaa

SEQ ID NO: 19757 - RNA, 18 nt, Artificial Sequence
  Description of Artificial Sequence: Synthetic oligonucleotide
gccagugcuucuugaggg

SEQ ID NO: 19758 - RNA, 18 nt, Artificial Sequence
  Description of Artificial Sequence: Synthetic oligonucleotide
uuucugccagugcuucuu

SEQ ID NO: 19759 - RNA, 18 nt, Artificial Sequence
  Description of Artificial Sequence: Synthetic oligonucleotide
cuggguuucugccagugc

SEQ ID NO: 19760 - RNA, 18 nt, Artificial Sequence
  Description of Artificial Sequence: Synthetic oligonucleotide
gauuccuggguuucugcc

SEQ ID NO: 19761 - RNA, 18 nt, Artificial Sequence
  Description of Artificial Sequence: Synthetic oligonucleotide
aauuugauuccuggguuu

SEQ ID NO: 19762 - RNA, 18 nt, Artificial Sequence
  Description of Artificial Sequence: Synthetic oligonucleotide
ugcccaauuugauuccug

SEQ ID NO: 19763 - RNA, 18 nt, Artificial Sequence
  Description of Artificial Sequence: Synthetic oligonucleotide
uuuugugcccaauuugau

SEQ ID NO: 19764 - RNA, 18 nt, Artificial Sequence
  Description of Artificial Sequence: Synthetic oligonucleotide
accauuuuugugcccaau

SEQ ID NO: 19765 - RNA, 18 nt, Artificial Sequence
  Description of Artificial Sequence: Synthetic oligonucleotide
uccuuaccauuuuugugc

SEQ ID NO: 19766 - RNA, 18 nt, Artificial Sequence
  Description of Artificial Sequence: Synthetic oligonucleotide
ccauuuccuuaccauuuu

SEQ ID NO: 19767 - RNA, 18 nt, Artificial Sequence
  Description of Artificial Sequence: Synthetic oligonucleotide
cuuugccauuuccuuacc

SEQ ID NO: 19768 - RNA, 18 nt, Artificial Sequence
  Description of Artificial Sequence: Synthetic oligonucleotide
aaauacuuugccauuucc

SEQ ID NO: 19769 - RNA, 18 nt, Artificial Sequence
  Description of Artificial Sequence: Synthetic oligonucleotide
guucuaaauacuuugcca

SEQ ID NO: 19770 - RNA, 18 nt, Artificial Sequence
  Description of Artificial Sequence: Synthetic oligonucleotide
gcgaaguucuaaauacuu

SEQ ID NO: 19771 - RNA, 18 nt, Artificial Sequence
  Description of Artificial Sequence: Synthetic oligonucleotide
agcgggcgaaguucuaaa

SEQ ID NO: 19772 - RNA, 18 nt, Artificial Sequence
  Description of Artificial Sequence: Synthetic oligonucleotide
caauuagcgggcgaaguu

SEQ ID NO: 19773 - RNA, 18 nt, Artificial Sequence
  Description of Artificial Sequence: Synthetic oligonucleotide
aaacacaauuagcgggcg

SEQ ID NO: 19774 - RNA, 18 nt, Artificial Sequence
  Description of Artificial Sequence: Synthetic oligonucleotide
uggagaaacacaauuagc

SEQ ID NO: 19775 - RNA, 18 nt, Artificial Sequence
  Description of Artificial Sequence: Synthetic oligonucleotide
gucccuggagaaacacaa

SEQ ID NO: 19776 - RNA, 18 nt, Artificial Sequence
  Description of Artificial Sequence: Synthetic oligonucleotide
aaacagucccuggagaaa

SEQ ID NO: 19777 - RNA, 18 nt, Artificial Sequence
  Description of Artificial Sequence: Synthetic oligonucleotide
gaggaaaacagucccugg

SEQ ID NO: 19778 - RNA, 18 nt, Artificial Sequence
  Description of Artificial Sequence: Synthetic oligonucleotide
uguuugaggaaaacaguc

SEQ ID NO: 19779 - RNA, 18 nt, Artificial Sequence
  Description of Artificial Sequence: Synthetic oligonucleotide
gaggauguuugaggaaaa

SEQ ID NO: 19780 - RNA, 18 nt, Artificial Sequence
  Description of Artificial Sequence: Synthetic oligonucleotide
uuucagaggauguuugag

SEQ ID NO: 19781 - RNA, 18 nt, Artificial Sequence
  Description of Artificial Sequence: Synthetic oligonucleotide
caggauuucagaggaugu

SEQ ID NO: 19782 - RNA, 18 nt, Artificial Sequence
  Description of Artificial Sequence: Synthetic oligonucleotide
aggaccaggauuucagag

SEQ ID NO: 19783 - RNA, 18 nt, Artificial Sequence
  Description of Artificial Sequence: Synthetic oligonucleotide
gauauaggaccaggauuu

SEQ ID NO: 19784 - RNA, 18 nt, Artificial Sequence
  Description of Artificial Sequence: Synthetic oligonucleotide
cugcugauauaggaccag

SEQ ID NO: 19785 - RNA, 18 nt, Artificial Sequence
  Description of Artificial Sequence: Synthetic oligonucleotide
auucccugcugauauagg

SEQ ID NO: 19786 - RNA, 18 nt, Artificial Sequence
  Description of Artificial Sequence: Synthetic oligonucleotide
gccucauucccugcugau

SEQ ID NO: 19787 - RNA, 18 nt, Artificial Sequence
  Description of Artificial Sequence: Synthetic oligonucleotide
cuguggccucauucccug

SEQ ID NO: 19788 - RNA, 18 nt, Artificial Sequence
  Description of Artificial Sequence: Synthetic oligonucleotide
ucagucuguggccucauu

SEQ ID NO: 19789 - RNA, 18 nt, Artificial Sequence
  Description of Artificial Sequence: Synthetic oligonucleotide
ucucaucagucuguggcc

SEQ ID NO: 19790 - RNA, 18 nt, Artificial Sequence
  Description of Artificial Sequence: Synthetic oligonucleotide
uuuccucucaucagucug

SEQ ID NO: 19791 - RNA, 18 nt, Artificial Sequence
  Description of Artificial Sequence: Synthetic oligonucleotide
uaaaauuuccucucauca

SEQ ID NO: 19792 - RNA, 18 nt, Artificial Sequence
  Description of Artificial Sequence: Synthetic oligonucleotide
uaaaauaaaauuuccucu

SEQ ID NO: 19793 - RNA, 18 nt, Artificial Sequence
  Description of Artificial Sequence: Synthetic oligonucleotide
auagcuaaaauaaaauuu

SEQ ID NO: 19794 - RNA, 18 nt, Artificial Sequence
  Description of Artificial Sequence: Synthetic oligonucleotide
uggaaauagcuaaaauaa

SEQ ID NO: 19795 - RNA, 18 nt, Artificial Sequence
  Description of Artificial Sequence: Synthetic oligonucleotide
aaauguggaaauagcuaa

SEQ ID NO: 19796 - RNA, 18 nt, Artificial Sequence
  Description of Artificial Sequence: Synthetic oligonucleotide
gagaaaaauguggaaaua

SEQ ID NO: 19797 - RNA, 18 nt, Artificial Sequence
  Description of Artificial Sequence: Synthetic oligonucleotide
ugaaugagaaaaaugugg

SEQ ID NO: 19798 - RNA, 18 nt, Artificial Sequence
  Description of Artificial Sequence: Synthetic oligonucleotide
ggaccugaaugagaaaaa

SEQ ID NO: 19799 - RNA, 18 nt, Artificial Sequence
  Description of Artificial Sequence: Synthetic oligonucleotide
uuagaggaccugaaugag

SEQ ID NO: 19800 - RNA, 18 nt, Artificial Sequence
  Description of Artificial Sequence: Synthetic oligonucleotide
ccacauuagaggaccuga

SEQ ID NO: 19801 - RNA, 18 nt, Artificial Sequence
  Description of Artificial Sequence: Synthetic oligonucleotide
acuaaccacauuagagga

SEQ ID NO: 19802 - RNA, 18 nt, Artificial Sequence
  Description of Artificial Sequence: Synthetic oligonucleotide
ccacaacuaaccacauua

SEQ ID NO: 19803 - RNA, 18 nt, Artificial Sequence
  Description of Artificial Sequence: Synthetic oligonucleotide
ucaggccacaacuaacca

SEQ ID NO: 19804 - RNA, 18 nt, Artificial Sequence
  Description of Artificial Sequence: Synthetic oligonucleotide
cauuuucaggccacaacu

SEQ ID NO: 19805 - RNA, 18 nt, Artificial Sequence
  Description of Artificial Sequence: Synthetic oligonucleotide
aauaucauuuucaggcca

SEQ ID NO: 19806 - RNA, 18 nt, Artificial Sequence
  Description of Artificial Sequence: Synthetic oligonucleotide
uuggaaauaucauuuuca

SEQ ID NO: 19807 - RNA, 18 nt, Artificial Sequence
  Description of Artificial Sequence: Synthetic oligonucleotide
uucauuuggaaauaucau

SEQ ID NO: 19808 - RNA, 18 nt, Artificial Sequence
  Description of Artificial Sequence: Synthetic oligonucleotide
uccuauucauuuggaaau

SEQ ID NO: 19809 - RNA, 18 nt, Artificial Sequence
  Description of Artificial Sequence: Synthetic oligonucleotide
uuccuuccuauucauuug

SEQ ID NO: 19810 - RNA, 18 nt, Artificial Sequence
  Description of Artificial Sequence: Synthetic oligonucleotide
uuuccuuccuuccuauuc

SEQ ID NO: 19811 - RNA, 18 nt, Artificial Sequence
  Description of Artificial Sequence: Synthetic oligonucleotide
aacaauuuccuuccuucc

SEQ ID NO: 19812 - RNA, 18 nt, Artificial Sequence
  Description of Artificial Sequence: Synthetic oligonucleotide
acaaaaacaauuuccuuc

SEQ ID NO: 19813 - RNA, 18 nt, Artificial Sequence
  Description of Artificial Sequence: Synthetic oligonucleotide
aaacaacaaaaacaauuu

SEQ ID NO: 19814 - RNA, 18 nt, Artificial Sequence
  Description of Artificial Sequence: Synthetic oligonucleotide
aucuuaaacaacaaaaac

SEQ ID NO: 19815 - RNA, 18 nt, Artificial Sequence
  Description of Artificial Sequence: Synthetic oligonucleotide
cuuccaucuuaaacaaca

SEQ ID NO: 19816 - RNA, 18 nt, Artificial Sequence
  Description of Artificial Sequence: Synthetic oligonucleotide
auuuccuuccaucuuaaa

SEQ ID NO: 19817 - RNA, 18 nt, Artificial Sequence
  Description of Artificial Sequence: Synthetic oligonucleotide
ccuauauuuccuuccauc

SEQ ID NO: 19818 - RNA, 18 nt, Artificial Sequence
  Description of Artificial Sequence: Synthetic oligonucleotide
augcaccuauauuuccuu

SEQ ID NO: 19819 - RNA, 18 nt, Artificial Sequence
  Description of Artificial Sequence: Synthetic oligonucleotide
uuuaaaugcaccuauauu

SEQ ID NO: 19820 - RNA, 18 nt, Artificial Sequence
  Description of Artificial Sequence: Synthetic oligonucleotide
cauuuuuuaaaugcaccu

SEQ ID NO: 19821 - RNA, 18 nt, Artificial Sequence
  Description of Artificial Sequence: Synthetic oligonucleotide
agcuccauuuuuuaaaug

SEQ ID NO: 19822 - RNA, 18 nt, Artificial Sequence
  Description of Artificial Sequence: Synthetic oligonucleotide
aaccaagcuccauuuuuu

SEQ ID NO: 19823 - RNA, 18 nt, Artificial Sequence
  Description of Artificial Sequence: Synthetic oligonucleotide
caugcaaccaagcuccau

SEQ ID NO: 19824 - RNA, 18 nt, Artificial Sequence
  Description of Artificial Sequence: Synthetic oligonucleotide
aaaaucaugcaaccaagc

SEQ ID NO: 19825 - RNA, 18 nt, Artificial Sequence
  Description of Artificial Sequence: Synthetic oligonucleotide
gagcgaaaaucaugcaac

SEQ ID NO: 19826 - RNA, 18 nt, Artificial Sequence
  Description of Artificial Sequence: Synthetic oligonucleotide
cucaagagcgaaaaucau

SEQ ID NO: 19827 - RNA, 18 nt, Artificial Sequence
  Description of Artificial Sequence: Synthetic oligonucleotide
gaugacucaagagcgaaa

SEQ ID NO: 19828 - RNA, 18 nt, Artificial Sequence
  Description of Artificial Sequence: Synthetic oligonucleotide
ggcuagaugacucaagag

SEQ ID NO: 19829 - RNA, 18 nt, Artificial Sequence
  Description of Artificial Sequence: Synthetic oligonucleotide
uagagggcuagaugacuc

SEQ ID NO: 19830 - RNA, 18 nt, Artificial Sequence
  Description of Artificial Sequence: Synthetic oligonucleotide
aucauuagagggcuagau

SEQ ID NO: 19831 - RNA, 18 nt, Artificial Sequence
  Description of Artificial Sequence: Synthetic oligonucleotide
aggcaaucauuagagggc

SEQ ID NO: 19832 - RNA, 18 nt, Artificial Sequence
  Description of Artificial Sequence: Synthetic oligonucleotide
guaugaggcaaucauuag

SEQ ID NO: 19833 - RNA, 18 nt, Artificial Sequence
  Description of Artificial Sequence: Synthetic oligonucleotide
caccgguaugaggcaauc

SEQ ID NO: 19834 - RNA, 18 nt, Artificial Sequence
  Description of Artificial Sequence: Synthetic oligonucleotide
guaaucaccgguaugagg

SEQ ID NO: 19835 - RNA, 18 nt, Artificial Sequence
  Description of Artificial Sequence: Synthetic oligonucleotide
cgcucguaaucaccggua

SEQ ID NO: 19836 - RNA, 18 nt, Artificial Sequence
  Description of Artificial Sequence: Synthetic oligonucleotide
aaagccgcucguaaucac

SEQ ID NO: 19837 - RNA, 18 nt, Artificial Sequence
  Description of Artificial Sequence: Synthetic oligonucleotide
caugaaaagccgcucgua

SEQ ID NO: 19838 - RNA, 18 nt, Artificial Sequence
  Description of Artificial Sequence: Synthetic oligonucleotide
gggucaugaaaagccgcu

SEQ ID NO: 19839 - RNA, 18 nt, Artificial Sequence
  Description of Artificial Sequence: Synthetic oligonucleotide
aaaugguacauauggaag

SEQ ID NO: 19840 - RNA, 18 nt, Artificial Sequence
  Description of Artificial Sequence: Synthetic oligonucleotide
uuuuaaaaugguacauau

SEQ ID NO: 19841 - RNA, 18 nt, Artificial Sequence
  Description of Artificial Sequence: Synthetic oligonucleotide
cagcauuuuaaaauggua

SEQ ID NO: 19842 - RNA, 18 nt, Artificial Sequence
  Description of Artificial Sequence: Synthetic oligonucleotide
guaaucagcauuuuaaaa

SEQ ID NO: 19843 - RNA, 18 nt, Artificial Sequence
  Description of Artificial Sequence: Synthetic oligonucleotide
aagaaguaaucagcauuu

SEQ ID NO: 19844 - RNA, 18 nt, Artificial Sequence
  Description of Artificial Sequence: Synthetic oligonucleotide
uucucaagaaguaaucag

SEQ ID NO: 19845 - RNA, 18 nt, Artificial Sequence
  Description of Artificial Sequence: Synthetic oligonucleotide
ucuuauucucaagaagua

SEQ ID NO: 19846 - RNA, 18 nt, Artificial Sequence
  Description of Artificial Sequence: Synthetic oligonucleotide
gcuucucuuauucucaag

SEQ ID NO: 19847 - RNA, 18 nt, Artificial Sequence
  Description of Artificial Sequence: Synthetic oligonucleotide
auuaggcuucucuuauuc

SEQ ID NO: 19848 - RNA, 18 nt, Artificial Sequence
  Description of Artificial Sequence: Synthetic oligonucleotide
cugaaauuaggcuucucu

SEQ ID NO: 19849 - RNA, 18 nt, Artificial Sequence
  Description of Artificial Sequence: Synthetic oligonucleotide
auauucugaaauuaggcu

SEQ ID NO: 19850 - RNA, 18 nt, Artificial Sequence
  Description of Artificial Sequence: Synthetic oligonucleotide
uaaugauauucugaaauu

SEQ ID NO: 19851 - RNA, 18 nt, Artificial Sequence
  Description of Artificial Sequence: Synthetic oligonucleotide
uacccuaaugauauucug

SEQ ID NO: 19852 - RNA, 18 nt, Artificial Sequence
  Description of Artificial Sequence: Synthetic oligonucleotide
auagguacccuaaugaua

SEQ ID NO: 19853 - RNA, 18 nt, Artificial Sequence
  Description of Artificial Sequence: Synthetic oligonucleotide
cuucaauagguacccuaa

SEQ ID NO: 19854 - RNA, 18 nt, Artificial Sequence
  Description of Artificial Sequence: Synthetic oligonucleotide
caagacuucaauagguac

SEQ ID NO: 19855 - RNA, 18 nt, Artificial Sequence
  Description of Artificial Sequence: Synthetic oligonucleotide
gcagucaagacuucaaua

SEQ ID NO: 19856 - RNA, 18 nt, Artificial Sequence
  Description of Artificial Sequence: Synthetic oligonucleotide
uaugugcagucaagacuu

SEQ ID NO: 19857 - RNA, 18 nt, Artificial Sequence
  Description of Artificial Sequence: Synthetic oligonucleotide
cuaaauaugugcagucaa

SEQ ID NO: 19858 - RNA, 18 nt, Artificial Sequence
  Description of Artificial Sequence: Synthetic oligonucleotide
guaugcuaaauaugugca

SEQ ID NO: 19859 - RNA, 18 nt, Artificial Sequence
  Description of Artificial Sequence: Synthetic oligonucleotide
agggaguaugcuaaauau

SEQ ID NO: 19860 - RNA, 18 nt, Artificial Sequence
  Description of Artificial Sequence: Synthetic oligonucleotide
uucccagggaguaugcua

SEQ ID NO: 19861 - RNA, 18 nt, Artificial Sequence
  Description of Artificial Sequence: Synthetic oligonucleotide
uauaauucccagggagua

SEQ ID NO: 19862 - RNA, 18 nt, Artificial Sequence
  Description of Artificial Sequence: Synthetic oligonucleotide
uaaaauauaauucccagg

SEQ ID NO: 19863 - RNA, 18 nt, Artificial Sequence
  Description of Artificial Sequence: Synthetic oligonucleotide
guccuuaaaauauaauuc

SEQ ID NO: 19864 - RNA, 18 nt, Artificial Sequence
  Description of Artificial Sequence: Synthetic oligonucleotide
aaaauguccuuaaaauau

SEQ ID NO: 19865 - RNA, 18 nt, Artificial Sequence
  Description of Artificial Sequence: Synthetic oligonucleotide
auagaaaaauguccuuaa

SEQ ID NO: 19866 - RNA, 18 nt, Artificial Sequence
  Description of Artificial Sequence: Synthetic oligonucleotide
auuuaauagaaaaauguc

SEQ ID NO: 19867 - RNA, 18 nt, Artificial Sequence
  Description of Artificial Sequence: Synthetic oligonucleotide
caaugauuuaauagaaaa

SEQ ID NO: 19868 - RNA, 18 nt, Artificial Sequence
  Description of Artificial Sequence: Synthetic oligonucleotide
auaugcaaugauuuaaua

SEQ ID NO: 19869 - RNA, 18 nt, Artificial Sequence
  Description of Artificial Sequence: Synthetic oligonucleotide
cuuccauaugcaaugauu

SEQ ID NO: 19870 - RNA, 18 nt, Artificial Sequence
  Description of Artificial Sequence: Synthetic oligonucleotide
aguuucuuccauaugcaa

SEQ ID NO: 19871 - RNA, 18 nt, Artificial Sequence
  Description of Artificial Sequence: Synthetic oligonucleotide
uauugaguuucuuccaua

SEQ ID NO: 19872 - RNA, 18 nt, Artificial Sequence
  Description of Artificial Sequence: Synthetic oligonucleotide
uauuauauugaguuucuu

SEQ ID NO: 19873 - RNA, 18 nt, Artificial Sequence
  Description of Artificial Sequence: Synthetic oligonucleotide
ucagcuauuauauugagu

SEQ ID NO: 19874 - RNA, 18 nt, Artificial Sequence
  Description of Artificial Sequence: Synthetic oligonucleotide
aaauaucagcuauuauau

SEQ ID NO: 19875 - RNA, 18 nt, Artificial Sequence
  Description of Artificial Sequence: Synthetic oligonucleotide
caaguaaauaucagcuau

SEQ ID NO: 19876 - RNA, 18 nt, Artificial Sequence
  Description of Artificial Sequence: Synthetic oligonucleotide
gaacccaaguaaauauca

SEQ ID NO: 19877 - RNA, 18 nt, Artificial Sequence
  Description of Artificial Sequence: Synthetic oligonucleotide
auuaagaacccaaguaaa

SEQ ID NO: 19878 - RNA, 18 nt, Artificial Sequence
  Description of Artificial Sequence: Synthetic oligonucleotide
uucugauuaagaacccaa

SEQ ID NO: 19879 - RNA, 18 nt, Artificial Sequence
  Description of Artificial Sequence: Synthetic oligonucleotide
caauguucugauuaagaa

SEQ ID NO: 19880 - RNA, 18 nt, Artificial Sequence
  Description of Artificial Sequence: Synthetic oligonucleotide
acagccaauguucugauu

SEQ ID NO: 19881 - RNA, 18 nt, Artificial Sequence
  Description of Artificial Sequence: Synthetic oligonucleotide
aucacacagccaauguuc

SEQ ID NO: 19882 - RNA, 18 nt, Artificial Sequence
  Description of Artificial Sequence: Synthetic oligonucleotide
ugaaaaucacacagccaa

SEQ ID NO: 19883 - RNA, 18 nt, Artificial Sequence
  Description of Artificial Sequence: Synthetic oligonucleotide
aaucaugaaaaucacaca

SEQ ID NO: 19884 - RNA, 18 nt, Artificial Sequence
  Description of Artificial Sequence: Synthetic oligonucleotide
aucauaaucaugaaaauc

SEQ ID NO: 19885 - RNA, 18 nt, Artificial Sequence
  Description of Artificial Sequence: Synthetic oligonucleotide
ugaaaaucauaaucauga

SEQ ID NO: 19886 - RNA, 18 nt, Artificial Sequence
  Description of Artificial Sequence: Synthetic oligonucleotide
ugcaaugaaaaucauaau

SEQ ID NO: 19887 - RNA, 18 nt, Artificial Sequence
  Description of Artificial Sequence: Synthetic oligonucleotide
uuaauugcaaugaaaauc

SEQ ID NO: 19888 - RNA, 18 nt, Artificial Sequence
  Description of Artificial Sequence: Synthetic oligonucleotide
ucaacuuaauugcaauga

SEQ ID NO: 19889 - RNA, 18 nt, Artificial Sequence
  Description of Artificial Sequence: Synthetic oligonucleotide
aaacaucaacuuaauugc

SEQ ID NO: 19890 - RNA, 18 nt, Artificial Sequence
  Description of Artificial Sequence: Synthetic oligonucleotide
cuacaaaacaucaacuua

SEQ ID NO: 19891 - RNA, 18 nt, Artificial Sequence
  Description of Artificial Sequence: Synthetic oligonucleotide
acugucuacaaaacauca

SEQ ID NO: 19892 - RNA, 18 nt, Artificial Sequence
  Description of Artificial Sequence: Synthetic oligonucleotide
auuucacugucuacaaaa

SEQ ID NO: 19893 - RNA, 18 nt, Artificial Sequence
  Description of Artificial Sequence: Synthetic oligonucleotide
ugguaauuucacugucua

SEQ ID NO: 19894 - RNA, 18 nt, Artificial Sequence
  Description of Artificial Sequence: Synthetic oligonucleotide
guagaugguaauuucacu

SEQ ID NO: 19895 - RNA, 18 nt, Artificial Sequence
  Description of Artificial Sequence: Synthetic oligonucleotide
uuggaguagaugguaauu

SEQ ID NO: 19896 - RNA, 18 nt, Artificial Sequence
  Description of Artificial Sequence: Synthetic oligonucleotide
aucuuuuggaguagaugg

SEQ ID NO: 19897 - RNA, 18 nt, Artificial Sequence
  Description of Artificial Sequence: Synthetic oligonucleotide
uugcaaucuuuuggagua

SEQ ID NO: 19898 - RNA, 18 nt, Artificial Sequence
  Description of Artificial Sequence: Synthetic oligonucleotide
cuauuuugcaaucuuuug

SEQ ID NO: 19899 - RNA, 18 nt, Artificial Sequence
  Description of Artificial Sequence: Synthetic oligonucleotide
aaauucuauuuugcaauc

SEQ ID NO: 19900 - RNA, 18 nt, Artificial Sequence
  Description of Artificial Sequence: Synthetic oligonucleotide
agguuaaauucuauuuug

SEQ ID NO: 19901 - RNA, 18 nt, Artificial Sequence
  Description of Artificial Sequence: Synthetic oligonucleotide
cucuaagguuaaauucua

SEQ ID NO: 19902 - RNA, 18 nt, Artificial Sequence
  Description of Artificial Sequence: Synthetic oligonucleotide
auuggcucuaagguuaaa

SEQ ID NO: 19903 - RNA, 18 nt, Artificial Sequence
  Description of Artificial Sequence: Synthetic oligonucleotide
ccugcauuggcucuaagg

SEQ ID NO: 19904 - RNA, 18 nt, Artificial Sequence
  Description of Artificial Sequence: Synthetic oligonucleotide
uuuucccugcauuggcuc

SEQ ID NO: 19905 - RNA, 18 nt, Artificial Sequence
  Description of Artificial Sequence: Synthetic oligonucleotide
acaaguuuucccugcauu

SEQ ID NO: 19906 - RNA, 18 nt, Artificial Sequence
  Description of Artificial Sequence: Synthetic oligonucleotide
cagaaacaaguuuucccu

SEQ ID NO: 19907 - RNA, 18 nt, Artificial Sequence
  Description of Artificial Sequence: Synthetic oligonucleotide
accugcagaaacaaguuu

SEQ ID NO: 19908 - RNA, 18 nt, Artificial Sequence
  Description of Artificial Sequence: Synthetic oligonucleotide
aaugcaccugcagaaaca

SEQ ID NO: 19909 - RNA, 18 nt, Artificial Sequence
  Description of Artificial Sequence: Synthetic oligonucleotide
caaaaaaugcaccugcag

SEQ ID NO: 19910 - RNA, 18 nt, Artificial Sequence
  Description of Artificial Sequence: Synthetic oligonucleotide
aguuucaaaaaaugcacc

SEQ ID NO: 19911 - RNA, 18 nt, Artificial Sequence
  Description of Artificial Sequence: Synthetic oligonucleotide
guugaaguuucaaaaaau

SEQ ID NO: 19912 - RNA, 18 nt, Artificial Sequence
  Description of Artificial Sequence: Synthetic oligonucleotide
uaucuguugaaguuucaa

SEQ ID NO: 19913 - RNA, 18 nt, Artificial Sequence
  Description of Artificial Sequence: Synthetic oligonucleotide
ccugcuaucuguugaagu

SEQ ID NO: 19914 - RNA, 18 nt, Artificial Sequence
  Description of Artificial Sequence: Synthetic oligonucleotide
uucccccugcuaucuguu

SEQ ID NO: 19915 - RNA, 18 nt, Artificial Sequence
  Description of Artificial Sequence: Synthetic oligonucleotide
uuuuuuucccccugcuau

SEQ ID NO: 19916 - RNA, 18 nt, Artificial Sequence
  Description of Artificial Sequence: Synthetic oligonucleotide
ucacuuuuuuuucccccu

SEQ ID NO: 19917 - RNA, 18 nt, Artificial Sequence
  Description of Artificial Sequence: Synthetic oligonucleotide
uucugucacuuuuuuuuc

SEQ ID NO: 19918 - RNA, 18 nt, Artificial Sequence
  Description of Artificial Sequence: Synthetic oligonucleotide
gauccuucugucacuuuu

SEQ ID NO: 19919 - RNA, 18 nt, Artificial Sequence
  Description of Artificial Sequence: Synthetic oligonucleotide
acugugauccuucuguca

SEQ ID NO: 19920 - RNA, 18 nt, Artificial Sequence
  Description of Artificial Sequence: Synthetic oligonucleotide
gcugaacugugauccuuc

SEQ ID NO: 19921 - RNA, 18 nt, Artificial Sequence
  Description of Artificial Sequence: Synthetic oligonucleotide
auacugcugaacugugau

SEQ ID NO: 19922 - RNA, 18 nt, Artificial Sequence
  Description of Artificial Sequence: Synthetic oligonucleotide
aauucauacugcugaacu

SEQ ID NO: 19923 - RNA, 18 nt, Artificial Sequence
  Description of Artificial Sequence: Synthetic oligonucleotide
cagacaauucauacugcu

SEQ ID NO: 19924 - RNA, 18 nt, Artificial Sequence
  Description of Artificial Sequence: Synthetic oligonucleotide
gccagcagacaauucaua

SEQ ID NO: 19925 - RNA, 18 nt, Artificial Sequence
  Description of Artificial Sequence: Synthetic oligonucleotide
aggcugccagcagacaau

SEQ ID NO: 19926 - RNA, 18 nt, Artificial Sequence
  Description of Artificial Sequence: Synthetic oligonucleotide
uugcaaggcugccagcag

SEQ ID NO: 19927 - RNA, 18 nt, Artificial Sequence
  Description of Artificial Sequence: Synthetic oligonucleotide
ccagauugcaaggcugcc

SEQ ID NO: 19928 - RNA, 18 nt, Artificial Sequence
  Description of Artificial Sequence: Synthetic oligonucleotide
gcacaccagauugcaagg

SEQ ID NO: 19929 - RNA, 18 nt, Artificial Sequence
  Description of Artificial Sequence: Synthetic oligonucleotide
ugccugcacaccagauug

SEQ ID NO: 19930 - RNA, 18 nt, Artificial Sequence
  Description of Artificial Sequence: Synthetic oligonucleotide
cucacugccugcacacca

SEQ ID NO: 19931 - RNA, 18 nt, Artificial Sequence
  Description of Artificial Sequence: Synthetic oligonucleotide
acaaucucacugccugca

SEQ ID NO: 19932 - RNA, 18 nt, Artificial Sequence
  Description of Artificial Sequence: Synthetic oligonucleotide
acaccacaaucucacugc

SEQ ID NO: 19933 - RNA, 18 nt, Artificial Sequence
  Description of Artificial Sequence: Synthetic oligonucleotide
cauguacaccacaaucuc

SEQ ID NO: 19934 - RNA, 18 nt, Artificial Sequence
  Description of Artificial Sequence: Synthetic oligonucleotide
ggugacauguacaccaca

SEQ ID NO: 19935 - RNA, 18 nt, Artificial Sequence
  Description of Artificial Sequence: Synthetic oligonucleotide
aaucaggugacauguaca

SEQ ID NO: 19936 - RNA, 18 nt, Artificial Sequence
  Description of Artificial Sequence: Synthetic oligonucleotide
uguaguccugguggcaug

SEQ ID NO: 19937 - RNA, 18 nt, Artificial Sequence
  Description of Artificial Sequence: Synthetic oligonucleotide
gccccuguaguccuggug

SEQ ID NO: 19938 - RNA, 18 nt, Artificial Sequence
  Description of Artificial Sequence: Synthetic oligonucleotide
acucugccccuguagucc

SEQ ID NO: 19939 - RNA, 18 nt, Artificial Sequence
  Description of Artificial Sequence: Synthetic oligonucleotide
gagacacucugccccugu

SEQ ID NO: 19940 - RNA, 18 nt, Artificial Sequence
  Description of Artificial Sequence: Synthetic oligonucleotide
cagaggagacacucugcc

SEQ ID NO: 19941 - RNA, 18 nt, Artificial Sequence
  Description of Artificial Sequence: Synthetic oligonucleotide
gcugccagaggagacacu

SEQ ID NO: 19942 - RNA, 18 nt, Artificial Sequence
  Description of Artificial Sequence: Synthetic oligonucleotide
ucagagcugccagaggag

SEQ ID NO: 19943 - RNA, 18 nt, Artificial Sequence
  Description of Artificial Sequence: Synthetic oligonucleotide
ugaucucagagcugccag

SEQ ID NO: 19944 - RNA, 18 nt, Artificial Sequence
  Description of Artificial Sequence: Synthetic oligonucleotide
ggauuugaucucagagcu

SEQ ID NO: 19945 - RNA, 18 nt, Artificial Sequence
  Description of Artificial Sequence: Synthetic oligonucleotide
ucaucggauuugaucuca

SEQ ID NO: 19946 - RNA, 18 nt, Artificial Sequence
  Description of Artificial Sequence: Synthetic oligonucleotide
ccucgucaucggauuuga

SEQ ID NO: 19947 - RNA, 18 nt, Artificial Sequence
  Description of Artificial Sequence: Synthetic oligonucleotide
aucacccucgucaucgga

SEQ ID NO: 19948 - RNA, 18 nt, Artificial Sequence
  Description of Artificial Sequence: Synthetic oligonucleotide
uucucaucacccucguca

SEQ ID NO: 19949 - RNA, 18 nt, Artificial Sequence
  Description of Artificial Sequence: Synthetic oligonucleotide
gcagguucucaucacccu

SEQ ID NO: 19950 - RNA, 18 nt, Artificial Sequence
  Description of Artificial Sequence: Synthetic oligonucleotide
gucuugcagguucucauc

SEQ ID NO: 19951 - RNA, 18 nt, Artificial Sequence
  Description of Artificial Sequence: Synthetic oligonucleotide
uucgugucuugcagguuc

SEQ ID NO: 19952 - RNA, 18 nt, Artificial Sequence
  Description of Artificial Sequence: Synthetic oligonucleotide
aagauuucgugucuugca

SEQ ID NO: 19953 - RNA, 18 nt, Artificial Sequence
  Description of Artificial Sequence: Synthetic oligonucleotide
cuccgaagauuucguguc

SEQ ID NO: 19954 - RNA, 18 nt, Artificial Sequence
  Description of Artificial Sequence: Synthetic oligonucleotide
uuguccuccgaagauuuc

SEQ ID NO: 19955 - RNA, 18 nt, Artificial Sequence
  Description of Artificial Sequence: Synthetic oligonucleotide
auuucuuguccuccgaag

SEQ ID NO: 19956 - RNA, 18 nt, Artificial Sequence
  Description of Artificial Sequence: Synthetic oligonucleotide
aucuaauuucuuguccuc

SEQ ID NO: 19957 - RNA, 18 nt, Artificial Sequence
  Description of Artificial Sequence: Synthetic oligonucleotide
ucgucaucuaauuucuug

SEQ ID NO: 19958 - RNA, 18 nt, Artificial Sequence
  Description of Artificial Sequence: Synthetic oligonucleotide
ucuugucgucaucuaauu

SEQ ID NO: 19959 - RNA, 18 nt, Artificial Sequence
  Description of Artificial Sequence: Synthetic oligonucleotide
auccuucuugucgucauc

SEQ ID NO: 19960 - RNA, 18 nt, Artificial Sequence
  Description of Artificial Sequence: Synthetic oligonucleotide
uugauauccuucuugucg

SEQ ID NO: 19961 - RNA, 18 nt, Artificial Sequence
  Description of Artificial Sequence: Synthetic oligonucleotide
uugauuugauauccuucu

SEQ ID NO: 19962 - RNA, 18 nt, Artificial Sequence
  Description of Artificial Sequence: Synthetic oligonucleotide
aguaauugauuugauauc

SEQ ID NO: 19963 - RNA, 18 nt, Artificial Sequence
  Description of Artificial Sequence: Synthetic oligonucleotide
gaccuaguaauugauuug

SEQ ID NO: 19964 - RNA, 18 nt, Artificial Sequence
  Description of Artificial Sequence: Synthetic oligonucleotide
aucuugaccuaguaauug

SEQ ID NO: 19965 - RNA, 18 nt, Artificial Sequence
  Description of Artificial Sequence: Synthetic oligonucleotide
uggcaucacggacaaugc

SEQ ID NO: 19966 - RNA, 18 nt, Artificial Sequence
  Description of Artificial Sequence: Synthetic oligonucleotide
acggcuggcaucacggac

SEQ ID NO: 19967 - RNA, 18 nt, Artificial Sequence
  Description of Artificial Sequence: Synthetic oligonucleotide
ugugcacggcuggcauca

SEQ ID NO: 19968 - RNA, 18 nt, Artificial Sequence
  Description of Artificial Sequence: Synthetic oligonucleotide
gaaggugugcacggcugg

SEQ ID NO: 19969 - RNA, 18 nt, Artificial Sequence
  Description of Artificial Sequence: Synthetic oligonucleotide
agagagaaggugugcacg

SEQ ID NO: 19970 - RNA, 18 nt, Artificial Sequence
  Description of Artificial Sequence: Synthetic oligonucleotide
caaagagagagaaggugu

SEQ ID NO: 19971 - RNA, 18 nt, Artificial Sequence
  Description of Artificial Sequence: Synthetic oligonucleotide
ucccgcaaagagagagaa

SEQ ID NO: 19972 - RNA, 18 nt, Artificial Sequence
  Description of Artificial Sequence: Synthetic oligonucleotide
gccaaucccgcaaagaga

SEQ ID NO: 19973 - RNA, 18 nt, Artificial Sequence
  Description of Artificial Sequence: Synthetic oligonucleotide
agacugccaaucccgcaa

SEQ ID NO: 19974 - RNA, 18 nt, Artificial Sequence
  Description of Artificial Sequence: Synthetic oligonucleotide
aaugaagacugccaaucc

SEQ ID NO: 19975 - RNA, 18 nt, Artificial Sequence
  Description of Artificial Sequence: Synthetic oligonucleotide
aagucaaugaagacugcc

SEQ ID NO: 19976 - RNA, 18 nt, Artificial Sequence
  Description of Artificial Sequence: Synthetic oligonucleotide
gaagaaagucaaugaaga

SEQ ID NO: 19977 - RNA, 18 nt, Artificial Sequence
  Description of Artificial Sequence: Synthetic oligonucleotide
cugcagaagaaagucaau

SEQ ID NO: 19978 - RNA, 18 nt, Artificial Sequence
  Description of Artificial Sequence: Synthetic oligonucleotide
guaaucugcagaagaaag

SEQ ID NO: 19979 - RNA, 18 nt, Artificial Sequence
  Description of Artificial Sequence: Synthetic oligonucleotide
aacagguaaucugcagaa

SEQ ID NO: 19980 - RNA, 18 nt, Artificial Sequence
  Description of Artificial Sequence: Synthetic oligonucleotide
cacgaaacagguaaucug

SEQ ID NO: 19981 - RNA, 18 nt, Artificial Sequence
  Description of Artificial Sequence: Synthetic oligonucleotide
agacucacgaaacaggua

SEQ ID NO: 19982 - RNA, 18 nt, Artificial Sequence
  Description of Artificial Sequence: Synthetic oligonucleotide
ccaagagacucacgaaac

SEQ ID NO: 19983 - RNA, 18 nt, Artificial Sequence
  Description of Artificial Sequence: Synthetic oligonucleotide
uaaccccaagagacucac

SEQ ID NO: 19984 - RNA, 18 nt, Artificial Sequence
  Description of Artificial Sequence: Synthetic oligonucleotide
augucuaaccccaagaga

SEQ ID NO: 19985 - RNA, 18 nt, Artificial Sequence
  Description of Artificial Sequence: Synthetic oligonucleotide
guuuaaugucuaacccca

SEQ ID NO: 19986 - RNA, 18 nt, Artificial Sequence
  Description of Artificial Sequence: Synthetic oligonucleotide
uugacguuuaaugucuaa

SEQ ID NO: 19987 - RNA, 18 nt, Artificial Sequence
  Description of Artificial Sequence: Synthetic oligonucleotide
cuauaauccuggcaccaa

SEQ ID NO: 19988 - RNA, 18 nt, Artificial Sequence
  Description of Artificial Sequence: Synthetic oligonucleotide
auagacuauaauccuggc

SEQ ID NO: 19989 - RNA, 18 nt, Artificial Sequence
  Description of Artificial Sequence: Synthetic oligonucleotide
auuaaauagacuauaauc

SEQ ID NO: 19990 - RNA, 18 nt, Artificial Sequence
  Description of Artificial Sequence: Synthetic oligonucleotide
cucaaauuaaauagacua

SEQ ID NO: 19991 - RNA, 18 nt, Artificial Sequence
  Description of Artificial Sequence: Synthetic oligonucleotide
cuagacucaaauuaaaua

SEQ ID NO: 19992 - RNA, 18 nt, Artificial Sequence
  Description of Artificial Sequence: Synthetic oligonucleotide
agauucuagacucaaauu

SEQ ID NO: 19993 - RNA, 18 nt, Artificial Sequence
  Description of Artificial Sequence: Synthetic oligonucleotide
ccucuagauucuagacuc

SEQ ID NO: 19994 - RNA, 18 nt, Artificial Sequence
  Description of Artificial Sequence: Synthetic oligonucleotide
ugcuuccucuagauucua

SEQ ID NO: 19995 - RNA, 18 nt, Artificial Sequence
  Description of Artificial Sequence: Synthetic oligonucleotide
cuagcugcuuccucuaga

SEQ ID NO: 19996 - RNA, 18 nt, Artificial Sequence
  Description of Artificial Sequence: Synthetic oligonucleotide
acccgcuagcugcuuccu

SEQ ID NO: 19997 - RNA, 18 nt, Artificial Sequence
  Description of Artificial Sequence: Synthetic oligonucleotide
guuauacccgcuagcugc

SEQ ID NO: 19998 - RNA, 18 nt, Artificial Sequence
  Description of Artificial Sequence: Synthetic oligonucleotide
caaagguuauacccgcua

SEQ ID NO: 19999 - RNA, 18 nt, Artificial Sequence
  Description of Artificial Sequence: Synthetic oligonucleotide
ucaaauuaaauagacuau

SEQ ID NO: 20000 - RNA, 18 nt, Artificial Sequence
  Description of Artificial Sequence: Synthetic oligonucleotide
uagacucaaauuaaauag

SEQ ID NO: 20001 - RNA, 18 nt, Artificial Sequence
  Description of Artificial Sequence: Synthetic oligonucleotide
gauucuagacucaaauua

SEQ ID NO: 20002 - RNA, 18 nt, Artificial Sequence
  Description of Artificial Sequence: Synthetic oligonucleotide
cucuagauucuagacuca

SEQ ID NO: 20003 - RNA, 18 nt, Artificial Sequence
  Description of Artificial Sequence: Synthetic oligonucleotide
gcuuccucuagauucuag

SEQ ID NO: 20004 - RNA, 18 nt, Artificial Sequence
  Description of Artificial Sequence: Synthetic oligonucleotide
uagcugcuuccucuagau

SEQ ID NO: 20005 - RNA, 18 nt, Artificial Sequence
  Description of Artificial Sequence: Synthetic oligonucleotide
cccgcuagcugcuuccuc

SEQ ID NO: 20006 - RNA, 18 nt, Artificial Sequence
  Description of Artificial Sequence: Synthetic oligonucleotide
uuauacccgcuagcugcu

SEQ ID NO: 20007 - RNA, 18 nt, Artificial Sequence
  Description of Artificial Sequence: Synthetic oligonucleotide
aaagguuauacccgcuag

SEQ ID NO: 20008 - RNA, 18 nt, Artificial Sequence
  Description of Artificial Sequence: Synthetic oligonucleotide
gaaacaaagguuauaccc

SEQ ID NO: 20009 - RNA, 18 nt, Artificial Sequence
  Description of Artificial Sequence: Synthetic oligonucleotide
agaugucuagccgauuuu

SEQ ID NO: 20010 - RNA, 18 nt, Artificial Sequence
  Description of Artificial Sequence: Synthetic oligonucleotide
gcaaaagaugucuagccg

SEQ ID NO: 20011 - RNA, 18 nt, Artificial Sequence
  Description of Artificial Sequence: Synthetic oligonucleotide
acacagcaaaagaugucu

SEQ ID NO: 20012 - RNA, 18 nt, Artificial Sequence
  Description of Artificial Sequence: Synthetic oligonucleotide
cucugacacagcaaaaga

SEQ ID NO: 20013 - RNA, 18 nt, Artificial Sequence
  Description of Artificial Sequence: Synthetic oligonucleotide
agcaccucugacacagca

SEQ ID NO: 20014 - RNA, 18 nt, Artificial Sequence
  Description of Artificial Sequence: Synthetic oligonucleotide
ucuucagcaccucugaca

SEQ ID NO: 20015 - RNA, 18 nt, Artificial Sequence
  Description of Artificial Sequence: Synthetic oligonucleotide
uuccaucuucagcaccuc

SEQ ID NO: 20016 - RNA, 18 nt, Artificial Sequence
  Description of Artificial Sequence: Synthetic oligonucleotide
gcuuguuccaucuucagc

SEQ ID NO: 20017 - RNA, 18 nt, Artificial Sequence
  Description of Artificial Sequence: Synthetic oligonucleotide
uggacgcuuguuccaucu

SEQ ID NO: 20018 - RNA, 18 nt, Artificial Sequence
  Description of Artificial Sequence: Synthetic oligonucleotide
aggccuggacgcuuguuc

SEQ ID NO: 20019 - RNA, 18 nt, Artificial Sequence
  Description of Artificial Sequence: Synthetic oligonucleotide
cucugaggccuggacgcu

SEQ ID NO: 20020 - RNA, 18 nt, Artificial Sequence
  Description of Artificial Sequence: Synthetic oligonucleotide
cagcucucugaggccugg

SEQ ID NO: 20021 - RNA, 18 nt, Artificial Sequence
  Description of Artificial Sequence: Synthetic oligonucleotide
acaaacagcucucugagg

SEQ ID NO: 20022 - RNA, 18 nt, Artificial Sequence
  Description of Artificial Sequence: Synthetic oligonucleotide
gcgaaacaaacagcucuc

SEQ ID NO: 20023 - RNA, 18 nt, Artificial Sequence
  Description of Artificial Sequence: Synthetic oligonucleotide
aagaagcgaaacaaacag

SEQ ID NO: 20024 - RNA, 18 nt, Artificial Sequence
  Description of Artificial Sequence: Synthetic oligonucleotide
uuuugaagaagcgaaaca

SEQ ID NO: 20025 - RNA, 18 nt, Artificial Sequence
  Description of Artificial Sequence: Synthetic oligonucleotide
ggaguuuuugaagaagcg

SEQ ID NO: 20026 - RNA, 18 nt, Artificial Sequence
  Description of Artificial Sequence: Synthetic oligonucleotide
gaauaggaguuuuugaag

SEQ ID NO: 20027 - RNA, 18 nt, Artificial Sequence
  Description of Artificial Sequence: Synthetic oligonucleotide
guggagaauaggaguuuu

SEQ ID NO: 20028 - RNA, 18 nt, Artificial Sequence
  Description of Artificial Sequence: Synthetic oligonucleotide
cagaaguggagaauagga

SEQ ID NO: 20029 - RNA, 18 nt, Artificial Sequence
  Description of Artificial Sequence: Synthetic oligonucleotide
uuuagcagaaguggagaa

SEQ ID NO: 20030 - RNA, 18 nt, Artificial Sequence
  Description of Artificial Sequence: Synthetic oligonucleotide
aguccuuuagcagaagug

SEQ ID NO: 20031 - RNA, 18 nt, Artificial Sequence
  Description of Artificial Sequence: Synthetic oligonucleotide
cauccaguccuuuagcag

SEQ ID NO: 20032 - RNA, 18 nt, Artificial Sequence
  Description of Artificial Sequence: Synthetic oligonucleotide
ggucucauccaguccuuu

SEQ ID NO: 20033 - RNA, 18 nt, Artificial Sequence
  Description of Artificial Sequence: Synthetic oligonucleotide
caauuggucucauccagu

SEQ ID NO: 20034 - RNA, 18 nt, Artificial Sequence
  Description of Artificial Sequence: Synthetic oligonucleotide
cgacaaagagauucagca

SEQ ID NO: 20035 - RNA, 18 nt, Artificial Sequence
  Description of Artificial Sequence: Synthetic oligonucleotide
gacggcgacaaagagauu

SEQ ID NO: 20036 - RNA, 18 nt, Artificial Sequence
  Description of Artificial Sequence: Synthetic oligonucleotide
augaugacggcgacaaag

SEQ ID NO: 20037 - RNA, 18 nt, Artificial Sequence
  Description of Artificial Sequence: Synthetic oligonucleotide
uguccaugaugacggcga

SEQ ID NO: 20038 - RNA, 18 nt, Artificial Sequence
  Description of Artificial Sequence: Synthetic oligonucleotide
aaaguuguccaugaugac

SEQ ID NO: 20039 - RNA, 18 nt, Artificial Sequence
  Description of Artificial Sequence: Synthetic oligonucleotide
uacucaaaguuguccaug

SEQ ID NO: 20040 - RNA, 18 nt, Artificial Sequence
  Description of Artificial Sequence: Synthetic oligonucleotide
ugagguacucaaaguugu

SEQ ID NO: 20041 - RNA, 18 nt, Artificial Sequence
  Description of Artificial Sequence: Synthetic oligonucleotide
ucgggugagguacucaaa

SEQ ID NO: 20042 - RNA, 18 nt, Artificial Sequence
  Description of Artificial Sequence: Synthetic oligonucleotide
gagucucgggugagguac

SEQ ID NO: 20043 - RNA, 18 nt, Artificial Sequence
  Description of Artificial Sequence: Synthetic oligonucleotide
uggaggagucucggguga

SEQ ID NO: 20044 - RNA, 18 nt, Artificial Sequence
  Description of Artificial Sequence: Synthetic oligonucleotide
caggauggaggagucucg

SEQ ID NO: 20045 - RNA, 18 nt, Artificial Sequence
  Description of Artificial Sequence: Synthetic oligonucleotide
gggcccaggauggaggag

SEQ ID NO: 20046 - RNA, 18 nt, Artificial Sequence
  Description of Artificial Sequence: Synthetic oligonucleotide
acucauccaggugguggg

SEQ ID NO: 20047 - RNA, 18 nt, Artificial Sequence
  Description of Artificial Sequence: Synthetic oligonucleotide
acguacucauccaggugg

SEQ ID NO: 20048 - RNA, 18 nt, Artificial Sequence
  Description of Artificial Sequence: Synthetic oligonucleotide
cacgcacguacucaucca

SEQ ID NO: 20049 - RNA, 18 nt, Artificial Sequence
  Description of Artificial Sequence: Synthetic oligonucleotide
ccagacacgcacguacuc

SEQ ID NO: 20050 - RNA, 18 nt, Artificial Sequence
  Description of Artificial Sequence: Synthetic oligonucleotide
ucggcccagacacgcacg

SEQ ID NO: 20051 - RNA, 18 nt, Artificial Sequence
  Description of Artificial Sequence: Synthetic oligonucleotide
cauacucggcccagacac

SEQ ID NO: 20052 - RNA, 18 nt, Artificial Sequence
  Description of Artificial Sequence: Synthetic oligonucleotide
auuguggcuggaggauuc

SEQ ID NO: 20053 - RNA, 18 nt, Artificial Sequence
  Description of Artificial Sequence: Synthetic oligonucleotide
ugaguauuguggcuggag

SEQ ID NO: 20054 - RNA, 18 nt, Artificial Sequence
  Description of Artificial Sequence: Synthetic oligonucleotide
agaggugaguauuguggc

SEQ ID NO: 20055 - RNA, 18 nt, Artificial Sequence
  Description of Artificial Sequence: Synthetic oligonucleotide
cagggagaggugaguauu

SEQ ID NO: 20056 - RNA, 18 nt, Artificial Sequence
  Description of Artificial Sequence: Synthetic oligonucleotide
aguuccagggagagguga

SEQ ID NO: 20057 - RNA, 18 nt, Artificial Sequence
  Description of Artificial Sequence: Synthetic oligonucleotide
guuccaguuccagggaga

SEQ ID NO: 20058 - RNA, 18 nt, Artificial Sequence
  Description of Artificial Sequence: Synthetic oligonucleotide
cccguguuccaguuccag

SEQ ID NO: 20059 - RNA, 18 nt, Artificial Sequence
  Description of Artificial Sequence: Synthetic oligonucleotide
ccuagcccguguuccagu

SEQ ID NO: 20060 - RNA, 18 nt, Artificial Sequence
  Description of Artificial Sequence: Synthetic oligonucleotide
ccugaccuagcccguguu

SEQ ID NO: 20061 - RNA, 18 nt, Artificial Sequence
  Description of Artificial Sequence: Synthetic oligonucleotide
gggccugaccuagcccgu

SEQ ID NO: 20062 - RNA, 18 nt, Artificial Sequence
  Description of Artificial Sequence: Synthetic oligonucleotide
agugcuccagagucuggg

SEQ ID NO: 20063 - RNA, 18 nt, Artificial Sequence
  Description of Artificial Sequence: Synthetic oligonucleotide
aguucagugcuccagagu

SEQ ID NO: 20064 - RNA, 18 nt, Artificial Sequence
  Description of Artificial Sequence: Synthetic oligonucleotide
ccaggaguucagugcucc

SEQ ID NO: 20065 - RNA, 18 nt, Artificial Sequence
  Description of Artificial Sequence: Synthetic oligonucleotide
ggaccccaggaguucagu

SEQ ID NO: 20066 - RNA, 18 nt, Artificial Sequence
  Description of Artificial Sequence: Synthetic oligonucleotide
ugcuaggaccccaggagu

SEQ ID NO: 20067 - RNA, 18 nt, Artificial Sequence
  Description of Artificial Sequence: Synthetic oligonucleotide
accccugcuaggacccca

SEQ ID NO: 20068 - RNA, 18 nt, Artificial Sequence
  Description of Artificial Sequence: Synthetic oligonucleotide
gugagaccccugcuagga

SEQ ID NO: 20069 - RNA, 18 nt, Artificial Sequence
  Description of Artificial Sequence: Synthetic oligonucleotide
aaccugugagaccccugc

SEQ ID NO: 20070 - RNA, 18 nt, Artificial Sequence
  Description of Artificial Sequence: Synthetic oligonucleotide
gacugaaccugugagacc

SEQ ID NO: 20071 - RNA, 18 nt, Artificial Sequence
  Description of Artificial Sequence: Synthetic oligonucleotide
cuccugacugaaccugug

SEQ ID NO: 20072 - RNA, 18 nt, Artificial Sequence
  Description of Artificial Sequence: Synthetic oligonucleotide
cuucucuccugacugaac

SEQ ID NO: 20073 - RNA, 18 nt, Artificial Sequence
  Description of Artificial Sequence: Synthetic oligonucleotide
uauaucuucucuccugac

SEQ ID NO: 20074 - RNA, 18 nt, Artificial Sequence
  Description of Artificial Sequence: Synthetic oligonucleotide
auucuuauaucuucucuc

SEQ ID NO: 20075 - RNA, 18 nt, Artificial Sequence
  Description of Artificial Sequence: Synthetic oligonucleotide
ugaugauucuuauaucuu

SEQ ID NO: 20076 - RNA, 18 nt, Artificial Sequence
  Description of Artificial Sequence: Synthetic oligonucleotide
aagggugaugauucuuau

SEQ ID NO: 20077 - RNA, 18 nt, Artificial Sequence
  Description of Artificial Sequence: Synthetic oligonucleotide
uaugcaagggugaugauu

SEQ ID NO: 20078 - RNA, 18 nt, Artificial Sequence
  Description of Artificial Sequence: Synthetic oligonucleotide
ggguaugcaagggugaug

SEQ ID NO: 20079 - RNA, 18 nt, Artificial Sequence
  Description of Artificial Sequence: Synthetic oligonucleotide
cuacguguuuaaucuggg

SEQ ID NO: 20080 - RNA, 18 nt, Artificial Sequence
  Description of Artificial Sequence: Synthetic oligonucleotide
gcacccuacguguuuaau

SEQ ID NO: 20081 - RNA, 18 nt, Artificial Sequence
  Description of Artificial Sequence: Synthetic oligonucleotide
gguuggcacccuacgugu

SEQ ID NO: 20082 - RNA, 18 nt, Artificial Sequence
  Description of Artificial Sequence: Synthetic oligonucleotide
ggcaggguuggcacccua

SEQ ID NO: 20083 - RNA, 18 nt, Artificial Sequence
  Description of Artificial Sequence: Synthetic oligonucleotide
guuugggcaggguuggca

SEQ ID NO: 20084 - RNA, 18 nt, Artificial Sequence
  Description of Artificial Sequence: Synthetic oligonucleotide
ccaggguuugggcagggu

SEQ ID NO: 20085 - RNA, 18 nt, Artificial Sequence
  Description of Artificial Sequence: Synthetic oligonucleotide
aaaguccaggguuugggc

SEQ ID NO: 20086 - RNA, 18 nt, Artificial Sequence
  Description of Artificial Sequence: Synthetic oligonucleotide
cccagaaaguccaggguu

SEQ ID NO: 20087 - RNA, 18 nt, Artificial Sequence
  Description of Artificial Sequence: Synthetic oligonucleotide
cauuucccagaaagucca

SEQ ID NO: 20088 - RNA, 18 nt, Artificial Sequence
  Description of Artificial Sequence: Synthetic oligonucleotide
ucccucauuucccagaaa

SEQ ID NO: 20089 - RNA, 18 nt, Artificial Sequence
  Description of Artificial Sequence: Synthetic oligonucleotide
cgcccucccucauuuccc

SEQ ID NO: 20090 - RNA, 18 nt, Artificial Sequence
  Description of Artificial Sequence: Synthetic oligonucleotide
guugacgcccucccucau

SEQ ID NO: 20091 - RNA, 18 nt, Artificial Sequence
  Description of Artificial Sequence: Synthetic oligonucleotide
ucaugguugacgcccucc

SEQ ID NO: 20092 - RNA, 18 nt, Artificial Sequence
  Description of Artificial Sequence: Synthetic oligonucleotide
acaucucaugguugacgc

SEQ ID NO: 20093 - RNA, 18 nt, Artificial Sequence
  Description of Artificial Sequence: Synthetic oligonucleotide
ucaggacaucucaugguu

SEQ ID NO: 20094 - RNA, 18 nt, Artificial Sequence
  Description of Artificial Sequence: Synthetic oligonucleotide
gcucuucaggacaucuca

SEQ ID NO: 20095 - RNA, 18 nt, Artificial Sequence
  Description of Artificial Sequence: Synthetic oligonucleotide
agagggcucuucaggaca

SEQ ID NO: 20096 - RNA, 18 nt, Artificial Sequence
  Description of Artificial Sequence: Synthetic oligonucleotide
ggaggagagggcucuuca

SEQ ID NO: 20097 - RNA, 18 nt, Artificial Sequence
  Description of Artificial Sequence: Synthetic oligonucleotide
ucguaggaggagagggcu

SEQ ID NO: 20098 - RNA, 18 nt, Artificial Sequence
  Description of Artificial Sequence: Synthetic oligonucleotide
gagacucguaggaggaga

SEQ ID NO: 20099 - RNA, 18 nt, Artificial Sequence
  Description of Artificial Sequence: Synthetic oligonucleotide
caggagagacucguagga

SEQ ID NO: 20100 - RNA, 18 nt, Artificial Sequence
  Description of Artificial Sequence: Synthetic oligonucleotide
agagacaggagagacucg

SEQ ID NO: 20101 - RNA, 18 nt, Artificial Sequence
  Description of Artificial Sequence: Synthetic oligonucleotide
cagugagagacaggagag

SEQ ID NO: 20102 - RNA, 18 nt, Artificial Sequence
  Description of Artificial Sequence: Synthetic oligonucleotide
cuucacagugagagacag

SEQ ID NO: 20103 - RNA, 18 nt, Artificial Sequence
  Description of Artificial Sequence: Synthetic oligonucleotide
ggagacuucacagugaga

SEQ ID NO: 20104 - RNA, 18 nt, Artificial Sequence
  Description of Artificial Sequence: Synthetic oligonucleotide
caucuggagacuucacag

SEQ ID NO: 20105 - RNA, 18 nt, Artificial Sequence
  Description of Artificial Sequence: Synthetic oligonucleotide
cucaccaucuggagacuu

SEQ ID NO: 20106 - RNA, 18 nt, Artificial Sequence
  Description of Artificial Sequence: Synthetic oligonucleotide
gcauccucaccaucugga

SEQ ID NO: 20107 - RNA, 18 nt, Artificial Sequence
  Description of Artificial Sequence: Synthetic oligonucleotide
cuaaugcauccucaccau

SEQ ID NO: 20108 - RNA, 18 nt, Artificial Sequence
  Description of Artificial Sequence: Synthetic oligonucleotide
ccuggcuaaugcauccuc

SEQ ID NO: 20109 - RNA, 18 nt, Artificial Sequence
  Description of Artificial Sequence: Synthetic oligonucleotide
uggagccuggcuaaugca

SEQ ID NO: 20110 - RNA, 18 nt, Artificial Sequence
  Description of Artificial Sequence: Synthetic oligonucleotide
cucccuggagccuggcua

SEQ ID NO: 20111 - RNA, 18 nt, Artificial Sequence
  Description of Artificial Sequence: Synthetic oligonucleotide
guuuucucccuggagccu

SEQ ID NO: 20112 - RNA, 18 nt, Artificial Sequence
  Description of Artificial Sequence: Synthetic oligonucleotide
uguugguuuucucccugg

SEQ ID NO: 20113 - RNA, 18 nt, Artificial Sequence
  Description of Artificial Sequence: Synthetic oligonucleotide
gaugcuguugguuuucuc

SEQ ID NO: 20114 - RNA, 18 nt, Artificial Sequence
  Description of Artificial Sequence: Synthetic oligonucleotide
gcugggaugcuguugguu

SEQ ID NO: 20115 - RNA, 18 nt, Artificial Sequence
  Description of Artificial Sequence: Synthetic oligonucleotide
cugaggcugggaugcugu

SEQ ID NO: 20116 - RNA, 18 nt, Artificial Sequence
  Description of Artificial Sequence: Synthetic oligonucleotide
gagaacugaggcugggau

SEQ ID NO: 20117 - RNA, 18 nt, Artificial Sequence
  Description of Artificial Sequence: Synthetic oligonucleotide
cucaagagaacugaggcu

SEQ ID NO: 20118 - RNA, 18 nt, Artificial Sequence
  Description of Artificial Sequence: Synthetic oligonucleotide
acacucucaagagaacug

SEQ ID NO: 20119 - RNA, 18 nt, Artificial Sequence
  Description of Artificial Sequence: Synthetic oligonucleotide
uccccacacucucaagag

SEQ ID NO: 20120 - RNA, 18 nt, Artificial Sequence
  Description of Artificial Sequence: Synthetic oligonucleotide
ccuccuccccacacucuc

SEQ ID NO: 20121 - RNA, 18 nt, Artificial Sequence
  Description of Artificial Sequence: Synthetic oligonucleotide
ccagcccuccuccccaca

SEQ ID NO: 20122 - RNA, 18 nt, Artificial Sequence
  Description of Artificial Sequence: Synthetic oligonucleotide
guaggccagcccuccucc

SEQ ID NO: 20123 - RNA, 18 nt, Artificial Sequence
  Description of Artificial Sequence: Synthetic oligonucleotide
caaggguaggccagcccu

SEQ ID NO: 20124 - RNA, 18 nt, Artificial Sequence
  Description of Artificial Sequence: Synthetic oligonucleotide
ucugccaaggguaggcca

SEQ ID NO: 20125 - RNA, 18 nt, Artificial Sequence
  Description of Artificial Sequence: Synthetic oligonucleotide
uccugucugccaagggua

SEQ ID NO: 20126 - RNA, 18 nt, Artificial Sequence
  Description of Artificial Sequence: Synthetic oligonucleotide
gccaauccugucugccaa

SEQ ID NO: 20127 - RNA, 18 nt, Artificial Sequence
  Description of Artificial Sequence: Synthetic oligonucleotide
uugcugccaauccugucu

SEQ ID NO: 20128 - RNA, 18 nt, Artificial Sequence
  Description of Artificial Sequence: Synthetic oligonucleotide
ugauguugcugccaaucc

SEQ ID NO: 20129 - RNA, 18 nt, Artificial Sequence
  Description of Artificial Sequence: Synthetic oligonucleotide
uacucugauguugcugcc

SEQ ID NO: 20130 - RNA, 18 nt, Artificial Sequence
  Description of Artificial Sequence: Synthetic oligonucleotide
ucugcuacucugauguug

SEQ ID NO: 20131 - RNA, 18 nt, Artificial Sequence
  Description of Artificial Sequence: Synthetic oligonucleotide
ugaguucugcuacucuga

SEQ ID NO: 20132 - RNA, 18 nt, Artificial Sequence
  Description of Artificial Sequence: Synthetic oligonucleotide
ggagcugaguucugcuac

SEQ ID NO: 20133 - RNA, 18 nt, Artificial Sequence
  Description of Artificial Sequence: Synthetic oligonucleotide
cagugggagcugaguucu

SEQ ID NO: 20134 - RNA, 18 nt, Artificial Sequence
  Description of Artificial Sequence: Synthetic oligonucleotide
ggucccagugggagcuga

SEQ ID NO: 20135 - RNA, 18 nt, Artificial Sequence
  Description of Artificial Sequence: Synthetic oligonucleotide
ucacgggucccaguggga

SEQ ID NO: 20136 - RNA, 18 nt, Artificial Sequence
  Description of Artificial Sequence: Synthetic oligonucleotide
cagguucacgggucccag

SEQ ID NO: 20137 - RNA, 18 nt, Artificial Sequence
  Description of Artificial Sequence: Synthetic oligonucleotide
acucccagguucacgggu

SEQ ID NO: 20138 - RNA, 18 nt, Artificial Sequence
  Description of Artificial Sequence: Synthetic oligonucleotide
cucucacucccagguuca

SEQ ID NO: 20139 - RNA, 18 nt, Artificial Sequence
  Description of Artificial Sequence: Synthetic oligonucleotide
auguccucucacucccag

SEQ ID NO: 20140 - RNA, 18 nt, Artificial Sequence
  Description of Artificial Sequence: Synthetic oligonucleotide
ccuguauguccucucacu

SEQ ID NO: 20141 - RNA, 18 nt, Artificial Sequence
  Description of Artificial Sequence: Synthetic oligonucleotide
ccuggccuguauguccuc

SEQ ID NO: 20142 - RNA, 18 nt, Artificial Sequence
  Description of Artificial Sequence: Synthetic oligonucleotide
ccuccccuggccuguaug

SEQ ID NO: 20143 - RNA, 18 nt, Artificial Sequence
  Description of Artificial Sequence: Synthetic oligonucleotide
ugcguccuccccuggccu

SEQ ID NO: 20144 - RNA, 18 nt, Artificial Sequence
  Description of Artificial Sequence: Synthetic oligonucleotide
ggcucugcguccuccccu

SEQ ID NO: 20145 - RNA, 18 nt, Artificial Sequence
  Description of Artificial Sequence: Synthetic oligonucleotide
ccugaggcucugcguccu

SEQ ID NO: 20146 - RNA, 18 nt, Artificial Sequence
  Description of Artificial Sequence: Synthetic oligonucleotide
ugccucagccucccaagu

SEQ ID NO: 20147 - RNA, 18 nt, Artificial Sequence
  Description of Artificial Sequence: Synthetic oligonucleotide
ccuucugccucagccucc

SEQ ID NO: 20148 - RNA, 18 nt, Artificial Sequence
  Description of Artificial Sequence: Synthetic oligonucleotide
gcaauccuucugccucag

SEQ ID NO: 20149 - RNA, 18 nt, Artificial Sequence
  Description of Artificial Sequence: Synthetic oligonucleotide
cucaagcaauccuucugc

SEQ ID NO: 20150 - RNA, 18 nt, Artificial Sequence
  Description of Artificial Sequence: Synthetic oligonucleotide
cugggcucaagcaauccu

SEQ ID NO: 20151 - RNA, 18 nt, Artificial Sequence
  Description of Artificial Sequence: Synthetic oligonucleotide
accuccugggcucaagca

SEQ ID NO: 20152 - RNA, 18 nt, Artificial Sequence
  Description of Artificial Sequence: Synthetic oligonucleotide
ccuccaccuccugggcuc

SEQ ID NO: 20153 - RNA, 18 nt, Artificial Sequence
  Description of Artificial Sequence: Synthetic oligonucleotide
ugcagccuccaccuccug

SEQ ID NO: 20154 - RNA, 18 nt, Artificial Sequence
  Description of Artificial Sequence: Synthetic oligonucleotide
cucacugcagccuccacc

SEQ ID NO: 20155 - RNA, 18 nt, Artificial Sequence
  Description of Artificial Sequence: Synthetic oligonucleotide
cauagcucacugcagccu

SEQ ID NO: 20156 - RNA, 18 nt, Artificial Sequence
  Description of Artificial Sequence: Synthetic oligonucleotide
gugaucauagcucacugc

SEQ ID NO: 20157 - RNA, 18 nt, Artificial Sequence
  Description of Artificial Sequence: Synthetic oligonucleotide
guggugugaucauagcuc

SEQ ID NO: 20158 - RNA, 18 nt, Artificial Sequence
  Description of Artificial Sequence: Synthetic oligonucleotide
gugcaguggugugaucau

SEQ ID NO: 20159 - RNA, 18 nt, Artificial Sequence
  Description of Artificial Sequence: Synthetic oligonucleotide
uuggagugcaguggugug

SEQ ID NO: 20160 - RNA, 18 nt, Artificial Sequence
  Description of Artificial Sequence: Synthetic oligonucleotide
cuggguuggagugcagug

SEQ ID NO: 20161 - RNA, 18 nt, Artificial Sequence
  Description of Artificial Sequence: Synthetic oligonucleotide
gucgccuggguuggagug

SEQ ID NO: 20162 - RNA, 18 nt, Artificial Sequence
  Description of Artificial Sequence: Synthetic oligonucleotide
ucucugucgccuggguug

SEQ ID NO: 20163 - RNA, 18 nt, Artificial Sequence
  Description of Artificial Sequence: Synthetic oligonucleotide
gucucucucugucgccug

SEQ ID NO: 20164 - RNA, 18 nt, Artificial Sequence
  Description of Artificial Sequence: Synthetic oligonucleotide
acagggucucucucuguc

SEQ ID NO: 20165 - RNA, 18 nt, Artificial Sequence
  Description of Artificial Sequence: Synthetic oligonucleotide
aagagacagggucucucu

SEQ ID NO: 20166 - RNA, 18 nt, Artificial Sequence
  Description of Artificial Sequence: Synthetic oligonucleotide
uuuuaaagagacaggguc

SEQ ID NO: 20167 - RNA, 18 nt, Artificial Sequence
  Description of Artificial Sequence: Synthetic oligonucleotide
uuuuuuuuuaaagagaca

SEQ ID NO: 20168 - RNA, 18 nt, Artificial Sequence
  Description of Artificial Sequence: Synthetic oligonucleotide
uuuuuuuuuuuuuuaaag

SEQ ID NO: 20169 - RNA, 18 nt, Artificial Sequence
  Description of Artificial Sequence: Synthetic oligonucleotide
uuuuuuuuuuuuuuuuuu

SEQ ID NO: 20170 - RNA, 18 nt, Artificial Sequence
  Description of Artificial Sequence: Synthetic oligonucleotide
uuuuuuuuuuuuuuuuuu

SEQ ID NO: 20171 - RNA, 18 nt, Artificial Sequence
  Description of Artificial Sequence: Synthetic oligonucleotide
ugccuuuuuuuuuuuuuu

SEQ ID NO: 20172 - RNA, 18 nt, Artificial Sequence
  Description of Artificial Sequence: Synthetic oligonucleotide
uucauugccuuuuuuuuu

SEQ ID NO: 20173 - RNA, 18 nt, Artificial Sequence
  Description of Artificial Sequence: Synthetic oligonucleotide
uuuuguucauugccuuuu

SEQ ID NO: 20174 - RNA, 18 nt, Artificial Sequence
  Description of Artificial Sequence: Synthetic oligonucleotide
caugcuuuuguucauugc

SEQ ID NO: 20175 - RNA, 18 nt, Artificial Sequence
  Description of Artificial Sequence: Synthetic oligonucleotide
agagccaugcuuuuguuc

SEQ ID NO: 20176 - RNA, 18 nt, Artificial Sequence
  Description of Artificial Sequence: Synthetic oligonucleotide
gacguagagccaugcuuu

SEQ ID NO: 20177 - RNA, 18 nt, Artificial Sequence
  Description of Artificial Sequence: Synthetic oligonucleotide
uggaagacguagagccau

SEQ ID NO: 20178 - RNA, 18 nt, Artificial Sequence
  Description of Artificial Sequence: Synthetic oligonucleotide
cacuuuggaagacguaga

SEQ ID NO: 20179 - RNA, 18 nt, Artificial Sequence
  Description of Artificial Sequence: Synthetic oligonucleotide
auucucacuuuggaagac

SEQ ID NO: 20180 - RNA, 18 nt, Artificial Sequence
  Description of Artificial Sequence: Synthetic oligonucleotide
ggagaauucucacuuugg

SEQ ID NO: 20181 - RNA, 18 nt, Artificial Sequence
  Description of Artificial Sequence: Synthetic oligonucleotide
gggagggagaauucucac

SEQ ID NO: 20182 - RNA, 18 nt, Artificial Sequence
  Description of Artificial Sequence: Synthetic oligonucleotide
cuggagggaugcggaggg

SEQ ID NO: 20183 - RNA, 18 nt, Artificial Sequence
  Description of Artificial Sequence: Synthetic oligonucleotide
ucuggagggaugcggagg

SEQ ID NO: 20184 - RNA, 18 nt, Artificial Sequence
  Description of Artificial Sequence: Synthetic oligonucleotide
acaguucuggagggaugc

SEQ ID NO: 20185 - RNA, 18 nt, Artificial Sequence
  Description of Artificial Sequence: Synthetic oligonucleotide
gagcuacaguucuggagg

SEQ ID NO: 20186 - RNA, 18 nt, Artificial Sequence
  Description of Artificial Sequence: Synthetic oligonucleotide
gcucugagcuacaguucu

SEQ ID NO: 20187 - RNA, 18 nt, Artificial Sequence
  Description of Artificial Sequence: Synthetic oligonucleotide
cgugggcucugagcuaca

SEQ ID NO: 20188 - RNA, 18 nt, Artificial Sequence
  Description of Artificial Sequence: Synthetic oligonucleotide
uucagcgugggcucugag

SEQ ID NO: 20189 - RNA, 18 nt, Artificial Sequence
  Description of Artificial Sequence: Synthetic oligonucleotide
ucagauucagcgugggcu

SEQ ID NO: 20190 - RNA, 18 nt, Artificial Sequence
  Description of Artificial Sequence: Synthetic oligonucleotide
aaaagucagauucagcgu

SEQ ID NO: 20191 - RNA, 18 nt, Artificial Sequence
  Description of Artificial Sequence: Synthetic oligonucleotide
aagagaaaagucagauuc

SEQ ID NO: 20192 - RNA, 18 nt, Artificial Sequence
  Description of Artificial Sequence: Synthetic oligonucleotide
gagaaaagagaaaaguca

SEQ ID NO: 20193 - RNA, 18 nt, Artificial Sequence
  Description of Artificial Sequence: Synthetic oligonucleotide
agagagagaaaagagaaa

SEQ ID NO: 20194 - RNA, 18 nt, Artificial Sequence
  Description of Artificial Sequence: Synthetic oligonucleotide
gggagagagagagaaaag

SEQ ID NO: 20195 - RNA, 18 nt, Artificial Sequence
  Description of Artificial Sequence: Synthetic oligonucleotide
gagcagggagagagagag

SEQ ID NO: 20196 - RNA, 18 nt, Artificial Sequence
  Description of Artificial Sequence: Synthetic oligonucleotide
cucgggagcagggagaga

SEQ ID NO: 20197 - RNA, 18 nt, Artificial Sequence
  Description of Artificial Sequence: Synthetic oligonucleotide
cacugcucgggagcaggg

SEQ ID NO: 20198 - RNA, 18 nt, Artificial Sequence
  Description of Artificial Sequence: Synthetic oligonucleotide
uacuucacugcucgggag

SEQ ID NO: 20199 - RNA, 18 nt, Artificial Sequence
  Description of Artificial Sequence: Synthetic oligonucleotide
aagauuacuucacugcuc

SEQ ID NO: 20200 - RNA, 18 nt, Artificial Sequence
  Description of Artificial Sequence: Synthetic oligonucleotide
aaaaaaagauuacuucac

SEQ ID NO: 20201 - RNA, 18 nt, Artificial Sequence
  Description of Artificial Sequence: Synthetic oligonucleotide
ucaguaaaaaaagauuac

SEQ ID NO: 20202 - RNA, 18 nt, Artificial Sequence
  Description of Artificial Sequence: Synthetic oligonucleotide
aaaggucaguaaaaaaag

SEQ ID NO: 20203 - RNA, 18 nt, Artificial Sequence
  Description of Artificial Sequence: Synthetic oligonucleotide
gaagaaaaggucaguaaa

SEQ ID NO: 20204 - RNA, 18 nt, Artificial Sequence
  Description of Artificial Sequence: Synthetic oligonucleotide
aaauggaagaaaagguca

SEQ ID NO: 20205 - RNA, 18 nt, Artificial Sequence
  Description of Artificial Sequence: Synthetic oligonucleotide
aaaaaaaauggaagaaaa

SEQ ID NO: 20206 - RNA, 18 nt, Artificial Sequence
  Description of Artificial Sequence: Synthetic oligonucleotide
ggaggaaaaaaaauggaa

SEQ ID NO: 20207 - RNA, 18 nt, Artificial Sequence
  Description of Artificial Sequence: Synthetic oligonucleotide
aaagaggaggaaaaaaaa

SEQ ID NO: 20208 - RNA, 18 nt, Artificial Sequence
  Description of Artificial Sequence: Synthetic oligonucleotide
auggaaaagaggaggaaa

SEQ ID NO: 20209 - RNA, 18 nt, Artificial Sequence
  Description of Artificial Sequence: Synthetic oligonucleotide
aaucaauggaaaagagga

SEQ ID NO: 20210 - RNA, 18 nt, Artificial Sequence
  Description of Artificial Sequence: Synthetic oligonucleotide
uuucaaaucaauggaaaa

SEQ ID NO: 20211 - RNA, 18 nt, Artificial Sequence
  Description of Artificial Sequence: Synthetic oligonucleotide
agauauuucaaaucaaug

SEQ ID NO: 20212 - RNA, 18 nt, Artificial Sequence
  Description of Artificial Sequence: Synthetic oligonucleotide
aaaauagauauuucaaau

SEQ ID NO: 20213 - RNA, 18 nt, Artificial Sequence
  Description of Artificial Sequence: Synthetic oligonucleotide
augauaaaauagauauuu

SEQ ID NO: 20214 - RNA, 18 nt, Artificial Sequence
  Description of Artificial Sequence: Synthetic oligonucleotide
agagaaugauaaaauaga

SEQ ID NO: 20215 - RNA, 18 nt, Artificial Sequence
  Description of Artificial Sequence: Synthetic oligonucleotide
gaugcagagaaugauaaa

SEQ ID NO: 20216 - RNA, 18 nt, Artificial Sequence
  Description of Artificial Sequence: Synthetic oligonucleotide
agaaagaugcagagaaug

SEQ ID NO: 20217 - RNA, 18 nt, Artificial Sequence
  Description of Artificial Sequence: Synthetic oligonucleotide
gagagagaaagaugcaga

SEQ ID NO: 20218 - RNA, 18 nt, Artificial Sequence
  Description of Artificial Sequence: Synthetic oligonucleotide
aaauagagagagaaagau

SEQ ID NO: 20219 - RNA, 18 nt, Artificial Sequence
  Description of Artificial Sequence: Synthetic oligonucleotide
cgaaaaaauagagagaga

SEQ ID NO: 20220 - RNA, 18 nt, Artificial Sequence
  Description of Artificial Sequence: Synthetic oligonucleotide
cgagccgaaaaaauagag

SEQ ID NO: 20221 - RNA, 18 nt, Artificial Sequence
  Description of Artificial Sequence: Synthetic oligonucleotide
ccacacgagccgaaaaaa

SEQ ID NO: 20222 - RNA, 18 nt, Artificial Sequence
  Description of Artificial Sequence: Synthetic oligonucleotide
gaaauccacacgagccga

SEQ ID NO: 20223 - RNA, 18 nt, Artificial Sequence
  Description of Artificial Sequence: Synthetic oligonucleotide
aaaaagaaauccacacga

SEQ ID NO: 20224 - RNA, 18 nt, Artificial Sequence
  Description of Artificial Sequence: Synthetic oligonucleotide
aaagaaaaaagaaaucca

SEQ ID NO: 20225 - RNA, 18 nt, Artificial Sequence
  Description of Artificial Sequence: Synthetic oligonucleotide
agaagaaagaaaaaagaa

SEQ ID NO: 20226 - RNA, 18 nt, Artificial Sequence
  Description of Artificial Sequence: Synthetic oligonucleotide
gaaacagaagaaagaaaa

SEQ ID NO: 20227 - RNA, 18 nt, Artificial Sequence
  Description of Artificial Sequence: Synthetic oligonucleotide
caaaggaagagagguggg

SEQ ID NO: 20228 - RNA, 18 nt, Artificial Sequence
  Description of Artificial Sequence: Synthetic oligonucleotide
agaaccaaaggaagagag

SEQ ID NO: 20229 - RNA, 18 nt, Artificial Sequence
  Description of Artificial Sequence: Synthetic oligonucleotide
aacagagaaccaaaggaa

SEQ ID NO: 20230 - RNA, 18 nt, Artificial Sequence
  Description of Artificial Sequence: Synthetic oligonucleotide
augggaacagagaaccaa

SEQ ID NO: 20231 - RNA, 18 nt, Artificial Sequence
  Description of Artificial Sequence: Synthetic oligonucleotide
cgggaaugggaacagaga

SEQ ID NO: 20232 - RNA, 18 nt, Artificial Sequence
  Description of Artificial Sequence: Synthetic oligonucleotide
caaaacgggaaugggaac

SEQ ID NO: 20233 - RNA, 18 nt, Artificial Sequence
  Description of Artificial Sequence: Synthetic oligonucleotide
aaaaacaaaacgggaaug

SEQ ID NO: 20234 - RNA, 18 nt, Artificial Sequence
  Description of Artificial Sequence: Synthetic oligonucleotide
aacaaaaaaacaaaacgg

SEQ ID NO: 20235 - RNA, 18 nt, Artificial Sequence
  Description of Artificial Sequence: Synthetic oligonucleotide
acaaaaacaaaaaaacaa

SEQ ID NO: 20236 - RNA, 18 nt, Artificial Sequence
  Description of Artificial Sequence: Synthetic oligonucleotide
caaaaacaaaaacaaaaa

SEQ ID NO: 20237 - RNA, 18 nt, Artificial Sequence
  Description of Artificial Sequence: Synthetic oligonucleotide
aaaaacaaaaacaaaaac

SEQ ID NO: 20238 - RNA, 18 nt, Artificial Sequence
  Description of Artificial Sequence: Synthetic oligonucleotide
augaaaaaaacaaaaaca

SEQ ID NO: 20239 - RNA, 18 nt, Artificial Sequence
  Description of Artificial Sequence: Synthetic oligonucleotide
cagguaaggcaugcggcc

SEQ ID NO: 20240 - RNA, 18 nt, Artificial Sequence
  Description of Artificial Sequence: Synthetic oligonucleotide
auguccagguaaggcaug

SEQ ID NO: 20241 - RNA, 18 nt, Artificial Sequence
  Description of Artificial Sequence: Synthetic oligonucleotide
gauacauguccagguaag

SEQ ID NO: 20242 - RNA, 18 nt, Artificial Sequence
  Description of Artificial Sequence: Synthetic oligonucleotide
caucugauacauguccag

SEQ ID NO: 20243 - RNA, 18 nt, Artificial Sequence
  Description of Artificial Sequence: Synthetic oligonucleotide
cucagcaucugauacaug

SEQ ID NO: 20244 - RNA, 18 nt, Artificial Sequence
  Description of Artificial Sequence: Synthetic oligonucleotide
ugugucucagcaucugau

SEQ ID NO: 20245 - RNA, 18 nt, Artificial Sequence
  Description of Artificial Sequence: Synthetic oligonucleotide
agacaugugucucagcau

SEQ ID NO: 20246 - RNA, 18 nt, Artificial Sequence
  Description of Artificial Sequence: Synthetic oligonucleotide
ggcggagacaugugucuc

SEQ ID NO: 20247 - RNA, 18 nt, Artificial Sequence
  Description of Artificial Sequence: Synthetic oligonucleotide
gggcggagacaugugucu

SEQ ID NO: 20248 - RNA, 18 nt, Artificial Sequence
  Description of Artificial Sequence: Synthetic oligonucleotide
ucuuccccagacccaggg

SEQ ID NO: 20249 - RNA, 18 nt, Artificial Sequence
  Description of Artificial Sequence: Synthetic oligonucleotide
acacuucuuccccagacc

SEQ ID NO: 20250 - RNA, 18 nt, Artificial Sequence
  Description of Artificial Sequence: Synthetic oligonucleotide
gccggacacuucuucccc

SEQ ID NO: 20251 - RNA, 18 nt, Artificial Sequence
  Description of Artificial Sequence: Synthetic oligonucleotide
cucuggccggacacuucu

SEQ ID NO: 20252 - RNA, 18 nt, Artificial Sequence
  Description of Artificial Sequence: Synthetic oligonucleotide
agccacucuggccggaca

SEQ ID NO: 20253 - RNA, 18 nt, Artificial Sequence
  Description of Artificial Sequence: Synthetic oligonucleotide
uuguaagccacucuggcc

SEQ ID NO: 20254 - RNA, 18 nt, Artificial Sequence
  Description of Artificial Sequence: Synthetic oligonucleotide
ccagguaaggcaugcggc

SEQ ID NO: 20255 - RNA, 18 nt, Artificial Sequence
  Description of Artificial Sequence: Synthetic oligonucleotide
cauguccagguaaggcau

SEQ ID NO: 20256 - RNA, 18 nt, Artificial Sequence
  Description of Artificial Sequence: Synthetic oligonucleotide
ugauacauguccagguaa

SEQ ID NO: 20257 - RNA, 18 nt, Artificial Sequence
  Description of Artificial Sequence: Synthetic oligonucleotide
gcaucugauacaugucca

SEQ ID NO: 20258 - RNA, 18 nt, Artificial Sequence
  Description of Artificial Sequence: Synthetic oligonucleotide
ucucagcaucugauacau

SEQ ID NO: 20259 - RNA, 18 nt, Artificial Sequence
  Description of Artificial Sequence: Synthetic oligonucleotide
augugucucagcaucuga

SEQ ID NO: 20260 - RNA, 18 nt, Artificial Sequence
  Description of Artificial Sequence: Synthetic oligonucleotide
gagacaugugucucagca

SEQ ID NO: 20261 - RNA, 18 nt, Artificial Sequence
  Description of Artificial Sequence: Synthetic oligonucleotide
gggcggagacaugugucu

SEQ ID NO: 20262 - RNA, 18 nt, Artificial Sequence
  Description of Artificial Sequence: Synthetic oligonucleotide
ucuuccccagacccaggg

SEQ ID NO: 20263 - RNA, 18 nt, Artificial Sequence
  Description of Artificial Sequence: Synthetic oligonucleotide
acuucuuccccagaccca

SEQ ID NO: 20264 - RNA, 18 nt, Artificial Sequence
  Description of Artificial Sequence: Synthetic oligonucleotide
cggacacuucuuccccag

SEQ ID NO: 20265 - RNA, 18 nt, Artificial Sequence
  Description of Artificial Sequence: Synthetic oligonucleotide
cuggccggacacuucuuc

SEQ ID NO: 20266 - RNA, 18 nt, Artificial Sequence
  Description of Artificial Sequence: Synthetic oligonucleotide
ccacucuggccggacacu

SEQ ID NO: 20267 - RNA, 18 nt, Artificial Sequence
  Description of Artificial Sequence: Synthetic oligonucleotide
guaagccacucuggccgg

SEQ ID NO: 20268 - RNA, 18 nt, Artificial Sequence
  Description of Artificial Sequence: Synthetic oligonucleotide
gguggucggcaaggguag

SEQ ID NO: 20269 - RNA, 18 nt, Artificial Sequence
  Description of Artificial Sequence: Synthetic oligonucleotide
acgucgguggucggcaag

SEQ ID NO: 20270 - RNA, 18 nt, Artificial Sequence
  Description of Artificial Sequence: Synthetic oligonucleotide
ccuggacgucgguggucg

SEQ ID NO: 20271 - RNA, 18 nt, Artificial Sequence
  Description of Artificial Sequence: Synthetic oligonucleotide
cagugccuggacgucggu

SEQ ID NO: 20272 - RNA, 18 nt, Artificial Sequence
  Description of Artificial Sequence: Synthetic oligonucleotide
aaacccagugccuggacg

SEQ ID NO: 20273 - RNA, 18 nt, Artificial Sequence
  Description of Artificial Sequence: Synthetic oligonucleotide
aaaaaaaacccagugccu

SEQ ID NO: 20274 - RNA, 18 nt, Artificial Sequence
  Description of Artificial Sequence: Synthetic oligonucleotide
gaagaaaaaaaaacccag

SEQ ID NO: 20275 - RNA, 18 nt, Artificial Sequence
  Description of Artificial Sequence: Synthetic oligonucleotide
aagaagaagaaaaaaaaa

SEQ ID NO: 20276 - RNA, 18 nt, Artificial Sequence
  Description of Artificial Sequence: Synthetic oligonucleotide
agaagaagaagaagaaaa

SEQ ID NO: 20277 - RNA, 18 nt, Artificial Sequence
  Description of Artificial Sequence: Synthetic oligonucleotide
aaaaaagaagaagaagaa

SEQ ID NO: 20278 - RNA, 18 nt, Artificial Sequence
  Description of Artificial Sequence: Synthetic oligonucleotide
cuaaaaaaaaagaagaag

SEQ ID NO: 20279 - RNA, 18 nt, Artificial Sequence
  Description of Artificial Sequence: Synthetic oligonucleotide
cagcacuaaaaaaaaaga

SEQ ID NO: 20280 - RNA, 18 nt, Artificial Sequence
  Description of Artificial Sequence: Synthetic oligonucleotide
cuggucagcacuaaaaaa

SEQ ID NO: 20281 - RNA, 18 nt, Artificial Sequence
  Description of Artificial Sequence: Synthetic oligonucleotide
uguuucuggucagcacua

SEQ ID NO: 20282 - RNA, 18 nt, Artificial Sequence
  Description of Artificial Sequence: Synthetic oligonucleotide
ccggguguuucuggucag

SEQ ID NO: 20283 - RNA, 18 nt, Artificial Sequence
  Description of Artificial Sequence: Synthetic oligonucleotide
gucggccggguguuucug

SEQ ID NO: 20284 - RNA, 18 nt, Artificial Sequence
  Description of Artificial Sequence: Synthetic oligonucleotide
agagagucggccgggugu

SEQ ID NO: 20285 - RNA, 18 nt, Artificial Sequence
  Description of Artificial Sequence: Synthetic oligonucleotide
gaaaaagagagucggccg

SEQ ID NO: 20286 - RNA, 18 nt, Artificial Sequence
  Description of Artificial Sequence: Synthetic oligonucleotide
cguuggaaaaagagaguc

SEQ ID NO: 20287 - RNA, 18 nt, Artificial Sequence
  Description of Artificial Sequence: Synthetic oligonucleotide
agaaacguuggaaaaaga

SEQ ID NO: 20288 - RNA, 18 nt, Artificial Sequence
  Description of Artificial Sequence: Synthetic oligonucleotide
agaagagaaacguuggaa

SEQ ID NO: 20289 - RNA, 18 nt, Artificial Sequence
  Description of Artificial Sequence: Synthetic oligonucleotide
aaaaaagaagagaaacgu

SEQ ID NO: 20290 - RNA, 18 nt, Artificial Sequence
  Description of Artificial Sequence: Synthetic oligonucleotide
aaaacaaaaaagaagaga

SEQ ID NO: 20291 - RNA, 18 nt, Artificial Sequence
  Description of Artificial Sequence: Synthetic oligonucleotide
aaucaaaaacaaaaaaga

SEQ ID NO: 20292 - RNA, 18 nt, Artificial Sequence
  Description of Artificial Sequence: Synthetic oligonucleotide
aaaagaaucaaaaacaaa

SEQ ID NO: 20293 - RNA, 18 nt, Artificial Sequence
  Description of Artificial Sequence: Synthetic oligonucleotide
gaaaaaaaagaaucaaaa

SEQ ID NO: 20294 - RNA, 18 nt, Artificial Sequence
  Description of Artificial Sequence: Synthetic oligonucleotide
gaaaagaaaaaaaagaau

SEQ ID NO: 20295 - RNA, 18 nt, Artificial Sequence
  Description of Artificial Sequence: Synthetic oligonucleotide
cucgagaaaagaaaaaaa

SEQ ID NO: 20296 - RNA, 18 nt, Artificial Sequence
  Description of Artificial Sequence: Synthetic oligonucleotide
guugacucgagaaaagaa

SEQ ID NO: 20297 - RNA, 18 nt, Artificial Sequence
  Description of Artificial Sequence: Synthetic oligonucleotide
gaucaguugacucgagaa

SEQ ID NO: 20298 - RNA, 18 nt, Artificial Sequence
  Description of Artificial Sequence: Synthetic oligonucleotide
gucaugaucaguugacuc

SEQ ID NO: 20299 - RNA, 18 nt, Artificial Sequence
  Description of Artificial Sequence: Synthetic oligonucleotide
ggauggucaugaucaguu

SEQ ID NO: 20300 - RNA, 18 nt, Artificial Sequence
  Description of Artificial Sequence: Synthetic oligonucleotide
ucaagggauggucaugau

SEQ ID NO: 20301 - RNA, 18 nt, Artificial Sequence
  Description of Artificial Sequence: Synthetic oligonucleotide
uagaaucaagggaugguc

SEQ ID NO: 20302 - RNA, 18 nt, Artificial Sequence
  Description of Artificial Sequence: Synthetic oligonucleotide
cugcuuagaaucaaggga

SEQ ID NO: 20303 - RNA, 18 nt, Artificial Sequence
  Description of Artificial Sequence: Synthetic oligonucleotide
gugugcugcuuagaauca

SEQ ID NO: 20304 - RNA, 18 nt, Artificial Sequence
  Description of Artificial Sequence: Synthetic oligonucleotide
acacagugugcugcuuag

SEQ ID NO: 20305 - RNA, 18 nt, Artificial Sequence
  Description of Artificial Sequence: Synthetic oligonucleotide
gacggacacagugugcug

SEQ ID NO: 20306 - RNA, 18 nt, Artificial Sequence
  Description of Artificial Sequence: Synthetic oligonucleotide
gaaaggacggacacagug

SEQ ID NO: 20307 - RNA, 18 nt, Artificial Sequence
  Description of Artificial Sequence: Synthetic oligonucleotide
caucagaaaggacggaca

SEQ ID NO: 20308 - RNA, 18 nt, Artificial Sequence
  Description of Artificial Sequence: Synthetic oligonucleotide
acacucaucagaaaggac

SEQ ID NO: 20309 - RNA, 18 nt, Artificial Sequence
  Description of Artificial Sequence: Synthetic oligonucleotide
cgaagacacucaucagaa

SEQ ID NO: 20310 - RNA, 18 nt, Artificial Sequence
  Description of Artificial Sequence: Synthetic oligonucleotide
aaacacgaagacacucau

SEQ ID NO: 20311 - RNA, 18 nt, Artificial Sequence
  Description of Artificial Sequence: Synthetic oligonucleotide
ucucaaaacacgaagaca

SEQ ID NO: 20312 - RNA, 18 nt, Artificial Sequence
  Description of Artificial Sequence: Synthetic oligonucleotide
uggagucucaaaacacga

SEQ ID NO: 20313 - RNA, 18 nt, Artificial Sequence
  Description of Artificial Sequence: Synthetic oligonucleotide
cauaauggagucucaaaa

SEQ ID NO: 20314 - RNA, 18 nt, Artificial Sequence
  Description of Artificial Sequence: Synthetic oligonucleotide
ucggccauaauggagucu

SEQ ID NO: 20315 - RNA, 18 nt, Artificial Sequence
  Description of Artificial Sequence: Synthetic oligonucleotide
gcaugucggccauaaugg

SEQ ID NO: 20316 - RNA, 18 nt, Artificial Sequence
  Description of Artificial Sequence: Synthetic oligonucleotide
ccccggcaugucggccau

SEQ ID NO: 20317 - RNA, 18 nt, Artificial Sequence
  Description of Artificial Sequence: Synthetic oligonucleotide
ccuccccccggcaugucg

SEQ ID NO: 20318 - RNA, 18 nt, Artificial Sequence
  Description of Artificial Sequence: Synthetic oligonucleotide
cucccccuccccccggca

SEQ ID NO: 20319 - RNA, 18 nt, Artificial Sequence
  Description of Artificial Sequence: Synthetic oligonucleotide
cuccccucccccuccccc

SEQ ID NO: 20320 - RNA, 18 nt, Artificial Sequence
  Description of Artificial Sequence: Synthetic oligonucleotide
gggcgcuccccucccccu

SEQ ID NO: 20321 - RNA, 18 nt, Artificial Sequence
  Description of Artificial Sequence: Synthetic oligonucleotide
gaccugggcgcuccccuc

SEQ ID NO: 20322 - RNA, 18 nt, Artificial Sequence
  Description of Artificial Sequence: Synthetic oligonucleotide
gggaccugggcgcucccc

SEQ ID NO: 20323 - RNA, 18 nt, Artificial Sequence
  Description of Artificial Sequence: Synthetic oligonucleotide
ggagaccaggugcaaggg

SEQ ID NO: 20324 - RNA, 18 nt, Artificial Sequence
  Description of Artificial Sequence: Synthetic oligonucleotide
accugggagaccaggugc

SEQ ID NO: 20325 - RNA, 18 nt, Artificial Sequence
  Description of Artificial Sequence: Synthetic oligonucleotide
uugguaccugggagacca

SEQ ID NO: 20326 - RNA, 18 nt, Artificial Sequence
  Description of Artificial Sequence: Synthetic oligonucleotide
ccaauuugguaccuggga

SEQ ID NO: 20327 - RNA, 18 nt, Artificial Sequence
  Description of Artificial Sequence: Synthetic oligonucleotide
uguuuccaauuugguacc

SEQ ID NO: 20328 - RNA, 18 nt, Artificial Sequence
  Description of Artificial Sequence: Synthetic oligonucleotide
guguuuguuuccaauuug

SEQ ID NO: 20329 - RNA, 18 nt, Artificial Sequence
  Description of Artificial Sequence: Synthetic oligonucleotide
gaagcguguuuguuucca

SEQ ID NO: 20330 - RNA, 18 nt, Artificial Sequence
  Description of Artificial Sequence: Synthetic oligonucleotide
cugaagaagcguguuugu

SEQ ID NO: 20331 - RNA, 18 nt, Artificial Sequence
  Description of Artificial Sequence: Synthetic oligonucleotide
acucccugaagaagcgug

SEQ ID NO: 20332 - RNA, 18 nt, Artificial Sequence
  Description of Artificial Sequence: Synthetic oligonucleotide
uuuugacucccugaagaa

SEQ ID NO: 20333 - RNA, 18 nt, Artificial Sequence
  Description of Artificial Sequence: Synthetic oligonucleotide
auggguuuugacucccug

SEQ ID NO: 20334 - RNA, 18 nt, Artificial Sequence
  Description of Artificial Sequence: Synthetic oligonucleotide
gaagcauggguuuugacu

SEQ ID NO: 20335 - RNA, 18 nt, Artificial Sequence
  Description of Artificial Sequence: Synthetic oligonucleotide
agugggaagcauggguuu

SEQ ID NO: 20336 - RNA, 18 nt, Artificial Sequence
  Description of Artificial Sequence: Synthetic oligonucleotide
gcagaagugggaagcaug

SEQ ID NO: 20337 - RNA, 18 nt, Artificial Sequence
  Description of Artificial Sequence: Synthetic oligonucleotide
ggugggcagaagugggaa

SEQ ID NO: 20338 - RNA, 18 nt, Artificial Sequence
  Description of Artificial Sequence: Synthetic oligonucleotide
cucugggugggcagaagu

SEQ ID NO: 20339 - RNA, 18 nt, Artificial Sequence
  Description of Artificial Sequence: Synthetic oligonucleotide
ggccgcucugggugggca

SEQ ID NO: 20340 - RNA, 18 nt, Artificial Sequence
  Description of Artificial Sequence: Synthetic oligonucleotide
gggccgcucugggugggc

SEQ ID NO: 20341 - RNA, 18 nt, Artificial Sequence
  Description of Artificial Sequence: Synthetic oligonucleotide
ccccagccugggcauggg

SEQ ID NO: 20342 - RNA, 18 nt, Artificial Sequence
  Description of Artificial Sequence: Synthetic oligonucleotide
gccugccccagccugggc

SEQ ID NO: 20343 - RNA, 18 nt, Artificial Sequence
  Description of Artificial Sequence: Synthetic oligonucleotide
aaggcgccugccccagcc

SEQ ID NO: 20344 - RNA, 18 nt, Artificial Sequence
  Description of Artificial Sequence: Synthetic oligonucleotide
ucugcaaggcgccugccc

SEQ ID NO: 20345 - RNA, 18 nt, Artificial Sequence
  Description of Artificial Sequence: Synthetic oligonucleotide
cccucucugcaaggcgcc

SEQ ID NO: 20346 - RNA, 18 nt, Artificial Sequence
  Description of Artificial Sequence: Synthetic oligonucleotide
aaagccccucucugcaag

SEQ ID NO: 20347 - RNA, 18 nt, Artificial Sequence
  Description of Artificial Sequence: Synthetic oligonucleotide
gggcuaaagccccucucu

SEQ ID NO: 20348 - RNA, 18 nt, Artificial Sequence
  Description of Artificial Sequence: Synthetic oligonucleotide
gggaccucgccugcuuuc

SEQ ID NO: 20349 - RNA, 18 nt, Artificial Sequence
  Description of Artificial Sequence: Synthetic oligonucleotide
gacccgggaccucgccug

SEQ ID NO: 20350 - RNA, 18 nt, Artificial Sequence
  Description of Artificial Sequence: Synthetic oligonucleotide
gggacccgggaccucgcc

SEQ ID NO: 20351 - RNA, 18 nt, Artificial Sequence
  Description of Artificial Sequence: Synthetic oligonucleotide
caggugugcguggcaggg

SEQ ID NO: 20352 - RNA, 18 nt, Artificial Sequence
  Description of Artificial Sequence: Synthetic oligonucleotide
agcuucaggugugcgugg

SEQ ID NO: 20353 - RNA, 18 nt, Artificial Sequence
  Description of Artificial Sequence: Synthetic oligonucleotide
agaucagcuucaggugug

SEQ ID NO: 20354 - RNA, 18 nt, Artificial Sequence
  Description of Artificial Sequence: Synthetic oligonucleotide
gucagagaucagcuucag

SEQ ID NO: 20355 - RNA, 18 nt, Artificial Sequence
  Description of Artificial Sequence: Synthetic oligonucleotide
ccuaggucagagaucagc

SEQ ID NO: 20356 - RNA, 18 nt, Artificial Sequence
  Description of Artificial Sequence: Synthetic oligonucleotide
aaggcccuaggucagaga

SEQ ID NO: 20357 - RNA, 18 nt, Artificial Sequence
  Description of Artificial Sequence: Synthetic oligonucleotide
uccccaaggcccuagguc

SEQ ID NO: 20358 - RNA, 18 nt, Artificial Sequence
  Description of Artificial Sequence: Synthetic oligonucleotide
ucgaauccccaaggcccu

SEQ ID NO: 20359 - RNA, 18 nt, Artificial Sequence
  Description of Artificial Sequence: Synthetic oligonucleotide
cauuccucugagaagcag

SEQ ID NO: 20360 - RNA, 18 nt, Artificial Sequence
  Description of Artificial Sequence: Synthetic oligonucleotide
cacaucauuccucugaga

SEQ ID NO: 20361 - RNA, 18 nt, Artificial Sequence
  Description of Artificial Sequence: Synthetic oligonucleotide
cagaccacaucauuccuc

SEQ ID NO: 20362 - RNA, 18 nt, Artificial Sequence
  Description of Artificial Sequence: Synthetic oligonucleotide
gggcacagaccacaucau

SEQ ID NO: 20363 - RNA, 18 nt, Artificial Sequence
  Description of Artificial Sequence: Synthetic oligonucleotide
cagaugggcacagaccac

SEQ ID NO: 20364 - RNA, 18 nt, Artificial Sequence
  Description of Artificial Sequence: Synthetic oligonucleotide
cagagcagaugggcacag

SEQ ID NO: 20365 - RNA, 18 nt, Artificial Sequence
  Description of Artificial Sequence: Synthetic oligonucleotide
caggacagagcagauggg

SEQ ID NO: 20366 - RNA, 18 nt, Artificial Sequence
  Description of Artificial Sequence: Synthetic oligonucleotide
cagaccaggacagagcag

SEQ ID NO: 20367 - RNA, 18 nt, Artificial Sequence
  Description of Artificial Sequence: Synthetic oligonucleotide
uggcccagaccaggacag

SEQ ID NO: 20368 - RNA, 18 nt, Artificial Sequence
  Description of Artificial Sequence: Synthetic oligonucleotide
uggcuuggcccagaccag

SEQ ID NO: 20369 - RNA, 18 nt, Artificial Sequence
  Description of Artificial Sequence: Synthetic oligonucleotide
aucccuggcuuggcccag

SEQ ID NO: 20370 - RNA, 18 nt, Artificial Sequence
  Description of Artificial Sequence: Synthetic oligonucleotide
acccaaucccuggcuugg

SEQ ID NO: 20371 - RNA, 18 nt, Artificial Sequence
  Description of Artificial Sequence: Synthetic oligonucleotide
cccacacccaaucccugg

SEQ ID NO: 20372 - RNA, 18 nt, Artificial Sequence
  Description of Artificial Sequence: Synthetic oligonucleotide
ggcuccccacacccaauc

SEQ ID NO: 20373 - RNA, 18 nt, Artificial Sequence
  Description of Artificial Sequence: Synthetic oligonucleotide
ccacuggcuccccacacc

SEQ ID NO: 20374 - RNA, 18 nt, Artificial Sequence
  Description of Artificial Sequence: Synthetic oligonucleotide
gggugccacuggcucccc

SEQ ID NO: 20375 - RNA, 18 nt, Artificial Sequence
  Description of Artificial Sequence: Synthetic oligonucleotide
accacagccgcugguggg

SEQ ID NO: 20376 - RNA, 18 nt, Artificial Sequence
  Description of Artificial Sequence: Synthetic oligonucleotide
aggaccacagccgcuggu

SEQ ID NO: 20377 - RNA, 18 nt, Artificial Sequence
  Description of Artificial Sequence: Synthetic oligonucleotide
gggccaggaccacagccg

SEQ ID NO: 20378 - RNA, 18 nt, Artificial Sequence
  Description of Artificial Sequence: Synthetic oligonucleotide
aacagccaaggcugaggg

SEQ ID NO: 20379 - RNA, 18 nt, Artificial Sequence
  Description of Artificial Sequence: Synthetic oligonucleotide
augcaacagccaaggcug

SEQ ID NO: 20380 - RNA, 18 nt, Artificial Sequence
  Description of Artificial Sequence: Synthetic oligonucleotide
agugcaugcaacagccaa

SEQ ID NO: 20381 - RNA, 18 nt, Artificial Sequence
  Description of Artificial Sequence: Synthetic oligonucleotide
ugagcagugcaugcaaca

SEQ ID NO: 20382 - RNA, 18 nt, Artificial Sequence
  Description of Artificial Sequence: Synthetic oligonucleotide
ggauuugagcagugcaug

SEQ ID NO: 20383 - RNA, 18 nt, Artificial Sequence
  Description of Artificial Sequence: Synthetic oligonucleotide
aagcuggauuugagcagu

SEQ ID NO: 20384 - RNA, 18 nt, Artificial Sequence
  Description of Artificial Sequence: Synthetic oligonucleotide
agcacaagcuggauuuga

SEQ ID NO: 20385 - RNA, 18 nt, Artificial Sequence
  Description of Artificial Sequence: Synthetic oligonucleotide
aaaagagcacaagcugga

SEQ ID NO: 20386 - RNA, 18 nt, Artificial Sequence
  Description of Artificial Sequence: Synthetic oligonucleotide
aaagaaaaagagcacaag

SEQ ID NO: 20387 - RNA, 18 nt, Artificial Sequence
  Description of Artificial Sequence: Synthetic oligonucleotide
accccaaagaaaaagagc

SEQ ID NO: 20388 - RNA, 18 nt, Artificial Sequence
  Description of Artificial Sequence: Synthetic oligonucleotide
gucugaccccaaagaaaa

SEQ ID NO: 20389 - RNA, 18 nt, Artificial Sequence
  Description of Artificial Sequence: Synthetic oligonucleotide
uuucagucugaccccaaa

SEQ ID NO: 20390 - RNA, 18 nt, Artificial Sequence
  Description of Artificial Sequence: Synthetic oligonucleotide
ccccguuucagucugacc

SEQ ID NO: 20391 - RNA, 18 nt, Artificial Sequence
  Description of Artificial Sequence: Synthetic oligonucleotide
gauggccccguuucaguc

SEQ ID NO: 20392 - RNA, 18 nt, Artificial Sequence
  Description of Artificial Sequence: Synthetic oligonucleotide
uucuggauggccccguuu

SEQ ID NO: 20393 - RNA, 18 nt, Artificial Sequence
  Description of Artificial Sequence: Synthetic oligonucleotide
aguucuucuggauggccc

SEQ ID NO: 20394 - RNA, 18 nt, Artificial Sequence
  Description of Artificial Sequence: Synthetic oligonucleotide
cccagaguucuucuggau

SEQ ID NO: 20395 - RNA, 18 nt, Artificial Sequence
  Description of Artificial Sequence: Synthetic oligonucleotide
ccugccccagaguucuuc

SEQ ID NO: 20396 - RNA, 18 nt, Artificial Sequence
  Description of Artificial Sequence: Synthetic oligonucleotide
cccgcccugccccagagu

SEQ ID NO: 20397 - RNA, 18 nt, Artificial Sequence
  Description of Artificial Sequence: Synthetic oligonucleotide
ccacccccgcccugcccc

SEQ ID NO: 20398 - RNA, 18 nt, Artificial Sequence
  Description of Artificial Sequence: Synthetic oligonucleotide
uugccccacccccgcccu

SEQ ID NO: 20399 - RNA, 18 nt, Artificial Sequence
  Description of Artificial Sequence: Synthetic oligonucleotide
aacccuugccccaccccc

SEQ ID NO: 20400 - RNA, 18 nt, Artificial Sequence
  Description of Artificial Sequence: Synthetic oligonucleotide
gccucaacccuugcccca

SEQ ID NO: 20401 - RNA, 18 nt, Artificial Sequence
  Description of Artificial Sequence: Synthetic oligonucleotide
gguuugccucaacccuug

SEQ ID NO: 20402 - RNA, 18 nt, Artificial Sequence
  Description of Artificial Sequence: Synthetic oligonucleotide
uccaggguuugccucaac

SEQ ID NO: 20403 - RNA, 18 nt, Artificial Sequence
  Description of Artificial Sequence: Synthetic oligonucleotide
gcauuuccaggguuugcc

SEQ ID NO: 20404 - RNA, 18 nt, Artificial Sequence
  Description of Artificial Sequence: Synthetic oligonucleotide
agcuggcauuuccagggu

SEQ ID NO: 20405 - RNA, 18 nt, Artificial Sequence
  Description of Artificial Sequence: Synthetic oligonucleotide
cugagagcuggcauuucc

SEQ ID NO: 20406 - RNA, 18 nt, Artificial Sequence
  Description of Artificial Sequence: Synthetic oligonucleotide
uugaccugagagcuggca

SEQ ID NO: 20407 - RNA, 18 nt, Artificial Sequence
  Description of Artificial Sequence: Synthetic oligonucleotide
ccugcuugaccugagagc

SEQ ID NO: 20408 - RNA, 18 nt, Artificial Sequence
  Description of Artificial Sequence: Synthetic oligonucleotide
ccccaccugcuugaccug

SEQ ID NO: 20409 - RNA, 18 nt, Artificial Sequence
  Description of Artificial Sequence: Synthetic oligonucleotide
uuuucccccaccugcuug

SEQ ID NO: 20410 - RNA, 18 nt, Artificial Sequence
  Description of Artificial Sequence: Synthetic oligonucleotide
uccuuuuuucccccaccu

SEQ ID NO: 20411 - RNA, 18 nt, Artificial Sequence
  Description of Artificial Sequence: Synthetic oligonucleotide
cccucuccuuuuuucccc

SEQ ID NO: 20412 - RNA, 18 nt, Artificial Sequence
  Description of Artificial Sequence: Synthetic oligonucleotide
cccugcccucuccuuuuu

SEQ ID NO: 20413 - RNA, 18 nt, Artificial Sequence
  Description of Artificial Sequence: Synthetic oligonucleotide
ugguccccugcccucucc

SEQ ID NO: 20414 - RNA, 18 nt, Artificial Sequence
  Description of Artificial Sequence: Synthetic oligonucleotide
acuucugguccccugccc

SEQ ID NO: 20415 - RNA, 18 nt, Artificial Sequence
  Description of Artificial Sequence: Synthetic oligonucleotide
cuuguacuucuggucccc

SEQ ID NO: 20416 - RNA, 18 nt, Artificial Sequence
  Description of Artificial Sequence: Synthetic oligonucleotide
gcucucuuguacuucugg

SEQ ID NO: 20417 - RNA, 18 nt, Artificial Sequence
  Description of Artificial Sequence: Synthetic oligonucleotide
aaaaggcucucuuguacu

SEQ ID NO: 20418 - RNA, 18 nt, Artificial Sequence
  Description of Artificial Sequence: Synthetic oligonucleotide
ggcacaaaaggcucucuu

SEQ ID NO: 20419 - RNA, 18 nt, Artificial Sequence
  Description of Artificial Sequence: Synthetic oligonucleotide
gggagggcacaaaaggcu

SEQ ID NO: 20420 - RNA, 18 nt, Artificial Sequence
  Description of Artificial Sequence: Synthetic oligonucleotide
ccgcagggagggcacaaa

SEQ ID NO: 20421 - RNA, 18 nt, Artificial Sequence
  Description of Artificial Sequence: Synthetic oligonucleotide
guggcccgcagggagggc

SEQ ID NO: 20422 - RNA, 18 nt, Artificial Sequence
  Description of Artificial Sequence: Synthetic oligonucleotide
ucuugguggcccgcaggg

SEQ ID NO: 20423 - RNA, 18 nt, Artificial Sequence
  Description of Artificial Sequence: Synthetic oligonucleotide
guuucucuugguggcccg

SEQ ID NO: 20424 - RNA, 18 nt, Artificial Sequence
  Description of Artificial Sequence: Synthetic oligonucleotide
acucaguuucucuuggug

SEQ ID NO: 20425 - RNA, 18 nt, Artificial Sequence
  Description of Artificial Sequence: Synthetic oligonucleotide
ccaguacucaguuucucu

SEQ ID NO: 20426 - RNA, 18 nt, Artificial Sequence
  Description of Artificial Sequence: Synthetic oligonucleotide
cugucccaguacucaguu

SEQ ID NO: 20427 - RNA, 18 nt, Artificial Sequence
  Description of Artificial Sequence: Synthetic oligonucleotide
guuaccugucccaguacu

SEQ ID NO: 20428 - RNA, 18 nt, Artificial Sequence
  Description of Artificial Sequence: Synthetic oligonucleotide
cuuagguuaccuguccca

SEQ ID NO: 20429 - RNA, 18 nt, Artificial Sequence
  Description of Artificial Sequence: Synthetic oligonucleotide
ucuuacuuagguuaccug

SEQ ID NO: 20430 - RNA, 18 nt, Artificial Sequence
  Description of Artificial Sequence: Synthetic oligonucleotide
gugucucuuacuuagguu

SEQ ID NO: 20431 - RNA, 18 nt, Artificial Sequence
  Description of Artificial Sequence: Synthetic oligonucleotide
cugaggugucucuuacuu

SEQ ID NO: 20432 - RNA, 18 nt, Artificial Sequence
  Description of Artificial Sequence: Synthetic oligonucleotide
ggcggcugaggugucucu

SEQ ID NO: 20433 - RNA, 18 nt, Artificial Sequence
  Description of Artificial Sequence: Synthetic oligonucleotide
gcuguggcggcugaggug

SEQ ID NO: 20434 - RNA, 18 nt, Artificial Sequence
  Description of Artificial Sequence: Synthetic oligonucleotide
ugaaagcuguggcggcug

SEQ ID NO: 20435 - RNA, 18 nt, Artificial Sequence
  Description of Artificial Sequence: Synthetic oligonucleotide
aacucugaaagcuguggc

SEQ ID NO: 20436 - RNA, 18 nt, Artificial Sequence
  Description of Artificial Sequence: Synthetic oligonucleotide
ggaagaacucugaaagcu

SEQ ID NO: 20437 - RNA, 18 nt, Artificial Sequence
  Description of Artificial Sequence: Synthetic oligonucleotide
ucccaggaagaacucuga

SEQ ID NO: 20438 - RNA, 18 nt, Artificial Sequence
  Description of Artificial Sequence: Synthetic oligonucleotide
gggagucccaggaagaac

SEQ ID NO: 20439 - RNA, 18 nt, Artificial Sequence
  Description of Artificial Sequence: Synthetic oligonucleotide
acccagggagucccagga

SEQ ID NO: 20440 - RNA, 18 nt, Artificial Sequence
  Description of Artificial Sequence: Synthetic oligonucleotide
ccccuacccagggagucc

SEQ ID NO: 20441 - RNA, 18 nt, Artificial Sequence
  Description of Artificial Sequence: Synthetic oligonucleotide
gcccgccccuacccaggg

SEQ ID NO: 20442 - RNA, 18 nt, Artificial Sequence
  Description of Artificial Sequence: Synthetic oligonucleotide
gccgcgcccgccccuacc

SEQ ID NO: 20443 - RNA, 18 nt, Artificial Sequence
  Description of Artificial Sequence: Synthetic oligonucleotide
cgugagccgcgcccgccc

SEQ ID NO: 20444 - RNA, 18 nt, Artificial Sequence
  Description of Artificial Sequence: Synthetic oligonucleotide
ucucccgugagccgcgcc

SEQ ID NO: 20445 - RNA, 18 nt, Artificial Sequence
  Description of Artificial Sequence: Synthetic oligonucleotide
cugggucucccgugagcc

SEQ ID NO: 20446 - RNA, 18 nt, Artificial Sequence
  Description of Artificial Sequence: Synthetic oligonucleotide
cccuccugggucucccgu

SEQ ID NO: 20447 - RNA, 18 nt, Artificial Sequence
  Description of Artificial Sequence: Synthetic oligonucleotide
ggcaucccuccugggucu

SEQ ID NO: 20448 - RNA, 18 nt, Artificial Sequence
  Description of Artificial Sequence: Synthetic oligonucleotide
ucccaggcaucccuccug

SEQ ID NO: 20449 - RNA, 18 nt, Artificial Sequence
  Description of Artificial Sequence: Synthetic oligonucleotide
gucauucccaggcauccc

SEQ ID NO: 20450 - RNA, 18 nt, Artificial Sequence
  Description of Artificial Sequence: Synthetic oligonucleotide
gcgcagucauucccaggc

SEQ ID NO: 20451 - RNA, 18 nt, Artificial Sequence
  Description of Artificial Sequence: Synthetic oligonucleotide
ggcaagcgcagucauucc

SEQ ID NO: 20452 - RNA, 18 nt, Artificial Sequence
  Description of Artificial Sequence: Synthetic oligonucleotide
gguccauccgcagaagcc

SEQ ID NO: 20453 - RNA, 18 nt, Artificial Sequence
  Description of Artificial Sequence: Synthetic oligonucleotide
gggcagguccauccgcag

SEQ ID NO: 20454 - RNA, 18 nt, Artificial Sequence
  Description of Artificial Sequence: Synthetic oligonucleotide
gcgacgggcagguccauc

SEQ ID NO: 20455 - RNA, 18 nt, Artificial Sequence
  Description of Artificial Sequence: Synthetic oligonucleotide
caucugcgacgggcaggu

SEQ ID NO: 20456 - RNA, 18 nt, Artificial Sequence
  Description of Artificial Sequence: Synthetic oligonucleotide
guugucaucugcgacggg

SEQ ID NO: 20457 - RNA, 18 nt, Artificial Sequence
  Description of Artificial Sequence: Synthetic oligonucleotide
acgguguugucaucugcg

SEQ ID NO: 20458 - RNA, 18 nt, Artificial Sequence
  Description of Artificial Sequence: Synthetic oligonucleotide
aguggacgguguugucau

SEQ ID NO: 20459 - RNA, 18 nt, Artificial Sequence
  Description of Artificial Sequence: Synthetic oligonucleotide
auugaaguggacgguguu

SEQ ID NO: 20460 - RNA, 18 nt, Artificial Sequence
  Description of Artificial Sequence: Synthetic oligonucleotide
guggaauugaaguggacg

SEQ ID NO: 20461 - RNA, 18 nt, Artificial Sequence
  Description of Artificial Sequence: Synthetic oligonucleotide
ugaggguggaauugaagu

SEQ ID NO: 20462 - RNA, 18 nt, Artificial Sequence
  Description of Artificial Sequence: Synthetic oligonucleotide
agccaugaggguggaauu

SEQ ID NO: 20463 - RNA, 18 nt, Artificial Sequence
  Description of Artificial Sequence: Synthetic oligonucleotide
aucagagccaugagggug

SEQ ID NO: 20464 - RNA, 18 nt, Artificial Sequence
  Description of Artificial Sequence: Synthetic oligonucleotide
ugcggaucagagccauga

SEQ ID NO: 20465 - RNA, 18 nt, Artificial Sequence
  Description of Artificial Sequence: Synthetic oligonucleotide
ggcugugcggaucagagc

SEQ ID NO: 20466 - RNA, 18 nt, Artificial Sequence
  Description of Artificial Sequence: Synthetic oligonucleotide
uccagggcugugcggauc

SEQ ID NO: 20467 - RNA, 18 nt, Artificial Sequence
  Description of Artificial Sequence: Synthetic oligonucleotide
ugauguccagggcugugc

SEQ ID NO: 20468 - RNA, 18 nt, Artificial Sequence
  Description of Artificial Sequence: Synthetic oligonucleotide
aaucuugauguccagggc

SEQ ID NO: 20469 - RNA, 18 nt, Artificial Sequence
  Description of Artificial Sequence: Synthetic oligonucleotide
uuggcaaucuugaugucc

SEQ ID NO: 20470 - RNA, 18 nt, Artificial Sequence
  Description of Artificial Sequence: Synthetic oligonucleotide
cgacaaagagauucagca

SEQ ID NO: 20471 - RNA, 18 nt, Artificial Sequence
  Description of Artificial Sequence: Synthetic oligonucleotide
gacggcgacaaagagauu

SEQ ID NO: 20472 - RNA, 18 nt, Artificial Sequence
  Description of Artificial Sequence: Synthetic oligonucleotide
augaugacggcgacaaag

SEQ ID NO: 20473 - RNA, 18 nt, Artificial Sequence
  Description of Artificial Sequence: Synthetic oligonucleotide
uguccaugaugacggcga

SEQ ID NO: 20474 - RNA, 18 nt, Artificial Sequence
  Description of Artificial Sequence: Synthetic oligonucleotide
aaaguuguccaugaugac

SEQ ID NO: 20475 - RNA, 18 nt, Artificial Sequence
  Description of Artificial Sequence: Synthetic oligonucleotide
uacucaaaguuguccaug

SEQ ID NO: 20476 - RNA, 18 nt, Artificial Sequence
  Description of Artificial Sequence: Synthetic oligonucleotide
ugagguacucaaaguugu

SEQ ID NO: 20477 - RNA, 18 nt, Artificial Sequence
  Description of Artificial Sequence: Synthetic oligonucleotide
ucgggugagguacucaaa

SEQ ID NO: 20478 - RNA, 18 nt, Artificial Sequence
  Description of Artificial Sequence: Synthetic oligonucleotide
gagucucgggugagguac

SEQ ID NO: 20479 - RNA, 18 nt, Artificial Sequence
  Description of Artificial Sequence: Synthetic oligonucleotide
uggaggagucucggguga

SEQ ID NO: 20480 - RNA, 18 nt, Artificial Sequence
  Description of Artificial Sequence: Synthetic oligonucleotide
caggauggaggagucucg

SEQ ID NO: 20481 - RNA, 18 nt, Artificial Sequence
  Description of Artificial Sequence: Synthetic oligonucleotide
gggcccaggauggaggag

SEQ ID NO: 20482 - RNA, 18 nt, Artificial Sequence
  Description of Artificial Sequence: Synthetic oligonucleotide
acucauccaggugguggg

SEQ ID NO: 20483 - RNA, 18 nt, Artificial Sequence
  Description of Artificial Sequence: Synthetic oligonucleotide
acguacucauccaggugg

SEQ ID NO: 20484 - RNA, 18 nt, Artificial Sequence
  Description of Artificial Sequence: Synthetic oligonucleotide
cacgcacguacucaucca

SEQ ID NO: 20485 - RNA, 18 nt, Artificial Sequence
  Description of Artificial Sequence: Synthetic oligonucleotide
ccagacacgcacguacuc

SEQ ID NO: 20486 - RNA, 18 nt, Artificial Sequence
  Description of Artificial Sequence: Synthetic oligonucleotide
ucggcccagacacgcacg

SEQ ID NO: 20487 - RNA, 18 nt, Artificial Sequence
  Description of Artificial Sequence: Synthetic oligonucleotide
cauacucggcccagacac

SEQ ID NO: 20488 - RNA, 18 nt, Artificial Sequence
  Description of Artificial Sequence: Synthetic oligonucleotide
auuguggcuggaggauuc

SEQ ID NO: 20489 - RNA, 18 nt, Artificial Sequence
  Description of Artificial Sequence: Synthetic oligonucleotide
ugaguauuguggcuggag

SEQ ID NO: 20490 - RNA, 18 nt, Artificial Sequence
  Description of Artificial Sequence: Synthetic oligonucleotide
agaggugaguauuguggc

SEQ ID NO: 20491 - RNA, 18 nt, Artificial Sequence
  Description of Artificial Sequence: Synthetic oligonucleotide
cagggagaggugaguauu

SEQ ID NO: 20492 - RNA, 18 nt, Artificial Sequence
  Description of Artificial Sequence: Synthetic oligonucleotide
aguuccagggagagguga

SEQ ID NO: 20493 - RNA, 18 nt, Artificial Sequence
  Description of Artificial Sequence: Synthetic oligonucleotide
guuccaguuccagggaga

SEQ ID NO: 20494 - RNA, 18 nt, Artificial Sequence
  Description of Artificial Sequence: Synthetic oligonucleotide
cccguguuccaguuccag

SEQ ID NO: 20495 - RNA, 18 nt, Artificial Sequence
  Description of Artificial Sequence: Synthetic oligonucleotide
ccuagcccguguuccagu

SEQ ID NO: 20496 - RNA, 18 nt, Artificial Sequence
  Description of Artificial Sequence: Synthetic oligonucleotide
ccugaccuagcccguguu

SEQ ID NO: 20497 - RNA, 18 nt, Artificial Sequence
  Description of Artificial Sequence: Synthetic oligonucleotide
gggccugaccuagcccgu

SEQ ID NO: 20498 - RNA, 18 nt, Artificial Sequence
  Description of Artificial Sequence: Synthetic oligonucleotide
agugcuccagagucuggg

SEQ ID NO: 20499 - RNA, 18 nt, Artificial Sequence
  Description of Artificial Sequence: Synthetic oligonucleotide
aguucagugcuccagagu

SEQ ID NO: 20500 - RNA, 18 nt, Artificial Sequence
  Description of Artificial Sequence: Synthetic oligonucleotide
ccaggaguucagugcucc

SEQ ID NO: 20501 - RNA, 18 nt, Artificial Sequence
  Description of Artificial Sequence: Synthetic oligonucleotide
ggaccccaggaguucagu

SEQ ID NO: 20502 - RNA, 18 nt, Artificial Sequence
  Description of Artificial Sequence: Synthetic oligonucleotide
ugcuaggaccccaggagu

SEQ ID NO: 20503 - RNA, 18 nt, Artificial Sequence
  Description of Artificial Sequence: Synthetic oligonucleotide
accccugcuaggacccca

SEQ ID NO: 20504 - RNA, 18 nt, Artificial Sequence
  Description of Artificial Sequence: Synthetic oligonucleotide
gugagaccccugcuagga

SEQ ID NO: 20505 - RNA, 18 nt, Artificial Sequence
  Description of Artificial Sequence: Synthetic oligonucleotide
aaccugugagaccccugc

SEQ ID NO: 20506 - RNA, 18 nt, Artificial Sequence
  Description of Artificial Sequence: Synthetic oligonucleotide
gacugaaccugugagacc

SEQ ID NO: 20507 - RNA, 18 nt, Artificial Sequence
  Description of Artificial Sequence: Synthetic oligonucleotide
cuccugacugaaccugug

SEQ ID NO: 20508 - RNA, 18 nt, Artificial Sequence
  Description of Artificial Sequence: Synthetic oligonucleotide
cuucucuccugacugaac

SEQ ID NO: 20509 - RNA, 18 nt, Artificial Sequence
  Description of Artificial Sequence: Synthetic oligonucleotide
uauaucuucucuccugac

SEQ ID NO: 20510 - RNA, 18 nt, Artificial Sequence
  Description of Artificial Sequence: Synthetic oligonucleotide
auucuuauaucuucucuc

SEQ ID NO: 20511 - RNA, 18 nt, Artificial Sequence
  Description of Artificial Sequence: Synthetic oligonucleotide
ugaugauucuuauaucuu

SEQ ID NO: 20512 - RNA, 18 nt, Artificial Sequence
  Description of Artificial Sequence: Synthetic oligonucleotide
aagggugaugauucuuau

SEQ ID NO: 20513 - RNA, 18 nt, Artificial Sequence
  Description of Artificial Sequence: Synthetic oligonucleotide
uaugcaagggugaugauu

SEQ ID NO: 20514 - RNA, 18 nt, Artificial Sequence
  Description of Artificial Sequence: Synthetic oligonucleotide
ggguaugcaagggugaug

SEQ ID NO: 20515 - RNA, 18 nt, Artificial Sequence
  Description of Artificial Sequence: Synthetic oligonucleotide
cuacguguuuaaucuggg

SEQ ID NO: 20516 - RNA, 18 nt, Artificial Sequence
  Description of Artificial Sequence: Synthetic oligonucleotide
gcacccuacguguuuaau

SEQ ID NO: 20517 - RNA, 18 nt, Artificial Sequence
  Description of Artificial Sequence: Synthetic oligonucleotide
gguuggcacccuacgugu

SEQ ID NO: 20518 - RNA, 18 nt, Artificial Sequence
  Description of Artificial Sequence: Synthetic oligonucleotide
ggcaggguuggcacccua

SEQ ID NO: 20519 - RNA, 18 nt, Artificial Sequence
  Description of Artificial Sequence: Synthetic oligonucleotide
guuugggcaggguuggca

SEQ ID NO: 20520 - RNA, 18 nt, Artificial Sequence
  Description of Artificial Sequence: Synthetic oligonucleotide
ccaggguuugggcagggu

SEQ ID NO: 20521 - RNA, 18 nt, Artificial Sequence
  Description of Artificial Sequence: Synthetic oligonucleotide
aaaguccaggguuugggc

SEQ ID NO: 20522 - RNA, 18 nt, Artificial Sequence
  Description of Artificial Sequence: Synthetic oligonucleotide
cccagaaaguccaggguu

SEQ ID NO: 20523 - RNA, 18 nt, Artificial Sequence
  Description of Artificial Sequence: Synthetic oligonucleotide
cauuucccagaaagucca

SEQ ID NO: 20524 - RNA, 18 nt, Artificial Sequence
  Description of Artificial Sequence: Synthetic oligonucleotide
ucccucauuucccagaaa

SEQ ID NO: 20525 - RNA, 18 nt, Artificial Sequence
  Description of Artificial Sequence: Synthetic oligonucleotide
cgcccucccucauuuccc

SEQ ID NO: 20526 - RNA, 18 nt, Artificial Sequence
  Description of Artificial Sequence: Synthetic oligonucleotide
guugacgcccucccucau

SEQ ID NO: 20527 - RNA, 18 nt, Artificial Sequence
  Description of Artificial Sequence: Synthetic oligonucleotide
ucaugguugacgcccucc

SEQ ID NO: 20528 - RNA, 18 nt, Artificial Sequence
  Description of Artificial Sequence: Synthetic oligonucleotide
acaucucaugguugacgc

SEQ ID NO: 20529 - RNA, 18 nt, Artificial Sequence
  Description of Artificial Sequence: Synthetic oligonucleotide
ucaggacaucucaugguu

SEQ ID NO: 20530 - RNA, 18 nt, Artificial Sequence
  Description of Artificial Sequence: Synthetic oligonucleotide
gcucuucaggacaucuca

SEQ ID NO: 20531 - RNA, 18 nt, Artificial Sequence
  Description of Artificial Sequence: Synthetic oligonucleotide
agagggcucuucaggaca

SEQ ID NO: 20532 - RNA, 18 nt, Artificial Sequence
  Description of Artificial Sequence: Synthetic oligonucleotide
ggaggagagggcucuuca

SEQ ID NO: 20533 - RNA, 18 nt, Artificial Sequence
  Description of Artificial Sequence: Synthetic oligonucleotide
ucguaggaggagagggcu

SEQ ID NO: 20534 - RNA, 18 nt, Artificial Sequence
  Description of Artificial Sequence: Synthetic oligonucleotide
gagacucguaggaggaga

SEQ ID NO: 20535 - RNA, 18 nt, Artificial Sequence
  Description of Artificial Sequence: Synthetic oligonucleotide
caggagagacucguagga

SEQ ID NO: 20536 - RNA, 18 nt, Artificial Sequence
  Description of Artificial Sequence: Synthetic oligonucleotide
agagacaggagagacucg

SEQ ID NO: 20537 - RNA, 18 nt, Artificial Sequence
  Description of Artificial Sequence: Synthetic oligonucleotide
cagugagagacaggagag

SEQ ID NO: 20538 - RNA, 18 nt, Artificial Sequence
  Description of Artificial Sequence: Synthetic oligonucleotide
cuucacagugagagacag

SEQ ID NO: 20539 - RNA, 18 nt, Artificial Sequence
  Description of Artificial Sequence: Synthetic oligonucleotide
ggagacuucacagugaga

SEQ ID NO: 20540 - RNA, 18 nt, Artificial Sequence
  Description of Artificial Sequence: Synthetic oligonucleotide
caucuggagacuucacag

SEQ ID NO: 20541 - RNA, 18 nt, Artificial Sequence
  Description of Artificial Sequence: Synthetic oligonucleotide
cucaccaucuggagacuu

SEQ ID NO: 20542 - RNA, 18 nt, Artificial Sequence
  Description of Artificial Sequence: Synthetic oligonucleotide
gcauccucaccaucugga

SEQ ID NO: 20543 - RNA, 18 nt, Artificial Sequence
  Description of Artificial Sequence: Synthetic oligonucleotide
cuaaugcauccucaccau

SEQ ID NO: 20544 - RNA, 18 nt, Artificial Sequence
  Description of Artificial Sequence: Synthetic oligonucleotide
ccuggcuaaugcauccuc

SEQ ID NO: 20545 - RNA, 18 nt, Artificial Sequence
  Description of Artificial Sequence: Synthetic oligonucleotide
uggagccuggcuaaugca

SEQ ID NO: 20546 - RNA, 18 nt, Artificial Sequence
  Description of Artificial Sequence: Synthetic oligonucleotide
cucccuggagccuggcua

SEQ ID NO: 20547 - RNA, 18 nt, Artificial Sequence
  Description of Artificial Sequence: Synthetic oligonucleotide
guuuucucccuggagccu

SEQ ID NO: 20548 - RNA, 18 nt, Artificial Sequence
  Description of Artificial Sequence: Synthetic oligonucleotide
uguugguuuucucccugg

SEQ ID NO: 20549 - RNA, 18 nt, Artificial Sequence
  Description of Artificial Sequence: Synthetic oligonucleotide
gaugcuguugguuuucuc

SEQ ID NO: 20550 - RNA, 18 nt, Artificial Sequence
  Description of Artificial Sequence: Synthetic oligonucleotide
gcugggaugcuguugguu

SEQ ID NO: 20551 - RNA, 18 nt, Artificial Sequence
  Description of Artificial Sequence: Synthetic oligonucleotide
cugaggcugggaugcugu

SEQ ID NO: 20552 - RNA, 18 nt, Artificial Sequence
  Description of Artificial Sequence: Synthetic oligonucleotide
gagaacugaggcugggau

SEQ ID NO: 20553 - RNA, 18 nt, Artificial Sequence
  Description of Artificial Sequence: Synthetic oligonucleotide
cucaagagaacugaggcu

SEQ ID NO: 20554 - RNA, 18 nt, Artificial Sequence
  Description of Artificial Sequence: Synthetic oligonucleotide
acacucucaagagaacug

SEQ ID NO: 20555 - RNA, 18 nt, Artificial Sequence
  Description of Artificial Sequence: Synthetic oligonucleotide
uccccacacucucaagag

SEQ ID NO: 20556 - RNA, 18 nt, Artificial Sequence
  Description of Artificial Sequence: Synthetic oligonucleotide
ccuccuccccacacucuc

SEQ ID NO: 20557 - RNA, 18 nt, Artificial Sequence
  Description of Artificial Sequence: Synthetic oligonucleotide
ccagcccuccuccccaca

SEQ ID NO: 20558 - RNA, 18 nt, Artificial Sequence
  Description of Artificial Sequence: Synthetic oligonucleotide
guaggccagcccuccucc

SEQ ID NO: 20559 - RNA, 18 nt, Artificial Sequence
  Description of Artificial Sequence: Synthetic oligonucleotide
caaggguaggccagcccu

SEQ ID NO: 20560 - RNA, 18 nt, Artificial Sequence
  Description of Artificial Sequence: Synthetic oligonucleotide
ucugccaaggguaggcca

SEQ ID NO: 20561 - RNA, 18 nt, Artificial Sequence
  Description of Artificial Sequence: Synthetic oligonucleotide
uccugucugccaagggua

SEQ ID NO: 20562 - RNA, 18 nt, Artificial Sequence
  Description of Artificial Sequence: Synthetic oligonucleotide
gccaauccugucugccaa

SEQ ID NO: 20563 - RNA, 18 nt, Artificial Sequence
  Description of Artificial Sequence: Synthetic oligonucleotide
uugcugccaauccugucu

SEQ ID NO: 20564 - RNA, 18 nt, Artificial Sequence
  Description of Artificial Sequence: Synthetic oligonucleotide
ugauguugcugccaaucc

SEQ ID NO: 20565 - RNA, 18 nt, Artificial Sequence
  Description of Artificial Sequence: Synthetic oligonucleotide
uacucugauguugcugcc

SEQ ID NO: 20566 - RNA, 18 nt, Artificial Sequence
  Description of Artificial Sequence: Synthetic oligonucleotide
ucugcuacucugauguug

SEQ ID NO: 20567 - RNA, 18 nt, Artificial Sequence
  Description of Artificial Sequence: Synthetic oligonucleotide
ugaguucugcuacucuga

SEQ ID NO: 20568 - RNA, 18 nt, Artificial Sequence
  Description of Artificial Sequence: Synthetic oligonucleotide
ggagcugaguucugcuac

SEQ ID NO: 20569 - RNA, 18 nt, Artificial Sequence
  Description of Artificial Sequence: Synthetic oligonucleotide
cagugggagcugaguucu

SEQ ID NO: 20570 - RNA, 18 nt, Artificial Sequence
  Description of Artificial Sequence: Synthetic oligonucleotide
ggucccagugggagcuga

SEQ ID NO: 20571 - RNA, 18 nt, Artificial Sequence
  Description of Artificial Sequence: Synthetic oligonucleotide
ucacgggucccaguggga

SEQ ID NO: 20572 - RNA, 18 nt, Artificial Sequence
  Description of Artificial Sequence: Synthetic oligonucleotide
cagguucacgggucccag

SEQ ID NO: 20573 - RNA, 18 nt, Artificial Sequence
  Description of Artificial Sequence: Synthetic oligonucleotide
acucccagguucacgggu

SEQ ID NO: 20574 - RNA, 18 nt, Artificial Sequence
  Description of Artificial Sequence: Synthetic oligonucleotide
cucucacucccagguuca

SEQ ID NO: 20575 - RNA, 18 nt, Artificial Sequence
  Description of Artificial Sequence: Synthetic oligonucleotide
auguccucucacucccag

SEQ ID NO: 20576 - RNA, 18 nt, Artificial Sequence
  Description of Artificial Sequence: Synthetic oligonucleotide
ccuguauguccucucacu

SEQ ID NO: 20577 - RNA, 18 nt, Artificial Sequence
  Description of Artificial Sequence: Synthetic oligonucleotide
ccuggccuguauguccuc

SEQ ID NO: 20578 - RNA, 18 nt, Artificial Sequence
  Description of Artificial Sequence: Synthetic oligonucleotide
ccuccccuggccuguaug

SEQ ID NO: 20579 - RNA, 18 nt, Artificial Sequence
  Description of Artificial Sequence: Synthetic oligonucleotide
ugcguccuccccuggccu

SEQ ID NO: 20580 - RNA, 18 nt, Artificial Sequence
  Description of Artificial Sequence: Synthetic oligonucleotide
ggcucugcguccuccccu

SEQ ID NO: 20581 - RNA, 18 nt, Artificial Sequence
  Description of Artificial Sequence: Synthetic oligonucleotide
ccugaggcucugcguccu

SEQ ID NO: 20582 - RNA, 18 nt, Artificial Sequence
  Description of Artificial Sequence: Synthetic oligonucleotide
ugccucagccucccaagu

SEQ ID NO: 20583 - RNA, 18 nt, Artificial Sequence
  Description of Artificial Sequence: Synthetic oligonucleotide
ccuucugccucagccucc

SEQ ID NO: 20584 - RNA, 18 nt, Artificial Sequence
  Description of Artificial Sequence: Synthetic oligonucleotide
gcaauccuucugccucag

SEQ ID NO: 20585 - RNA, 18 nt, Artificial Sequence
  Description of Artificial Sequence: Synthetic oligonucleotide
cucaagcaauccuucugc

SEQ ID NO: 20586 - RNA, 18 nt, Artificial Sequence
  Description of Artificial Sequence: Synthetic oligonucleotide
cugggcucaagcaauccu

SEQ ID NO: 20587 - RNA, 18 nt, Artificial Sequence
  Description of Artificial Sequence: Synthetic oligonucleotide
accuccugggcucaagca

SEQ ID NO: 20588 - RNA, 18 nt, Artificial Sequence
  Description of Artificial Sequence: Synthetic oligonucleotide
ccuccaccuccugggcuc

SEQ ID NO: 20589 - RNA, 18 nt, Artificial Sequence
  Description of Artificial Sequence: Synthetic oligonucleotide
ugcagccuccaccuccug

SEQ ID NO: 20590 - RNA, 18 nt, Artificial Sequence
  Description of Artificial Sequence: Synthetic oligonucleotide
cucacugcagccuccacc

SEQ ID NO: 20591 - RNA, 18 nt, Artificial Sequence
  Description of Artificial Sequence: Synthetic oligonucleotide
cauagcucacugcagccu

SEQ ID NO: 20592 - RNA, 18 nt, Artificial Sequence
  Description of Artificial Sequence: Synthetic oligonucleotide
gugaucauagcucacugc

SEQ ID NO: 20593 - RNA, 18 nt, Artificial Sequence
  Description of Artificial Sequence: Synthetic oligonucleotide
guggugugaucauagcuc

SEQ ID NO: 20594 - RNA, 18 nt, Artificial Sequence
  Description of Artificial Sequence: Synthetic oligonucleotide
gugcaguggugugaucau

SEQ ID NO: 20595 - RNA, 18 nt, Artificial Sequence
  Description of Artificial Sequence: Synthetic oligonucleotide
uuggagugcaguggugug

SEQ ID NO: 20596 - RNA, 18 nt, Artificial Sequence
  Description of Artificial Sequence: Synthetic oligonucleotide
cuggguuggagugcagug

SEQ ID NO: 20597 - RNA, 18 nt, Artificial Sequence
  Description of Artificial Sequence: Synthetic oligonucleotide
gucgccuggguuggagug

SEQ ID NO: 20598 - RNA, 18 nt, Artificial Sequence
  Description of Artificial Sequence: Synthetic oligonucleotide
ucucugucgccuggguug

SEQ ID NO: 20599 - RNA, 18 nt, Artificial Sequence
  Description of Artificial Sequence: Synthetic oligonucleotide
gucucucucugucgccug

SEQ ID NO: 20600 - RNA, 18 nt, Artificial Sequence
  Description of Artificial Sequence: Synthetic oligonucleotide
acagggucucucucuguc

SEQ ID NO: 20601 - RNA, 18 nt, Artificial Sequence
  Description of Artificial Sequence: Synthetic oligonucleotide
aagagacagggucucucu

SEQ ID NO: 20602 - RNA, 18 nt, Artificial Sequence
  Description of Artificial Sequence: Synthetic oligonucleotide
uuuuaaagagacaggguc

SEQ ID NO: 20603 - RNA, 18 nt, Artificial Sequence
  Description of Artificial Sequence: Synthetic oligonucleotide
uuuuuuuuuaaagagaca

SEQ ID NO: 20604 - RNA, 18 nt, Artificial Sequence
  Description of Artificial Sequence: Synthetic oligonucleotide
uuuuuuuuuuuuuuaaag

SEQ ID NO: 20605 - RNA, 18 nt, Artificial Sequence
  Description of Artificial Sequence: Synthetic oligonucleotide
uuuuuuuuuuuuuuuuuu

SEQ ID NO: 20606 - RNA, 18 nt, Artificial Sequence
  Description of Artificial Sequence: Synthetic oligonucleotide
uuuuuuuuuuuuuuuuuu

SEQ ID NO: 20607 - RNA, 18 nt, Artificial Sequence
  Description of Artificial Sequence: Synthetic oligonucleotide
ugccuuuuuuuuuuuuuu

SEQ ID NO: 20608 - RNA, 18 nt, Artificial Sequence
  Description of Artificial Sequence: Synthetic oligonucleotide
uucauugccuuuuuuuuu

SEQ ID NO: 20609 - RNA, 18 nt, Artificial Sequence
  Description of Artificial Sequence: Synthetic oligonucleotide
uuuuguucauugccuuuu

SEQ ID NO: 20610 - RNA, 18 nt, Artificial Sequence
  Description of Artificial Sequence: Synthetic oligonucleotide
caugcuuuuguucauugc

SEQ ID NO: 20611 - RNA, 18 nt, Artificial Sequence
  Description of Artificial Sequence: Synthetic oligonucleotide
agagccaugcuuuuguuc

SEQ ID NO: 20612 - RNA, 18 nt, Artificial Sequence
  Description of Artificial Sequence: Synthetic oligonucleotide
gacguagagccaugcuuu

SEQ ID NO: 20613 - RNA, 18 nt, Artificial Sequence
  Description of Artificial Sequence: Synthetic oligonucleotide
uggaagacguagagccau

SEQ ID NO: 20614 - RNA, 18 nt, Artificial Sequence
  Description of Artificial Sequence: Synthetic oligonucleotide
cacuuuggaagacguaga

SEQ ID NO: 20615 - RNA, 18 nt, Artificial Sequence
  Description of Artificial Sequence: Synthetic oligonucleotide
auucucacuuuggaagac

SEQ ID NO: 20616 - RNA, 18 nt, Artificial Sequence
  Description of Artificial Sequence: Synthetic oligonucleotide
ggagaauucucacuuugg

SEQ ID NO: 20617 - RNA, 18 nt, Artificial Sequence
  Description of Artificial Sequence: Synthetic oligonucleotide
gggagggagaauucucac

SEQ ID NO: 20618 - RNA, 18 nt, Artificial Sequence
  Description of Artificial Sequence: Synthetic oligonucleotide
cuggagggaugcggaggg

SEQ ID NO: 20619 - RNA, 18 nt, Artificial Sequence
  Description of Artificial Sequence: Synthetic oligonucleotide
ucuggagggaugcggagg

SEQ ID NO: 20620 - RNA, 18 nt, Artificial Sequence
  Description of Artificial Sequence: Synthetic oligonucleotide
acaguucuggagggaugc

SEQ ID NO: 20621 - RNA, 18 nt, Artificial Sequence
  Description of Artificial Sequence: Synthetic oligonucleotide
gagcuacaguucuggagg

SEQ ID NO: 20622 - RNA, 18 nt, Artificial Sequence
  Description of Artificial Sequence: Synthetic oligonucleotide
gcucugagcuacaguucu

SEQ ID NO: 20623 - RNA, 18 nt, Artificial Sequence
  Description of Artificial Sequence: Synthetic oligonucleotide
cgugggcucugagcuaca

SEQ ID NO: 20624 - RNA, 18 nt, Artificial Sequence
  Description of Artificial Sequence: Synthetic oligonucleotide
uucagcgugggcucugag

SEQ ID NO: 20625 - RNA, 18 nt, Artificial Sequence
  Description of Artificial Sequence: Synthetic oligonucleotide
ucagauucagcgugggcu

SEQ ID NO: 20626 - RNA, 18 nt, Artificial Sequence
  Description of Artificial Sequence: Synthetic oligonucleotide
aaaagucagauucagcgu

SEQ ID NO: 20627 - RNA, 18 nt, Artificial Sequence
  Description of Artificial Sequence: Synthetic oligonucleotide
aagagaaaagucagauuc

SEQ ID NO: 20628 - RNA, 18 nt, Artificial Sequence
  Description of Artificial Sequence: Synthetic oligonucleotide
gagaaaagagaaaaguca

SEQ ID NO: 20629 - RNA, 18 nt, Artificial Sequence
  Description of Artificial Sequence: Synthetic oligonucleotide
agagagagaaaagagaaa

SEQ ID NO: 20630 - RNA, 18 nt, Artificial Sequence
  Description of Artificial Sequence: Synthetic oligonucleotide
gggagagagagagaaaag

SEQ ID NO: 20631 - RNA, 18 nt, Artificial Sequence
  Description of Artificial Sequence: Synthetic oligonucleotide
gagcagggagagagagag

SEQ ID NO: 20632 - RNA, 18 nt, Artificial Sequence
  Description of Artificial Sequence: Synthetic oligonucleotide
cucgggagcagggagaga

SEQ ID NO: 20633 - RNA, 18 nt, Artificial Sequence
  Description of Artificial Sequence: Synthetic oligonucleotide
cacugcucgggagcaggg

SEQ ID NO: 20634 - RNA, 18 nt, Artificial Sequence
  Description of Artificial Sequence: Synthetic oligonucleotide
uacuucacugcucgggag

SEQ ID NO: 20635 - RNA, 18 nt, Artificial Sequence
  Description of Artificial Sequence: Synthetic oligonucleotide
aagauuacuucacugcuc

SEQ ID NO: 20636 - RNA, 18 nt, Artificial Sequence
  Description of Artificial Sequence: Synthetic oligonucleotide
aaaaaaagauuacuucac

SEQ ID NO: 20637 - RNA, 18 nt, Artificial Sequence
  Description of Artificial Sequence: Synthetic oligonucleotide
ucaguaaaaaaagauuac

SEQ ID NO: 20638 - RNA, 18 nt, Artificial Sequence
  Description of Artificial Sequence: Synthetic oligonucleotide
aaaggucaguaaaaaaag

SEQ ID NO: 20639 - RNA, 18 nt, Artificial Sequence
  Description of Artificial Sequence: Synthetic oligonucleotide
gaagaaaaggucaguaaa

SEQ ID NO: 20640 - RNA, 18 nt, Artificial Sequence
  Description of Artificial Sequence: Synthetic oligonucleotide
aaauggaagaaaagguca

SEQ ID NO: 20641 - RNA, 18 nt, Artificial Sequence
  Description of Artificial Sequence: Synthetic oligonucleotide
aaaaaaaauggaagaaaa

SEQ ID NO: 20642 - RNA, 18 nt, Artificial Sequence
  Description of Artificial Sequence: Synthetic oligonucleotide
ggaggaaaaaaaauggaa

SEQ ID NO: 20643 - RNA, 18 nt, Artificial Sequence
  Description of Artificial Sequence: Synthetic oligonucleotide
aaagaggaggaaaaaaaa

SEQ ID NO: 20644 - RNA, 18 nt, Artificial Sequence
  Description of Artificial Sequence: Synthetic oligonucleotide
auggaaaagaggaggaaa

SEQ ID NO: 20645 - RNA, 18 nt, Artificial Sequence
  Description of Artificial Sequence: Synthetic oligonucleotide
aaucaauggaaaagagga

SEQ ID NO: 20646 - RNA, 18 nt, Artificial Sequence
  Description of Artificial Sequence: Synthetic oligonucleotide
uuucaaaucaauggaaaa

SEQ ID NO: 20647 - RNA, 18 nt, Artificial Sequence
  Description of Artificial Sequence: Synthetic oligonucleotide
agauauuucaaaucaaug

SEQ ID NO: 20648 - RNA, 18 nt, Artificial Sequence
  Description of Artificial Sequence: Synthetic oligonucleotide
aaaauagauauuucaaau

SEQ ID NO: 20649 - RNA, 18 nt, Artificial Sequence
  Description of Artificial Sequence: Synthetic oligonucleotide
augauaaaauagauauuu

SEQ ID NO: 20650 - RNA, 18 nt, Artificial Sequence
  Description of Artificial Sequence: Synthetic oligonucleotide
agagaaugauaaaauaga

SEQ ID NO: 20651 - RNA, 18 nt, Artificial Sequence
  Description of Artificial Sequence: Synthetic oligonucleotide
gaugcagagaaugauaaa

SEQ ID NO: 20652 - RNA, 18 nt, Artificial Sequence
  Description of Artificial Sequence: Synthetic oligonucleotide
agaaagaugcagagaaug

SEQ ID NO: 20653 - RNA, 18 nt, Artificial Sequence
  Description of Artificial Sequence: Synthetic oligonucleotide
gagagagaaagaugcaga

SEQ ID NO: 20654 - RNA, 18 nt, Artificial Sequence
  Description of Artificial Sequence: Synthetic oligonucleotide
aaauagagagagaaagau

SEQ ID NO: 20655 - RNA, 18 nt, Artificial Sequence
  Description of Artificial Sequence: Synthetic oligonucleotide
cgaaaaaauagagagaga

SEQ ID NO: 20656 - RNA, 18 nt, Artificial Sequence
  Description of Artificial Sequence: Synthetic oligonucleotide
cgagccgaaaaaauagag

SEQ ID NO: 20657 - RNA, 18 nt, Artificial Sequence
  Description of Artificial Sequence: Synthetic oligonucleotide
ccacacgagccgaaaaaa

SEQ ID NO: 20658 - RNA, 18 nt, Artificial Sequence
  Description of Artificial Sequence: Synthetic oligonucleotide
gaaauccacacgagccga

SEQ ID NO: 20659 - RNA, 18 nt, Artificial Sequence
  Description of Artificial Sequence: Synthetic oligonucleotide
aaaaagaaauccacacga

SEQ ID NO: 20660 - RNA, 18 nt, Artificial Sequence
  Description of Artificial Sequence: Synthetic oligonucleotide
aaagaaaaaagaaaucca

SEQ ID NO: 20661 - RNA, 18 nt, Artificial Sequence
  Description of Artificial Sequence: Synthetic oligonucleotide
agaagaaagaaaaaagaa

SEQ ID NO: 20662 - RNA, 18 nt, Artificial Sequence
  Description of Artificial Sequence: Synthetic oligonucleotide
gaaacagaagaaagaaaa

SEQ ID NO: 20663 - RNA, 18 nt, Artificial Sequence
  Description of Artificial Sequence: Synthetic oligonucleotide
caaaggaagagagguggg

SEQ ID NO: 20664 - RNA, 18 nt, Artificial Sequence
  Description of Artificial Sequence: Synthetic oligonucleotide
agaaccaaaggaagagag

SEQ ID NO: 20665 - RNA, 18 nt, Artificial Sequence
  Description of Artificial Sequence: Synthetic oligonucleotide
aacagagaaccaaaggaa

SEQ ID NO: 20666 - RNA, 18 nt, Artificial Sequence
  Description of Artificial Sequence: Synthetic oligonucleotide
augggaacagagaaccaa

SEQ ID NO: 20667 - RNA, 18 nt, Artificial Sequence
  Description of Artificial Sequence: Synthetic oligonucleotide
cgggaaugggaacagaga

SEQ ID NO: 20668 - RNA, 18 nt, Artificial Sequence
  Description of Artificial Sequence: Synthetic oligonucleotide
caaaacgggaaugggaac

SEQ ID NO: 20669 - RNA, 18 nt, Artificial Sequence
  Description of Artificial Sequence: Synthetic oligonucleotide
aaaaacaaaacgggaaug

SEQ ID NO: 20670 - RNA, 18 nt, Artificial Sequence
  Description of Artificial Sequence: Synthetic oligonucleotide
aacaaaaaaacaaaacgg

SEQ ID NO: 20671 - RNA, 18 nt, Artificial Sequence
  Description of Artificial Sequence: Synthetic oligonucleotide
acaaaaacaaaaaaacaa

SEQ ID NO: 20672 - RNA, 18 nt, Artificial Sequence
  Description of Artificial Sequence: Synthetic oligonucleotide
caaaaacaaaaacaaaaa

SEQ ID NO: 20673 - RNA, 18 nt, Artificial Sequence
  Description of Artificial Sequence: Synthetic oligonucleotide
aaaaacaaaaacaaaaac

SEQ ID NO: 20674 - RNA, 18 nt, Artificial Sequence
  Description of Artificial Sequence: Synthetic oligonucleotide
augaaaaaaacaaaaaca

SEQ ID NO: 20675 - RNA, 18 nt, Artificial Sequence
  Description of Artificial Sequence: Synthetic oligonucleotide
cagguaaggcaugcggcc

SEQ ID NO: 20676 - RNA, 18 nt, Artificial Sequence
  Description of Artificial Sequence: Synthetic oligonucleotide
auguccagguaaggcaug

SEQ ID NO: 20677 - RNA, 18 nt, Artificial Sequence
  Description of Artificial Sequence: Synthetic oligonucleotide
gauacauguccagguaag

SEQ ID NO: 20678 - RNA, 18 nt, Artificial Sequence
  Description of Artificial Sequence: Synthetic oligonucleotide
caucugauacauguccag

SEQ ID NO: 20679 - RNA, 18 nt, Artificial Sequence
  Description of Artificial Sequence: Synthetic oligonucleotide
cucagcaucugauacaug

SEQ ID NO: 20680 - RNA, 18 nt, Artificial Sequence
  Description of Artificial Sequence: Synthetic oligonucleotide
ugugucucagcaucugau

SEQ ID NO: 20681 - RNA, 18 nt, Artificial Sequence
  Description of Artificial Sequence: Synthetic oligonucleotide
agacaugugucucagcau

SEQ ID NO: 20682 - RNA, 18 nt, Artificial Sequence
  Description of Artificial Sequence: Synthetic oligonucleotide
ggcggagacaugugucuc

SEQ ID NO: 20683 - RNA, 18 nt, Artificial Sequence
  Description of Artificial Sequence: Synthetic oligonucleotide
gggcggagacaugugucu

SEQ ID NO: 20684 - RNA, 18 nt, Artificial Sequence
  Description of Artificial Sequence: Synthetic oligonucleotide
ucuuccccagacccaggg

SEQ ID NO: 20685 - RNA, 18 nt, Artificial Sequence
  Description of Artificial Sequence: Synthetic oligonucleotide
acacuucuuccccagacc

SEQ ID NO: 20686 - RNA, 18 nt, Artificial Sequence
  Description of Artificial Sequence: Synthetic oligonucleotide
gccggacacuucuucccc

SEQ ID NO: 20687 - RNA, 18 nt, Artificial Sequence
  Description of Artificial Sequence: Synthetic oligonucleotide
cucuggccggacacuucu

SEQ ID NO: 20688 - RNA, 18 nt, Artificial Sequence
  Description of Artificial Sequence: Synthetic oligonucleotide
agccacucuggccggaca

SEQ ID NO: 20689 - RNA, 18 nt, Artificial Sequence
  Description of Artificial Sequence: Synthetic oligonucleotide
uuguaagccacucuggcc

SEQ ID NO: 20690 - RNA, 18 nt, Artificial Sequence
  Description of Artificial Sequence: Synthetic oligonucleotide
ccagguaaggcaugcggc

SEQ ID NO: 20691 - RNA, 18 nt, Artificial Sequence
  Description of Artificial Sequence: Synthetic oligonucleotide
cauguccagguaaggcau

SEQ ID NO: 20692 - RNA, 18 nt, Artificial Sequence
  Description of Artificial Sequence: Synthetic oligonucleotide
ugauacauguccagguaa

SEQ ID NO: 20693 - RNA, 18 nt, Artificial Sequence
  Description of Artificial Sequence: Synthetic oligonucleotide
gcaucugauacaugucca

SEQ ID NO: 20694 - RNA, 18 nt, Artificial Sequence
  Description of Artificial Sequence: Synthetic oligonucleotide
ucucagcaucugauacau

SEQ ID NO: 20695 - RNA, 18 nt, Artificial Sequence
  Description of Artificial Sequence: Synthetic oligonucleotide
augugucucagcaucuga

SEQ ID NO: 20696 - RNA, 18 nt, Artificial Sequence
  Description of Artificial Sequence: Synthetic oligonucleotide
gagacaugugucucagca

SEQ ID NO: 20697 - RNA, 18 nt, Artificial Sequence
  Description of Artificial Sequence: Synthetic oligonucleotide
gggcggagacaugugucu

SEQ ID NO: 20698 - RNA, 18 nt, Artificial Sequence
  Description of Artificial Sequence: Synthetic oligonucleotide
ucuuccccagacccaggg

SEQ ID NO: 20699 - RNA, 18 nt, Artificial Sequence
  Description of Artificial Sequence: Synthetic oligonucleotide
acuucuuccccagaccca

SEQ ID NO: 20700 - RNA, 18 nt, Artificial Sequence
  Description of Artificial Sequence: Synthetic oligonucleotide
cggacacuucuuccccag

SEQ ID NO: 20701 - RNA, 18 nt, Artificial Sequence
  Description of Artificial Sequence: Synthetic oligonucleotide
cuggccggacacuucuuc

SEQ ID NO: 20702 - RNA, 18 nt, Artificial Sequence
  Description of Artificial Sequence: Synthetic oligonucleotide
ccacucuggccggacacu

SEQ ID NO: 20703 - RNA, 18 nt, Artificial Sequence
  Description of Artificial Sequence: Synthetic oligonucleotide
guaagccacucuggccgg

SEQ ID NO: 20704 - RNA, 18 nt, Artificial Sequence
  Description of Artificial Sequence: Synthetic oligonucleotide
gguggucggcaaggguag

SEQ ID NO: 20705 - RNA, 18 nt, Artificial Sequence
  Description of Artificial Sequence: Synthetic oligonucleotide
acgucgguggucggcaag

SEQ ID NO: 20706 - RNA, 18 nt, Artificial Sequence
  Description of Artificial Sequence: Synthetic oligonucleotide
ccuggacgucgguggucg

SEQ ID NO: 20707 - RNA, 18 nt, Artificial Sequence
  Description of Artificial Sequence: Synthetic oligonucleotide
cagugccuggacgucggu

SEQ ID NO: 20708 - RNA, 18 nt, Artificial Sequence
  Description of Artificial Sequence: Synthetic oligonucleotide
aaacccagugccuggacg

SEQ ID NO: 20709 - RNA, 18 nt, Artificial Sequence
  Description of Artificial Sequence: Synthetic oligonucleotide
aaaaaaaacccagugccu

SEQ ID NO: 20710 - RNA, 18 nt, Artificial Sequence
  Description of Artificial Sequence: Synthetic oligonucleotide
gaagaaaaaaaaacccag

SEQ ID NO: 20711 - RNA, 18 nt, Artificial Sequence
  Description of Artificial Sequence: Synthetic oligonucleotide
aagaagaagaaaaaaaaa

SEQ ID NO: 20712 - RNA, 18 nt, Artificial Sequence
  Description of Artificial Sequence: Synthetic oligonucleotide
agaagaagaagaagaaaa

SEQ ID NO: 20713 - RNA, 18 nt, Artificial Sequence
  Description of Artificial Sequence: Synthetic oligonucleotide
aaaaaagaagaagaagaa

SEQ ID NO: 20714 - RNA, 18 nt, Artificial Sequence
  Description of Artificial Sequence: Synthetic oligonucleotide
cuaaaaaaaaagaagaag

SEQ ID NO: 20715 - RNA, 18 nt, Artificial Sequence
  Description of Artificial Sequence: Synthetic oligonucleotide
cagcacuaaaaaaaaaga

SEQ ID NO: 20716 - RNA, 18 nt, Artificial Sequence
  Description of Artificial Sequence: Synthetic oligonucleotide
cuggucagcacuaaaaaa

SEQ ID NO: 20717 - RNA, 18 nt, Artificial Sequence
  Description of Artificial Sequence: Synthetic oligonucleotide
uguuucuggucagcacua

SEQ ID NO: 20718 - RNA, 18 nt, Artificial Sequence
  Description of Artificial Sequence: Synthetic oligonucleotide
ccggguguuucuggucag

SEQ ID NO: 20719 - RNA, 18 nt, Artificial Sequence
  Description of Artificial Sequence: Synthetic oligonucleotide
gucggccggguguuucug

SEQ ID NO: 20720 - RNA, 18 nt, Artificial Sequence
  Description of Artificial Sequence: Synthetic oligonucleotide
agagagucggccgggugu

SEQ ID NO: 20721 - RNA, 18 nt, Artificial Sequence
  Description of Artificial Sequence: Synthetic oligonucleotide
gaaaaagagagucggccg

SEQ ID NO: 20722 - RNA, 18 nt, Artificial Sequence
  Description of Artificial Sequence: Synthetic oligonucleotide
cguuggaaaaagagaguc

SEQ ID NO: 20723 - RNA, 18 nt, Artificial Sequence
  Description of Artificial Sequence: Synthetic oligonucleotide
agaaacguuggaaaaaga

SEQ ID NO: 20724 - RNA, 18 nt, Artificial Sequence
  Description of Artificial Sequence: Synthetic oligonucleotide
agaagagaaacguuggaa

SEQ ID NO: 20725 - RNA, 18 nt, Artificial Sequence
  Description of Artificial Sequence: Synthetic oligonucleotide
aaaaaagaagagaaacgu

SEQ ID NO: 20726 - RNA, 18 nt, Artificial Sequence
  Description of Artificial Sequence: Synthetic oligonucleotide
aaaacaaaaaagaagaga

SEQ ID NO: 20727 - RNA, 18 nt, Artificial Sequence
  Description of Artificial Sequence: Synthetic oligonucleotide
aaucaaaaacaaaaaaga

SEQ ID NO: 20728 - RNA, 18 nt, Artificial Sequence
  Description of Artificial Sequence: Synthetic oligonucleotide
aaaagaaucaaaaacaaa

SEQ ID NO: 20729 - RNA, 18 nt, Artificial Sequence
  Description of Artificial Sequence: Synthetic oligonucleotide
gaaaaaaaagaaucaaaa

SEQ ID NO: 20730 - RNA, 18 nt, Artificial Sequence
  Description of Artificial Sequence: Synthetic oligonucleotide
gaaaagaaaaaaaagaau

SEQ ID NO: 20731 - RNA, 18 nt, Artificial Sequence
  Description of Artificial Sequence: Synthetic oligonucleotide
cucgagaaaagaaaaaaa

SEQ ID NO: 20732 - RNA, 18 nt, Artificial Sequence
  Description of Artificial Sequence: Synthetic oligonucleotide
guugacucgagaaaagaa

SEQ ID NO: 20733 - RNA, 18 nt, Artificial Sequence
  Description of Artificial Sequence: Synthetic oligonucleotide
gaucaguugacucgagaa

SEQ ID NO: 20734 - RNA, 18 nt, Artificial Sequence
  Description of Artificial Sequence: Synthetic oligonucleotide
gucaugaucaguugacuc

SEQ ID NO: 20735 - RNA, 18 nt, Artificial Sequence
  Description of Artificial Sequence: Synthetic oligonucleotide
ggauggucaugaucaguu

SEQ ID NO: 20736 - RNA, 18 nt, Artificial Sequence
  Description of Artificial Sequence: Synthetic oligonucleotide
ucaagggauggucaugau

SEQ ID NO: 20737 - RNA, 18 nt, Artificial Sequence
  Description of Artificial Sequence: Synthetic oligonucleotide
uagaaucaagggaugguc

SEQ ID NO: 20738 - RNA, 18 nt, Artificial Sequence
  Description of Artificial Sequence: Synthetic oligonucleotide
cugcuuagaaucaaggga

SEQ ID NO: 20739 - RNA, 18 nt, Artificial Sequence
  Description of Artificial Sequence: Synthetic oligonucleotide
gugugcugcuuagaauca

SEQ ID NO: 20740 - RNA, 18 nt, Artificial Sequence
  Description of Artificial Sequence: Synthetic oligonucleotide
acacagugugcugcuuag

SEQ ID NO: 20741 - RNA, 18 nt, Artificial Sequence
  Description of Artificial Sequence: Synthetic oligonucleotide
gacggacacagugugcug

SEQ ID NO: 20742 - RNA, 18 nt, Artificial Sequence
  Description of Artificial Sequence: Synthetic oligonucleotide
gaaaggacggacacagug

SEQ ID NO: 20743 - RNA, 18 nt, Artificial Sequence
  Description of Artificial Sequence: Synthetic oligonucleotide
caucagaaaggacggaca

SEQ ID NO: 20744 - RNA, 18 nt, Artificial Sequence
  Description of Artificial Sequence: Synthetic oligonucleotide
acacucaucagaaaggac

SEQ ID NO: 20745 - RNA, 18 nt, Artificial Sequence
  Description of Artificial Sequence: Synthetic oligonucleotide
cgaagacacucaucagaa

SEQ ID NO: 20746 - RNA, 18 nt, Artificial Sequence
  Description of Artificial Sequence: Synthetic oligonucleotide
aaacacgaagacacucau

SEQ ID NO: 20747 - RNA, 18 nt, Artificial Sequence
  Description of Artificial Sequence: Synthetic oligonucleotide
ucucaaaacacgaagaca

SEQ ID NO: 20748 - RNA, 18 nt, Artificial Sequence
  Description of Artificial Sequence: Synthetic oligonucleotide
uggagucucaaaacacga

SEQ ID NO: 20749 - RNA, 18 nt, Artificial Sequence
  Description of Artificial Sequence: Synthetic oligonucleotide
cauaauggagucucaaaa

SEQ ID NO: 20750 - RNA, 18 nt, Artificial Sequence
  Description of Artificial Sequence: Synthetic oligonucleotide
ucggccauaauggagucu

SEQ ID NO: 20751 - RNA, 18 nt, Artificial Sequence
  Description of Artificial Sequence: Synthetic oligonucleotide
gcaugucggccauaaugg

SEQ ID NO: 20752 - RNA, 18 nt, Artificial Sequence
  Description of Artificial Sequence: Synthetic oligonucleotide
ccccggcaugucggccau

SEQ ID NO: 20753 - RNA, 18 nt, Artificial Sequence
  Description of Artificial Sequence: Synthetic oligonucleotide
ccuccccccggcaugucg

SEQ ID NO: 20754 - RNA, 18 nt, Artificial Sequence
  Description of Artificial Sequence: Synthetic oligonucleotide
cucccccuccccccggca

SEQ ID NO: 20755 - RNA, 18 nt, Artificial Sequence
  Description of Artificial Sequence: Synthetic oligonucleotide
cuccccucccccuccccc

SEQ ID NO: 20756 - RNA, 18 nt, Artificial Sequence
  Description of Artificial Sequence: Synthetic oligonucleotide
gggcgcuccccucccccu

SEQ ID NO: 20757 - RNA, 18 nt, Artificial Sequence
  Description of Artificial Sequence: Synthetic oligonucleotide
gaccugggcgcuccccuc

SEQ ID NO: 20758 - RNA, 18 nt, Artificial Sequence
  Description of Artificial Sequence: Synthetic oligonucleotide
gggaccugggcgcucccc

SEQ ID NO: 20759 - RNA, 18 nt, Artificial Sequence
  Description of Artificial Sequence: Synthetic oligonucleotide
ggagaccaggugcaaggg

SEQ ID NO: 20760 - RNA, 18 nt, Artificial Sequence
  Description of Artificial Sequence: Synthetic oligonucleotide
accugggagaccaggugc

SEQ ID NO: 20761 - RNA, 18 nt, Artificial Sequence
  Description of Artificial Sequence: Synthetic oligonucleotide
uugguaccugggagacca

SEQ ID NO: 20762 - RNA, 18 nt, Artificial Sequence
  Description of Artificial Sequence: Synthetic oligonucleotide
ccaauuugguaccuggga

SEQ ID NO: 20763 - RNA, 18 nt, Artificial Sequence
  Description of Artificial Sequence: Synthetic oligonucleotide
uguuuccaauuugguacc

SEQ ID NO: 20764 - RNA, 18 nt, Artificial Sequence
  Description of Artificial Sequence: Synthetic oligonucleotide
guguuuguuuccaauuug

SEQ ID NO: 20765 - RNA, 18 nt, Artificial Sequence
  Description of Artificial Sequence: Synthetic oligonucleotide
gaagcguguuuguuucca

SEQ ID NO: 20766 - RNA, 18 nt, Artificial Sequence
  Description of Artificial Sequence: Synthetic oligonucleotide
cugaagaagcguguuugu

SEQ ID NO: 20767 - RNA, 18 nt, Artificial Sequence
  Description of Artificial Sequence: Synthetic oligonucleotide
acucccugaagaagcgug

SEQ ID NO: 20768 - RNA, 18 nt, Artificial Sequence
  Description of Artificial Sequence: Synthetic oligonucleotide
uuuugacucccugaagaa

SEQ ID NO: 20769 - RNA, 18 nt, Artificial Sequence
  Description of Artificial Sequence: Synthetic oligonucleotide
auggguuuugacucccug

SEQ ID NO: 20770 - RNA, 18 nt, Artificial Sequence
  Description of Artificial Sequence: Synthetic oligonucleotide
gaagcauggguuuugacu

SEQ ID NO: 20771 - RNA, 18 nt, Artificial Sequence
  Description of Artificial Sequence: Synthetic oligonucleotide
agugggaagcauggguuu

SEQ ID NO: 20772 - RNA, 18 nt, Artificial Sequence
  Description of Artificial Sequence: Synthetic oligonucleotide
gcagaagugggaagcaug

SEQ ID NO: 20773 - RNA, 18 nt, Artificial Sequence
  Description of Artificial Sequence: Synthetic oligonucleotide
ggugggcagaagugggaa

SEQ ID NO: 20774 - RNA, 18 nt, Artificial Sequence
  Description of Artificial Sequence: Synthetic oligonucleotide
cucugggugggcagaagu

SEQ ID NO: 20775 - RNA, 18 nt, Artificial Sequence
  Description of Artificial Sequence: Synthetic oligonucleotide
ggccgcucugggugggca

SEQ ID NO: 20776 - RNA, 18 nt, Artificial Sequence
  Description of Artificial Sequence: Synthetic oligonucleotide
gggccgcucugggugggc

SEQ ID NO: 20777 - RNA, 18 nt, Artificial Sequence
  Description of Artificial Sequence: Synthetic oligonucleotide
ccccagccugggcauggg

SEQ ID NO: 20778 - RNA, 18 nt, Artificial Sequence
  Description of Artificial Sequence: Synthetic oligonucleotide
gccugccccagccugggc

SEQ ID NO: 20779 - RNA, 18 nt, Artificial Sequence
  Description of Artificial Sequence: Synthetic oligonucleotide
aaggcgccugccccagcc

SEQ ID NO: 20780 - RNA, 18 nt, Artificial Sequence
  Description of Artificial Sequence: Synthetic oligonucleotide
ucugcaaggcgccugccc

SEQ ID NO: 20781 - RNA, 18 nt, Artificial Sequence
  Description of Artificial Sequence: Synthetic oligonucleotide
cccucucugcaaggcgcc

SEQ ID NO: 20782 - RNA, 18 nt, Artificial Sequence
  Description of Artificial Sequence: Synthetic oligonucleotide
aaagccccucucugcaag

SEQ ID NO: 20783 - RNA, 18 nt, Artificial Sequence
  Description of Artificial Sequence: Synthetic oligonucleotide
gggcuaaagccccucucu

SEQ ID NO: 20784 - RNA, 18 nt, Artificial Sequence
  Description of Artificial Sequence: Synthetic oligonucleotide
gggaccucgccugcuuuc

SEQ ID NO: 20785 - RNA, 18 nt, Artificial Sequence
  Description of Artificial Sequence: Synthetic oligonucleotide
gacccgggaccucgccug

SEQ ID NO: 20786 - RNA, 18 nt, Artificial Sequence
  Description of Artificial Sequence: Synthetic oligonucleotide
gggacccgggaccucgcc

SEQ ID NO: 20787 - RNA, 18 nt, Artificial Sequence
  Description of Artificial Sequence: Synthetic oligonucleotide
caggugugcguggcaggg

SEQ ID NO: 20788 - RNA, 18 nt, Artificial Sequence
  Description of Artificial Sequence: Synthetic oligonucleotide
agcuucaggugugcgugg

SEQ ID NO: 20789 - RNA, 18 nt, Artificial Sequence
  Description of Artificial Sequence: Synthetic oligonucleotide
agaucagcuucaggugug

SEQ ID NO: 20790 - RNA, 18 nt, Artificial Sequence
  Description of Artificial Sequence: Synthetic oligonucleotide
gucagagaucagcuucag

SEQ ID NO: 20791 - RNA, 18 nt, Artificial Sequence
  Description of Artificial Sequence: Synthetic oligonucleotide
ccuaggucagagaucagc

SEQ ID NO: 20792 - RNA, 18 nt, Artificial Sequence
  Description of Artificial Sequence: Synthetic oligonucleotide
aaggcccuaggucagaga

SEQ ID NO: 20793 - RNA, 18 nt, Artificial Sequence
  Description of Artificial Sequence: Synthetic oligonucleotide
uccccaaggcccuagguc

SEQ ID NO: 20794 - RNA, 18 nt, Artificial Sequence
  Description of Artificial Sequence: Synthetic oligonucleotide
ucgaauccccaaggcccu

SEQ ID NO: 20795 - RNA, 18 nt, Artificial Sequence
  Description of Artificial Sequence: Synthetic oligonucleotide
cauuccucugagaagcag

SEQ ID NO: 20796 - RNA, 18 nt, Artificial Sequence
  Description of Artificial Sequence: Synthetic oligonucleotide
cacaucauuccucugaga

SEQ ID NO: 20797 - RNA, 18 nt, Artificial Sequence
  Description of Artificial Sequence: Synthetic oligonucleotide
cagaccacaucauuccuc

SEQ ID NO: 20798 - RNA, 18 nt, Artificial Sequence
  Description of Artificial Sequence: Synthetic oligonucleotide
gggcacagaccacaucau

SEQ ID NO: 20799 - RNA, 18 nt, Artificial Sequence
  Description of Artificial Sequence: Synthetic oligonucleotide
cagaugggcacagaccac

SEQ ID NO: 20800 - RNA, 18 nt, Artificial Sequence
  Description of Artificial Sequence: Synthetic oligonucleotide
cagagcagaugggcacag

SEQ ID NO: 20801 - RNA, 18 nt, Artificial Sequence
  Description of Artificial Sequence: Synthetic oligonucleotide
caggacagagcagauggg

SEQ ID NO: 20802 - RNA, 18 nt, Artificial Sequence
  Description of Artificial Sequence: Synthetic oligonucleotide
cagaccaggacagagcag

SEQ ID NO: 20803 - RNA, 18 nt, Artificial Sequence
  Description of Artificial Sequence: Synthetic oligonucleotide
uggcccagaccaggacag

SEQ ID NO: 20804 - RNA, 18 nt, Artificial Sequence
  Description of Artificial Sequence: Synthetic oligonucleotide
uggcuuggcccagaccag

SEQ ID NO: 20805 - RNA, 18 nt, Artificial Sequence
  Description of Artificial Sequence: Synthetic oligonucleotide
aucccuggcuuggcccag

SEQ ID NO: 20806 - RNA, 18 nt, Artificial Sequence
  Description of Artificial Sequence: Synthetic oligonucleotide
acccaaucccuggcuugg

SEQ ID NO: 20807 - RNA, 18 nt, Artificial Sequence
  Description of Artificial Sequence: Synthetic oligonucleotide
cccacacccaaucccugg

SEQ ID NO: 20808 - RNA, 18 nt, Artificial Sequence
  Description of Artificial Sequence: Synthetic oligonucleotide
ggcuccccacacccaauc

SEQ ID NO: 20809 - RNA, 18 nt, Artificial Sequence
  Description of Artificial Sequence: Synthetic oligonucleotide
ccacuggcuccccacacc

SEQ ID NO: 20810 - RNA, 18 nt, Artificial Sequence
  Description of Artificial Sequence: Synthetic oligonucleotide
gggugccacuggcucccc

SEQ ID NO: 20811 - RNA, 18 nt, Artificial Sequence
  Description of Artificial Sequence: Synthetic oligonucleotide
accacagccgcugguggg

SEQ ID NO: 20812 - RNA, 18 nt, Artificial Sequence
  Description of Artificial Sequence: Synthetic oligonucleotide
aggaccacagccgcuggu

SEQ ID NO: 20813 - RNA, 18 nt, Artificial Sequence
  Description of Artificial Sequence: Synthetic oligonucleotide
gggccaggaccacagccg

SEQ ID NO: 20814 - RNA, 18 nt, Artificial Sequence
  Description of Artificial Sequence: Synthetic oligonucleotide
aacagccaaggcugaggg

SEQ ID NO: 20815 - RNA, 18 nt, Artificial Sequence
  Description of Artificial Sequence: Synthetic oligonucleotide
augcaacagccaaggcug

SEQ ID NO: 20816 - RNA, 18 nt, Artificial Sequence
  Description of Artificial Sequence: Synthetic oligonucleotide
agugcaugcaacagccaa

SEQ ID NO: 20817 - RNA, 18 nt, Artificial Sequence
  Description of Artificial Sequence: Synthetic oligonucleotide
ugagcagugcaugcaaca

SEQ ID NO: 20818 - RNA, 18 nt, Artificial Sequence
  Description of Artificial Sequence: Synthetic oligonucleotide
ggauuugagcagugcaug

SEQ ID NO: 20819 - RNA, 18 nt, Artificial Sequence
  Description of Artificial Sequence: Synthetic oligonucleotide
aagcuggauuugagcagu

SEQ ID NO: 20820 - RNA, 18 nt, Artificial Sequence
  Description of Artificial Sequence: Synthetic oligonucleotide
agcacaagcuggauuuga

SEQ ID NO: 20821 - RNA, 18 nt, Artificial Sequence
  Description of Artificial Sequence: Synthetic oligonucleotide
aaaagagcacaagcugga

SEQ ID NO: 20822 - RNA, 18 nt, Artificial Sequence
  Description of Artificial Sequence: Synthetic oligonucleotide
aaagaaaaagagcacaag

SEQ ID NO: 20823 - RNA, 18 nt, Artificial Sequence
  Description of Artificial Sequence: Synthetic oligonucleotide
accccaaagaaaaagagc

SEQ ID NO: 20824 - RNA, 18 nt, Artificial Sequence
  Description of Artificial Sequence: Synthetic oligonucleotide
gucugaccccaaagaaaa

SEQ ID NO: 20825 - RNA, 18 nt, Artificial Sequence
  Description of Artificial Sequence: Synthetic oligonucleotide
uuucagucugaccccaaa

SEQ ID NO: 20826 - RNA, 18 nt, Artificial Sequence
  Description of Artificial Sequence: Synthetic oligonucleotide
ccccguuucagucugacc

SEQ ID NO: 20827 - RNA, 18 nt, Artificial Sequence
  Description of Artificial Sequence: Synthetic oligonucleotide
gauggccccguuucaguc

SEQ ID NO: 20828 - RNA, 18 nt, Artificial Sequence
  Description of Artificial Sequence: Synthetic oligonucleotide
uucuggauggccccguuu

SEQ ID NO: 20829 - RNA, 18 nt, Artificial Sequence
  Description of Artificial Sequence: Synthetic oligonucleotide
aguucuucuggauggccc

SEQ ID NO: 20830 - RNA, 18 nt, Artificial Sequence
  Description of Artificial Sequence: Synthetic oligonucleotide
cccagaguucuucuggau

SEQ ID NO: 20831 - RNA, 18 nt, Artificial Sequence
  Description of Artificial Sequence: Synthetic oligonucleotide
ccugccccagaguucuuc

SEQ ID NO: 20832 - RNA, 18 nt, Artificial Sequence
  Description of Artificial Sequence: Synthetic oligonucleotide
cccgcccugccccagagu

SEQ ID NO: 20833 - RNA, 18 nt, Artificial Sequence
  Description of Artificial Sequence: Synthetic oligonucleotide
ccacccccgcccugcccc

SEQ ID NO: 20834 - RNA, 18 nt, Artificial Sequence
  Description of Artificial Sequence: Synthetic oligonucleotide
uugccccacccccgcccu

SEQ ID NO: 20835 - RNA, 18 nt, Artificial Sequence
  Description of Artificial Sequence: Synthetic oligonucleotide
aacccuugccccaccccc

SEQ ID NO: 20836 - RNA, 18 nt, Artificial Sequence
  Description of Artificial Sequence: Synthetic oligonucleotide
gccucaacccuugcccca

SEQ ID NO: 20837 - RNA, 18 nt, Artificial Sequence
  Description of Artificial Sequence: Synthetic oligonucleotide
gguuugccucaacccuug

SEQ ID NO: 20838 - RNA, 18 nt, Artificial Sequence
  Description of Artificial Sequence: Synthetic oligonucleotide
uccaggguuugccucaac

SEQ ID NO: 20839 - RNA, 18 nt, Artificial Sequence
  Description of Artificial Sequence: Synthetic oligonucleotide
gcauuuccaggguuugcc

SEQ ID NO: 20840 - RNA, 18 nt, Artificial Sequence
  Description of Artificial Sequence: Synthetic oligonucleotide
agcuggcauuuccagggu

SEQ ID NO: 20841 - RNA, 18 nt, Artificial Sequence
  Description of Artificial Sequence: Synthetic oligonucleotide
cugagagcuggcauuucc

SEQ ID NO: 20842 - RNA, 18 nt, Artificial Sequence
  Description of Artificial Sequence: Synthetic oligonucleotide
uugaccugagagcuggca

SEQ ID NO: 20843 - RNA, 18 nt, Artificial Sequence
  Description of Artificial Sequence: Synthetic oligonucleotide
ccugcuugaccugagagc

SEQ ID NO: 20844 - RNA, 18 nt, Artificial Sequence
  Description of Artificial Sequence: Synthetic oligonucleotide
ccccaccugcuugaccug

SEQ ID NO: 20845 - RNA, 18 nt, Artificial Sequence
  Description of Artificial Sequence: Synthetic oligonucleotide
uuuucccccaccugcuug

SEQ ID NO: 20846 - RNA, 18 nt, Artificial Sequence
  Description of Artificial Sequence: Synthetic oligonucleotide
uccuuuuuucccccaccu

SEQ ID NO: 20847 - RNA, 18 nt, Artificial Sequence
  Description of Artificial Sequence: Synthetic oligonucleotide
cccucuccuuuuuucccc

SEQ ID NO: 20848 - RNA, 18 nt, Artificial Sequence
  Description of Artificial Sequence: Synthetic oligonucleotide
cccugcccucuccuuuuu

SEQ ID NO: 20849 - RNA, 18 nt, Artificial Sequence
  Description of Artificial Sequence: Synthetic oligonucleotide
ugguccccugcccucucc

SEQ ID NO: 20850 - RNA, 18 nt, Artificial Sequence
  Description of Artificial Sequence: Synthetic oligonucleotide
acuucugguccccugccc

SEQ ID NO: 20851 - RNA, 18 nt, Artificial Sequence
  Description of Artificial Sequence: Synthetic oligonucleotide
cuuguacuucuggucccc

SEQ ID NO: 20852 - RNA, 18 nt, Artificial Sequence
  Description of Artificial Sequence: Synthetic oligonucleotide
gcucucuuguacuucugg

SEQ ID NO: 20853 - RNA, 18 nt, Artificial Sequence
  Description of Artificial Sequence: Synthetic oligonucleotide
aaaaggcucucuuguacu

SEQ ID NO: 20854 - RNA, 18 nt, Artificial Sequence
  Description of Artificial Sequence: Synthetic oligonucleotide
ggcacaaaaggcucucuu

SEQ ID NO: 20855 - RNA, 18 nt, Artificial Sequence
  Description of Artificial Sequence: Synthetic oligonucleotide
gggagggcacaaaaggcu

SEQ ID NO: 20856 - RNA, 18 nt, Artificial Sequence
  Description of Artificial Sequence: Synthetic oligonucleotide
ccgcagggagggcacaaa

SEQ ID NO: 20857 - RNA, 18 nt, Artificial Sequence
  Description of Artificial Sequence: Synthetic oligonucleotide
guggcccgcagggagggc

SEQ ID NO: 20858 - RNA, 18 nt, Artificial Sequence
  Description of Artificial Sequence: Synthetic oligonucleotide
ucuugguggcccgcaggg

SEQ ID NO: 20859 - RNA, 18 nt, Artificial Sequence
  Description of Artificial Sequence: Synthetic oligonucleotide
guuucucuugguggcccg

SEQ ID NO: 20860 - RNA, 18 nt, Artificial Sequence
  Description of Artificial Sequence: Synthetic oligonucleotide
acucaguuucucuuggug

SEQ ID NO: 20861 - RNA, 18 nt, Artificial Sequence
  Description of Artificial Sequence: Synthetic oligonucleotide
ccaguacucaguuucucu

SEQ ID NO: 20862 - RNA, 18 nt, Artificial Sequence
  Description of Artificial Sequence: Synthetic oligonucleotide
cugucccaguacucaguu

SEQ ID NO: 20863 - RNA, 18 nt, Artificial Sequence
  Description of Artificial Sequence: Synthetic oligonucleotide
guuaccugucccaguacu

SEQ ID NO: 20864 - RNA, 18 nt, Artificial Sequence
  Description of Artificial Sequence: Synthetic oligonucleotide
cuuagguuaccuguccca

SEQ ID NO: 20865 - RNA, 18 nt, Artificial Sequence
  Description of Artificial Sequence: Synthetic oligonucleotide
ucuuacuuagguuaccug

SEQ ID NO: 20866 - RNA, 18 nt, Artificial Sequence
  Description of Artificial Sequence: Synthetic oligonucleotide
gugucucuuacuuagguu

SEQ ID NO: 20867 - RNA, 18 nt, Artificial Sequence
  Description of Artificial Sequence: Synthetic oligonucleotide
cugaggugucucuuacuu

SEQ ID NO: 20868 - RNA, 18 nt, Artificial Sequence
  Description of Artificial Sequence: Synthetic oligonucleotide
ggcggcugaggugucucu

SEQ ID NO: 20869 - RNA, 18 nt, Artificial Sequence
  Description of Artificial Sequence: Synthetic oligonucleotide
gcuguggcggcugaggug

SEQ ID NO: 20870 - RNA, 18 nt, Artificial Sequence
  Description of Artificial Sequence: Synthetic oligonucleotide
ugaaagcuguggcggcug

SEQ ID NO: 20871 - RNA, 18 nt, Artificial Sequence
  Description of Artificial Sequence: Synthetic oligonucleotide
aacucugaaagcuguggc

SEQ ID NO: 20872 - RNA, 18 nt, Artificial Sequence
  Description of Artificial Sequence: Synthetic oligonucleotide
ggaagaacucugaaagcu

SEQ ID NO: 20873 - RNA, 18 nt, Artificial Sequence
  Description of Artificial Sequence: Synthetic oligonucleotide
ucccaggaagaacucuga

SEQ ID NO: 20874 - RNA, 18 nt, Artificial Sequence
  Description of Artificial Sequence: Synthetic oligonucleotide
gggagucccaggaagaac

SEQ ID NO: 20875 - RNA, 18 nt, Artificial Sequence
  Description of Artificial Sequence: Synthetic oligonucleotide
acccagggagucccagga

SEQ ID NO: 20876 - RNA, 18 nt, Artificial Sequence
  Description of Artificial Sequence: Synthetic oligonucleotide
ccccuacccagggagucc

SEQ ID NO: 20877 - RNA, 18 nt, Artificial Sequence
  Description of Artificial Sequence: Synthetic oligonucleotide
gcccgccccuacccaggg

SEQ ID NO: 20878 - RNA, 18 nt, Artificial Sequence
  Description of Artificial Sequence: Synthetic oligonucleotide
gccgcgcccgccccuacc

SEQ ID NO: 20879 - RNA, 18 nt, Artificial Sequence
  Description of Artificial Sequence: Synthetic oligonucleotide
cgugagccgcgcccgccc

SEQ ID NO: 20880 - RNA, 18 nt, Artificial Sequence
  Description of Artificial Sequence: Synthetic oligonucleotide
ucucccgugagccgcgcc

SEQ ID NO: 20881 - RNA, 18 nt, Artificial Sequence
  Description of Artificial Sequence: Synthetic oligonucleotide
cugggucucccgugagcc

SEQ ID NO: 20882 - RNA, 18 nt, Artificial Sequence
  Description of Artificial Sequence: Synthetic oligonucleotide
cccuccugggucucccgu

SEQ ID NO: 20883 - RNA, 18 nt, Artificial Sequence
  Description of Artificial Sequence: Synthetic oligonucleotide
ggcaucccuccugggucu

SEQ ID NO: 20884 - RNA, 18 nt, Artificial Sequence
  Description of Artificial Sequence: Synthetic oligonucleotide
ucccaggcaucccuccug

SEQ ID NO: 20885 - RNA, 18 nt, Artificial Sequence
  Description of Artificial Sequence: Synthetic oligonucleotide
gucauucccaggcauccc

SEQ ID NO: 20886 - RNA, 18 nt, Artificial Sequence
  Description of Artificial Sequence: Synthetic oligonucleotide
gcgcagucauucccaggc

SEQ ID NO: 20887 - RNA, 18 nt, Artificial Sequence
  Description of Artificial Sequence: Synthetic oligonucleotide
ggcaagcgcagucauucc

SEQ ID NO: 20888 - RNA, 18 nt, Artificial Sequence
  Description of Artificial Sequence: Synthetic oligonucleotide
gguccauccgcagaagcc

SEQ ID NO: 20889 - RNA, 18 nt, Artificial Sequence
  Description of Artificial Sequence: Synthetic oligonucleotide
gggcagguccauccgcag

SEQ ID NO: 20890 - RNA, 18 nt, Artificial Sequence
  Description of Artificial Sequence: Synthetic oligonucleotide
gcgacgggcagguccauc

SEQ ID NO: 20891 - RNA, 18 nt, Artificial Sequence
  Description of Artificial Sequence: Synthetic oligonucleotide
caucugcgacgggcaggu

SEQ ID NO: 20892 - RNA, 18 nt, Artificial Sequence
  Description of Artificial Sequence: Synthetic oligonucleotide
guugucaucugcgacggg

SEQ ID NO: 20893 - RNA, 18 nt, Artificial Sequence
  Description of Artificial Sequence: Synthetic oligonucleotide
acgguguugucaucugcg

SEQ ID NO: 20894 - RNA, 18 nt, Artificial Sequence
  Description of Artificial Sequence: Synthetic oligonucleotide
aguggacgguguugucau

SEQ ID NO: 20895 - RNA, 18 nt, Artificial Sequence
  Description of Artificial Sequence: Synthetic oligonucleotide
auugaaguggacgguguu

SEQ ID NO: 20896 - RNA, 18 nt, Artificial Sequence
  Description of Artificial Sequence: Synthetic oligonucleotide
guggaauugaaguggacg

SEQ ID NO: 20897 - RNA, 18 nt, Artificial Sequence
  Description of Artificial Sequence: Synthetic oligonucleotide
ugaggguggaauugaagu

SEQ ID NO: 20898 - RNA, 18 nt, Artificial Sequence
  Description of Artificial Sequence: Synthetic oligonucleotide
agccaugaggguggaauu

SEQ ID NO: 20899 - RNA, 18 nt, Artificial Sequence
  Description of Artificial Sequence: Synthetic oligonucleotide
aucagagccaugagggug

SEQ ID NO: 20900 - RNA, 18 nt, Artificial Sequence
  Description of Artificial Sequence: Synthetic oligonucleotide
ugcggaucagagccauga

SEQ ID NO: 20901 - RNA, 18 nt, Artificial Sequence
  Description of Artificial Sequence: Synthetic oligonucleotide
ggcugugcggaucagagc

SEQ ID NO: 20902 - RNA, 18 nt, Artificial Sequence
  Description of Artificial Sequence: Synthetic oligonucleotide
uccagggcugugcggauc

SEQ ID NO: 20903 - RNA, 18 nt, Artificial Sequence
  Description of Artificial Sequence: Synthetic oligonucleotide
ugauguccagggcugugc

SEQ ID NO: 20904 - RNA, 18 nt, Artificial Sequence
  Description of Artificial Sequence: Synthetic oligonucleotide
aaucuugauguccagggc

SEQ ID NO: 20905 - RNA, 18 nt, Artificial Sequence
  Description of Artificial Sequence: Synthetic oligonucleotide
uuggcaaucuugaugucc

SEQ ID NO: 20906 - RNA, 18 nt, Artificial Sequence
  Description of Artificial Sequence: Synthetic oligonucleotide
cgacaaagagauucagca

SEQ ID NO: 20907 - RNA, 18 nt, Artificial Sequence
  Description of Artificial Sequence: Synthetic oligonucleotide
gacggcgacaaagagauu

SEQ ID NO: 20908 - RNA, 18 nt, Artificial Sequence
  Description of Artificial Sequence: Synthetic oligonucleotide
augaugacggcgacaaag

SEQ ID NO: 20909 - RNA, 18 nt, Artificial Sequence
  Description of Artificial Sequence: Synthetic oligonucleotide
uguccaugaugacggcga

SEQ ID NO: 20910 - RNA, 18 nt, Artificial Sequence
  Description of Artificial Sequence: Synthetic oligonucleotide
aaaguuguccaugaugac

SEQ ID NO: 20911 - RNA, 18 nt, Artificial Sequence
  Description of Artificial Sequence: Synthetic oligonucleotide
uacucaaaguuguccaug

SEQ ID NO: 20912 - RNA, 18 nt, Artificial Sequence
  Description of Artificial Sequence: Synthetic oligonucleotide
ugagguacucaaaguugu

SEQ ID NO: 20913 - RNA, 18 nt, Artificial Sequence
  Description of Artificial Sequence: Synthetic oligonucleotide
ucgggugagguacucaaa

SEQ ID NO: 20914 - RNA, 18 nt, Artificial Sequence
  Description of Artificial Sequence: Synthetic oligonucleotide
gagucucgggugagguac

SEQ ID NO: 20915 - RNA, 18 nt, Artificial Sequence
  Description of Artificial Sequence: Synthetic oligonucleotide
uggaggagucucggguga

SEQ ID NO: 20916 - RNA, 18 nt, Artificial Sequence
  Description of Artificial Sequence: Synthetic oligonucleotide
caggauggaggagucucg

SEQ ID NO: 20917 - RNA, 18 nt, Artificial Sequence
  Description of Artificial Sequence: Synthetic oligonucleotide
gggcccaggauggaggag

SEQ ID NO: 20918 - RNA, 18 nt, Artificial Sequence
  Description of Artificial Sequence: Synthetic oligonucleotide
acucauccaggugguggg

SEQ ID NO: 20919 - RNA, 18 nt, Artificial Sequence
  Description of Artificial Sequence: Synthetic oligonucleotide
acguacucauccaggugg

SEQ ID NO: 20920 - RNA, 18 nt, Artificial Sequence
  Description of Artificial Sequence: Synthetic oligonucleotide
cacgcacguacucaucca

SEQ ID NO: 20921 - RNA, 18 nt, Artificial Sequence
  Description of Artificial Sequence: Synthetic oligonucleotide
ccagacacgcacguacuc

SEQ ID NO: 20922 - RNA, 18 nt, Artificial Sequence
  Description of Artificial Sequence: Synthetic oligonucleotide
ucggcccagacacgcacg

SEQ ID NO: 20923 - RNA, 18 nt, Artificial Sequence
  Description of Artificial Sequence: Synthetic oligonucleotide
cauacucggcccagacac

SEQ ID NO: 20924 - RNA, 18 nt, Artificial Sequence
  Description of Artificial Sequence: Synthetic oligonucleotide
auuguggcuggaggauuc

SEQ ID NO: 20925 - RNA, 18 nt, Artificial Sequence
  Description of Artificial Sequence: Synthetic oligonucleotide
ugaguauuguggcuggag

SEQ ID NO: 20926 - RNA, 18 nt, Artificial Sequence
  Description of Artificial Sequence: Synthetic oligonucleotide
agaggugaguauuguggc

SEQ ID NO: 20927 - RNA, 18 nt, Artificial Sequence
  Description of Artificial Sequence: Synthetic oligonucleotide
cagggagaggugaguauu

SEQ ID NO: 20928 - RNA, 18 nt, Artificial Sequence
  Description of Artificial Sequence: Synthetic oligonucleotide
aguuccagggagagguga

SEQ ID NO: 20929 - RNA, 18 nt, Artificial Sequence
  Description of Artificial Sequence: Synthetic oligonucleotide
guuccaguuccagggaga

SEQ ID NO: 20930 - RNA, 18 nt, Artificial Sequence
  Description of Artificial Sequence: Synthetic oligonucleotide
cccguguuccaguuccag

SEQ ID NO: 20931 - RNA, 18 nt, Artificial Sequence
  Description of Artificial Sequence: Synthetic oligonucleotide
ccuagcccguguuccagu

SEQ ID NO: 20932 - RNA, 18 nt, Artificial Sequence
  Description of Artificial Sequence: Synthetic oligonucleotide
ccugaccuagcccguguu

SEQ ID NO: 20933 - RNA, 18 nt, Artificial Sequence
  Description of Artificial Sequence: Synthetic oligonucleotide
gggccugaccuagcccgu

SEQ ID NO: 20934 - RNA, 18 nt, Artificial Sequence
  Description of Artificial Sequence: Synthetic oligonucleotide
agugcuccagagucuggg

SEQ ID NO: 20935 - RNA, 18 nt, Artificial Sequence
  Description of Artificial Sequence: Synthetic oligonucleotide
aguucagugcuccagagu

SEQ ID NO: 20936 - RNA, 18 nt, Artificial Sequence
  Description of Artificial Sequence: Synthetic oligonucleotide
ccaggaguucagugcucc

SEQ ID NO: 20937 - RNA, 18 nt, Artificial Sequence
  Description of Artificial Sequence: Synthetic oligonucleotide
ggaccccaggaguucagu

SEQ ID NO: 20938 - RNA, 18 nt, Artificial Sequence
  Description of Artificial Sequence: Synthetic oligonucleotide
ugcuaggaccccaggagu

SEQ ID NO: 20939 - RNA, 18 nt, Artificial Sequence
  Description of Artificial Sequence: Synthetic oligonucleotide
accccugcuaggacccca

SEQ ID NO: 20940 - RNA, 18 nt, Artificial Sequence
  Description of Artificial Sequence: Synthetic oligonucleotide
gugagaccccugcuagga

SEQ ID NO: 20941 - RNA, 18 nt, Artificial Sequence
  Description of Artificial Sequence: Synthetic oligonucleotide
aaccugugagaccccugc

SEQ ID NO: 20942 - RNA, 18 nt, Artificial Sequence
  Description of Artificial Sequence: Synthetic oligonucleotide
gacugaaccugugagacc

SEQ ID NO: 20943 - RNA, 18 nt, Artificial Sequence
  Description of Artificial Sequence: Synthetic oligonucleotide
cuccugacugaaccugug

SEQ ID NO: 20944 - RNA, 18 nt, Artificial Sequence
  Description of Artificial Sequence: Synthetic oligonucleotide
cuucucuccugacugaac

SEQ ID NO: 20945 - RNA, 18 nt, Artificial Sequence
  Description of Artificial Sequence: Synthetic oligonucleotide
uauaucuucucuccugac

SEQ ID NO: 20946 - RNA, 18 nt, Artificial Sequence
  Description of Artificial Sequence: Synthetic oligonucleotide
auucuuauaucuucucuc

SEQ ID NO: 20947 - RNA, 18 nt, Artificial Sequence
  Description of Artificial Sequence: Synthetic oligonucleotide
ugaugauucuuauaucuu

SEQ ID NO: 20948 - RNA, 18 nt, Artificial Sequence
  Description of Artificial Sequence: Synthetic oligonucleotide
aagggugaugauucuuau

SEQ ID NO: 20949 - RNA, 18 nt, Artificial Sequence
  Description of Artificial Sequence: Synthetic oligonucleotide
uaugcaagggugaugauu

SEQ ID NO: 20950 - RNA, 18 nt, Artificial Sequence
  Description of Artificial Sequence: Synthetic oligonucleotide
ggguaugcaagggugaug

SEQ ID NO: 20951 - RNA, 18 nt, Artificial Sequence
  Description of Artificial Sequence: Synthetic oligonucleotide
cuacguguuuaaucuggg

SEQ ID NO: 20952 - RNA, 18 nt, Artificial Sequence
  Description of Artificial Sequence: Synthetic oligonucleotide
gcacccuacguguuuaau

SEQ ID NO: 20953 - RNA, 18 nt, Artificial Sequence
  Description of Artificial Sequence: Synthetic oligonucleotide
gguuggcacccuacgugu

SEQ ID NO: 20954 - RNA, 18 nt, Artificial Sequence
  Description of Artificial Sequence: Synthetic oligonucleotide
ggcaggguuggcacccua

SEQ ID NO: 20955 - RNA, 18 nt, Artificial Sequence
  Description of Artificial Sequence: Synthetic oligonucleotide
guuugggcaggguuggca

SEQ ID NO: 20956 - RNA, 18 nt, Artificial Sequence
  Description of Artificial Sequence: Synthetic oligonucleotide
ccaggguuugggcagggu

SEQ ID NO: 20957 - RNA, 18 nt, Artificial Sequence
  Description of Artificial Sequence: Synthetic oligonucleotide
aaaguccaggguuugggc

SEQ ID NO: 20958 - RNA, 18 nt, Artificial Sequence
  Description of Artificial Sequence: Synthetic oligonucleotide
cccagaaaguccaggguu

SEQ ID NO: 20959 - RNA, 18 nt, Artificial Sequence
  Description of Artificial Sequence: Synthetic oligonucleotide
cauuucccagaaagucca

SEQ ID NO: 20960 - RNA, 18 nt, Artificial Sequence
  Description of Artificial Sequence: Synthetic oligonucleotide
ucccucauuucccagaaa

SEQ ID NO: 20961 - RNA, 18 nt, Artificial Sequence
  Description of Artificial Sequence: Synthetic oligonucleotide
cgcccucccucauuuccc

SEQ ID NO: 20962 - RNA, 18 nt, Artificial Sequence
  Description of Artificial Sequence: Synthetic oligonucleotide
guugacgcccucccucau

SEQ ID NO: 20963 - RNA, 18 nt, Artificial Sequence
  Description of Artificial Sequence: Synthetic oligonucleotide
ucaugguugacgcccucc

SEQ ID NO: 20964 - RNA, 18 nt, Artificial Sequence
  Description of Artificial Sequence: Synthetic oligonucleotide
acaucucaugguugacgc

SEQ ID NO: 20965 - RNA, 18 nt, Artificial Sequence
  Description of Artificial Sequence: Synthetic oligonucleotide
ucaggacaucucaugguu

SEQ ID NO: 20966 - RNA, 18 nt, Artificial Sequence
  Description of Artificial Sequence: Synthetic oligonucleotide
gcucuucaggacaucuca

SEQ ID NO: 20967 - RNA, 18 nt, Artificial Sequence
  Description of Artificial Sequence: Synthetic oligonucleotide
agagggcucuucaggaca

SEQ ID NO: 20968 - RNA, 18 nt, Artificial Sequence
  Description of Artificial Sequence: Synthetic oligonucleotide
ggaggagagggcucuuca

SEQ ID NO: 20969 - RNA, 18 nt, Artificial Sequence
  Description of Artificial Sequence: Synthetic oligonucleotide
ucguaggaggagagggcu

SEQ ID NO: 20970 - RNA, 18 nt, Artificial Sequence
  Description of Artificial Sequence: Synthetic oligonucleotide
gagacucguaggaggaga

SEQ ID NO: 20971 - RNA, 18 nt, Artificial Sequence
  Description of Artificial Sequence: Synthetic oligonucleotide
caggagagacucguagga

SEQ ID NO: 20972 - RNA, 18 nt, Artificial Sequence
  Description of Artificial Sequence: Synthetic oligonucleotide
agagacaggagagacucg

SEQ ID NO: 20973 - RNA, 18 nt, Artificial Sequence
  Description of Artificial Sequence: Synthetic oligonucleotide
cagugagagacaggagag

SEQ ID NO: 20974 - RNA, 18 nt, Artificial Sequence
  Description of Artificial Sequence: Synthetic oligonucleotide
cuucacagugagagacag

SEQ ID NO: 20975 - RNA, 18 nt, Artificial Sequence
  Description of Artificial Sequence: Synthetic oligonucleotide
ggagacuucacagugaga

SEQ ID NO: 20976 - RNA, 18 nt, Artificial Sequence
  Description of Artificial Sequence: Synthetic oligonucleotide
caucuggagacuucacag

SEQ ID NO: 20977 - RNA, 18 nt, Artificial Sequence
  Description of Artificial Sequence: Synthetic oligonucleotide
cucaccaucuggagacuu

SEQ ID NO: 20978 - RNA, 18 nt, Artificial Sequence
  Description of Artificial Sequence: Synthetic oligonucleotide
gcauccucaccaucugga

SEQ ID NO: 20979 - RNA, 18 nt, Artificial Sequence
  Description of Artificial Sequence: Synthetic oligonucleotide
cuaaugcauccucaccau

SEQ ID NO: 20980 - RNA, 18 nt, Artificial Sequence
  Description of Artificial Sequence: Synthetic oligonucleotide
ccuggcuaaugcauccuc

SEQ ID NO: 20981 - RNA, 18 nt, Artificial Sequence
  Description of Artificial Sequence: Synthetic oligonucleotide
uggagccuggcuaaugca

SEQ ID NO: 20982 - RNA, 18 nt, Artificial Sequence
  Description of Artificial Sequence: Synthetic oligonucleotide
cucccuggagccuggcua

SEQ ID NO: 20983 - RNA, 18 nt, Artificial Sequence
  Description of Artificial Sequence: Synthetic oligonucleotide
guuuucucccuggagccu

SEQ ID NO: 20984 - RNA, 18 nt, Artificial Sequence
  Description of Artificial Sequence: Synthetic oligonucleotide
uguugguuuucucccugg

SEQ ID NO: 20985 - RNA, 18 nt, Artificial Sequence
  Description of Artificial Sequence: Synthetic oligonucleotide
gaugcuguugguuuucuc

SEQ ID NO: 20986 - RNA, 18 nt, Artificial Sequence
  Description of Artificial Sequence: Synthetic oligonucleotide
gcugggaugcuguugguu

SEQ ID NO: 20987 - RNA, 18 nt, Artificial Sequence
  Description of Artificial Sequence: Synthetic oligonucleotide
cugaggcugggaugcugu

SEQ ID NO: 20988 - RNA, 18 nt, Artificial Sequence
  Description of Artificial Sequence: Synthetic oligonucleotide
gagaacugaggcugggau

SEQ ID NO: 20989 - RNA, 18 nt, Artificial Sequence
  Description of Artificial Sequence: Synthetic oligonucleotide
cucaagagaacugaggcu

SEQ ID NO: 20990 - RNA, 18 nt, Artificial Sequence
  Description of Artificial Sequence: Synthetic oligonucleotide
acacucucaagagaacug

SEQ ID NO: 20991 - RNA, 18 nt, Artificial Sequence
  Description of Artificial Sequence: Synthetic oligonucleotide
uccccacacucucaagag

SEQ ID NO: 20992 - RNA, 18 nt, Artificial Sequence
  Description of Artificial Sequence: Synthetic oligonucleotide
ccuccuccccacacucuc

SEQ ID NO: 20993 - RNA, 18 nt, Artificial Sequence
  Description of Artificial Sequence: Synthetic oligonucleotide
ccagcccuccuccccaca

SEQ ID NO: 20994 - RNA, 18 nt, Artificial Sequence
  Description of Artificial Sequence: Synthetic oligonucleotide
guaggccagcccuccucc

SEQ ID NO: 20995 - RNA, 18 nt, Artificial Sequence
  Description of Artificial Sequence: Synthetic oligonucleotide
caaggguaggccagcccu

SEQ ID NO: 20996 - RNA, 18 nt, Artificial Sequence
  Description of Artificial Sequence: Synthetic oligonucleotide
ucugccaaggguaggcca

SEQ ID NO: 20997 - RNA, 18 nt, Artificial Sequence
  Description of Artificial Sequence: Synthetic oligonucleotide
uccugucugccaagggua

SEQ ID NO: 20998 - RNA, 18 nt, Artificial Sequence
  Description of Artificial Sequence: Synthetic oligonucleotide
gccaauccugucugccaa

SEQ ID NO: 20999 - RNA, 18 nt, Artificial Sequence
  Description of Artificial Sequence: Synthetic oligonucleotide
uugcugccaauccugucu

SEQ ID NO: 21000 - RNA, 18 nt, Artificial Sequence
  Description of Artificial Sequence: Synthetic oligonucleotide
ugauguugcugccaaucc

SEQ ID NO: 21001 - RNA, 18 nt, Artificial Sequence
  Description of Artificial Sequence: Synthetic oligonucleotide
uacucugauguugcugcc

SEQ ID NO: 21002 - RNA, 18 nt, Artificial Sequence
  Description of Artificial Sequence: Synthetic oligonucleotide
ucugcuacucugauguug

SEQ ID NO: 21003 - RNA, 18 nt, Artificial Sequence
  Description of Artificial Sequence: Synthetic oligonucleotide
ugaguucugcuacucuga

SEQ ID NO: 21004 - RNA, 18 nt, Artificial Sequence
  Description of Artificial Sequence: Synthetic oligonucleotide
ggagcugaguucugcuac

SEQ ID NO: 21005 - RNA, 18 nt, Artificial Sequence
  Description of Artificial Sequence: Synthetic oligonucleotide
cagugggagcugaguucu

SEQ ID NO: 21006 - RNA, 18 nt, Artificial Sequence
  Description of Artificial Sequence: Synthetic oligonucleotide
ggucccagugggagcuga

SEQ ID NO: 21007 - RNA, 18 nt, Artificial Sequence
  Description of Artificial Sequence: Synthetic oligonucleotide
ucacgggucccaguggga

SEQ ID NO: 21008 - RNA, 18 nt, Artificial Sequence
  Description of Artificial Sequence: Synthetic oligonucleotide
cagguucacgggucccag

SEQ ID NO: 21009 - RNA, 18 nt, Artificial Sequence
  Description of Artificial Sequence: Synthetic oligonucleotide
acucccagguucacgggu

SEQ ID NO: 21010 - RNA, 18 nt, Artificial Sequence
  Description of Artificial Sequence: Synthetic oligonucleotide
cucucacucccagguuca

SEQ ID NO: 21011 - RNA, 18 nt, Artificial Sequence
  Description of Artificial Sequence: Synthetic oligonucleotide
auguccucucacucccag

SEQ ID NO: 21012 - RNA, 18 nt, Artificial Sequence
  Description of Artificial Sequence: Synthetic oligonucleotide
ccuguauguccucucacu

SEQ ID NO: 21013 - RNA, 18 nt, Artificial Sequence
  Description of Artificial Sequence: Synthetic oligonucleotide
ccuggccuguauguccuc

SEQ ID NO: 21014 - RNA, 18 nt, Artificial Sequence
  Description of Artificial Sequence: Synthetic oligonucleotide
ccuccccuggccuguaug

SEQ ID NO: 21015 - RNA, 18 nt, Artificial Sequence
  Description of Artificial Sequence: Synthetic oligonucleotide
ugcguccuccccuggccu

SEQ ID NO: 21016 - RNA, 18 nt, Artificial Sequence
  Description of Artificial Sequence: Synthetic oligonucleotide
ggcucugcguccuccccu

SEQ ID NO: 21017 - RNA, 18 nt, Artificial Sequence
  Description of Artificial Sequence: Synthetic oligonucleotide
ccugaggcucugcguccu

SEQ ID NO: 21018 - RNA, 18 nt, Artificial Sequence
  Description of Artificial Sequence: Synthetic oligonucleotide
ugccucagccucccaagu

SEQ ID NO: 21019 - RNA, 18 nt, Artificial Sequence
  Description of Artificial Sequence: Synthetic oligonucleotide
ccuucugccucagccucc

SEQ ID NO: 21020 - RNA, 18 nt, Artificial Sequence
  Description of Artificial Sequence: Synthetic oligonucleotide
gcaauccuucugccucag

SEQ ID NO: 21021 - RNA, 18 nt, Artificial Sequence
  Description of Artificial Sequence: Synthetic oligonucleotide
cucaagcaauccuucugc

SEQ ID NO: 21022 - RNA, 18 nt, Artificial Sequence
  Description of Artificial Sequence: Synthetic oligonucleotide
cugggcucaagcaauccu

SEQ ID NO: 21023 - RNA, 18 nt, Artificial Sequence
  Description of Artificial Sequence: Synthetic oligonucleotide
accuccugggcucaagca

SEQ ID NO: 21024 - RNA, 18 nt, Artificial Sequence
  Description of Artificial Sequence: Synthetic oligonucleotide
ccuccaccuccugggcuc

SEQ ID NO: 21025 - RNA, 18 nt, Artificial Sequence
  Description of Artificial Sequence: Synthetic oligonucleotide
ugcagccuccaccuccug

SEQ ID NO: 21026 - RNA, 18 nt, Artificial Sequence
  Description of Artificial Sequence: Synthetic oligonucleotide
cucacugcagccuccacc

SEQ ID NO: 21027 - RNA, 18 nt, Artificial Sequence
  Description of Artificial Sequence: Synthetic oligonucleotide
cauagcucacugcagccu

SEQ ID NO: 21028 - RNA, 18 nt, Artificial Sequence
  Description of Artificial Sequence: Synthetic oligonucleotide
gugaucauagcucacugc

SEQ ID NO: 21029 - RNA, 18 nt, Artificial Sequence
  Description of Artificial Sequence: Synthetic oligonucleotide
guggugugaucauagcuc

SEQ ID NO: 21030 - RNA, 18 nt, Artificial Sequence
  Description of Artificial Sequence: Synthetic oligonucleotide
gugcaguggugugaucau

SEQ ID NO: 21031 - RNA, 18 nt, Artificial Sequence
  Description of Artificial Sequence: Synthetic oligonucleotide
uuggagugcaguggugug

SEQ ID NO: 21032 - RNA, 18 nt, Artificial Sequence
  Description of Artificial Sequence: Synthetic oligonucleotide
cuggguuggagugcagug

SEQ ID NO: 21033 - RNA, 18 nt, Artificial Sequence
  Description of Artificial Sequence: Synthetic oligonucleotide
gucgccuggguuggagug

SEQ ID NO: 21034 - RNA, 18 nt, Artificial Sequence
  Description of Artificial Sequence: Synthetic oligonucleotide
ucucugucgccuggguug

SEQ ID NO: 21035 - RNA, 18 nt, Artificial Sequence
  Description of Artificial Sequence: Synthetic oligonucleotide
gucucucucugucgccug

SEQ ID NO: 21036 - RNA, 18 nt, Artificial Sequence
  Description of Artificial Sequence: Synthetic oligonucleotide
acagggucucucucuguc

SEQ ID NO: 21037 - RNA, 18 nt, Artificial Sequence
  Description of Artificial Sequence: Synthetic oligonucleotide
aagagacagggucucucu

SEQ ID NO: 21038 - RNA, 18 nt, Artificial Sequence
  Description of Artificial Sequence: Synthetic oligonucleotide
uuuuaaagagacaggguc

SEQ ID NO: 21039 - RNA, 18 nt, Artificial Sequence
  Description of Artificial Sequence: Synthetic oligonucleotide
uuuuuuuuuaaagagaca

SEQ ID NO: 21040 - RNA, 18 nt, Artificial Sequence
  Description of Artificial Sequence: Synthetic oligonucleotide
uuuuuuuuuuuuuuaaag

SEQ ID NO: 21041 - RNA, 18 nt, Artificial Sequence
  Description of Artificial Sequence: Synthetic oligonucleotide
uuuuuuuuuuuuuuuuuu

SEQ ID NO: 21042 - RNA, 18 nt, Artificial Sequence
  Description of Artificial Sequence: Synthetic oligonucleotide
uuuuuuuuuuuuuuuuuu

SEQ ID NO: 21043 - RNA, 18 nt, Artificial Sequence
  Description of Artificial Sequence: Synthetic oligonucleotide
ugccuuuuuuuuuuuuuu

SEQ ID NO: 21044 - RNA, 18 nt, Artificial Sequence
  Description of Artificial Sequence: Synthetic oligonucleotide
uucauugccuuuuuuuuu

SEQ ID NO: 21045 - RNA, 18 nt, Artificial Sequence
  Description of Artificial Sequence: Synthetic oligonucleotide
uuuuguucauugccuuuu

SEQ ID NO: 21046 - RNA, 18 nt, Artificial Sequence
  Description of Artificial Sequence: Synthetic oligonucleotide
caugcuuuuguucauugc

SEQ ID NO: 21047 - RNA, 18 nt, Artificial Sequence
  Description of Artificial Sequence: Synthetic oligonucleotide
agagccaugcuuuuguuc

SEQ ID NO: 21048 - RNA, 18 nt, Artificial Sequence
  Description of Artificial Sequence: Synthetic oligonucleotide
gacguagagccaugcuuu

SEQ ID NO: 21049 - RNA, 18 nt, Artificial Sequence
  Description of Artificial Sequence: Synthetic oligonucleotide
uggaagacguagagccau

SEQ ID NO: 21050 - RNA, 18 nt, Artificial Sequence
  Description of Artificial Sequence: Synthetic oligonucleotide
cacuuuggaagacguaga

SEQ ID NO: 21051 - RNA, 18 nt, Artificial Sequence
  Description of Artificial Sequence: Synthetic oligonucleotide
auucucacuuuggaagac

SEQ ID NO: 21052 - RNA, 18 nt, Artificial Sequence
  Description of Artificial Sequence: Synthetic oligonucleotide
ggagaauucucacuuugg

SEQ ID NO: 21053 - RNA, 18 nt, Artificial Sequence
  Description of Artificial Sequence: Synthetic oligonucleotide
gggagggagaauucucac

SEQ ID NO: 21054 - RNA, 18 nt, Artificial Sequence
  Description of Artificial Sequence: Synthetic oligonucleotide
cuggagggaugcggaggg

SEQ ID NO: 21055 - RNA, 18 nt, Artificial Sequence
  Description of Artificial Sequence: Synthetic oligonucleotide
ucuggagggaugcggagg

SEQ ID NO: 21056 - RNA, 18 nt, Artificial Sequence
  Description of Artificial Sequence: Synthetic oligonucleotide
acaguucuggagggaugc

SEQ ID NO: 21057 - RNA, 18 nt, Artificial Sequence
  Description of Artificial Sequence: Synthetic oligonucleotide
gagcuacaguucuggagg

SEQ ID NO: 21058 - RNA, 18 nt, Artificial Sequence
  Description of Artificial Sequence: Synthetic oligonucleotide
gcucugagcuacaguucu

SEQ ID NO: 21059 - RNA, 18 nt, Artificial Sequence
  Description of Artificial Sequence: Synthetic oligonucleotide
cgugggcucugagcuaca

SEQ ID NO: 21060 - RNA, 18 nt, Artificial Sequence
  Description of Artificial Sequence: Synthetic oligonucleotide
uucagcgugggcucugag

SEQ ID NO: 21061 - RNA, 18 nt, Artificial Sequence
  Description of Artificial Sequence: Synthetic oligonucleotide
ucagauucagcgugggcu

SEQ ID NO: 21062 - RNA, 18 nt, Artificial Sequence
  Description of Artificial Sequence: Synthetic oligonucleotide
aaaagucagauucagcgu

SEQ ID NO: 21063 - RNA, 18 nt, Artificial Sequence
  Description of Artificial Sequence: Synthetic oligonucleotide
aagagaaaagucagauuc

SEQ ID NO: 21064 - RNA, 18 nt, Artificial Sequence
  Description of Artificial Sequence: Synthetic oligonucleotide
gagaaaagagaaaaguca

SEQ ID NO: 21065 - RNA, 18 nt, Artificial Sequence
  Description of Artificial Sequence: Synthetic oligonucleotide
agagagagaaaagagaaa

SEQ ID NO: 21066 - RNA, 18 nt, Artificial Sequence
  Description of Artificial Sequence: Synthetic oligonucleotide
gggagagagagagaaaag

SEQ ID NO: 21067 - RNA, 18 nt, Artificial Sequence
  Description of Artificial Sequence: Synthetic oligonucleotide
gagcagggagagagagag

SEQ ID NO: 21068 - RNA, 18 nt, Artificial Sequence
  Description of Artificial Sequence: Synthetic oligonucleotide
cucgggagcagggagaga

SEQ ID NO: 21069 - RNA, 18 nt, Artificial Sequence
  Description of Artificial Sequence: Synthetic oligonucleotide
cacugcucgggagcaggg

SEQ ID NO: 21070 - RNA, 18 nt, Artificial Sequence
  Description of Artificial Sequence: Synthetic oligonucleotide
uacuucacugcucgggag

SEQ ID NO: 21071 - RNA, 18 nt, Artificial Sequence
  Description of Artificial Sequence: Synthetic oligonucleotide
aagauuacuucacugcuc

SEQ ID NO: 21072 - RNA, 18 nt, Artificial Sequence
  Description of Artificial Sequence: Synthetic oligonucleotide
aaaaaaagauuacuucac

SEQ ID NO: 21073 - RNA, 18 nt, Artificial Sequence
  Description of Artificial Sequence: Synthetic oligonucleotide
ucaguaaaaaaagauuac

SEQ ID NO: 21074 - RNA, 18 nt, Artificial Sequence
  Description of Artificial Sequence: Synthetic oligonucleotide
aaaggucaguaaaaaaag

SEQ ID NO: 21075 - RNA, 18 nt, Artificial Sequence
  Description of Artificial Sequence: Synthetic oligonucleotide
gaagaaaaggucaguaaa

SEQ ID NO: 21076 - RNA, 18 nt, Artificial Sequence
  Description of Artificial Sequence: Synthetic oligonucleotide
aaauggaagaaaagguca

SEQ ID NO: 21077 - RNA, 18 nt, Artificial Sequence
  Description of Artificial Sequence: Synthetic oligonucleotide
aaaaaaaauggaagaaaa

SEQ ID NO: 21078 - RNA, 18 nt, Artificial Sequence
  Description of Artificial Sequence: Synthetic oligonucleotide
ggaggaaaaaaaauggaa

SEQ ID NO: 21079 - RNA, 18 nt, Artificial Sequence
  Description of Artificial Sequence: Synthetic oligonucleotide
aaagaggaggaaaaaaaa

SEQ ID NO: 21080 - RNA, 18 nt, Artificial Sequence
  Description of Artificial Sequence: Synthetic oligonucleotide
auggaaaagaggaggaaa

SEQ ID NO: 21081 - RNA, 18 nt, Artificial Sequence
  Description of Artificial Sequence: Synthetic oligonucleotide
aaucaauggaaaagagga

SEQ ID NO: 21082 - RNA, 18 nt, Artificial Sequence
  Description of Artificial Sequence: Synthetic oligonucleotide
uuucaaaucaauggaaaa

SEQ ID NO: 21083 - RNA, 18 nt, Artificial Sequence
  Description of Artificial Sequence: Synthetic oligonucleotide
agauauuucaaaucaaug

SEQ ID NO: 21084 - RNA, 18 nt, Artificial Sequence
  Description of Artificial Sequence: Synthetic oligonucleotide
aaaauagauauuucaaau

SEQ ID NO: 21085 - RNA, 18 nt, Artificial Sequence
  Description of Artificial Sequence: Synthetic oligonucleotide
augauaaaauagauauuu

SEQ ID NO: 21086 - RNA, 18 nt, Artificial Sequence
  Description of Artificial Sequence: Synthetic oligonucleotide
agagaaugauaaaauaga

SEQ ID NO: 21087 - RNA, 18 nt, Artificial Sequence
  Description of Artificial Sequence: Synthetic oligonucleotide
gaugcagagaaugauaaa

SEQ ID NO: 21088 - RNA, 18 nt, Artificial Sequence
  Description of Artificial Sequence: Synthetic oligonucleotide
agaaagaugcagagaaug

SEQ ID NO: 21089 - RNA, 18 nt, Artificial Sequence
  Description of Artificial Sequence: Synthetic oligonucleotide
gagagagaaagaugcaga

SEQ ID NO: 21090 - RNA, 18 nt, Artificial Sequence
  Description of Artificial Sequence: Synthetic oligonucleotide
aaauagagagagaaagau

SEQ ID NO: 21091 - RNA, 18 nt, Artificial Sequence
  Description of Artificial Sequence: Synthetic oligonucleotide
cgaaaaaauagagagaga

SEQ ID NO: 21092 - RNA, 18 nt, Artificial Sequence
  Description of Artificial Sequence: Synthetic oligonucleotide
cgagccgaaaaaauagag

SEQ ID NO: 21093 - RNA, 18 nt, Artificial Sequence
  Description of Artificial Sequence: Synthetic oligonucleotide
ccacacgagccgaaaaaa

SEQ ID NO: 21094 - RNA, 18 nt, Artificial Sequence
  Description of Artificial Sequence: Synthetic oligonucleotide
gaaauccacacgagccga

SEQ ID NO: 21095 - RNA, 18 nt, Artificial Sequence
  Description of Artificial Sequence: Synthetic oligonucleotide
aaaaagaaauccacacga

SEQ ID NO: 21096 - RNA, 18 nt, Artificial Sequence
  Description of Artificial Sequence: Synthetic oligonucleotide
aaagaaaaaagaaaucca

SEQ ID NO: 21097 - RNA, 18 nt, Artificial Sequence
  Description of Artificial Sequence: Synthetic oligonucleotide
agaagaaagaaaaaagaa

SEQ ID NO: 21098 - RNA, 18 nt, Artificial Sequence
  Description of Artificial Sequence: Synthetic oligonucleotide
gaaacagaagaaagaaaa

SEQ ID NO: 21099 - RNA, 18 nt, Artificial Sequence
  Description of Artificial Sequence: Synthetic oligonucleotide
caaaggaagagagguggg

SEQ ID NO: 21100 - RNA, 18 nt, Artificial Sequence
  Description of Artificial Sequence: Synthetic oligonucleotide
agaaccaaaggaagagag

SEQ ID NO: 21101 - RNA, 18 nt, Artificial Sequence
  Description of Artificial Sequence: Synthetic oligonucleotide
aacagagaaccaaaggaa

SEQ ID NO: 21102 - RNA, 18 nt, Artificial Sequence
  Description of Artificial Sequence: Synthetic oligonucleotide
augggaacagagaaccaa

SEQ ID NO: 21103 - RNA, 18 nt, Artificial Sequence
  Description of Artificial Sequence: Synthetic oligonucleotide
cgggaaugggaacagaga

SEQ ID NO: 21104 - RNA, 18 nt, Artificial Sequence
  Description of Artificial Sequence: Synthetic oligonucleotide
caaaacgggaaugggaac

SEQ ID NO: 21105 - RNA, 18 nt, Artificial Sequence
  Description of Artificial Sequence: Synthetic oligonucleotide
aaaaacaaaacgggaaug

SEQ ID NO: 21106 - RNA, 18 nt, Artificial Sequence
  Description of Artificial Sequence: Synthetic oligonucleotide
aacaaaaaaacaaaacgg

SEQ ID NO: 21107 - RNA, 18 nt, Artificial Sequence
  Description of Artificial Sequence: Synthetic oligonucleotide
acaaaaacaaaaaaacaa

SEQ ID NO: 21108 - RNA, 18 nt, Artificial Sequence
  Description of Artificial Sequence: Synthetic oligonucleotide
caaaaacaaaaacaaaaa

SEQ ID NO: 21109 - RNA, 18 nt, Artificial Sequence
  Description of Artificial Sequence: Synthetic oligonucleotide
aaaaacaaaaacaaaaac

SEQ ID NO: 21110 - RNA, 18 nt, Artificial Sequence
  Description of Artificial Sequence: Synthetic oligonucleotide
augaaaaaaacaaaaaca

SEQ ID NO: 21111 - RNA, 18 nt, Artificial Sequence
  Description of Artificial Sequence: Synthetic oligonucleotide
cagguaaggcaugcggcc

SEQ ID NO: 21112 - RNA, 18 nt, Artificial Sequence
  Description of Artificial Sequence: Synthetic oligonucleotide
auguccagguaaggcaug

SEQ ID NO: 21113 - RNA, 18 nt, Artificial Sequence
  Description of Artificial Sequence: Synthetic oligonucleotide
gauacauguccagguaag

SEQ ID NO: 21114 - RNA, 18 nt, Artificial Sequence
  Description of Artificial Sequence: Synthetic oligonucleotide
caucugauacauguccag

SEQ ID NO: 21115 - RNA, 18 nt, Artificial Sequence
  Description of Artificial Sequence: Synthetic oligonucleotide
cucagcaucugauacaug

SEQ ID NO: 21116 - RNA, 18 nt, Artificial Sequence
  Description of Artificial Sequence: Synthetic oligonucleotide
ugugucucagcaucugau

SEQ ID NO: 21117 - RNA, 18 nt, Artificial Sequence
  Description of Artificial Sequence: Synthetic oligonucleotide
agacaugugucucagcau

SEQ ID NO: 21118 - RNA, 18 nt, Artificial Sequence
  Description of Artificial Sequence: Synthetic oligonucleotide
ggcggagacaugugucuc

SEQ ID NO: 21119 - RNA, 18 nt, Artificial Sequence
  Description of Artificial Sequence: Synthetic oligonucleotide
gggcggagacaugugucu

SEQ ID NO: 21120 - RNA, 18 nt, Artificial Sequence
  Description of Artificial Sequence: Synthetic oligonucleotide
ucuuccccagacccaggg

SEQ ID NO: 21121 - RNA, 18 nt, Artificial Sequence
  Description of Artificial Sequence: Synthetic oligonucleotide
acacuucuuccccagacc

SEQ ID NO: 21122 - RNA, 18 nt, Artificial Sequence
  Description of Artificial Sequence: Synthetic oligonucleotide
gccggacacuucuucccc

SEQ ID NO: 21123 - RNA, 18 nt, Artificial Sequence
  Description of Artificial Sequence: Synthetic oligonucleotide
cucuggccggacacuucu

SEQ ID NO: 21124 - RNA, 18 nt, Artificial Sequence
  Description of Artificial Sequence: Synthetic oligonucleotide
agccacucuggccggaca

SEQ ID NO: 21125 - RNA, 18 nt, Artificial Sequence
  Description of Artificial Sequence: Synthetic oligonucleotide
uuguaagccacucuggcc

SEQ ID NO: 21126 - RNA, 18 nt, Artificial Sequence
  Description of Artificial Sequence: Synthetic oligonucleotide
ccagguaaggcaugcggc

SEQ ID NO: 21127 - RNA, 18 nt, Artificial Sequence
  Description of Artificial Sequence: Synthetic oligonucleotide
cauguccagguaaggcau

SEQ ID NO: 21128 - RNA, 18 nt, Artificial Sequence
  Description of Artificial Sequence: Synthetic oligonucleotide
ugauacauguccagguaa

SEQ ID NO: 21129 - RNA, 18 nt, Artificial Sequence
  Description of Artificial Sequence: Synthetic oligonucleotide
gcaucugauacaugucca

SEQ ID NO: 21130 - RNA, 18 nt, Artificial Sequence
  Description of Artificial Sequence: Synthetic oligonucleotide
ucucagcaucugauacau

SEQ ID NO: 21131 - RNA, 18 nt, Artificial Sequence
  Description of Artificial Sequence: Synthetic oligonucleotide
augugucucagcaucuga

SEQ ID NO: 21132 - RNA, 18 nt, Artificial Sequence
  Description of Artificial Sequence: Synthetic oligonucleotide
gagacaugugucucagca

SEQ ID NO: 21133 - RNA, 18 nt, Artificial Sequence
  Description of Artificial Sequence: Synthetic oligonucleotide
gggcggagacaugugucu

SEQ ID NO: 21134 - RNA, 18 nt, Artificial Sequence
  Description of Artificial Sequence: Synthetic oligonucleotide
ucuuccccagacccaggg

SEQ ID NO: 21135 - RNA, 18 nt, Artificial Sequence
  Description of Artificial Sequence: Synthetic oligonucleotide
acuucuuccccagaccca

SEQ ID NO: 21136 - RNA, 18 nt, Artificial Sequence
  Description of Artificial Sequence: Synthetic oligonucleotide
cggacacuucuuccccag

SEQ ID NO: 21137 - RNA, 18 nt, Artificial Sequence
  Description of Artificial Sequence: Synthetic oligonucleotide
cuggccggacacuucuuc

SEQ ID NO: 21138 - RNA, 18 nt, Artificial Sequence
  Description of Artificial Sequence: Synthetic oligonucleotide
ccacucuggccggacacu

SEQ ID NO: 21139 - RNA, 18 nt, Artificial Sequence
  Description of Artificial Sequence: Synthetic oligonucleotide
guaagccacucuggccgg

SEQ ID NO: 21140 - RNA, 18 nt, Artificial Sequence
  Description of Artificial Sequence: Synthetic oligonucleotide
gguggucggcaaggguag

SEQ ID NO: 21141 - RNA, 18 nt, Artificial Sequence
  Description of Artificial Sequence: Synthetic oligonucleotide
acgucgguggucggcaag

SEQ ID NO: 21142 - RNA, 18 nt, Artificial Sequence
  Description of Artificial Sequence: Synthetic oligonucleotide
ccuggacgucgguggucg

SEQ ID NO: 21143 - RNA, 18 nt, Artificial Sequence
  Description of Artificial Sequence: Synthetic oligonucleotide
cagugccuggacgucggu

SEQ ID NO: 21144 - RNA, 18 nt, Artificial Sequence
  Description of Artificial Sequence: Synthetic oligonucleotide
aaacccagugccuggacg

SEQ ID NO: 21145 - RNA, 18 nt, Artificial Sequence
  Description of Artificial Sequence: Synthetic oligonucleotide
aaaaaaaacccagugccu

SEQ ID NO: 21146 - RNA, 18 nt, Artificial Sequence
  Description of Artificial Sequence: Synthetic oligonucleotide
gaagaaaaaaaaacccag

SEQ ID NO: 21147 - RNA, 18 nt, Artificial Sequence
  Description of Artificial Sequence: Synthetic oligonucleotide
aagaagaagaaaaaaaaa

SEQ ID NO: 21148 - RNA, 18 nt, Artificial Sequence
  Description of Artificial Sequence: Synthetic oligonucleotide
agaagaagaagaagaaaa

SEQ ID NO: 21149 - RNA, 18 nt, Artificial Sequence
  Description of Artificial Sequence: Synthetic oligonucleotide
aaaaaagaagaagaagaa

SEQ ID NO: 21150 - RNA, 18 nt, Artificial Sequence
  Description of Artificial Sequence: Synthetic oligonucleotide
cuaaaaaaaaagaagaag

SEQ ID NO: 21151 - RNA, 18 nt, Artificial Sequence
  Description of Artificial Sequence: Synthetic oligonucleotide
cagcacuaaaaaaaaaga

SEQ ID NO: 21152 - RNA, 18 nt, Artificial Sequence
  Description of Artificial Sequence: Synthetic oligonucleotide
cuggucagcacuaaaaaa

SEQ ID NO: 21153 - RNA, 18 nt, Artificial Sequence
  Description of Artificial Sequence: Synthetic oligonucleotide
uguuucuggucagcacua

SEQ ID NO: 21154 - RNA, 18 nt, Artificial Sequence
  Description of Artificial Sequence: Synthetic oligonucleotide
ccggguguuucuggucag

SEQ ID NO: 21155 - RNA, 18 nt, Artificial Sequence
  Description of Artificial Sequence: Synthetic oligonucleotide
gucggccggguguuucug

SEQ ID NO: 21156 - RNA, 18 nt, Artificial Sequence
  Description of Artificial Sequence: Synthetic oligonucleotide
agagagucggccgggugu

SEQ ID NO: 21157 - RNA, 18 nt, Artificial Sequence
  Description of Artificial Sequence: Synthetic oligonucleotide
gaaaaagagagucggccg

SEQ ID NO: 21158 - RNA, 18 nt, Artificial Sequence
  Description of Artificial Sequence: Synthetic oligonucleotide
cguuggaaaaagagaguc

SEQ ID NO: 21159 - RNA, 18 nt, Artificial Sequence
  Description of Artificial Sequence: Synthetic oligonucleotide
agaaacguuggaaaaaga

SEQ ID NO: 21160 - RNA, 18 nt, Artificial Sequence
  Description of Artificial Sequence: Synthetic oligonucleotide
agaagagaaacguuggaa

SEQ ID NO: 21161 - RNA, 18 nt, Artificial Sequence
  Description of Artificial Sequence: Synthetic oligonucleotide
aaaaaagaagagaaacgu

SEQ ID NO: 21162 - RNA, 18 nt, Artificial Sequence
  Description of Artificial Sequence: Synthetic oligonucleotide
aaaacaaaaaagaagaga

SEQ ID NO: 21163 - RNA, 18 nt, Artificial Sequence
  Description of Artificial Sequence: Synthetic oligonucleotide
aaucaaaaacaaaaaaga

SEQ ID NO: 21164 - RNA, 18 nt, Artificial Sequence
  Description of Artificial Sequence: Synthetic oligonucleotide
aaaagaaucaaaaacaaa

SEQ ID NO: 21165 - RNA, 18 nt, Artificial Sequence
  Description of Artificial Sequence: Synthetic oligonucleotide
gaaaaaaaagaaucaaaa

SEQ ID NO: 21166 - RNA, 18 nt, Artificial Sequence
  Description of Artificial Sequence: Synthetic oligonucleotide
gaaaagaaaaaaaagaau

SEQ ID NO: 21167 - RNA, 18 nt, Artificial Sequence
  Description of Artificial Sequence: Synthetic oligonucleotide
cucgagaaaagaaaaaaa

SEQ ID NO: 21168 - RNA, 18 nt, Artificial Sequence
  Description of Artificial Sequence: Synthetic oligonucleotide
guugacucgagaaaagaa

SEQ ID NO: 21169 - RNA, 18 nt, Artificial Sequence
  Description of Artificial Sequence: Synthetic oligonucleotide
gaucaguugacucgagaa

SEQ ID NO: 21170 - RNA, 18 nt, Artificial Sequence
  Description of Artificial Sequence: Synthetic oligonucleotide
gucaugaucaguugacuc

SEQ ID NO: 21171 - RNA, 18 nt, Artificial Sequence
  Description of Artificial Sequence: Synthetic oligonucleotide
ggauggucaugaucaguu

SEQ ID NO: 21172 - RNA, 18 nt, Artificial Sequence
  Description of Artificial Sequence: Synthetic oligonucleotide
ucaagggauggucaugau

SEQ ID NO: 21173 - RNA, 18 nt, Artificial Sequence
  Description of Artificial Sequence: Synthetic oligonucleotide
uagaaucaagggaugguc

SEQ ID NO: 21174 - RNA, 18 nt, Artificial Sequence
  Description of Artificial Sequence: Synthetic oligonucleotide
cugcuuagaaucaaggga

SEQ ID NO: 21175 - RNA, 18 nt, Artificial Sequence
  Description of Artificial Sequence: Synthetic oligonucleotide
gugugcugcuuagaauca

SEQ ID NO: 21176 - RNA, 18 nt, Artificial Sequence
  Description of Artificial Sequence: Synthetic oligonucleotide
acacagugugcugcuuag

SEQ ID NO: 21177 - RNA, 18 nt, Artificial Sequence
  Description of Artificial Sequence: Synthetic oligonucleotide
gacggacacagugugcug

SEQ ID NO: 21178 - RNA, 18 nt, Artificial Sequence
  Description of Artificial Sequence: Synthetic oligonucleotide
gaaaggacggacacagug

SEQ ID NO: 21179 - RNA, 18 nt, Artificial Sequence
  Description of Artificial Sequence: Synthetic oligonucleotide
caucagaaaggacggaca

SEQ ID NO: 21180 - RNA, 18 nt, Artificial Sequence
  Description of Artificial Sequence: Synthetic oligonucleotide
acacucaucagaaaggac

SEQ ID NO: 21181 - RNA, 18 nt, Artificial Sequence
  Description of Artificial Sequence: Synthetic oligonucleotide
cgaagacacucaucagaa

SEQ ID NO: 21182 - RNA, 18 nt, Artificial Sequence
  Description of Artificial Sequence: Synthetic oligonucleotide
aaacacgaagacacucau

SEQ ID NO: 21183 - RNA, 18 nt, Artificial Sequence
  Description of Artificial Sequence: Synthetic oligonucleotide
ucucaaaacacgaagaca

SEQ ID NO: 21184 - RNA, 18 nt, Artificial Sequence
  Description of Artificial Sequence: Synthetic oligonucleotide
uggagucucaaaacacga

SEQ ID NO: 21185 - RNA, 18 nt, Artificial Sequence
  Description of Artificial Sequence: Synthetic oligonucleotide
cauaauggagucucaaaa

SEQ ID NO: 21186 - RNA, 18 nt, Artificial Sequence
  Description of Artificial Sequence: Synthetic oligonucleotide
ucggccauaauggagucu

SEQ ID NO: 21187 - RNA, 18 nt, Artificial Sequence
  Description of Artificial Sequence: Synthetic oligonucleotide
gcaugucggccauaaugg

SEQ ID NO: 21188 - RNA, 18 nt, Artificial Sequence
  Description of Artificial Sequence: Synthetic oligonucleotide
ccccggcaugucggccau

SEQ ID NO: 21189 - RNA, 18 nt, Artificial Sequence
  Description of Artificial Sequence: Synthetic oligonucleotide
ccuccccccggcaugucg

SEQ ID NO: 21190 - RNA, 18 nt, Artificial Sequence
  Description of Artificial Sequence: Synthetic oligonucleotide
cucccccuccccccggca

SEQ ID NO: 21191 - RNA, 18 nt, Artificial Sequence
  Description of Artificial Sequence: Synthetic oligonucleotide
cuccccucccccuccccc

SEQ ID NO: 21192 - RNA, 18 nt, Artificial Sequence
  Description of Artificial Sequence: Synthetic oligonucleotide
gggcgcuccccucccccu

SEQ ID NO: 21193 - RNA, 18 nt, Artificial Sequence
  Description of Artificial Sequence: Synthetic oligonucleotide
gaccugggcgcuccccuc

SEQ ID NO: 21194 - RNA, 18 nt, Artificial Sequence
  Description of Artificial Sequence: Synthetic oligonucleotide
gggaccugggcgcucccc

SEQ ID NO: 21195 - RNA, 18 nt, Artificial Sequence
  Description of Artificial Sequence: Synthetic oligonucleotide
ggagaccaggugcaaggg

SEQ ID NO: 21196 - RNA, 18 nt, Artificial Sequence
  Description of Artificial Sequence: Synthetic oligonucleotide
accugggagaccaggugc

SEQ ID NO: 21197 - RNA, 18 nt, Artificial Sequence
  Description of Artificial Sequence: Synthetic oligonucleotide
uugguaccugggagacca

SEQ ID NO: 21198 - RNA, 18 nt, Artificial Sequence
  Description of Artificial Sequence: Synthetic oligonucleotide
ccaauuugguaccuggga

SEQ ID NO: 21199 - RNA, 18 nt, Artificial Sequence
  Description of Artificial Sequence: Synthetic oligonucleotide
uguuuccaauuugguacc

SEQ ID NO: 21200 - RNA, 18 nt, Artificial Sequence
  Description of Artificial Sequence: Synthetic oligonucleotide
guguuuguuuccaauuug

SEQ ID NO: 21201 - RNA, 18 nt, Artificial Sequence
  Description of Artificial Sequence: Synthetic oligonucleotide
gaagcguguuuguuucca

SEQ ID NO: 21202 - RNA, 18 nt, Artificial Sequence
  Description of Artificial Sequence: Synthetic oligonucleotide
cugaagaagcguguuugu

SEQ ID NO: 21203 - RNA, 18 nt, Artificial Sequence
  Description of Artificial Sequence: Synthetic oligonucleotide
acucccugaagaagcgug

SEQ ID NO: 21204 - RNA, 18 nt, Artificial Sequence
  Description of Artificial Sequence: Synthetic oligonucleotide
uuuugacucccugaagaa

SEQ ID NO: 21205 - RNA, 18 nt, Artificial Sequence
  Description of Artificial Sequence: Synthetic oligonucleotide
auggguuuugacucccug

SEQ ID NO: 21206 - RNA, 18 nt, Artificial Sequence
  Description of Artificial Sequence: Synthetic oligonucleotide
gaagcauggguuuugacu

SEQ ID NO: 21207 - RNA, 18 nt, Artificial Sequence
  Description of Artificial Sequence: Synthetic oligonucleotide
agugggaagcauggguuu

SEQ ID NO: 21208 - RNA, 18 nt, Artificial Sequence
  Description of Artificial Sequence: Synthetic oligonucleotide
gcagaagugggaagcaug

SEQ ID NO: 21209 - RNA, 18 nt, Artificial Sequence
  Description of Artificial Sequence: Synthetic oligonucleotide
ggugggcagaagugggaa

SEQ ID NO: 21210 - RNA, 18 nt, Artificial Sequence
  Description of Artificial Sequence: Synthetic oligonucleotide
cucugggugggcagaagu

SEQ ID NO: 21211 - RNA, 18 nt, Artificial Sequence
  Description of Artificial Sequence: Synthetic oligonucleotide
ggccgcucugggugggca

SEQ ID NO: 21212 - RNA, 18 nt, Artificial Sequence
  Description of Artificial Sequence: Synthetic oligonucleotide
gggccgcucugggugggc

SEQ ID NO: 21213 - RNA, 18 nt, Artificial Sequence
  Description of Artificial Sequence: Synthetic oligonucleotide
ccccagccugggcauggg

SEQ ID NO: 21214 - RNA, 18 nt, Artificial Sequence
  Description of Artificial Sequence: Synthetic oligonucleotide
gccugccccagccugggc

SEQ ID NO: 21215 - RNA, 18 nt, Artificial Sequence
  Description of Artificial Sequence: Synthetic oligonucleotide
aaggcgccugccccagcc

SEQ ID NO: 21216 - RNA, 18 nt, Artificial Sequence
  Description of Artificial Sequence: Synthetic oligonucleotide
ucugcaaggcgccugccc

SEQ ID NO: 21217 - RNA, 18 nt, Artificial Sequence
  Description of Artificial Sequence: Synthetic oligonucleotide
cccucucugcaaggcgcc

SEQ ID NO: 21218 - RNA, 18 nt, Artificial Sequence
  Description of Artificial Sequence: Synthetic oligonucleotide
aaagccccucucugcaag

SEQ ID NO: 21219 - RNA, 18 nt, Artificial Sequence
  Description of Artificial Sequence: Synthetic oligonucleotide
gggcuaaagccccucucu

SEQ ID NO: 21220 - RNA, 18 nt, Artificial Sequence
  Description of Artificial Sequence: Synthetic oligonucleotide
gggaccucgccugcuuuc

SEQ ID NO: 21221 - RNA, 18 nt, Artificial Sequence
  Description of Artificial Sequence: Synthetic oligonucleotide
gacccgggaccucgccug

SEQ ID NO: 21222 - RNA, 18 nt, Artificial Sequence
  Description of Artificial Sequence: Synthetic oligonucleotide
gggacccgggaccucgcc

SEQ ID NO: 21223 - RNA, 18 nt, Artificial Sequence
  Description of Artificial Sequence: Synthetic oligonucleotide
caggugugcguggcaggg

SEQ ID NO: 21224 - RNA, 18 nt, Artificial Sequence
  Description of Artificial Sequence: Synthetic oligonucleotide
agcuucaggugugcgugg

SEQ ID NO: 21225 - RNA, 18 nt, Artificial Sequence
  Description of Artificial Sequence: Synthetic oligonucleotide
agaucagcuucaggugug

SEQ ID NO: 21226 - RNA, 18 nt, Artificial Sequence
  Description of Artificial Sequence: Synthetic oligonucleotide
gucagagaucagcuucag

SEQ ID NO: 21227 - RNA, 18 nt, Artificial Sequence
  Description of Artificial Sequence: Synthetic oligonucleotide
ccuaggucagagaucagc

SEQ ID NO: 21228 - RNA, 18 nt, Artificial Sequence
  Description of Artificial Sequence: Synthetic oligonucleotide
aaggcccuaggucagaga

SEQ ID NO: 21229 - RNA, 18 nt, Artificial Sequence
  Description of Artificial Sequence: Synthetic oligonucleotide
uccccaaggcccuagguc

SEQ ID NO: 21230 - RNA, 18 nt, Artificial Sequence
  Description of Artificial Sequence: Synthetic oligonucleotide
ucgaauccccaaggcccu

SEQ ID NO: 21231 - RNA, 18 nt, Artificial Sequence
  Description of Artificial Sequence: Synthetic oligonucleotide
cauuccucugagaagcag

SEQ ID NO: 21232 - RNA, 18 nt, Artificial Sequence
  Description of Artificial Sequence: Synthetic oligonucleotide
cacaucauuccucugaga

SEQ ID NO: 21233 - RNA, 18 nt, Artificial Sequence
  Description of Artificial Sequence: Synthetic oligonucleotide
cagaccacaucauuccuc

SEQ ID NO: 21234 - RNA, 18 nt, Artificial Sequence
  Description of Artificial Sequence: Synthetic oligonucleotide
gggcacagaccacaucau

SEQ ID NO: 21235 - RNA, 18 nt, Artificial Sequence
  Description of Artificial Sequence: Synthetic oligonucleotide
cagaugggcacagaccac

SEQ ID NO: 21236 - RNA, 18 nt, Artificial Sequence
  Description of Artificial Sequence: Synthetic oligonucleotide
cagagcagaugggcacag

SEQ ID NO: 21237 - RNA, 18 nt, Artificial Sequence
  Description of Artificial Sequence: Synthetic oligonucleotide
caggacagagcagauggg

SEQ ID NO: 21238 - RNA, 18 nt, Artificial Sequence
  Description of Artificial Sequence: Synthetic oligonucleotide
cagaccaggacagagcag

SEQ ID NO: 21239 - RNA, 18 nt, Artificial Sequence
  Description of Artificial Sequence: Synthetic oligonucleotide
uggcccagaccaggacag

SEQ ID NO: 21240 - RNA, 18 nt, Artificial Sequence
  Description of Artificial Sequence: Synthetic oligonucleotide
uggcuuggcccagaccag

SEQ ID NO: 21241 - RNA, 18 nt, Artificial Sequence
  Description of Artificial Sequence: Synthetic oligonucleotide
aucccuggcuuggcccag

SEQ ID NO: 21242 - RNA, 18 nt, Artificial Sequence
  Description of Artificial Sequence: Synthetic oligonucleotide
acccaaucccuggcuugg

SEQ ID NO: 21243 - RNA, 18 nt, Artificial Sequence
  Description of Artificial Sequence: Synthetic oligonucleotide
cccacacccaaucccugg

SEQ ID NO: 21244 - RNA, 18 nt, Artificial Sequence
  Description of Artificial Sequence: Synthetic oligonucleotide
ggcuccccacacccaauc

SEQ ID NO: 21245 - RNA, 18 nt, Artificial Sequence
  Description of Artificial Sequence: Synthetic oligonucleotide
ccacuggcuccccacacc

SEQ ID NO: 21246 - RNA, 18 nt, Artificial Sequence
  Description of Artificial Sequence: Synthetic oligonucleotide
gggugccacuggcucccc

SEQ ID NO: 21247 - RNA, 18 nt, Artificial Sequence
  Description of Artificial Sequence: Synthetic oligonucleotide
accacagccgcugguggg

SEQ ID NO: 21248 - RNA, 18 nt, Artificial Sequence
  Description of Artificial Sequence: Synthetic oligonucleotide
aggaccacagccgcuggu

SEQ ID NO: 21249 - RNA, 18 nt, Artificial Sequence
  Description of Artificial Sequence: Synthetic oligonucleotide
gggccaggaccacagccg

SEQ ID NO: 21250 - RNA, 18 nt, Artificial Sequence
  Description of Artificial Sequence: Synthetic oligonucleotide
aacagccaaggcugaggg

SEQ ID NO: 21251 - RNA, 18 nt, Artificial Sequence
  Description of Artificial Sequence: Synthetic oligonucleotide
augcaacagccaaggcug

SEQ ID NO: 21252 - RNA, 18 nt, Artificial Sequence
  Description of Artificial Sequence: Synthetic oligonucleotide
agugcaugcaacagccaa

SEQ ID NO: 21253 - RNA, 18 nt, Artificial Sequence
  Description of Artificial Sequence: Synthetic oligonucleotide
ugagcagugcaugcaaca

SEQ ID NO: 21254 - RNA, 18 nt, Artificial Sequence
  Description of Artificial Sequence: Synthetic oligonucleotide
ggauuugagcagugcaug

SEQ ID NO: 21255 - RNA, 18 nt, Artificial Sequence
  Description of Artificial Sequence: Synthetic oligonucleotide
aagcuggauuugagcagu

SEQ ID NO: 21256 - RNA, 18 nt, Artificial Sequence
  Description of Artificial Sequence: Synthetic oligonucleotide
agcacaagcuggauuuga

SEQ ID NO: 21257 - RNA, 18 nt, Artificial Sequence
  Description of Artificial Sequence: Synthetic oligonucleotide
aaaagagcacaagcugga

SEQ ID NO: 21258 - RNA, 18 nt, Artificial Sequence
  Description of Artificial Sequence: Synthetic oligonucleotide
aaagaaaaagagcacaag

SEQ ID NO: 21259 - RNA, 18 nt, Artificial Sequence
  Description of Artificial Sequence: Synthetic oligonucleotide
accccaaagaaaaagagc

SEQ ID NO: 21260 - RNA, 18 nt, Artificial Sequence
  Description of Artificial Sequence: Synthetic oligonucleotide
gucugaccccaaagaaaa

SEQ ID NO: 21261 - RNA, 18 nt, Artificial Sequence
  Description of Artificial Sequence: Synthetic oligonucleotide
uuucagucugaccccaaa

SEQ ID NO: 21262 - RNA, 18 nt, Artificial Sequence
  Description of Artificial Sequence: Synthetic oligonucleotide
ccccguuucagucugacc

SEQ ID NO: 21263 - RNA, 18 nt, Artificial Sequence
  Description of Artificial Sequence: Synthetic oligonucleotide
gauggccccguuucaguc

SEQ ID NO: 21264 - RNA, 18 nt, Artificial Sequence
  Description of Artificial Sequence: Synthetic oligonucleotide
uucuggauggccccguuu

SEQ ID NO: 21265 - RNA, 18 nt, Artificial Sequence
  Description of Artificial Sequence: Synthetic oligonucleotide
aguucuucuggauggccc

SEQ ID NO: 21266 - RNA, 18 nt, Artificial Sequence
  Description of Artificial Sequence: Synthetic oligonucleotide
cccagaguucuucuggau

SEQ ID NO: 21267 - RNA, 18 nt, Artificial Sequence
  Description of Artificial Sequence: Synthetic oligonucleotide
ccugccccagaguucuuc

SEQ ID NO: 21268 - RNA, 18 nt, Artificial Sequence
  Description of Artificial Sequence: Synthetic oligonucleotide
cccgcccugccccagagu

SEQ ID NO: 21269 - RNA, 18 nt, Artificial Sequence
  Description of Artificial Sequence: Synthetic oligonucleotide
ccacccccgcccugcccc

SEQ ID NO: 21270 - RNA, 18 nt, Artificial Sequence
  Description of Artificial Sequence: Synthetic oligonucleotide
uugccccacccccgcccu

SEQ ID NO: 21271 - RNA, 18 nt, Artificial Sequence
  Description of Artificial Sequence: Synthetic oligonucleotide
aacccuugccccaccccc

SEQ ID NO: 21272 - RNA, 18 nt, Artificial Sequence
  Description of Artificial Sequence: Synthetic oligonucleotide
gccucaacccuugcccca

SEQ ID NO: 21273 - RNA, 18 nt, Artificial Sequence
  Description of Artificial Sequence: Synthetic oligonucleotide
gguuugccucaacccuug

SEQ ID NO: 21274 - RNA, 18 nt, Artificial Sequence
  Description of Artificial Sequence: Synthetic oligonucleotide
uccaggguuugccucaac

SEQ ID NO: 21275 - RNA, 18 nt, Artificial Sequence
  Description of Artificial Sequence: Synthetic oligonucleotide
gcauuuccaggguuugcc

SEQ ID NO: 21276 - RNA, 18 nt, Artificial Sequence
  Description of Artificial Sequence: Synthetic oligonucleotide
agcuggcauuuccagggu

SEQ ID NO: 21277 - RNA, 18 nt, Artificial Sequence
  Description of Artificial Sequence: Synthetic oligonucleotide
cugagagcuggcauuucc

SEQ ID NO: 21278 - RNA, 18 nt, Artificial Sequence
  Description of Artificial Sequence: Synthetic oligonucleotide
uugaccugagagcuggca

SEQ ID NO: 21279 - RNA, 18 nt, Artificial Sequence
  Description of Artificial Sequence: Synthetic oligonucleotide
ccugcuugaccugagagc

SEQ ID NO: 21280 - RNA, 18 nt, Artificial Sequence
  Description of Artificial Sequence: Synthetic oligonucleotide
ccccaccugcuugaccug

SEQ ID NO: 21281 - RNA, 18 nt, Artificial Sequence
  Description of Artificial Sequence: Synthetic oligonucleotide
uuuucccccaccugcuug

SEQ ID NO: 21282 - RNA, 18 nt, Artificial Sequence
  Description of Artificial Sequence: Synthetic oligonucleotide
uccuuuuuucccccaccu

SEQ ID NO: 21283 - RNA, 18 nt, Artificial Sequence
  Description of Artificial Sequence: Synthetic oligonucleotide
cccucuccuuuuuucccc

SEQ ID NO: 21284 - RNA, 18 nt, Artificial Sequence
  Description of Artificial Sequence: Synthetic oligonucleotide
cccugcccucuccuuuuu

SEQ ID NO: 21285 - RNA, 18 nt, Artificial Sequence
  Description of Artificial Sequence: Synthetic oligonucleotide
ugguccccugcccucucc

SEQ ID NO: 21286 - RNA, 18 nt, Artificial Sequence
  Description of Artificial Sequence: Synthetic oligonucleotide
acuucugguccccugccc

SEQ ID NO: 21287 - RNA, 18 nt, Artificial Sequence
  Description of Artificial Sequence: Synthetic oligonucleotide
cuuguacuucuggucccc

SEQ ID NO: 21288 - RNA, 18 nt, Artificial Sequence
  Description of Artificial Sequence: Synthetic oligonucleotide
gcucucuuguacuucugg

SEQ ID NO: 21289 - RNA, 18 nt, Artificial Sequence
  Description of Artificial Sequence: Synthetic oligonucleotide
aaaaggcucucuuguacu

SEQ ID NO: 21290 - RNA, 18 nt, Artificial Sequence
  Description of Artificial Sequence: Synthetic oligonucleotide
ggcacaaaaggcucucuu

SEQ ID NO: 21291 - RNA, 18 nt, Artificial Sequence
  Description of Artificial Sequence: Synthetic oligonucleotide
gggagggcacaaaaggcu

SEQ ID NO: 21292 - RNA, 18 nt, Artificial Sequence
  Description of Artificial Sequence: Synthetic oligonucleotide
ccgcagggagggcacaaa

SEQ ID NO: 21293 - RNA, 18 nt, Artificial Sequence
  Description of Artificial Sequence: Synthetic oligonucleotide
guggcccgcagggagggc

SEQ ID NO: 21294 - RNA, 18 nt, Artificial Sequence
  Description of Artificial Sequence: Synthetic oligonucleotide
ucuugguggcccgcaggg

SEQ ID NO: 21295 - RNA, 18 nt, Artificial Sequence
  Description of Artificial Sequence: Synthetic oligonucleotide
guuucucuugguggcccg

SEQ ID NO: 21296 - RNA, 18 nt, Artificial Sequence
  Description of Artificial Sequence: Synthetic oligonucleotide
acucaguuucucuuggug

SEQ ID NO: 21297 - RNA, 18 nt, Artificial Sequence
  Description of Artificial Sequence: Synthetic oligonucleotide
ccaguacucaguuucucu

SEQ ID NO: 21298 - RNA, 18 nt, Artificial Sequence
  Description of Artificial Sequence: Synthetic oligonucleotide
cugucccaguacucaguu

SEQ ID NO: 21299 - RNA, 18 nt, Artificial Sequence
  Description of Artificial Sequence: Synthetic oligonucleotide
guuaccugucccaguacu

SEQ ID NO: 21300 - RNA, 18 nt, Artificial Sequence
  Description of Artificial Sequence: Synthetic oligonucleotide
cuuagguuaccuguccca

SEQ ID NO: 21301 - RNA, 18 nt, Artificial Sequence
  Description of Artificial Sequence: Synthetic oligonucleotide
ucuuacuuagguuaccug

SEQ ID NO: 21302 - RNA, 18 nt, Artificial Sequence
  Description of Artificial Sequence: Synthetic oligonucleotide
gugucucuuacuuagguu

SEQ ID NO: 21303 - RNA, 18 nt, Artificial Sequence
  Description of Artificial Sequence: Synthetic oligonucleotide
cugaggugucucuuacuu

SEQ ID NO: 21304 - RNA, 18 nt, Artificial Sequence
  Description of Artificial Sequence: Synthetic oligonucleotide
ggcggcugaggugucucu

SEQ ID NO: 21305 - RNA, 18 nt, Artificial Sequence
  Description of Artificial Sequence: Synthetic oligonucleotide
gcuguggcggcugaggug

SEQ ID NO: 21306 - RNA, 18 nt, Artificial Sequence
  Description of Artificial Sequence: Synthetic oligonucleotide
ugaaagcuguggcggcug

SEQ ID NO: 21307 - RNA, 18 nt, Artificial Sequence
  Description of Artificial Sequence: Synthetic oligonucleotide
aacucugaaagcuguggc

SEQ ID NO: 21308 - RNA, 18 nt, Artificial Sequence
  Description of Artificial Sequence: Synthetic oligonucleotide
ggaagaacucugaaagcu

SEQ ID NO: 21309 - RNA, 18 nt, Artificial Sequence
  Description of Artificial Sequence: Synthetic oligonucleotide
ucccaggaagaacucuga

SEQ ID NO: 21310 - RNA, 18 nt, Artificial Sequence
  Description of Artificial Sequence: Synthetic oligonucleotide
gggagucccaggaagaac

SEQ ID NO: 21311 - RNA, 18 nt, Artificial Sequence
  Description of Artificial Sequence: Synthetic oligonucleotide
acccagggagucccagga

SEQ ID NO: 21312 - RNA, 18 nt, Artificial Sequence
  Description of Artificial Sequence: Synthetic oligonucleotide
ccccuacccagggagucc

SEQ ID NO: 21313 - RNA, 18 nt, Artificial Sequence
  Description of Artificial Sequence: Synthetic oligonucleotide
gcccgccccuacccaggg

SEQ ID NO: 21314 - RNA, 18 nt, Artificial Sequence
  Description of Artificial Sequence: Synthetic oligonucleotide
gccgcgcccgccccuacc

SEQ ID NO: 21315 - RNA, 18 nt, Artificial Sequence
  Description of Artificial Sequence: Synthetic oligonucleotide
cgugagccgcgcccgccc

SEQ ID NO: 21316 - RNA, 18 nt, Artificial Sequence
  Description of Artificial Sequence: Synthetic oligonucleotide
ucucccgugagccgcgcc

SEQ ID NO: 21317 - RNA, 18 nt, Artificial Sequence
  Description of Artificial Sequence: Synthetic oligonucleotide
cugggucucccgugagcc

SEQ ID NO: 21318 - RNA, 18 nt, Artificial Sequence
  Description of Artificial Sequence: Synthetic oligonucleotide
cccuccugggucucccgu

SEQ ID NO: 21319 - RNA, 18 nt, Artificial Sequence
  Description of Artificial Sequence: Synthetic oligonucleotide
ggcaucccuccugggucu

SEQ ID NO: 21320 - RNA, 18 nt, Artificial Sequence
  Description of Artificial Sequence: Synthetic oligonucleotide
ucccaggcaucccuccug

SEQ ID NO: 21321 - RNA, 18 nt, Artificial Sequence
  Description of Artificial Sequence: Synthetic oligonucleotide
gucauucccaggcauccc

SEQ ID NO: 21322 - RNA, 18 nt, Artificial Sequence
  Description of Artificial Sequence: Synthetic oligonucleotide
gcgcagucauucccaggc

SEQ ID NO: 21323 - RNA, 18 nt, Artificial Sequence
  Description of Artificial Sequence: Synthetic oligonucleotide
ggcaagcgcagucauucc

SEQ ID NO: 21324 - RNA, 18 nt, Artificial Sequence
  Description of Artificial Sequence: Synthetic oligonucleotide
gguccauccgcagaagcc

SEQ ID NO: 21325 - RNA, 18 nt, Artificial Sequence
  Description of Artificial Sequence: Synthetic oligonucleotide
gggcagguccauccgcag

SEQ ID NO: 21326 - RNA, 18 nt, Artificial Sequence
  Description of Artificial Sequence: Synthetic oligonucleotide
gcgacgggcagguccauc

SEQ ID NO: 21327 - RNA, 18 nt, Artificial Sequence
  Description of Artificial Sequence: Synthetic oligonucleotide
caucugcgacgggcaggu

SEQ ID NO: 21328 - RNA, 18 nt, Artificial Sequence
  Description of Artificial Sequence: Synthetic oligonucleotide
guugucaucugcgacggg

SEQ ID NO: 21329 - RNA, 18 nt, Artificial Sequence
  Description of Artificial Sequence: Synthetic oligonucleotide
acgguguugucaucugcg

SEQ ID NO: 21330 - RNA, 18 nt, Artificial Sequence
  Description of Artificial Sequence: Synthetic oligonucleotide
aguggacgguguugucau

SEQ ID NO: 21331 - RNA, 18 nt, Artificial Sequence
  Description of Artificial Sequence: Synthetic oligonucleotide
auugaaguggacgguguu

SEQ ID NO: 21332 - RNA, 18 nt, Artificial Sequence
  Description of Artificial Sequence: Synthetic oligonucleotide
guggaauugaaguggacg

SEQ ID NO: 21333 - RNA, 18 nt, Artificial Sequence
  Description of Artificial Sequence: Synthetic oligonucleotide
ugaggguggaauugaagu

SEQ ID NO: 21334 - RNA, 18 nt, Artificial Sequence
  Description of Artificial Sequence: Synthetic oligonucleotide
agccaugaggguggaauu

SEQ ID NO: 21335 - RNA, 18 nt, Artificial Sequence
  Description of Artificial Sequence: Synthetic oligonucleotide
aucagagccaugagggug

SEQ ID NO: 21336 - RNA, 18 nt, Artificial Sequence
  Description of Artificial Sequence: Synthetic oligonucleotide
ugcggaucagagccauga

SEQ ID NO: 21337 - RNA, 18 nt, Artificial Sequence
  Description of Artificial Sequence: Synthetic oligonucleotide
ggcugugcggaucagagc

SEQ ID NO: 21338 - RNA, 18 nt, Artificial Sequence
  Description of Artificial Sequence: Synthetic oligonucleotide
uccagggcugugcggauc

SEQ ID NO: 21339 - RNA, 18 nt, Artificial Sequence
  Description of Artificial Sequence: Synthetic oligonucleotide
ugauguccagggcugugc

SEQ ID NO: 21340 - RNA, 18 nt, Artificial Sequence
  Description of Artificial Sequence: Synthetic oligonucleotide
aaucuugauguccagggc

SEQ ID NO: 21341 - RNA, 18 nt, Artificial Sequence
  Description of Artificial Sequence: Synthetic oligonucleotide
uuggcaaucuugaugucc

SEQ ID NO: 21342 - RNA, 18 nt, Artificial Sequence
  Description of Artificial Sequence: Synthetic oligonucleotide
cgacaaagagauucagca

SEQ ID NO: 21343 - RNA, 18 nt, Artificial Sequence
  Description of Artificial Sequence: Synthetic oligonucleotide
gacggcgacaaagagauu

SEQ ID NO: 21344 - RNA, 18 nt, Artificial Sequence
  Description of Artificial Sequence: Synthetic oligonucleotide
augaugacggcgacaaag

SEQ ID NO: 21345 - RNA, 18 nt, Artificial Sequence
  Description of Artificial Sequence: Synthetic oligonucleotide
uguccaugaugacggcga

SEQ ID NO: 21346 - RNA, 18 nt, Artificial Sequence
  Description of Artificial Sequence: Synthetic oligonucleotide
aaaguuguccaugaugac

SEQ ID NO: 21347 - RNA, 18 nt, Artificial Sequence
  Description of Artificial Sequence: Synthetic oligonucleotide
uacucaaaguuguccaug

SEQ ID NO: 21348 - RNA, 18 nt, Artificial Sequence
  Description of Artificial Sequence: Synthetic oligonucleotide
ugagguacucaaaguugu

SEQ ID NO: 21349 - RNA, 18 nt, Artificial Sequence
  Description of Artificial Sequence: Synthetic oligonucleotide
ucgggugagguacucaaa

SEQ ID NO: 21350 - RNA, 18 nt, Artificial Sequence
  Description of Artificial Sequence: Synthetic oligonucleotide
gagucucgggugagguac

SEQ ID NO: 21351 - RNA, 18 nt, Artificial Sequence
  Description of Artificial Sequence: Synthetic oligonucleotide
uggaggagucucggguga

SEQ ID NO: 21352 - RNA, 18 nt, Artificial Sequence
  Description of Artificial Sequence: Synthetic oligonucleotide
caggauggaggagucucg

SEQ ID NO: 21353 - RNA, 18 nt, Artificial Sequence
  Description of Artificial Sequence: Synthetic oligonucleotide
gggcccaggauggaggag

SEQ ID NO: 21354 - RNA, 18 nt, Artificial Sequence
  Description of Artificial Sequence: Synthetic oligonucleotide
acucauccaggugguggg

SEQ ID NO: 21355 - RNA, 18 nt, Artificial Sequence
  Description of Artificial Sequence: Synthetic oligonucleotide
acguacucauccaggugg

SEQ ID NO: 21356 - RNA, 18 nt, Artificial Sequence
  Description of Artificial Sequence: Synthetic oligonucleotide
cacgcacguacucaucca

SEQ ID NO: 21357 - RNA, 18 nt, Artificial Sequence
  Description of Artificial Sequence: Synthetic oligonucleotide
ccagacacgcacguacuc

SEQ ID NO: 21358 - RNA, 18 nt, Artificial Sequence
  Description of Artificial Sequence: Synthetic oligonucleotide
ucggcccagacacgcacg

SEQ ID NO: 21359 - RNA, 18 nt, Artificial Sequence
  Description of Artificial Sequence: Synthetic oligonucleotide
cauacucggcccagacac

SEQ ID NO: 21360 - RNA, 18 nt, Artificial Sequence
  Description of Artificial Sequence: Synthetic oligonucleotide
auuguggcuggaggauuc

SEQ ID NO: 21361 - RNA, 18 nt, Artificial Sequence
  Description of Artificial Sequence: Synthetic oligonucleotide
ugaguauuguggcuggag

SEQ ID NO: 21362 - RNA, 18 nt, Artificial Sequence
  Description of Artificial Sequence: Synthetic oligonucleotide
agaggugaguauuguggc

SEQ ID NO: 21363 - RNA, 18 nt, Artificial Sequence
  Description of Artificial Sequence: Synthetic oligonucleotide
cagggagaggugaguauu

SEQ ID NO: 21364 - RNA, 18 nt, Artificial Sequence
  Description of Artificial Sequence: Synthetic oligonucleotide
aguuccagggagagguga

SEQ ID NO: 21365 - RNA, 18 nt, Artificial Sequence
  Description of Artificial Sequence: Synthetic oligonucleotide
guuccaguuccagggaga

SEQ ID NO: 21366 - RNA, 18 nt, Artificial Sequence
  Description of Artificial Sequence: Synthetic oligonucleotide
cccguguuccaguuccag

SEQ ID NO: 21367 - RNA, 18 nt, Artificial Sequence
  Description of Artificial Sequence: Synthetic oligonucleotide
ccuagcccguguuccagu

SEQ ID NO: 21368 - RNA, 18 nt, Artificial Sequence
  Description of Artificial Sequence: Synthetic oligonucleotide
ccugaccuagcccguguu

SEQ ID NO: 21369 - RNA, 18 nt, Artificial Sequence
  Description of Artificial Sequence: Synthetic oligonucleotide
gggccugaccuagcccgu

SEQ ID NO: 21370 - RNA, 18 nt, Artificial Sequence
  Description of Artificial Sequence: Synthetic oligonucleotide
agugcuccagagucuggg

SEQ ID NO: 21371 - RNA, 18 nt, Artificial Sequence
  Description of Artificial Sequence: Synthetic oligonucleotide
aguucagugcuccagagu

SEQ ID NO: 21372 - RNA, 18 nt, Artificial Sequence
  Description of Artificial Sequence: Synthetic oligonucleotide
ccaggaguucagugcucc

SEQ ID NO: 21373 - RNA, 18 nt, Artificial Sequence
  Description of Artificial Sequence: Synthetic oligonucleotide
ggaccccaggaguucagu

SEQ ID NO: 21374 - RNA, 18 nt, Artificial Sequence
  Description of Artificial Sequence: Synthetic oligonucleotide
ugcuaggaccccaggagu

SEQ ID NO: 21375 - RNA, 18 nt, Artificial Sequence
  Description of Artificial Sequence: Synthetic oligonucleotide
accccugcuaggacccca

SEQ ID NO: 21376 - RNA, 18 nt, Artificial Sequence
  Description of Artificial Sequence: Synthetic oligonucleotide
gugagaccccugcuagga

SEQ ID NO: 21377 - RNA, 18 nt, Artificial Sequence
  Description of Artificial Sequence: Synthetic oligonucleotide
aaccugugagaccccugc

SEQ ID NO: 21378 - RNA, 18 nt, Artificial Sequence
  Description of Artificial Sequence: Synthetic oligonucleotide
gacugaaccugugagacc

SEQ ID NO: 21379 - RNA, 18 nt, Artificial Sequence
  Description of Artificial Sequence: Synthetic oligonucleotide
cuccugacugaaccugug

SEQ ID NO: 21380 - RNA, 18 nt, Artificial Sequence
  Description of Artificial Sequence: Synthetic oligonucleotide
cuucucuccugacugaac

SEQ ID NO: 21381 - RNA, 18 nt, Artificial Sequence
  Description of Artificial Sequence: Synthetic oligonucleotide
uauaucuucucuccugac

SEQ ID NO: 21382 - RNA, 18 nt, Artificial Sequence
  Description of Artificial Sequence: Synthetic oligonucleotide
auucuuauaucuucucuc

SEQ ID NO: 21383 - RNA, 18 nt, Artificial Sequence
  Description of Artificial Sequence: Synthetic oligonucleotide
ugaugauucuuauaucuu

SEQ ID NO: 21384 - RNA, 18 nt, Artificial Sequence
  Description of Artificial Sequence: Synthetic oligonucleotide
aagggugaugauucuuau

SEQ ID NO: 21385 - RNA, 18 nt, Artificial Sequence
  Description of Artificial Sequence: Synthetic oligonucleotide
uaugcaagggugaugauu

SEQ ID NO: 21386 - RNA, 18 nt, Artificial Sequence
  Description of Artificial Sequence: Synthetic oligonucleotide
ggguaugcaagggugaug

SEQ ID NO: 21387 - RNA, 18 nt, Artificial Sequence
  Description of Artificial Sequence: Synthetic oligonucleotide
cuacguguuuaaucuggg

SEQ ID NO: 21388 - RNA, 18 nt, Artificial Sequence
  Description of Artificial Sequence: Synthetic oligonucleotide
gcacccuacguguuuaau

SEQ ID NO: 21389 - RNA, 18 nt, Artificial Sequence
  Description of Artificial Sequence: Synthetic oligonucleotide
gguuggcacccuacgugu

SEQ ID NO: 21390 - RNA, 18 nt, Artificial Sequence
  Description of Artificial Sequence: Synthetic oligonucleotide
ggcaggguuggcacccua

SEQ ID NO: 21391 - RNA, 18 nt, Artificial Sequence
  Description of Artificial Sequence: Synthetic oligonucleotide
guuugggcaggguuggca

SEQ ID NO: 21392 - RNA, 18 nt, Artificial Sequence
  Description of Artificial Sequence: Synthetic oligonucleotide
ccaggguuugggcagggu

SEQ ID NO: 21393 - RNA, 18 nt, Artificial Sequence
  Description of Artificial Sequence: Synthetic oligonucleotide
aaaguccaggguuugggc

SEQ ID NO: 21394 - RNA, 18 nt, Artificial Sequence
  Description of Artificial Sequence: Synthetic oligonucleotide
cccagaaaguccaggguu

SEQ ID NO: 21395 - RNA, 18 nt, Artificial Sequence
  Description of Artificial Sequence: Synthetic oligonucleotide
cauuucccagaaagucca

SEQ ID NO: 21396 - RNA, 18 nt, Artificial Sequence
  Description of Artificial Sequence: Synthetic oligonucleotide
ucccucauuucccagaaa

SEQ ID NO: 21397 - RNA, 18 nt, Artificial Sequence
  Description of Artificial Sequence: Synthetic oligonucleotide
cgcccucccucauuuccc

SEQ ID NO: 21398 - RNA, 18 nt, Artificial Sequence
  Description of Artificial Sequence: Synthetic oligonucleotide
guugacgcccucccucau

SEQ ID NO: 21399 - RNA, 18 nt, Artificial Sequence
  Description of Artificial Sequence: Synthetic oligonucleotide
ucaugguugacgcccucc

SEQ ID NO: 21400 - RNA, 18 nt, Artificial Sequence
  Description of Artificial Sequence: Synthetic oligonucleotide
acaucucaugguugacgc

SEQ ID NO: 21401 - RNA, 18 nt, Artificial Sequence
  Description of Artificial Sequence: Synthetic oligonucleotide
ucaggacaucucaugguu

SEQ ID NO: 21402 - RNA, 18 nt, Artificial Sequence
  Description of Artificial Sequence: Synthetic oligonucleotide
gcucuucaggacaucuca

SEQ ID NO: 21403 - RNA, 18 nt, Artificial Sequence
  Description of Artificial Sequence: Synthetic oligonucleotide
agagggcucuucaggaca

SEQ ID NO: 21404 - RNA, 18 nt, Artificial Sequence
  Description of Artificial Sequence: Synthetic oligonucleotide
ggaggagagggcucuuca

SEQ ID NO: 21405 - RNA, 18 nt, Artificial Sequence
  Description of Artificial Sequence: Synthetic oligonucleotide
ucguaggaggagagggcu

SEQ ID NO: 21406 - RNA, 18 nt, Artificial Sequence
  Description of Artificial Sequence: Synthetic oligonucleotide
gagacucguaggaggaga

SEQ ID NO: 21407 - RNA, 18 nt, Artificial Sequence
  Description of Artificial Sequence: Synthetic oligonucleotide
caggagagacucguagga

SEQ ID NO: 21408 - RNA, 18 nt, Artificial Sequence
  Description of Artificial Sequence: Synthetic oligonucleotide
agagacaggagagacucg

SEQ ID NO: 21409 - RNA, 18 nt, Artificial Sequence
  Description of Artificial Sequence: Synthetic oligonucleotide
cagugagagacaggagag

SEQ ID NO: 21410 - RNA, 18 nt, Artificial Sequence
  Description of Artificial Sequence: Synthetic oligonucleotide
cuucacagugagagacag

SEQ ID NO: 21411 - RNA, 18 nt, Artificial Sequence
  Description of Artificial Sequence: Synthetic oligonucleotide
ggagacuucacagugaga

SEQ ID NO: 21412 - RNA, 18 nt, Artificial Sequence
  Description of Artificial Sequence: Synthetic oligonucleotide
caucuggagacuucacag

SEQ ID NO: 21413 - RNA, 18 nt, Artificial Sequence
  Description of Artificial Sequence: Synthetic oligonucleotide
cucaccaucuggagacuu

SEQ ID NO: 21414 - RNA, 18 nt, Artificial Sequence
  Description of Artificial Sequence: Synthetic oligonucleotide
gcauccucaccaucugga

SEQ ID NO: 21415 - RNA, 18 nt, Artificial Sequence
  Description of Artificial Sequence: Synthetic oligonucleotide
cuaaugcauccucaccau

SEQ ID NO: 21416 - RNA, 18 nt, Artificial Sequence
  Description of Artificial Sequence: Synthetic oligonucleotide
ccuggcuaaugcauccuc

SEQ ID NO: 21417 - RNA, 18 nt, Artificial Sequence
  Description of Artificial Sequence: Synthetic oligonucleotide
uggagccuggcuaaugca

SEQ ID NO: 21418 - RNA, 18 nt, Artificial Sequence
  Description of Artificial Sequence: Synthetic oligonucleotide
cucccuggagccuggcua

SEQ ID NO: 21419 - RNA, 18 nt, Artificial Sequence
  Description of Artificial Sequence: Synthetic oligonucleotide
guuuucucccuggagccu

SEQ ID NO: 21420 - RNA, 18 nt, Artificial Sequence
  Description of Artificial Sequence: Synthetic oligonucleotide
uguugguuuucucccugg

SEQ ID NO: 21421 - RNA, 18 nt, Artificial Sequence
  Description of Artificial Sequence: Synthetic oligonucleotide
gaugcuguugguuuucuc

SEQ ID NO: 21422 - RNA, 18 nt, Artificial Sequence
  Description of Artificial Sequence: Synthetic oligonucleotide
gcugggaugcuguugguu

SEQ ID NO: 21423 - RNA, 18 nt, Artificial Sequence
  Description of Artificial Sequence: Synthetic oligonucleotide
cugaggcugggaugcugu

SEQ ID NO: 21424 - RNA, 18 nt, Artificial Sequence
  Description of Artificial Sequence: Synthetic oligonucleotide
gagaacugaggcugggau

SEQ ID NO: 21425 - RNA, 18 nt, Artificial Sequence
  Description of Artificial Sequence: Synthetic oligonucleotide
cucaagagaacugaggcu

SEQ ID NO: 21426 - RNA, 18 nt, Artificial Sequence
  Description of Artificial Sequence: Synthetic oligonucleotide
acacucucaagagaacug

SEQ ID NO: 21427 - RNA, 18 nt, Artificial Sequence
  Description of Artificial Sequence: Synthetic oligonucleotide
uccccacacucucaagag

SEQ ID NO: 21428 - RNA, 18 nt, Artificial Sequence
  Description of Artificial Sequence: Synthetic oligonucleotide
ccuccuccccacacucuc

SEQ ID NO: 21429 - RNA, 18 nt, Artificial Sequence
  Description of Artificial Sequence: Synthetic oligonucleotide
ccagcccuccuccccaca

SEQ ID NO: 21430 - RNA, 18 nt, Artificial Sequence
  Description of Artificial Sequence: Synthetic oligonucleotide
guaggccagcccuccucc

SEQ ID NO: 21431 - RNA, 18 nt, Artificial Sequence
  Description of Artificial Sequence: Synthetic oligonucleotide
caaggguaggccagcccu

SEQ ID NO: 21432 - RNA, 18 nt, Artificial Sequence
  Description of Artificial Sequence: Synthetic oligonucleotide
ucugccaaggguaggcca

SEQ ID NO: 21433 - RNA, 18 nt, Artificial Sequence
  Description of Artificial Sequence: Synthetic oligonucleotide
uccugucugccaagggua

SEQ ID NO: 21434 - RNA, 18 nt, Artificial Sequence
  Description of Artificial Sequence: Synthetic oligonucleotide
gccaauccugucugccaa

SEQ ID NO: 21435 - RNA, 18 nt, Artificial Sequence
  Description of Artificial Sequence: Synthetic oligonucleotide
uugcugccaauccugucu

SEQ ID NO: 21436 - RNA, 18 nt, Artificial Sequence
  Description of Artificial Sequence: Synthetic oligonucleotide
ugauguugcugccaaucc

SEQ ID NO: 21437 - RNA, 18 nt, Artificial Sequence
  Description of Artificial Sequence: Synthetic oligonucleotide
uacucugauguugcugcc

SEQ ID NO: 21438 - RNA, 18 nt, Artificial Sequence
  Description of Artificial Sequence: Synthetic oligonucleotide
ucugcuacucugauguug

SEQ ID NO: 21439 - RNA, 18 nt, Artificial Sequence
  Description of Artificial Sequence: Synthetic oligonucleotide
ugaguucugcuacucuga

SEQ ID NO: 21440 - RNA, 18 nt, Artificial Sequence
  Description of Artificial Sequence: Synthetic oligonucleotide
ggagcugaguucugcuac

SEQ ID NO: 21441 - RNA, 18 nt, Artificial Sequence
  Description of Artificial Sequence: Synthetic oligonucleotide
cagugggagcugaguucu

SEQ ID NO: 21442 - RNA, 18 nt, Artificial Sequence
  Description of Artificial Sequence: Synthetic oligonucleotide
ggucccagugggagcuga

SEQ ID NO: 21443 - RNA, 18 nt, Artificial Sequence
  Description of Artificial Sequence: Synthetic oligonucleotide
ucacgggucccaguggga

SEQ ID NO: 21444 - RNA, 18 nt, Artificial Sequence
  Description of Artificial Sequence: Synthetic oligonucleotide
cagguucacgggucccag

SEQ ID NO: 21445 - RNA, 18 nt, Artificial Sequence
  Description of Artificial Sequence: Synthetic oligonucleotide
acucccagguucacgggu

SEQ ID NO: 21446 - RNA, 18 nt, Artificial Sequence
  Description of Artificial Sequence: Synthetic oligonucleotide
cucucacucccagguuca

SEQ ID NO: 21447 - RNA, 18 nt, Artificial Sequence
  Description of Artificial Sequence: Synthetic oligonucleotide
auguccucucacucccag

SEQ ID NO: 21448 - RNA, 18 nt, Artificial Sequence
  Description of Artificial Sequence: Synthetic oligonucleotide
ccuguauguccucucacu

SEQ ID NO: 21449 - RNA, 18 nt, Artificial Sequence
  Description of Artificial Sequence: Synthetic oligonucleotide
ccuggccuguauguccuc

SEQ ID NO: 21450 - RNA, 18 nt, Artificial Sequence
  Description of Artificial Sequence: Synthetic oligonucleotide
ccuccccuggccuguaug

SEQ ID NO: 21451 - RNA, 18 nt, Artificial Sequence
  Description of Artificial Sequence: Synthetic oligonucleotide
ugcguccuccccuggccu

SEQ ID NO: 21452 - RNA, 18 nt, Artificial Sequence
  Description of Artificial Sequence: Synthetic oligonucleotide
ggcucugcguccuccccu

SEQ ID NO: 21453 - RNA, 18 nt, Artificial Sequence
  Description of Artificial Sequence: Synthetic oligonucleotide
ccugaggcucugcguccu

SEQ ID NO: 21454 - RNA, 18 nt, Artificial Sequence
  Description of Artificial Sequence: Synthetic oligonucleotide
ugccucagccucccaagu

SEQ ID NO: 21455 - RNA, 18 nt, Artificial Sequence
  Description of Artificial Sequence: Synthetic oligonucleotide
ccuucugccucagccucc

SEQ ID NO: 21456 - RNA, 18 nt, Artificial Sequence
  Description of Artificial Sequence: Synthetic oligonucleotide
gcaauccuucugccucag

SEQ ID NO: 21457 - RNA, 18 nt, Artificial Sequence
  Description of Artificial Sequence: Synthetic oligonucleotide
cucaagcaauccuucugc

SEQ ID NO: 21458 - RNA, 18 nt, Artificial Sequence
  Description of Artificial Sequence: Synthetic oligonucleotide
cugggcucaagcaauccu

SEQ ID NO: 21459 - RNA, 18 nt, Artificial Sequence
  Description of Artificial Sequence: Synthetic oligonucleotide
accuccugggcucaagca

SEQ ID NO: 21460 - RNA, 18 nt, Artificial Sequence
  Description of Artificial Sequence: Synthetic oligonucleotide
ccuccaccuccugggcuc

SEQ ID NO: 21461 - RNA, 18 nt, Artificial Sequence
  Description of Artificial Sequence: Synthetic oligonucleotide
ugcagccuccaccuccug

SEQ ID NO: 21462 - RNA, 18 nt, Artificial Sequence
  Description of Artificial Sequence: Synthetic oligonucleotide
cucacugcagccuccacc

SEQ ID NO: 21463 - RNA, 18 nt, Artificial Sequence
  Description of Artificial Sequence: Synthetic oligonucleotide
cauagcucacugcagccu

SEQ ID NO: 21464 - RNA, 18 nt, Artificial Sequence
  Description of Artificial Sequence: Synthetic oligonucleotide
gugaucauagcucacugc

SEQ ID NO: 21465 - RNA, 18 nt, Artificial Sequence
  Description of Artificial Sequence: Synthetic oligonucleotide
guggugugaucauagcuc

SEQ ID NO: 21466 - RNA, 18 nt, Artificial Sequence
  Description of Artificial Sequence: Synthetic oligonucleotide
gugcaguggugugaucau

SEQ ID NO: 21467 - RNA, 18 nt, Artificial Sequence
  Description of Artificial Sequence: Synthetic oligonucleotide
uuggagugcaguggugug

SEQ ID NO: 21468 - RNA, 18 nt, Artificial Sequence
  Description of Artificial Sequence: Synthetic oligonucleotide
cuggguuggagugcagug

SEQ ID NO: 21469 - RNA, 18 nt, Artificial Sequence
  Description of Artificial Sequence: Synthetic oligonucleotide
gucgccuggguuggagug

SEQ ID NO: 21470 - RNA, 18 nt, Artificial Sequence
  Description of Artificial Sequence: Synthetic oligonucleotide
ucucugucgccuggguug

SEQ ID NO: 21471 - RNA, 18 nt, Artificial Sequence
  Description of Artificial Sequence: Synthetic oligonucleotide
gucucucucugucgccug

SEQ ID NO: 21472 - RNA, 18 nt, Artificial Sequence
  Description of Artificial Sequence: Synthetic oligonucleotide
acagggucucucucuguc

SEQ ID NO: 21473 - RNA, 18 nt, Artificial Sequence
  Description of Artificial Sequence: Synthetic oligonucleotide
aagagacagggucucucu

SEQ ID NO: 21474 - RNA, 18 nt, Artificial Sequence
  Description of Artificial Sequence: Synthetic oligonucleotide
uuuuaaagagacaggguc

SEQ ID NO: 21475 - RNA, 18 nt, Artificial Sequence
  Description of Artificial Sequence: Synthetic oligonucleotide
uuuuuuuuuaaagagaca

SEQ ID NO: 21476 - RNA, 18 nt, Artificial Sequence
  Description of Artificial Sequence: Synthetic oligonucleotide
uuuuuuuuuuuuuuaaag

SEQ ID NO: 21477 - RNA, 18 nt, Artificial Sequence
  Description of Artificial Sequence: Synthetic oligonucleotide
uuuuuuuuuuuuuuuuuu

SEQ ID NO: 21478 - RNA, 18 nt, Artificial Sequence
  Description of Artificial Sequence: Synthetic oligonucleotide
uuuuuuuuuuuuuuuuuu

SEQ ID NO: 21479 - RNA, 18 nt, Artificial Sequence
  Description of Artificial Sequence: Synthetic oligonucleotide
ugccuuuuuuuuuuuuuu

SEQ ID NO: 21480 - RNA, 18 nt, Artificial Sequence
  Description of Artificial Sequence: Synthetic oligonucleotide
uucauugccuuuuuuuuu

SEQ ID NO: 21481 - RNA, 18 nt, Artificial Sequence
  Description of Artificial Sequence: Synthetic oligonucleotide
uuuuguucauugccuuuu

SEQ ID NO: 21482 - RNA, 18 nt, Artificial Sequence
  Description of Artificial Sequence: Synthetic oligonucleotide
caugcuuuuguucauugc

SEQ ID NO: 21483 - RNA, 18 nt, Artificial Sequence
  Description of Artificial Sequence: Synthetic oligonucleotide
agagccaugcuuuuguuc

SEQ ID NO: 21484 - RNA, 18 nt, Artificial Sequence
  Description of Artificial Sequence: Synthetic oligonucleotide
gacguagagccaugcuuu

SEQ ID NO: 21485 - RNA, 18 nt, Artificial Sequence
  Description of Artificial Sequence: Synthetic oligonucleotide
uggaagacguagagccau

SEQ ID NO: 21486 - RNA, 18 nt, Artificial Sequence
  Description of Artificial Sequence: Synthetic oligonucleotide
cacuuuggaagacguaga

SEQ ID NO: 21487 - RNA, 18 nt, Artificial Sequence
  Description of Artificial Sequence: Synthetic oligonucleotide
auucucacuuuggaagac

SEQ ID NO: 21488 - RNA, 18 nt, Artificial Sequence
  Description of Artificial Sequence: Synthetic oligonucleotide
ggagaauucucacuuugg

SEQ ID NO: 21489 - RNA, 18 nt, Artificial Sequence
  Description of Artificial Sequence: Synthetic oligonucleotide
gggagggagaauucucac

SEQ ID NO: 21490 - RNA, 18 nt, Artificial Sequence
  Description of Artificial Sequence: Synthetic oligonucleotide
cuggagggaugcggaggg

SEQ ID NO: 21491 - RNA, 18 nt, Artificial Sequence
  Description of Artificial Sequence: Synthetic oligonucleotide
ucuggagggaugcggagg

SEQ ID NO: 21492 - RNA, 18 nt, Artificial Sequence
  Description of Artificial Sequence: Synthetic oligonucleotide
acaguucuggagggaugc

SEQ ID NO: 21493 - RNA, 18 nt, Artificial Sequence
  Description of Artificial Sequence: Synthetic oligonucleotide
gagcuacaguucuggagg

SEQ ID NO: 21494 - RNA, 18 nt, Artificial Sequence
  Description of Artificial Sequence: Synthetic oligonucleotide
gcucugagcuacaguucu

SEQ ID NO: 21495 - RNA, 18 nt, Artificial Sequence
  Description of Artificial Sequence: Synthetic oligonucleotide
cgugggcucugagcuaca

SEQ ID NO: 21496 - RNA, 18 nt, Artificial Sequence
  Description of Artificial Sequence: Synthetic oligonucleotide
uucagcgugggcucugag

SEQ ID NO: 21497 - RNA, 18 nt, Artificial Sequence
  Description of Artificial Sequence: Synthetic oligonucleotide
ucagauucagcgugggcu

SEQ ID NO: 21498 - RNA, 18 nt, Artificial Sequence
  Description of Artificial Sequence: Synthetic oligonucleotide
aaaagucagauucagcgu

SEQ ID NO: 21499 - RNA, 18 nt, Artificial Sequence
  Description of Artificial Sequence: Synthetic oligonucleotide
aagagaaaagucagauuc

SEQ ID NO: 21500 - RNA, 18 nt, Artificial Sequence
  Description of Artificial Sequence: Synthetic oligonucleotide
gagaaaagagaaaaguca

SEQ ID NO: 21501 - RNA, 18 nt, Artificial Sequence
  Description of Artificial Sequence: Synthetic oligonucleotide
agagagagaaaagagaaa

SEQ ID NO: 21502 - RNA, 18 nt, Artificial Sequence
  Description of Artificial Sequence: Synthetic oligonucleotide
gggagagagagagaaaag

SEQ ID NO: 21503 - RNA, 18 nt, Artificial Sequence
  Description of Artificial Sequence: Synthetic oligonucleotide
gagcagggagagagagag

SEQ ID NO: 21504 - RNA, 18 nt, Artificial Sequence
  Description of Artificial Sequence: Synthetic oligonucleotide
cucgggagcagggagaga

SEQ ID NO: 21505 - RNA, 18 nt, Artificial Sequence
  Description of Artificial Sequence: Synthetic oligonucleotide
cacugcucgggagcaggg

SEQ ID NO: 21506 - RNA, 18 nt, Artificial Sequence
  Description of Artificial Sequence: Synthetic oligonucleotide
uacuucacugcucgggag

SEQ ID NO: 21507 - RNA, 18 nt, Artificial Sequence
  Description of Artificial Sequence: Synthetic oligonucleotide
aagauuacuucacugcuc

SEQ ID NO: 21508 - RNA, 18 nt, Artificial Sequence
  Description of Artificial Sequence: Synthetic oligonucleotide
aaaaaaagauuacuucac

SEQ ID NO: 21509 - RNA, 18 nt, Artificial Sequence
  Description of Artificial Sequence: Synthetic oligonucleotide
ucaguaaaaaaagauuac

SEQ ID NO: 21510 - RNA, 18 nt, Artificial Sequence
  Description of Artificial Sequence: Synthetic oligonucleotide
aaaggucaguaaaaaaag

SEQ ID NO: 21511 - RNA, 18 nt, Artificial Sequence
  Description of Artificial Sequence: Synthetic oligonucleotide
gaagaaaaggucaguaaa

SEQ ID NO: 21512 - RNA, 18 nt, Artificial Sequence
  Description of Artificial Sequence: Synthetic oligonucleotide
aaauggaagaaaagguca

SEQ ID NO: 21513 - RNA, 18 nt, Artificial Sequence
  Description of Artificial Sequence: Synthetic oligonucleotide
aaaaaaaauggaagaaaa

SEQ ID NO: 21514 - RNA, 18 nt, Artificial Sequence
  Description of Artificial Sequence: Synthetic oligonucleotide
ggaggaaaaaaaauggaa

SEQ ID NO: 21515 - RNA, 18 nt, Artificial Sequence
  Description of Artificial Sequence: Synthetic oligonucleotide
aaagaggaggaaaaaaaa

SEQ ID NO: 21516 - RNA, 18 nt, Artificial Sequence
  Description of Artificial Sequence: Synthetic oligonucleotide
auggaaaagaggaggaaa

SEQ ID NO: 21517 - RNA, 18 nt, Artificial Sequence
  Description of Artificial Sequence: Synthetic oligonucleotide
aaucaauggaaaagagga

SEQ ID NO: 21518 - RNA, 18 nt, Artificial Sequence
  Description of Artificial Sequence: Synthetic oligonucleotide
uuucaaaucaauggaaaa

SEQ ID NO: 21519 - RNA, 18 nt, Artificial Sequence
  Description of Artificial Sequence: Synthetic oligonucleotide
agauauuucaaaucaaug

SEQ ID NO: 21520 - RNA, 18 nt, Artificial Sequence
  Description of Artificial Sequence: Synthetic oligonucleotide
aaaauagauauuucaaau

SEQ ID NO: 21521 - RNA, 18 nt, Artificial Sequence
  Description of Artificial Sequence: Synthetic oligonucleotide
augauaaaauagauauuu

SEQ ID NO: 21522 - RNA, 18 nt, Artificial Sequence
  Description of Artificial Sequence: Synthetic oligonucleotide
agagaaugauaaaauaga

SEQ ID NO: 21523 - RNA, 18 nt, Artificial Sequence
  Description of Artificial Sequence: Synthetic oligonucleotide
gaugcagagaaugauaaa

SEQ ID NO: 21524 - RNA, 18 nt, Artificial Sequence
  Description of Artificial Sequence: Synthetic oligonucleotide
agaaagaugcagagaaug

SEQ ID NO: 21525 - RNA, 18 nt, Artificial Sequence
  Description of Artificial Sequence: Synthetic oligonucleotide
gagagagaaagaugcaga

SEQ ID NO: 21526 - RNA, 18 nt, Artificial Sequence
  Description of Artificial Sequence: Synthetic oligonucleotide
aaauagagagagaaagau

SEQ ID NO: 21527 - RNA, 18 nt, Artificial Sequence
  Description of Artificial Sequence: Synthetic oligonucleotide
cgaaaaaauagagagaga

SEQ ID NO: 21528 - RNA, 18 nt, Artificial Sequence
  Description of Artificial Sequence: Synthetic oligonucleotide
cgagccgaaaaaauagag

SEQ ID NO: 21529 - RNA, 18 nt, Artificial Sequence
  Description of Artificial Sequence: Synthetic oligonucleotide
ccacacgagccgaaaaaa

SEQ ID NO: 21530 - RNA, 18 nt, Artificial Sequence
  Description of Artificial Sequence: Synthetic oligonucleotide
gaaauccacacgagccga

SEQ ID NO: 21531 - RNA, 18 nt, Artificial Sequence
  Description of Artificial Sequence: Synthetic oligonucleotide
aaaaagaaauccacacga

SEQ ID NO: 21532 - RNA, 18 nt, Artificial Sequence
  Description of Artificial Sequence: Synthetic oligonucleotide
aaagaaaaaagaaaucca

SEQ ID NO: 21533 - RNA, 18 nt, Artificial Sequence
  Description of Artificial Sequence: Synthetic oligonucleotide
agaagaaagaaaaaagaa

SEQ ID NO: 21534 - RNA, 18 nt, Artificial Sequence
  Description of Artificial Sequence: Synthetic oligonucleotide
gaaacagaagaaagaaaa

SEQ ID NO: 21535 - RNA, 18 nt, Artificial Sequence
  Description of Artificial Sequence: Synthetic oligonucleotide
caaaggaagagagguggg

SEQ ID NO: 21536 - RNA, 18 nt, Artificial Sequence
  Description of Artificial Sequence: Synthetic oligonucleotide
agaaccaaaggaagagag

SEQ ID NO: 21537 - RNA, 18 nt, Artificial Sequence
  Description of Artificial Sequence: Synthetic oligonucleotide
aacagagaaccaaaggaa

SEQ ID NO: 21538 - RNA, 18 nt, Artificial Sequence
  Description of Artificial Sequence: Synthetic oligonucleotide
augggaacagagaaccaa

SEQ ID NO: 21539 - RNA, 18 nt, Artificial Sequence
  Description of Artificial Sequence: Synthetic oligonucleotide
cgggaaugggaacagaga

SEQ ID NO: 21540 - RNA, 18 nt, Artificial Sequence
  Description of Artificial Sequence: Synthetic oligonucleotide
caaaacgggaaugggaac

SEQ ID NO: 21541 - RNA, 18 nt, Artificial Sequence
  Description of Artificial Sequence: Synthetic oligonucleotide
aaaaacaaaacgggaaug

SEQ ID NO: 21542 - RNA, 18 nt, Artificial Sequence
  Description of Artificial Sequence: Synthetic oligonucleotide
aacaaaaaaacaaaacgg

SEQ ID NO: 21543 - RNA, 18 nt, Artificial Sequence
  Description of Artificial Sequence: Synthetic oligonucleotide
acaaaaacaaaaaaacaa

SEQ ID NO: 21544 - RNA, 18 nt, Artificial Sequence
  Description of Artificial Sequence: Synthetic oligonucleotide
caaaaacaaaaacaaaaa

SEQ ID NO: 21545 - RNA, 18 nt, Artificial Sequence
  Description of Artificial Sequence: Synthetic oligonucleotide
aaaaacaaaaacaaaaac

SEQ ID NO: 21546 - RNA, 18 nt, Artificial Sequence
  Description of Artificial Sequence: Synthetic oligonucleotide
augaaaaaaacaaaaaca

SEQ ID NO: 21547 - RNA, 18 nt, Artificial Sequence
  Description of Artificial Sequence: Synthetic oligonucleotide
cagguaaggcaugcggcc

SEQ ID NO: 21548 - RNA, 18 nt, Artificial Sequence
  Description of Artificial Sequence: Synthetic oligonucleotide
auguccagguaaggcaug

SEQ ID NO: 21549 - RNA, 18 nt, Artificial Sequence
  Description of Artificial Sequence: Synthetic oligonucleotide
gauacauguccagguaag

SEQ ID NO: 21550 - RNA, 18 nt, Artificial Sequence
  Description of Artificial Sequence: Synthetic oligonucleotide
caucugauacauguccag

SEQ ID NO: 21551 - RNA, 18 nt, Artificial Sequence
  Description of Artificial Sequence: Synthetic oligonucleotide
cucagcaucugauacaug

SEQ ID NO: 21552 - RNA, 18 nt, Artificial Sequence
  Description of Artificial Sequence: Synthetic oligonucleotide
ugugucucagcaucugau

SEQ ID NO: 21553 - RNA, 18 nt, Artificial Sequence
  Description of Artificial Sequence: Synthetic oligonucleotide
agacaugugucucagcau

SEQ ID NO: 21554 - RNA, 18 nt, Artificial Sequence
  Description of Artificial Sequence: Synthetic oligonucleotide
ggcggagacaugugucuc

SEQ ID NO: 21555 - RNA, 18 nt, Artificial Sequence
  Description of Artificial Sequence: Synthetic oligonucleotide
gggcggagacaugugucu

SEQ ID NO: 21556 - RNA, 18 nt, Artificial Sequence
  Description of Artificial Sequence: Synthetic oligonucleotide
ucuuccccagacccaggg

SEQ ID NO: 21557 - RNA, 18 nt, Artificial Sequence
  Description of Artificial Sequence: Synthetic oligonucleotide
acacuucuuccccagacc

SEQ ID NO: 21558 - RNA, 18 nt, Artificial Sequence
  Description of Artificial Sequence: Synthetic oligonucleotide
gccggacacuucuucccc

SEQ ID NO: 21559 - RNA, 18 nt, Artificial Sequence
  Description of Artificial Sequence: Synthetic oligonucleotide
cucuggccggacacuucu

SEQ ID NO: 21560 - RNA, 18 nt, Artificial Sequence
  Description of Artificial Sequence: Synthetic oligonucleotide
agccacucuggccggaca

SEQ ID NO: 21561 - RNA, 18 nt, Artificial Sequence
  Description of Artificial Sequence: Synthetic oligonucleotide
uuguaagccacucuggcc

SEQ ID NO: 21562 - RNA, 18 nt, Artificial Sequence
  Description of Artificial Sequence: Synthetic oligonucleotide
ccagguaaggcaugcggc

SEQ ID NO: 21563 - RNA, 18 nt, Artificial Sequence
  Description of Artificial Sequence: Synthetic oligonucleotide
cauguccagguaaggcau

SEQ ID NO: 21564 - RNA, 18 nt, Artificial Sequence
  Description of Artificial Sequence: Synthetic oligonucleotide
ugauacauguccagguaa

SEQ ID NO: 21565 - RNA, 18 nt, Artificial Sequence
  Description of Artificial Sequence: Synthetic oligonucleotide
gcaucugauacaugucca

SEQ ID NO: 21566 - RNA, 18 nt, Artificial Sequence
  Description of Artificial Sequence: Synthetic oligonucleotide
ucucagcaucugauacau

SEQ ID NO: 21567 - RNA, 18 nt, Artificial Sequence
  Description of Artificial Sequence: Synthetic oligonucleotide
augugucucagcaucuga

SEQ ID NO: 21568 - RNA, 18 nt, Artificial Sequence
  Description of Artificial Sequence: Synthetic oligonucleotide
gagacaugugucucagca

SEQ ID NO: 21569 - RNA, 18 nt, Artificial Sequence
  Description of Artificial Sequence: Synthetic oligonucleotide
gggcggagacaugugucu

SEQ ID NO: 21570 - RNA, 18 nt, Artificial Sequence
  Description of Artificial Sequence: Synthetic oligonucleotide
ucuuccccagacccaggg

SEQ ID NO: 21571 - RNA, 18 nt, Artificial Sequence
  Description of Artificial Sequence: Synthetic oligonucleotide
acuucuuccccagaccca

SEQ ID NO: 21572 - RNA, 18 nt, Artificial Sequence
  Description of Artificial Sequence: Synthetic oligonucleotide
cggacacuucuuccccag

SEQ ID NO: 21573 - RNA, 18 nt, Artificial Sequence
  Description of Artificial Sequence: Synthetic oligonucleotide
cuggccggacacuucuuc

SEQ ID NO: 21574 - RNA, 18 nt, Artificial Sequence
  Description of Artificial Sequence: Synthetic oligonucleotide
ccacucuggccggacacu

SEQ ID NO: 21575 - RNA, 18 nt, Artificial Sequence
  Description of Artificial Sequence: Synthetic oligonucleotide
guaagccacucuggccgg

SEQ ID NO: 21576 - RNA, 18 nt, Artificial Sequence
  Description of Artificial Sequence: Synthetic oligonucleotide
gguggucggcaaggguag

SEQ ID NO: 21577 - RNA, 18 nt, Artificial Sequence
  Description of Artificial Sequence: Synthetic oligonucleotide
acgucgguggucggcaag

SEQ ID NO: 21578 - RNA, 18 nt, Artificial Sequence
  Description of Artificial Sequence: Synthetic oligonucleotide
ccuggacgucgguggucg

SEQ ID NO: 21579 - RNA, 18 nt, Artificial Sequence
  Description of Artificial Sequence: Synthetic oligonucleotide
cagugccuggacgucggu

SEQ ID NO: 21580 - RNA, 18 nt, Artificial Sequence
  Description of Artificial Sequence: Synthetic oligonucleotide
aaacccagugccuggacg

SEQ ID NO: 21581 - RNA, 18 nt, Artificial Sequence
  Description of Artificial Sequence: Synthetic oligonucleotide
aaaaaaaacccagugccu

SEQ ID NO: 21582 - RNA, 18 nt, Artificial Sequence
  Description of Artificial Sequence: Synthetic oligonucleotide
gaagaaaaaaaaacccag

SEQ ID NO: 21583 - RNA, 18 nt, Artificial Sequence
  Description of Artificial Sequence: Synthetic oligonucleotide
aagaagaagaaaaaaaaa

SEQ ID NO: 21584 - RNA, 18 nt, Artificial Sequence
  Description of Artificial Sequence: Synthetic oligonucleotide
agaagaagaagaagaaaa

SEQ ID NO: 21585 - RNA, 18 nt, Artificial Sequence
  Description of Artificial Sequence: Synthetic oligonucleotide
aaaaaagaagaagaagaa

SEQ ID NO: 21586 - RNA, 18 nt, Artificial Sequence
  Description of Artificial Sequence: Synthetic oligonucleotide
cuaaaaaaaaagaagaag

SEQ ID NO: 21587 - RNA, 18 nt, Artificial Sequence
  Description of Artificial Sequence: Synthetic oligonucleotide
cagcacuaaaaaaaaaga

SEQ ID NO: 21588 - RNA, 18 nt, Artificial Sequence
  Description of Artificial Sequence: Synthetic oligonucleotide
cuggucagcacuaaaaaa

SEQ ID NO: 21589 - RNA, 18 nt, Artificial Sequence
  Description of Artificial Sequence: Synthetic oligonucleotide
uguuucuggucagcacua

SEQ ID NO: 21590 - RNA, 18 nt, Artificial Sequence
  Description of Artificial Sequence: Synthetic oligonucleotide
ccggguguuucuggucag

SEQ ID NO: 21591 - RNA, 18 nt, Artificial Sequence
  Description of Artificial Sequence: Synthetic oligonucleotide
gucggccggguguuucug

SEQ ID NO: 21592 - RNA, 18 nt, Artificial Sequence
  Description of Artificial Sequence: Synthetic oligonucleotide
agagagucggccgggugu

SEQ ID NO: 21593 - RNA, 18 nt, Artificial Sequence
  Description of Artificial Sequence: Synthetic oligonucleotide
gaaaaagagagucggccg

SEQ ID NO: 21594 - RNA, 18 nt, Artificial Sequence
  Description of Artificial Sequence: Synthetic oligonucleotide
cguuggaaaaagagaguc

SEQ ID NO: 21595 - RNA, 18 nt, Artificial Sequence
  Description of Artificial Sequence: Synthetic oligonucleotide
agaaacguuggaaaaaga

SEQ ID NO: 21596 - RNA, 18 nt, Artificial Sequence
  Description of Artificial Sequence: Synthetic oligonucleotide
agaagagaaacguuggaa

SEQ ID NO: 21597 - RNA, 18 nt, Artificial Sequence
  Description of Artificial Sequence: Synthetic oligonucleotide
aaaaaagaagagaaacgu

SEQ ID NO: 21598 - RNA, 18 nt, Artificial Sequence
  Description of Artificial Sequence: Synthetic oligonucleotide
aaaacaaaaaagaagaga

SEQ ID NO: 21599 - RNA, 18 nt, Artificial Sequence
  Description of Artificial Sequence: Synthetic oligonucleotide
aaucaaaaacaaaaaaga

SEQ ID NO: 21600 - RNA, 18 nt, Artificial Sequence
  Description of Artificial Sequence: Synthetic oligonucleotide
aaaagaaucaaaaacaaa

SEQ ID NO: 21601 - RNA, 18 nt, Artificial Sequence
  Description of Artificial Sequence: Synthetic oligonucleotide
gaaaaaaaagaaucaaaa

SEQ ID NO: 21602 - RNA, 18 nt, Artificial Sequence
  Description of Artificial Sequence: Synthetic oligonucleotide
gaaaagaaaaaaaagaau

SEQ ID NO: 21603 - RNA, 18 nt, Artificial Sequence
  Description of Artificial Sequence: Synthetic oligonucleotide
cucgagaaaagaaaaaaa

SEQ ID NO: 21604 - RNA, 18 nt, Artificial Sequence
  Description of Artificial Sequence: Synthetic oligonucleotide
guugacucgagaaaagaa

SEQ ID NO: 21605 - RNA, 18 nt, Artificial Sequence
  Description of Artificial Sequence: Synthetic oligonucleotide
gaucaguugacucgagaa

SEQ ID NO: 21606 - RNA, 18 nt, Artificial Sequence
  Description of Artificial Sequence: Synthetic oligonucleotide
gucaugaucaguugacuc

SEQ ID NO: 21607 - RNA, 18 nt, Artificial Sequence
  Description of Artificial Sequence: Synthetic oligonucleotide
ggauggucaugaucaguu

SEQ ID NO: 21608 - RNA, 18 nt, Artificial Sequence
  Description of Artificial Sequence: Synthetic oligonucleotide
ucaagggauggucaugau

SEQ ID NO: 21609 - RNA, 18 nt, Artificial Sequence
  Description of Artificial Sequence: Synthetic oligonucleotide
uagaaucaagggaugguc

SEQ ID NO: 21610 - RNA, 18 nt, Artificial Sequence
  Description of Artificial Sequence: Synthetic oligonucleotide
cugcuuagaaucaaggga

SEQ ID NO: 21611 - RNA, 18 nt, Artificial Sequence
  Description of Artificial Sequence: Synthetic oligonucleotide
gugugcugcuuagaauca

SEQ ID NO: 21612 - RNA, 18 nt, Artificial Sequence
  Description of Artificial Sequence: Synthetic oligonucleotide
acacagugugcugcuuag

SEQ ID NO: 21613 - RNA, 18 nt, Artificial Sequence
  Description of Artificial Sequence: Synthetic oligonucleotide
gacggacacagugugcug

SEQ ID NO: 21614 - RNA, 18 nt, Artificial Sequence
  Description of Artificial Sequence: Synthetic oligonucleotide
gaaaggacggacacagug

SEQ ID NO: 21615 - RNA, 18 nt, Artificial Sequence
  Description of Artificial Sequence: Synthetic oligonucleotide
caucagaaaggacggaca

SEQ ID NO: 21616 - RNA, 18 nt, Artificial Sequence
  Description of Artificial Sequence: Synthetic oligonucleotide
acacucaucagaaaggac

SEQ ID NO: 21617 - RNA, 18 nt, Artificial Sequence
  Description of Artificial Sequence: Synthetic oligonucleotide
cgaagacacucaucagaa

SEQ ID NO: 21618 - RNA, 18 nt, Artificial Sequence
  Description of Artificial Sequence: Synthetic oligonucleotide
aaacacgaagacacucau

SEQ ID NO: 21619 - RNA, 18 nt, Artificial Sequence
  Description of Artificial Sequence: Synthetic oligonucleotide
ucucaaaacacgaagaca

SEQ ID NO: 21620 - RNA, 18 nt, Artificial Sequence
  Description of Artificial Sequence: Synthetic oligonucleotide
uggagucucaaaacacga

SEQ ID NO: 21621 - RNA, 18 nt, Artificial Sequence
  Description of Artificial Sequence: Synthetic oligonucleotide
cauaauggagucucaaaa

SEQ ID NO: 21622 - RNA, 18 nt, Artificial Sequence
  Description of Artificial Sequence: Synthetic oligonucleotide
ucggccauaauggagucu

SEQ ID NO: 21623 - RNA, 18 nt, Artificial Sequence
  Description of Artificial Sequence: Synthetic oligonucleotide
gcaugucggccauaaugg

SEQ ID NO: 21624 - RNA, 18 nt, Artificial Sequence
  Description of Artificial Sequence: Synthetic oligonucleotide
ccccggcaugucggccau

SEQ ID NO: 21625 - RNA, 18 nt, Artificial Sequence
  Description of Artificial Sequence: Synthetic oligonucleotide
ccuccccccggcaugucg

SEQ ID NO: 21626 - RNA, 18 nt, Artificial Sequence
  Description of Artificial Sequence: Synthetic oligonucleotide
cucccccuccccccggca

SEQ ID NO: 21627 - RNA, 18 nt, Artificial Sequence
  Description of Artificial Sequence: Synthetic oligonucleotide
cuccccucccccuccccc

SEQ ID NO: 21628 - RNA, 18 nt, Artificial Sequence
  Description of Artificial Sequence: Synthetic oligonucleotide
gggcgcuccccucccccu

SEQ ID NO: 21629 - RNA, 18 nt, Artificial Sequence
  Description of Artificial Sequence: Synthetic oligonucleotide
gaccugggcgcuccccuc

SEQ ID NO: 21630 - RNA, 18 nt, Artificial Sequence
  Description of Artificial Sequence: Synthetic oligonucleotide
gggaccugggcgcucccc

SEQ ID NO: 21631 - RNA, 18 nt, Artificial Sequence
  Description of Artificial Sequence: Synthetic oligonucleotide
ggagaccaggugcaaggg

SEQ ID NO: 21632 - RNA, 18 nt, Artificial Sequence
  Description of Artificial Sequence: Synthetic oligonucleotide
accugggagaccaggugc

SEQ ID NO: 21633 - RNA, 18 nt, Artificial Sequence
  Description of Artificial Sequence: Synthetic oligonucleotide
uugguaccugggagacca

SEQ ID NO: 21634 - RNA, 18 nt, Artificial Sequence
  Description of Artificial Sequence: Synthetic oligonucleotide
ccaauuugguaccuggga

SEQ ID NO: 21635 - RNA, 18 nt, Artificial Sequence
  Description of Artificial Sequence: Synthetic oligonucleotide
uguuuccaauuugguacc

SEQ ID NO: 21636 - RNA, 18 nt, Artificial Sequence
  Description of Artificial Sequence: Synthetic oligonucleotide
guguuuguuuccaauuug

SEQ ID NO: 21637 - RNA, 18 nt, Artificial Sequence
  Description of Artificial Sequence: Synthetic oligonucleotide
gaagcguguuuguuucca

SEQ ID NO: 21638 - RNA, 18 nt, Artificial Sequence
  Description of Artificial Sequence: Synthetic oligonucleotide
cugaagaagcguguuugu

SEQ ID NO: 21639 - RNA, 18 nt, Artificial Sequence
  Description of Artificial Sequence: Synthetic oligonucleotide
acucccugaagaagcgug

SEQ ID NO: 21640 - RNA, 18 nt, Artificial Sequence
  Description of Artificial Sequence: Synthetic oligonucleotide
uuuugacucccugaagaa

SEQ ID NO: 21641 - RNA, 18 nt, Artificial Sequence
  Description of Artificial Sequence: Synthetic oligonucleotide
auggguuuugacucccug

SEQ ID NO: 21642 - RNA, 18 nt, Artificial Sequence
  Description of Artificial Sequence: Synthetic oligonucleotide
gaagcauggguuuugacu

SEQ ID NO: 21643 - RNA, 18 nt, Artificial Sequence
  Description of Artificial Sequence: Synthetic oligonucleotide
agugggaagcauggguuu

SEQ ID NO: 21644 - RNA, 18 nt, Artificial Sequence
  Description of Artificial Sequence: Synthetic oligonucleotide
gcagaagugggaagcaug

SEQ ID NO: 21645 - RNA, 18 nt, Artificial Sequence
  Description of Artificial Sequence: Synthetic oligonucleotide
ggugggcagaagugggaa

SEQ ID NO: 21646 - RNA, 18 nt, Artificial Sequence
  Description of Artificial Sequence: Synthetic oligonucleotide
cucugggugggcagaagu

SEQ ID NO: 21647 - RNA, 18 nt, Artificial Sequence
  Description of Artificial Sequence: Synthetic oligonucleotide
ggccgcucugggugggca

SEQ ID NO: 21648 - RNA, 18 nt, Artificial Sequence
  Description of Artificial Sequence: Synthetic oligonucleotide
gggccgcucugggugggc

SEQ ID NO: 21649 - RNA, 18 nt, Artificial Sequence
  Description of Artificial Sequence: Synthetic oligonucleotide
ccccagccugggcauggg

SEQ ID NO: 21650 - RNA, 18 nt, Artificial Sequence
  Description of Artificial Sequence: Synthetic oligonucleotide
gccugccccagccugggc

SEQ ID NO: 21651 - RNA, 18 nt, Artificial Sequence
  Description of Artificial Sequence: Synthetic oligonucleotide
aaggcgccugccccagcc

SEQ ID NO: 21652 - RNA, 18 nt, Artificial Sequence
  Description of Artificial Sequence: Synthetic oligonucleotide
ucugcaaggcgccugccc

SEQ ID NO: 21653 - RNA, 18 nt, Artificial Sequence
  Description of Artificial Sequence: Synthetic oligonucleotide
cccucucugcaaggcgcc

SEQ ID NO: 21654 - RNA, 18 nt, Artificial Sequence
  Description of Artificial Sequence: Synthetic oligonucleotide
aaagccccucucugcaag

SEQ ID NO: 21655 - RNA, 18 nt, Artificial Sequence
  Description of Artificial Sequence: Synthetic oligonucleotide
gggcuaaagccccucucu

SEQ ID NO: 21656 - RNA, 18 nt, Artificial Sequence
  Description of Artificial Sequence: Synthetic oligonucleotide
gggaccucgccugcuuuc

SEQ ID NO: 21657 - RNA, 18 nt, Artificial Sequence
  Description of Artificial Sequence: Synthetic oligonucleotide
gacccgggaccucgccug

SEQ ID NO: 21658 - RNA, 18 nt, Artificial Sequence
  Description of Artificial Sequence: Synthetic oligonucleotide
gggacccgggaccucgcc

SEQ ID NO: 21659 - RNA, 18 nt, Artificial Sequence
  Description of Artificial Sequence: Synthetic oligonucleotide
caggugugcguggcaggg

SEQ ID NO: 21660 - RNA, 18 nt, Artificial Sequence
  Description of Artificial Sequence: Synthetic oligonucleotide
agcuucaggugugcgugg

SEQ ID NO: 21661 - RNA, 18 nt, Artificial Sequence
  Description of Artificial Sequence: Synthetic oligonucleotide
agaucagcuucaggugug

SEQ ID NO: 21662 - RNA, 18 nt, Artificial Sequence
  Description of Artificial Sequence: Synthetic oligonucleotide
gucagagaucagcuucag

SEQ ID NO: 21663 - RNA, 18 nt, Artificial Sequence
  Description of Artificial Sequence: Synthetic oligonucleotide
ccuaggucagagaucagc

SEQ ID NO: 21664 - RNA, 18 nt, Artificial Sequence
  Description of Artificial Sequence: Synthetic oligonucleotide
aaggcccuaggucagaga

SEQ ID NO: 21665 - RNA, 18 nt, Artificial Sequence
  Description of Artificial Sequence: Synthetic oligonucleotide
uccccaaggcccuagguc

SEQ ID NO: 21666 - RNA, 18 nt, Artificial Sequence
  Description of Artificial Sequence: Synthetic oligonucleotide
ucgaauccccaaggcccu

SEQ ID NO: 21667 - RNA, 18 nt, Artificial Sequence
  Description of Artificial Sequence: Synthetic oligonucleotide
cauuccucugagaagcag

SEQ ID NO: 21668 - RNA, 18 nt, Artificial Sequence
  Description of Artificial Sequence: Synthetic oligonucleotide
cacaucauuccucugaga

SEQ ID NO: 21669 - RNA, 18 nt, Artificial Sequence
  Description of Artificial Sequence: Synthetic oligonucleotide
cagaccacaucauuccuc

SEQ ID NO: 21670 - RNA, 18 nt, Artificial Sequence
  Description of Artificial Sequence: Synthetic oligonucleotide
gggcacagaccacaucau

SEQ ID NO: 21671 - RNA, 18 nt, Artificial Sequence
  Description of Artificial Sequence: Synthetic oligonucleotide
cagaugggcacagaccac

SEQ ID NO: 21672 - RNA, 18 nt, Artificial Sequence
  Description of Artificial Sequence: Synthetic oligonucleotide
cagagcagaugggcacag

SEQ ID NO: 21673 - RNA, 18 nt, Artificial Sequence
  Description of Artificial Sequence: Synthetic oligonucleotide
caggacagagcagauggg

SEQ ID NO: 21674 - RNA, 18 nt, Artificial Sequence
  Description of Artificial Sequence: Synthetic oligonucleotide
cagaccaggacagagcag

SEQ ID NO: 21675 - RNA, 18 nt, Artificial Sequence
  Description of Artificial Sequence: Synthetic oligonucleotide
uggcccagaccaggacag

SEQ ID NO: 21676 - RNA, 18 nt, Artificial Sequence
  Description of Artificial Sequence: Synthetic oligonucleotide
uggcuuggcccagaccag

SEQ ID NO: 21677 - RNA, 18 nt, Artificial Sequence
  Description of Artificial Sequence: Synthetic oligonucleotide
aucccuggcuuggcccag

SEQ ID NO: 21678 - RNA, 18 nt, Artificial Sequence
  Description of Artificial Sequence: Synthetic oligonucleotide
acccaaucccuggcuugg

SEQ ID NO: 21679 - RNA, 18 nt, Artificial Sequence
  Description of Artificial Sequence: Synthetic oligonucleotide
cccacacccaaucccugg

SEQ ID NO: 21680 - RNA, 18 nt, Artificial Sequence
  Description of Artificial Sequence: Synthetic oligonucleotide
ggcuccccacacccaauc

SEQ ID NO: 21681 - RNA, 18 nt, Artificial Sequence
  Description of Artificial Sequence: Synthetic oligonucleotide
ccacuggcuccccacacc

SEQ ID NO: 21682 - RNA, 18 nt, Artificial Sequence
  Description of Artificial Sequence: Synthetic oligonucleotide
gggugccacuggcucccc

SEQ ID NO: 21683 - RNA, 18 nt, Artificial Sequence
  Description of Artificial Sequence: Synthetic oligonucleotide
accacagccgcugguggg

SEQ ID NO: 21684 - RNA, 18 nt, Artificial Sequence
  Description of Artificial Sequence: Synthetic oligonucleotide
aggaccacagccgcuggu

SEQ ID NO: 21685 - RNA, 18 nt, Artificial Sequence
  Description of Artificial Sequence: Synthetic oligonucleotide
gggccaggaccacagccg

SEQ ID NO: 21686 - RNA, 18 nt, Artificial Sequence
  Description of Artificial Sequence: Synthetic oligonucleotide
aacagccaaggcugaggg

SEQ ID NO: 21687 - RNA, 18 nt, Artificial Sequence
  Description of Artificial Sequence: Synthetic oligonucleotide
augcaacagccaaggcug

SEQ ID NO: 21688 - RNA, 18 nt, Artificial Sequence
  Description of Artificial Sequence: Synthetic oligonucleotide
agugcaugcaacagccaa

SEQ ID NO: 21689 - RNA, 18 nt, Artificial Sequence
  Description of Artificial Sequence: Synthetic oligonucleotide
ugagcagugcaugcaaca

SEQ ID NO: 21690 - RNA, 18 nt, Artificial Sequence
  Description of Artificial Sequence: Synthetic oligonucleotide
ggauuugagcagugcaug

SEQ ID NO: 21691 - RNA, 18 nt, Artificial Sequence
  Description of Artificial Sequence: Synthetic oligonucleotide
aagcuggauuugagcagu

SEQ ID NO: 21692 - RNA, 18 nt, Artificial Sequence
  Description of Artificial Sequence: Synthetic oligonucleotide
agcacaagcuggauuuga

SEQ ID NO: 21693 - RNA, 18 nt, Artificial Sequence
  Description of Artificial Sequence: Synthetic oligonucleotide
aaaagagcacaagcugga

SEQ ID NO: 21694 - RNA, 18 nt, Artificial Sequence
  Description of Artificial Sequence: Synthetic oligonucleotide
aaagaaaaagagcacaag

SEQ ID NO: 21695 - RNA, 18 nt, Artificial Sequence
  Description of Artificial Sequence: Synthetic oligonucleotide
accccaaagaaaaagagc

SEQ ID NO: 21696 - RNA, 18 nt, Artificial Sequence
  Description of Artificial Sequence: Synthetic oligonucleotide
gucugaccccaaagaaaa

SEQ ID NO: 21697 - RNA, 18 nt, Artificial Sequence
  Description of Artificial Sequence: Synthetic oligonucleotide
uuucagucugaccccaaa

SEQ ID NO: 21698 - RNA, 18 nt, Artificial Sequence
  Description of Artificial Sequence: Synthetic oligonucleotide
ccccguuucagucugacc

SEQ ID NO: 21699 - RNA, 18 nt, Artificial Sequence
  Description of Artificial Sequence: Synthetic oligonucleotide
gauggccccguuucaguc

SEQ ID NO: 21700 - RNA, 18 nt, Artificial Sequence
  Description of Artificial Sequence: Synthetic oligonucleotide
uucuggauggccccguuu

SEQ ID NO: 21701 - RNA, 18 nt, Artificial Sequence
  Description of Artificial Sequence: Synthetic oligonucleotide
aguucuucuggauggccc

SEQ ID NO: 21702 - RNA, 18 nt, Artificial Sequence
  Description of Artificial Sequence: Synthetic oligonucleotide
cccagaguucuucuggau

SEQ ID NO: 21703 - RNA, 18 nt, Artificial Sequence
  Description of Artificial Sequence: Synthetic oligonucleotide
ccugccccagaguucuuc

SEQ ID NO: 21704 - RNA, 18 nt, Artificial Sequence
  Description of Artificial Sequence: Synthetic oligonucleotide
cccgcccugccccagagu

SEQ ID NO: 21705 - RNA, 18 nt, Artificial Sequence
  Description of Artificial Sequence: Synthetic oligonucleotide
ccacccccgcccugcccc

SEQ ID NO: 21706 - RNA, 18 nt, Artificial Sequence
  Description of Artificial Sequence: Synthetic oligonucleotide
uugccccacccccgcccu

SEQ ID NO: 21707 - RNA, 18 nt, Artificial Sequence
  Description of Artificial Sequence: Synthetic oligonucleotide
aacccuugccccaccccc

SEQ ID NO: 21708 - RNA, 18 nt, Artificial Sequence
  Description of Artificial Sequence: Synthetic oligonucleotide
gccucaacccuugcccca

SEQ ID NO: 21709 - RNA, 18 nt, Artificial Sequence
  Description of Artificial Sequence: Synthetic oligonucleotide
gguuugccucaacccuug

SEQ ID NO: 21710 - RNA, 18 nt, Artificial Sequence
  Description of Artificial Sequence: Synthetic oligonucleotide
uccaggguuugccucaac

SEQ ID NO: 21711 - RNA, 18 nt, Artificial Sequence
  Description of Artificial Sequence: Synthetic oligonucleotide
gcauuuccaggguuugcc

SEQ ID NO: 21712 - RNA, 18 nt, Artificial Sequence
  Description of Artificial Sequence: Synthetic oligonucleotide
agcuggcauuuccagggu

SEQ ID NO: 21713 - RNA, 18 nt, Artificial Sequence
  Description of Artificial Sequence: Synthetic oligonucleotide
cugagagcuggcauuucc

SEQ ID NO: 21714 - RNA, 18 nt, Artificial Sequence
  Description of Artificial Sequence: Synthetic oligonucleotide
uugaccugagagcuggca

SEQ ID NO: 21715 - RNA, 18 nt, Artificial Sequence
  Description of Artificial Sequence: Synthetic oligonucleotide
ccugcuugaccugagagc

SEQ ID NO: 21716 - RNA, 18 nt, Artificial Sequence
  Description of Artificial Sequence: Synthetic oligonucleotide
ccccaccugcuugaccug

SEQ ID NO: 21717 - RNA, 18 nt, Artificial Sequence
  Description of Artificial Sequence: Synthetic oligonucleotide
uuuucccccaccugcuug

SEQ ID NO: 21718 - RNA, 18 nt, Artificial Sequence
  Description of Artificial Sequence: Synthetic oligonucleotide
uccuuuuuucccccaccu

SEQ ID NO: 21719 - RNA, 18 nt, Artificial Sequence
  Description of Artificial Sequence: Synthetic oligonucleotide
cccucuccuuuuuucccc

SEQ ID NO: 21720 - RNA, 18 nt, Artificial Sequence
  Description of Artificial Sequence: Synthetic oligonucleotide
cccugcccucuccuuuuu

SEQ ID NO: 21721 - RNA, 18 nt, Artificial Sequence
  Description of Artificial Sequence: Synthetic oligonucleotide
ugguccccugcccucucc

SEQ ID NO: 21722 - RNA, 18 nt, Artificial Sequence
  Description of Artificial Sequence: Synthetic oligonucleotide
acuucugguccccugccc

SEQ ID NO: 21723 - RNA, 18 nt, Artificial Sequence
  Description of Artificial Sequence: Synthetic oligonucleotide
cuuguacuucuggucccc

SEQ ID NO: 21724 - RNA, 18 nt, Artificial Sequence
  Description of Artificial Sequence: Synthetic oligonucleotide
gcucucuuguacuucugg

SEQ ID NO: 21725 - RNA, 18 nt, Artificial Sequence
  Description of Artificial Sequence: Synthetic oligonucleotide
aaaaggcucucuuguacu

SEQ ID NO: 21726 - RNA, 18 nt, Artificial Sequence
  Description of Artificial Sequence: Synthetic oligonucleotide
ggcacaaaaggcucucuu

SEQ ID NO: 21727 - RNA, 18 nt, Artificial Sequence
  Description of Artificial Sequence: Synthetic oligonucleotide
gggagggcacaaaaggcu

SEQ ID NO: 21728 - RNA, 18 nt, Artificial Sequence
  Description of Artificial Sequence: Synthetic oligonucleotide
ccgcagggagggcacaaa

SEQ ID NO: 21729 - RNA, 18 nt, Artificial Sequence
  Description of Artificial Sequence: Synthetic oligonucleotide
guggcccgcagggagggc

SEQ ID NO: 21730 - RNA, 18 nt, Artificial Sequence
  Description of Artificial Sequence: Synthetic oligonucleotide
ucuugguggcccgcaggg

SEQ ID NO: 21731 - RNA, 18 nt, Artificial Sequence
  Description of Artificial Sequence: Synthetic oligonucleotide
guuucucuugguggcccg

SEQ ID NO: 21732 - RNA, 18 nt, Artificial Sequence
  Description of Artificial Sequence: Synthetic oligonucleotide
acucaguuucucuuggug

SEQ ID NO: 21733 - RNA, 18 nt, Artificial Sequence
  Description of Artificial Sequence: Synthetic oligonucleotide
ccaguacucaguuucucu

SEQ ID NO: 21734 - RNA, 18 nt, Artificial Sequence
  Description of Artificial Sequence: Synthetic oligonucleotide
cugucccaguacucaguu

SEQ ID NO: 21735 - RNA, 18 nt, Artificial Sequence
  Description of Artificial Sequence: Synthetic oligonucleotide
guuaccugucccaguacu

SEQ ID NO: 21736 - RNA, 18 nt, Artificial Sequence
  Description of Artificial Sequence: Synthetic oligonucleotide
cuuagguuaccuguccca

SEQ ID NO: 21737 - RNA, 18 nt, Artificial Sequence
  Description of Artificial Sequence: Synthetic oligonucleotide
ucuuacuuagguuaccug

SEQ ID NO: 21738 - RNA, 18 nt, Artificial Sequence
  Description of Artificial Sequence: Synthetic oligonucleotide
gugucucuuacuuagguu

SEQ ID NO: 21739 - RNA, 18 nt, Artificial Sequence
  Description of Artificial Sequence: Synthetic oligonucleotide
cugaggugucucuuacuu

SEQ ID NO: 21740 - RNA, 18 nt, Artificial Sequence
  Description of Artificial Sequence: Synthetic oligonucleotide
ggcggcugaggugucucu

SEQ ID NO: 21741 - RNA, 18 nt, Artificial Sequence
  Description of Artificial Sequence: Synthetic oligonucleotide
gcuguggcggcugaggug

SEQ ID NO: 21742 - RNA, 18 nt, Artificial Sequence
  Description of Artificial Sequence: Synthetic oligonucleotide
ugaaagcuguggcggcug

SEQ ID NO: 21743 - RNA, 18 nt, Artificial Sequence
  Description of Artificial Sequence: Synthetic oligonucleotide
aacucugaaagcuguggc

SEQ ID NO: 21744 - RNA, 18 nt, Artificial Sequence
  Description of Artificial Sequence: Synthetic oligonucleotide
ggaagaacucugaaagcu

SEQ ID NO: 21745 - RNA, 18 nt, Artificial Sequence
  Description of Artificial Sequence: Synthetic oligonucleotide
ucccaggaagaacucuga

SEQ ID NO: 21746 - RNA, 18 nt, Artificial Sequence
  Description of Artificial Sequence: Synthetic oligonucleotide
gggagucccaggaagaac

SEQ ID NO: 21747 - RNA, 18 nt, Artificial Sequence
  Description of Artificial Sequence: Synthetic oligonucleotide
acccagggagucccagga

SEQ ID NO: 21748 - RNA, 18 nt, Artificial Sequence
  Description of Artificial Sequence: Synthetic oligonucleotide
ccccuacccagggagucc

SEQ ID NO: 21749 - RNA, 18 nt, Artificial Sequence
  Description of Artificial Sequence: Synthetic oligonucleotide
gcccgccccuacccaggg

SEQ ID NO: 21750 - RNA, 18 nt, Artificial Sequence
  Description of Artificial Sequence: Synthetic oligonucleotide
gccgcgcccgccccuacc

SEQ ID NO: 21751 - RNA, 18 nt, Artificial Sequence
  Description of Artificial Sequence: Synthetic oligonucleotide
cgugagccgcgcccgccc

SEQ ID NO: 21752 - RNA, 18 nt, Artificial Sequence
  Description of Artificial Sequence: Synthetic oligonucleotide
ucucccgugagccgcgcc

SEQ ID NO: 21753 - RNA, 18 nt, Artificial Sequence
  Description of Artificial Sequence: Synthetic oligonucleotide
cugggucucccgugagcc

SEQ ID NO: 21754 - RNA, 18 nt, Artificial Sequence
  Description of Artificial Sequence: Synthetic oligonucleotide
cccuccugggucucccgu

SEQ ID NO: 21755 - RNA, 18 nt, Artificial Sequence
  Description of Artificial Sequence: Synthetic oligonucleotide
ggcaucccuccugggucu

SEQ ID NO: 21756 - RNA, 18 nt, Artificial Sequence
  Description of Artificial Sequence: Synthetic oligonucleotide
ucccaggcaucccuccug

SEQ ID NO: 21757 - RNA, 18 nt, Artificial Sequence
  Description of Artificial Sequence: Synthetic oligonucleotide
gucauucccaggcauccc

SEQ ID NO: 21758 - RNA, 18 nt, Artificial Sequence
  Description of Artificial Sequence: Synthetic oligonucleotide
gcgcagucauucccaggc

SEQ ID NO: 21759 - RNA, 18 nt, Artificial Sequence
  Description of Artificial Sequence: Synthetic oligonucleotide
ggcaagcgcagucauucc

SEQ ID NO: 21760 - RNA, 18 nt, Artificial Sequence
  Description of Artificial Sequence: Synthetic oligonucleotide
gguccauccgcagaagcc

SEQ ID NO: 21761 - RNA, 18 nt, Artificial Sequence
  Description of Artificial Sequence: Synthetic oligonucleotide
gggcagguccauccgcag

SEQ ID NO: 21762 - RNA, 18 nt, Artificial Sequence
  Description of Artificial Sequence: Synthetic oligonucleotide
gcgacgggcagguccauc

SEQ ID NO: 21763 - RNA, 18 nt, Artificial Sequence
  Description of Artificial Sequence: Synthetic oligonucleotide
caucugcgacgggcaggu

SEQ ID NO: 21764 - RNA, 18 nt, Artificial Sequence
  Description of Artificial Sequence: Synthetic oligonucleotide
guugucaucugcgacggg

SEQ ID NO: 21765 - RNA, 18 nt, Artificial Sequence
  Description of Artificial Sequence: Synthetic oligonucleotide
acgguguugucaucugcg

SEQ ID NO: 21766 - RNA, 18 nt, Artificial Sequence
  Description of Artificial Sequence: Synthetic oligonucleotide
aguggacgguguugucau

SEQ ID NO: 21767 - RNA, 18 nt, Artificial Sequence
  Description of Artificial Sequence: Synthetic oligonucleotide
auugaaguggacgguguu

SEQ ID NO: 21768 - RNA, 18 nt, Artificial Sequence
  Description of Artificial Sequence: Synthetic oligonucleotide
guggaauugaaguggacg

SEQ ID NO: 21769 - RNA, 18 nt, Artificial Sequence
  Description of Artificial Sequence: Synthetic oligonucleotide
ugaggguggaauugaagu

SEQ ID NO: 21770 - RNA, 18 nt, Artificial Sequence
  Description of Artificial Sequence: Synthetic oligonucleotide
agccaugaggguggaauu

SEQ ID NO: 21771 - RNA, 18 nt, Artificial Sequence
  Description of Artificial Sequence: Synthetic oligonucleotide
aucagagccaugagggug

SEQ ID NO: 21772 - RNA, 18 nt, Artificial Sequence
  Description of Artificial Sequence: Synthetic oligonucleotide
ugcggaucagagccauga

SEQ ID NO: 21773 - RNA, 18 nt, Artificial Sequence
  Description of Artificial Sequence: Synthetic oligonucleotide
ggcugugcggaucagagc

SEQ ID NO: 21774 - RNA, 18 nt, Artificial Sequence
  Description of Artificial Sequence: Synthetic oligonucleotide
uccagggcugugcggauc

SEQ ID NO: 21775 - RNA, 18 nt, Artificial Sequence
  Description of Artificial Sequence: Synthetic oligonucleotide
ugauguccagggcugugc

SEQ ID NO: 21776 - RNA, 18 nt, Artificial Sequence
  Description of Artificial Sequence: Synthetic oligonucleotide
aaucuugauguccagggc

SEQ ID NO: 21777 - RNA, 18 nt, Artificial Sequence
  Description of Artificial Sequence: Synthetic oligonucleotide
uuggcaaucuugaugucc

SEQ ID NO: 21778 - RNA, 18 nt, Artificial Sequence
  Description of Artificial Sequence: Synthetic oligonucleotide
cgacaaagagauucagca

SEQ ID NO: 21779 - RNA, 18 nt, Artificial Sequence
  Description of Artificial Sequence: Synthetic oligonucleotide
gacggcgacaaagagauu

SEQ ID NO: 21780 - RNA, 18 nt, Artificial Sequence
  Description of Artificial Sequence: Synthetic oligonucleotide
augaugacggcgacaaag

SEQ ID NO: 21781 - RNA, 18 nt, Artificial Sequence
  Description of Artificial Sequence: Synthetic oligonucleotide
uguccaugaugacggcga

SEQ ID NO: 21782 - RNA, 18 nt, Artificial Sequence
  Description of Artificial Sequence: Synthetic oligonucleotide
aaaguuguccaugaugac

SEQ ID NO: 21783 - RNA, 18 nt, Artificial Sequence
  Description of Artificial Sequence: Synthetic oligonucleotide
uacucaaaguuguccaug

SEQ ID NO: 21784 - RNA, 18 nt, Artificial Sequence
  Description of Artificial Sequence: Synthetic oligonucleotide
ugagguacucaaaguugu

SEQ ID NO: 21785 - RNA, 18 nt, Artificial Sequence
  Description of Artificial Sequence: Synthetic oligonucleotide
ucgggugagguacucaaa

SEQ ID NO: 21786 - RNA, 18 nt, Artificial Sequence
  Description of Artificial Sequence: Synthetic oligonucleotide
gagucucgggugagguac

SEQ ID NO: 21787 - RNA, 18 nt, Artificial Sequence
  Description of Artificial Sequence: Synthetic oligonucleotide
uggaggagucucggguga

SEQ ID NO: 21788 - RNA, 18 nt, Artificial Sequence
  Description of Artificial Sequence: Synthetic oligonucleotide
caggauggaggagucucg

SEQ ID NO: 21789 - RNA, 18 nt, Artificial Sequence
  Description of Artificial Sequence: Synthetic oligonucleotide
gggcccaggauggaggag

SEQ ID NO: 21790 - RNA, 18 nt, Artificial Sequence
  Description of Artificial Sequence: Synthetic oligonucleotide
acucauccaggugguggg

SEQ ID NO: 21791 - RNA, 18 nt, Artificial Sequence
  Description of Artificial Sequence: Synthetic oligonucleotide
acguacucauccaggugg

SEQ ID NO: 21792 - RNA, 18 nt, Artificial Sequence
  Description of Artificial Sequence: Synthetic oligonucleotide
cacgcacguacucaucca

SEQ ID NO: 21793 - RNA, 18 nt, Artificial Sequence
  Description of Artificial Sequence: Synthetic oligonucleotide
ccagacacgcacguacuc

SEQ ID NO: 21794 - RNA, 18 nt, Artificial Sequence
  Description of Artificial Sequence: Synthetic oligonucleotide
ucggcccagacacgcacg

SEQ ID NO: 21795 - RNA, 18 nt, Artificial Sequence
  Description of Artificial Sequence: Synthetic oligonucleotide
cauacucggcccagacac

SEQ ID NO: 21796 - RNA, 18 nt, Artificial Sequence
  Description of Artificial Sequence: Synthetic oligonucleotide
auuguggcuggaggauuc

SEQ ID NO: 21797 - RNA, 18 nt, Artificial Sequence
  Description of Artificial Sequence: Synthetic oligonucleotide
ugaguauuguggcuggag

SEQ ID NO: 21798 - RNA, 18 nt, Artificial Sequence
  Description of Artificial Sequence: Synthetic oligonucleotide
agaggugaguauuguggc

SEQ ID NO: 21799 - RNA, 18 nt, Artificial Sequence
  Description of Artificial Sequence: Synthetic oligonucleotide
cagggagaggugaguauu

SEQ ID NO: 21800 - RNA, 18 nt, Artificial Sequence
  Description of Artificial Sequence: Synthetic oligonucleotide
aguuccagggagagguga

SEQ ID NO: 21801 - RNA, 18 nt, Artificial Sequence
  Description of Artificial Sequence: Synthetic oligonucleotide
guuccaguuccagggaga

SEQ ID NO: 21802 - RNA, 18 nt, Artificial Sequence
  Description of Artificial Sequence: Synthetic oligonucleotide
cccguguuccaguuccag

SEQ ID NO: 21803 - RNA, 18 nt, Artificial Sequence
  Description of Artificial Sequence: Synthetic oligonucleotide
ccuagcccguguuccagu

SEQ ID NO: 21804 - RNA, 18 nt, Artificial Sequence
  Description of Artificial Sequence: Synthetic oligonucleotide
ccugaccuagcccguguu

SEQ ID NO: 21805 - RNA, 18 nt, Artificial Sequence
  Description of Artificial Sequence: Synthetic oligonucleotide
gggccugaccuagcccgu

SEQ ID NO: 21806 - RNA, 18 nt, Artificial Sequence
  Description of Artificial Sequence: Synthetic oligonucleotide
agugcuccagagucuggg

SEQ ID NO: 21807 - RNA, 18 nt, Artificial Sequence
  Description of Artificial Sequence: Synthetic oligonucleotide
aguucagugcuccagagu

SEQ ID NO: 21808 - RNA, 18 nt, Artificial Sequence
  Description of Artificial Sequence: Synthetic oligonucleotide
ccaggaguucagugcucc

SEQ ID NO: 21809 - RNA, 18 nt, Artificial Sequence
  Description of Artificial Sequence: Synthetic oligonucleotide
ggaccccaggaguucagu

SEQ ID NO: 21810 - RNA, 18 nt, Artificial Sequence
  Description of Artificial Sequence: Synthetic oligonucleotide
ugcuaggaccccaggagu

SEQ ID NO: 21811 - RNA, 18 nt, Artificial Sequence
  Description of Artificial Sequence: Synthetic oligonucleotide
accccugcuaggacccca

SEQ ID NO: 21812 - RNA, 18 nt, Artificial Sequence
  Description of Artificial Sequence: Synthetic oligonucleotide
gugagaccccugcuagga

SEQ ID NO: 21813 - RNA, 18 nt, Artificial Sequence
  Description of Artificial Sequence: Synthetic oligonucleotide
aaccugugagaccccugc

SEQ ID NO: 21814 - RNA, 18 nt, Artificial Sequence
  Description of Artificial Sequence: Synthetic oligonucleotide
gacugaaccugugagacc

SEQ ID NO: 21815 - RNA, 18 nt, Artificial Sequence
  Description of Artificial Sequence: Synthetic oligonucleotide
cuccugacugaaccugug

SEQ ID NO: 21816 - RNA, 18 nt, Artificial Sequence
  Description of Artificial Sequence: Synthetic oligonucleotide
cuucucuccugacugaac

SEQ ID NO: 21817 - RNA, 18 nt, Artificial Sequence
  Description of Artificial Sequence: Synthetic oligonucleotide
uauaucuucucuccugac

SEQ ID NO: 21818 - RNA, 18 nt, Artificial Sequence
  Description of Artificial Sequence: Synthetic oligonucleotide
auucuuauaucuucucuc

SEQ ID NO: 21819 - RNA, 18 nt, Artificial Sequence
  Description of Artificial Sequence: Synthetic oligonucleotide
ugaugauucuuauaucuu

SEQ ID NO: 21820 - RNA, 18 nt, Artificial Sequence
  Description of Artificial Sequence: Synthetic oligonucleotide
aagggugaugauucuuau

SEQ ID NO: 21821 - RNA, 18 nt, Artificial Sequence
  Description of Artificial Sequence: Synthetic oligonucleotide
uaugcaagggugaugauu

SEQ ID NO: 21822 - RNA, 18 nt, Artificial Sequence
  Description of Artificial Sequence: Synthetic oligonucleotide
ggguaugcaagggugaug

SEQ ID NO: 21823 - RNA, 18 nt, Artificial Sequence
  Description of Artificial Sequence: Synthetic oligonucleotide
cuacguguuuaaucuggg

SEQ ID NO: 21824 - RNA, 18 nt, Artificial Sequence
  Description of Artificial Sequence: Synthetic oligonucleotide
gcacccuacguguuuaau

SEQ ID NO: 21825 - RNA, 18 nt, Artificial Sequence
  Description of Artificial Sequence: Synthetic oligonucleotide
gguuggcacccuacgugu

SEQ ID NO: 21826 - RNA, 18 nt, Artificial Sequence
  Description of Artificial Sequence: Synthetic oligonucleotide
ggcaggguuggcacccua

SEQ ID NO: 21827 - RNA, 18 nt, Artificial Sequence
  Description of Artificial Sequence: Synthetic oligonucleotide
guuugggcaggguuggca

SEQ ID NO: 21828 - RNA, 18 nt, Artificial Sequence
  Description of Artificial Sequence: Synthetic oligonucleotide
ccaggguuugggcagggu

SEQ ID NO: 21829 - RNA, 18 nt, Artificial Sequence
  Description of Artificial Sequence: Synthetic oligonucleotide
aaaguccaggguuugggc

SEQ ID NO: 21830 - RNA, 18 nt, Artificial Sequence
  Description of Artificial Sequence: Synthetic oligonucleotide
cccagaaaguccaggguu

SEQ ID NO: 21831 - RNA, 18 nt, Artificial Sequence
  Description of Artificial Sequence: Synthetic oligonucleotide
cauuucccagaaagucca

SEQ ID NO: 21832 - RNA, 18 nt, Artificial Sequence
  Description of Artificial Sequence: Synthetic oligonucleotide
ucccucauuucccagaaa

SEQ ID NO: 21833 - RNA, 18 nt, Artificial Sequence
  Description of Artificial Sequence: Synthetic oligonucleotide
cgcccucccucauuuccc

SEQ ID NO: 21834 - RNA, 18 nt, Artificial Sequence
  Description of Artificial Sequence: Synthetic oligonucleotide
guugacgcccucccucau

SEQ ID NO: 21835 - RNA, 18 nt, Artificial Sequence
  Description of Artificial Sequence: Synthetic oligonucleotide
ucaugguugacgcccucc

SEQ ID NO: 21836 - RNA, 18 nt, Artificial Sequence
  Description of Artificial Sequence: Synthetic oligonucleotide
acaucucaugguugacgc

SEQ ID NO: 21837 - RNA, 18 nt, Artificial Sequence
  Description of Artificial Sequence: Synthetic oligonucleotide
ucaggacaucucaugguu

SEQ ID NO: 21838 - RNA, 18 nt, Artificial Sequence
  Description of Artificial Sequence: Synthetic oligonucleotide
gcucuucaggacaucuca

SEQ ID NO: 21839 - RNA, 18 nt, Artificial Sequence
  Description of Artificial Sequence: Synthetic oligonucleotide
agagggcucuucaggaca

SEQ ID NO: 21840 - RNA, 18 nt, Artificial Sequence
  Description of Artificial Sequence: Synthetic oligonucleotide
ggaggagagggcucuuca

SEQ ID NO: 21841 - RNA, 18 nt, Artificial Sequence
  Description of Artificial Sequence: Synthetic oligonucleotide
ucguaggaggagagggcu

SEQ ID NO: 21842 - RNA, 18 nt, Artificial Sequence
  Description of Artificial Sequence: Synthetic oligonucleotide
gagacucguaggaggaga

SEQ ID NO: 21843 - RNA, 18 nt, Artificial Sequence
  Description of Artificial Sequence: Synthetic oligonucleotide
caggagagacucguagga

SEQ ID NO: 21844 - RNA, 18 nt, Artificial Sequence
  Description of Artificial Sequence: Synthetic oligonucleotide
agagacaggagagacucg

SEQ ID NO: 21845 - RNA, 18 nt, Artificial Sequence
  Description of Artificial Sequence: Synthetic oligonucleotide
cagugagagacaggagag

SEQ ID NO: 21846 - RNA, 18 nt, Artificial Sequence
  Description of Artificial Sequence: Synthetic oligonucleotide
cuucacagugagagacag

SEQ ID NO: 21847 - RNA, 18 nt, Artificial Sequence
  Description of Artificial Sequence: Synthetic oligonucleotide
ggagacuucacagugaga

SEQ ID NO: 21848 - RNA, 18 nt, Artificial Sequence
  Description of Artificial Sequence: Synthetic oligonucleotide
caucuggagacuucacag

SEQ ID NO: 21849 - RNA, 18 nt, Artificial Sequence
  Description of Artificial Sequence: Synthetic oligonucleotide
cucaccaucuggagacuu

SEQ ID NO: 21850 - RNA, 18 nt, Artificial Sequence
  Description of Artificial Sequence: Synthetic oligonucleotide
gcauccucaccaucugga

SEQ ID NO: 21851 - RNA, 18 nt, Artificial Sequence
  Description of Artificial Sequence: Synthetic oligonucleotide
cuaaugcauccucaccau

SEQ ID NO: 21852 - RNA, 18 nt, Artificial Sequence
  Description of Artificial Sequence: Synthetic oligonucleotide
ccuggcuaaugcauccuc

SEQ ID NO: 21853 - RNA, 18 nt, Artificial Sequence
  Description of Artificial Sequence: Synthetic oligonucleotide
uggagccuggcuaaugca

SEQ ID NO: 21854 - RNA, 18 nt, Artificial Sequence
  Description of Artificial Sequence: Synthetic oligonucleotide
cucccuggagccuggcua

SEQ ID NO: 21855 - RNA, 18 nt, Artificial Sequence
  Description of Artificial Sequence: Synthetic oligonucleotide
guuuucucccuggagccu

SEQ ID NO: 21856 - RNA, 18 nt, Artificial Sequence
  Description of Artificial Sequence: Synthetic oligonucleotide
uguugguuuucucccugg

SEQ ID NO: 21857 - RNA, 18 nt, Artificial Sequence
  Description of Artificial Sequence: Synthetic oligonucleotide
gaugcuguugguuuucuc

SEQ ID NO: 21858 - RNA, 18 nt, Artificial Sequence
  Description of Artificial Sequence: Synthetic oligonucleotide
gcugggaugcuguugguu

SEQ ID NO: 21859 - RNA, 18 nt, Artificial Sequence
  Description of Artificial Sequence: Synthetic oligonucleotide
cugaggcugggaugcugu

SEQ ID NO: 21860 - RNA, 18 nt, Artificial Sequence
  Description of Artificial Sequence: Synthetic oligonucleotide
gagaacugaggcugggau

SEQ ID NO: 21861 - RNA, 18 nt, Artificial Sequence
  Description of Artificial Sequence: Synthetic oligonucleotide
cucaagagaacugaggcu

SEQ ID NO: 21862 - RNA, 18 nt, Artificial Sequence
  Description of Artificial Sequence: Synthetic oligonucleotide
acacucucaagagaacug

SEQ ID NO: 21863 - RNA, 18 nt, Artificial Sequence
  Description of Artificial Sequence: Synthetic oligonucleotide
uccccacacucucaagag

SEQ ID NO: 21864 - RNA, 18 nt, Artificial Sequence
  Description of Artificial Sequence: Synthetic oligonucleotide
ccuccuccccacacucuc

SEQ ID NO: 21865 - RNA, 18 nt, Artificial Sequence
  Description of Artificial Sequence: Synthetic oligonucleotide
ccagcccuccuccccaca

SEQ ID NO: 21866 - RNA, 18 nt, Artificial Sequence
  Description of Artificial Sequence: Synthetic oligonucleotide
guaggccagcccuccucc

SEQ ID NO: 21867 - RNA, 18 nt, Artificial Sequence
  Description of Artificial Sequence: Synthetic oligonucleotide
caaggguaggccagcccu

SEQ ID NO: 21868 - RNA, 18 nt, Artificial Sequence
  Description of Artificial Sequence: Synthetic oligonucleotide
ucugccaaggguaggcca

SEQ ID NO: 21869 - RNA, 18 nt, Artificial Sequence
  Description of Artificial Sequence: Synthetic oligonucleotide
uccugucugccaagggua

SEQ ID NO: 21870 - RNA, 18 nt, Artificial Sequence
  Description of Artificial Sequence: Synthetic oligonucleotide
gccaauccugucugccaa

SEQ ID NO: 21871 - RNA, 18 nt, Artificial Sequence
  Description of Artificial Sequence: Synthetic oligonucleotide
uugcugccaauccugucu

SEQ ID NO: 21872 - RNA, 18 nt, Artificial Sequence
  Description of Artificial Sequence: Synthetic oligonucleotide
ugauguugcugccaaucc

SEQ ID NO: 21873 - RNA, 18 nt, Artificial Sequence
  Description of Artificial Sequence: Synthetic oligonucleotide
uacucugauguugcugcc

SEQ ID NO: 21874 - RNA, 18 nt, Artificial Sequence
  Description of Artificial Sequence: Synthetic oligonucleotide
ucugcuacucugauguug

SEQ ID NO: 21875 - RNA, 18 nt, Artificial Sequence
  Description of Artificial Sequence: Synthetic oligonucleotide
ugaguucugcuacucuga

SEQ ID NO: 21876 - RNA, 18 nt, Artificial Sequence
  Description of Artificial Sequence: Synthetic oligonucleotide
ggagcugaguucugcuac

SEQ ID NO: 21877 - RNA, 18 nt, Artificial Sequence
  Description of Artificial Sequence: Synthetic oligonucleotide
cagugggagcugaguucu

SEQ ID NO: 21878 - RNA, 18 nt, Artificial Sequence
  Description of Artificial Sequence: Synthetic oligonucleotide
ggucccagugggagcuga

SEQ ID NO: 21879 - RNA, 18 nt, Artificial Sequence
  Description of Artificial Sequence: Synthetic oligonucleotide
ucacgggucccaguggga

SEQ ID NO: 21880 - RNA, 18 nt, Artificial Sequence
  Description of Artificial Sequence: Synthetic oligonucleotide
cagguucacgggucccag

SEQ ID NO: 21881 - RNA, 18 nt, Artificial Sequence
  Description of Artificial Sequence: Synthetic oligonucleotide
acucccagguucacgggu

SEQ ID NO: 21882 - RNA, 18 nt, Artificial Sequence
  Description of Artificial Sequence: Synthetic oligonucleotide
cucucacucccagguuca

SEQ ID NO: 21883 - RNA, 18 nt, Artificial Sequence
  Description of Artificial Sequence: Synthetic oligonucleotide
auguccucucacucccag

SEQ ID NO: 21884 - RNA, 18 nt, Artificial Sequence
  Description of Artificial Sequence: Synthetic oligonucleotide
ccuguauguccucucacu

SEQ ID NO: 21885 - RNA, 18 nt, Artificial Sequence
  Description of Artificial Sequence: Synthetic oligonucleotide
ccuggccuguauguccuc

SEQ ID NO: 21886 - RNA, 18 nt, Artificial Sequence
  Description of Artificial Sequence: Synthetic oligonucleotide
ccuccccuggccuguaug

SEQ ID NO: 21887 - RNA, 18 nt, Artificial Sequence
  Description of Artificial Sequence: Synthetic oligonucleotide
ugcguccuccccuggccu

SEQ ID NO: 21888 - RNA, 18 nt, Artificial Sequence
  Description of Artificial Sequence: Synthetic oligonucleotide
ggcucugcguccuccccu

SEQ ID NO: 21889 - RNA, 18 nt, Artificial Sequence
  Description of Artificial Sequence: Synthetic oligonucleotide
ccugaggcucugcguccu

SEQ ID NO: 21890 - RNA, 18 nt, Artificial Sequence
  Description of Artificial Sequence: Synthetic oligonucleotide
gggcuuaggcugcugagg

SEQ ID NO: 21891 - RNA, 18 nt, Artificial Sequence
  Description of Artificial Sequence: Synthetic oligonucleotide
aggccagaggaagauggg

SEQ ID NO: 21892 - RNA, 18 nt, Artificial Sequence
  Description of Artificial Sequence: Synthetic oligonucleotide
gaggccagaggaagaugg

SEQ ID NO: 21893 - RNA, 18 nt, Artificial Sequence
  Description of Artificial Sequence: Synthetic oligonucleotide
gugcugaggccagaggaa

SEQ ID NO: 21894 - RNA, 18 nt, Artificial Sequence
  Description of Artificial Sequence: Synthetic oligonucleotide
cucuggugcugaggccag

SEQ ID NO: 21895 - RNA, 18 nt, Artificial Sequence
  Description of Artificial Sequence: Synthetic oligonucleotide
cuccucucuggugcugag

SEQ ID NO: 21896 - RNA, 18 nt, Artificial Sequence
  Description of Artificial Sequence: Synthetic oligonucleotide
acggccuccucucuggug

SEQ ID NO: 21897 - RNA, 18 nt, Artificial Sequence
  Description of Artificial Sequence: Synthetic oligonucleotide
ucgugacggccuccucuc

SEQ ID NO: 21898 - RNA, 18 nt, Artificial Sequence
  Description of Artificial Sequence: Synthetic oligonucleotide
cuuccucgugacggccuc

SEQ ID NO: 21899 - RNA, 18 nt, Artificial Sequence
  Description of Artificial Sequence: Synthetic oligonucleotide
cccaccuuccucgugacg

SEQ ID NO: 21900 - RNA, 18 nt, Artificial Sequence
  Description of Artificial Sequence: Synthetic oligonucleotide
uccugcccaccuuccucg

SEQ ID NO: 21901 - RNA, 18 nt, Artificial Sequence
  Description of Artificial Sequence: Synthetic oligonucleotide
ccaccuccugcccaccuu

SEQ ID NO: 21902 - RNA, 18 nt, Artificial Sequence
  Description of Artificial Sequence: Synthetic oligonucleotide
caagaccaccuccugccc

SEQ ID NO: 21903 - RNA, 18 nt, Artificial Sequence
  Description of Artificial Sequence: Synthetic oligonucleotide
auagccaagaccaccucc

SEQ ID NO: 21904 - RNA, 18 nt, Artificial Sequence
  Description of Artificial Sequence: Synthetic oligonucleotide
ugggaauagccaagacca

SEQ ID NO: 21905 - RNA, 18 nt, Artificial Sequence
  Description of Artificial Sequence: Synthetic oligonucleotide
ggcuaugggaauagccaa

SEQ ID NO: 21906 - RNA, 18 nt, Artificial Sequence
  Description of Artificial Sequence: Synthetic oligonucleotide
uuugaggcuaugggaaua

SEQ ID NO: 21907 - RNA, 18 nt, Artificial Sequence
  Description of Artificial Sequence: Synthetic oligonucleotide
acuuguuugaggcuaugg

SEQ ID NO: 21908 - RNA, 18 nt, Artificial Sequence
  Description of Artificial Sequence: Synthetic oligonucleotide
ggaguacuuguuugaggc

SEQ ID NO: 21909 - RNA, 18 nt, Artificial Sequence
  Description of Artificial Sequence: Synthetic oligonucleotide
cucauggaguacuuguuu

SEQ ID NO: 21910 - RNA, 18 nt, Artificial Sequence
  Description of Artificial Sequence: Synthetic oligonucleotide
ucggucucauggaguacu

SEQ ID NO: 21911 - RNA, 18 nt, Artificial Sequence
  Description of Artificial Sequence: Synthetic oligonucleotide
gccucucggucucaugga

SEQ ID NO: 21912 - RNA, 18 nt, Artificial Sequence
  Description of Artificial Sequence: Synthetic oligonucleotide
ccccagccucucggucuc

SEQ ID NO: 21913 - RNA, 18 nt, Artificial Sequence
  Description of Artificial Sequence: Synthetic oligonucleotide
gcucuccccagccucucg

SEQ ID NO: 21914 - RNA, 18 nt, Artificial Sequence
  Description of Artificial Sequence: Synthetic oligonucleotide
ccacggcucuccccagcc

SEQ ID NO: 21915 - RNA, 18 nt, Artificial Sequence
  Description of Artificial Sequence: Synthetic oligonucleotide
cagacccacggcucuccc

SEQ ID NO: 21916 - RNA, 18 nt, Artificial Sequence
  Description of Artificial Sequence: Synthetic oligonucleotide
agccccagacccacggcu

SEQ ID NO: 21917 - RNA, 18 nt, Artificial Sequence
  Description of Artificial Sequence: Synthetic oligonucleotide
agcccagccccagaccca

SEQ ID NO: 21918 - RNA, 18 nt, Artificial Sequence
  Description of Artificial Sequence: Synthetic oligonucleotide
gccaaagcccagccccag

SEQ ID NO: 21919 - RNA, 18 nt, Artificial Sequence
  Description of Artificial Sequence: Synthetic oligonucleotide
aaccagccaaagcccagc

SEQ ID NO: 21920 - RNA, 18 nt, Artificial Sequence
  Description of Artificial Sequence: Synthetic oligonucleotide
uuaggaaccagccaaagc

SEQ ID NO: 21921 - RNA, 18 nt, Artificial Sequence
  Description of Artificial Sequence: Synthetic oligonucleotide
aagaguuaggaaccagcc

SEQ ID NO: 21922 - RNA, 18 nt, Artificial Sequence
  Description of Artificial Sequence: Synthetic oligonucleotide
agaggaagaguuaggaac

SEQ ID NO: 21923 - RNA, 18 nt, Artificial Sequence
  Description of Artificial Sequence: Synthetic oligonucleotide
ucaaaagaggaagaguua

SEQ ID NO: 21924 - RNA, 18 nt, Artificial Sequence
  Description of Artificial Sequence: Synthetic oligonucleotide
uaaaaucaaaagaggaag

SEQ ID NO: 21925 - RNA, 18 nt, Artificial Sequence
  Description of Artificial Sequence: Synthetic oligonucleotide
ugaccuaaaaucaaaaga

SEQ ID NO: 21926 - RNA, 18 nt, Artificial Sequence
  Description of Artificial Sequence: Synthetic oligonucleotide
ugcugugaccuaaaauca

SEQ ID NO: 21927 - RNA, 18 nt, Artificial Sequence
  Description of Artificial Sequence: Synthetic oligonucleotide
ccaauugcugugaccuaa

SEQ ID NO: 21928 - RNA, 18 nt, Artificial Sequence
  Description of Artificial Sequence: Synthetic oligonucleotide
agcauccaauugcuguga

SEQ ID NO: 21929 - RNA, 18 nt, Artificial Sequence
  Description of Artificial Sequence: Synthetic oligonucleotide
gggacagcauccaauugc

SEQ ID NO: 21930 - RNA, 18 nt, Artificial Sequence
  Description of Artificial Sequence: Synthetic oligonucleotide
uggaauagaggccuuggg

SEQ ID NO: 21931 - RNA, 18 nt, Artificial Sequence
  Description of Artificial Sequence: Synthetic oligonucleotide
uuguggaauagaggccuu

SEQ ID NO: 21932 - RNA, 18 nt, Artificial Sequence
  Description of Artificial Sequence: Synthetic oligonucleotide
ucuacaugggcuacaggg

SEQ ID NO: 21933 - RNA, 18 nt, Artificial Sequence
  Description of Artificial Sequence: Synthetic oligonucleotide
cacagucuacaugggcua

SEQ ID NO: 21934 - RNA, 18 nt, Artificial Sequence
  Description of Artificial Sequence: Synthetic oligonucleotide
uccuccacagucuacaug

SEQ ID NO: 21935 - RNA, 18 nt, Artificial Sequence
  Description of Artificial Sequence: Synthetic oligonucleotide
cugccuccuccacagucu

SEQ ID NO: 21936 - RNA, 18 nt, Artificial Sequence
  Description of Artificial Sequence: Synthetic oligonucleotide
ugcaucugccuccuccac

SEQ ID NO: 21937 - RNA, 18 nt, Artificial Sequence
  Description of Artificial Sequence: Synthetic oligonucleotide
cucucugcaucugccucc

SEQ ID NO: 21938 - RNA, 18 nt, Artificial Sequence
  Description of Artificial Sequence: Synthetic oligonucleotide
gggcucucucugcaucug

SEQ ID NO: 21939 - RNA, 18 nt, Artificial Sequence
  Description of Artificial Sequence: Synthetic oligonucleotide
cagggcaccuccccuggg

SEQ ID NO: 21940 - RNA, 18 nt, Artificial Sequence
  Description of Artificial Sequence: Synthetic oligonucleotide
gcagggcaccuccccugg

SEQ ID NO: 21941 - RNA, 18 nt, Artificial Sequence
  Description of Artificial Sequence: Synthetic oligonucleotide
ggacugcagggcaccucc

SEQ ID NO: 21942 - RNA, 18 nt, Artificial Sequence
  Description of Artificial Sequence: Synthetic oligonucleotide
guucgggacugcagggca

SEQ ID NO: 21943 - RNA, 18 nt, Artificial Sequence
  Description of Artificial Sequence: Synthetic oligonucleotide
gucgaguucgggacugca

SEQ ID NO: 21944 - RNA, 18 nt, Artificial Sequence
  Description of Artificial Sequence: Synthetic oligonucleotide
ugucagucgaguucggga

SEQ ID NO: 21945 - RNA, 18 nt, Artificial Sequence
  Description of Artificial Sequence: Synthetic oligonucleotide
uaggaugucagucgaguu

SEQ ID NO: 21946 - RNA, 18 nt, Artificial Sequence
  Description of Artificial Sequence: Synthetic oligonucleotide
ggguguaggaugucaguc

SEQ ID NO: 21947 - RNA, 18 nt, Artificial Sequence
  Description of Artificial Sequence: Synthetic oligonucleotide
acauucccagacacuggg

SEQ ID NO: 21948 - RNA, 18 nt, Artificial Sequence
  Description of Artificial Sequence: Synthetic oligonucleotide
guacauucccagacacug

SEQ ID NO: 21949 - RNA, 18 nt, Artificial Sequence
  Description of Artificial Sequence: Synthetic oligonucleotide
ccccaguacauucccaga

SEQ ID NO: 21950 - RNA, 18 nt, Artificial Sequence
  Description of Artificial Sequence: Synthetic oligonucleotide
aagguccccaguacauuc

SEQ ID NO: 21951 - RNA, 18 nt, Artificial Sequence
  Description of Artificial Sequence: Synthetic oligonucleotide
aagugaagguccccagua

SEQ ID NO: 21952 - RNA, 18 nt, Artificial Sequence
  Description of Artificial Sequence: Synthetic oligonucleotide
gggacaagugaagguccc

SEQ ID NO: 21953 - RNA, 18 nt, Artificial Sequence
  Description of Artificial Sequence: Synthetic oligonucleotide
ggagugggagagacuggg

SEQ ID NO: 21954 - RNA, 18 nt, Artificial Sequence
  Description of Artificial Sequence: Synthetic oligonucleotide
gaaggagugggagagacu

SEQ ID NO: 21955 - RNA, 18 nt, Artificial Sequence
  Description of Artificial Sequence: Synthetic oligonucleotide
ggcuugaaggagugggag

SEQ ID NO: 21956 - RNA, 18 nt, Artificial Sequence
  Description of Artificial Sequence: Synthetic oligonucleotide
ucccuggcuugaaggagu

SEQ ID NO: 21957 - RNA, 18 nt, Artificial Sequence
  Description of Artificial Sequence: Synthetic oligonucleotide
gggugucccuggcuugaa

SEQ ID NO: 21958 - RNA, 18 nt, Artificial Sequence
  Description of Artificial Sequence: Synthetic oligonucleotide
augaugcccgaggcuggg

SEQ ID NO: 21959 - RNA, 18 nt, Artificial Sequence
  Description of Artificial Sequence: Synthetic oligonucleotide
caugaugcccgaggcugg

SEQ ID NO: 21960 - RNA, 18 nt, Artificial Sequence
  Description of Artificial Sequence: Synthetic oligonucleotide
gaggucaugaugcccgag

SEQ ID NO: 21961 - RNA, 18 nt, Artificial Sequence
  Description of Artificial Sequence: Synthetic oligonucleotide
acagcgaggucaugaugc

SEQ ID NO: 21962 - RNA, 18 nt, Artificial Sequence
  Description of Artificial Sequence: Synthetic oligonucleotide
ggcacacagcgaggucau

SEQ ID NO: 21963 - RNA, 18 nt, Artificial Sequence
  Description of Artificial Sequence: Synthetic oligonucleotide
cccugggcacacagcgag

SEQ ID NO: 21964 - RNA, 18 nt, Artificial Sequence
  Description of Artificial Sequence: Synthetic oligonucleotide
gggcucccugggcacaca

SEQ ID NO: 21965 - RNA, 18 nt, Artificial Sequence
  Description of Artificial Sequence: Synthetic oligonucleotide
cacacgggcucccugggc

SEQ ID NO: 21966 - RNA, 18 nt, Artificial Sequence
  Description of Artificial Sequence: Synthetic oligonucleotide
ggguucacacgggcuccc

SEQ ID NO: 21967 - RNA, 18 nt, Artificial Sequence
  Description of Artificial Sequence: Synthetic oligonucleotide
gcaauggguucacacggg

SEQ ID NO: 21968 - RNA, 18 nt, Artificial Sequence
  Description of Artificial Sequence: Synthetic oligonucleotide
ugcaggcaauggguucac

SEQ ID NO: 21969 - RNA, 18 nt, Artificial Sequence
  Description of Artificial Sequence: Synthetic oligonucleotide
guuagugcaggcaauggg

SEQ ID NO: 21970 - RNA, 18 nt, Artificial Sequence
  Description of Artificial Sequence: Synthetic oligonucleotide
cuuauaaugaauccgacc

SEQ ID NO: 21971 - RNA, 18 nt, Artificial Sequence
  Description of Artificial Sequence: Synthetic oligonucleotide
auauccuuauaaugaauc

SEQ ID NO: 21972 - RNA, 18 nt, Artificial Sequence
  Description of Artificial Sequence: Synthetic oligonucleotide
uguacauauccuuauaau

SEQ ID NO: 21973 - RNA, 18 nt, Artificial Sequence
  Description of Artificial Sequence: Synthetic oligonucleotide
uaaacuguacauauccuu

SEQ ID NO: 21974 - RNA, 18 nt, Artificial Sequence
  Description of Artificial Sequence: Synthetic oligonucleotide
cguaauaaacuguacaua

SEQ ID NO: 21975 - RNA, 18 nt, Artificial Sequence
  Description of Artificial Sequence: Synthetic oligonucleotide
uuacucguaauaaacugu

SEQ ID NO: 21976 - RNA, 18 nt, Artificial Sequence
  Description of Artificial Sequence: Synthetic oligonucleotide
agauauuacucguaauaa

SEQ ID NO: 21977 - RNA, 18 nt, Artificial Sequence
  Description of Artificial Sequence: Synthetic oligonucleotide
gggagauauuacucguaa

SEQ ID NO: 21978 - RNA, 18 nt, Artificial Sequence
  Description of Artificial Sequence: Synthetic oligonucleotide
uugccuaagccgagaggg

SEQ ID NO: 21979 - RNA, 18 nt, Artificial Sequence
  Description of Artificial Sequence: Synthetic oligonucleotide
auuucuugccuaagccga

SEQ ID NO: 21980 - RNA, 18 nt, Artificial Sequence
  Description of Artificial Sequence: Synthetic oligonucleotide
aggacauuucuugccuaa

SEQ ID NO: 21981 - RNA, 18 nt, Artificial Sequence
  Description of Artificial Sequence: Synthetic oligonucleotide
cuaugaggacauuucuug

SEQ ID NO: 21982 - RNA, 18 nt, Artificial Sequence
  Description of Artificial Sequence: Synthetic oligonucleotide
caacccuaugaggacauu

SEQ ID NO: 21983 - RNA, 18 nt, Artificial Sequence
  Description of Artificial Sequence: Synthetic oligonucleotide
gcaagcaacccuaugagg

SEQ ID NO: 21984 - RNA, 18 nt, Artificial Sequence
  Description of Artificial Sequence: Synthetic oligonucleotide
cuuauaaugaauccgacc

SEQ ID NO: 21985 - RNA, 18 nt, Artificial Sequence
  Description of Artificial Sequence: Synthetic oligonucleotide
auauccuuauaaugaauc

SEQ ID NO: 21986 - RNA, 18 nt, Artificial Sequence
  Description of Artificial Sequence: Synthetic oligonucleotide
uguacauauccuuauaau

SEQ ID NO: 21987 - RNA, 18 nt, Artificial Sequence
  Description of Artificial Sequence: Synthetic oligonucleotide
uaaacuguacauauccuu

SEQ ID NO: 21988 - RNA, 18 nt, Artificial Sequence
  Description of Artificial Sequence: Synthetic oligonucleotide
cguaauaaacuguacaua

SEQ ID NO: 21989 - RNA, 18 nt, Artificial Sequence
  Description of Artificial Sequence: Synthetic oligonucleotide
uuacucguaauaaacugu

SEQ ID NO: 21990 - RNA, 18 nt, Artificial Sequence
  Description of Artificial Sequence: Synthetic oligonucleotide
agauauuacucguaauaa

SEQ ID NO: 21991 - RNA, 18 nt, Artificial Sequence
  Description of Artificial Sequence: Synthetic oligonucleotide
uugccuaagccgagaggg

SEQ ID NO: 21992 - RNA, 18 nt, Artificial Sequence
  Description of Artificial Sequence: Synthetic oligonucleotide
auuucuugccuaagccga

SEQ ID NO: 21993 - RNA, 18 nt, Artificial Sequence
  Description of Artificial Sequence: Synthetic oligonucleotide
aggacauuucuugccuaa

SEQ ID NO: 21994 - RNA, 18 nt, Artificial Sequence
  Description of Artificial Sequence: Synthetic oligonucleotide
cuaugaggacauuucuug

SEQ ID NO: 21995 - RNA, 18 nt, Artificial Sequence
  Description of Artificial Sequence: Synthetic oligonucleotide
caacccuaugaggacauu

SEQ ID NO: 21996 - RNA, 18 nt, Artificial Sequence
  Description of Artificial Sequence: Synthetic oligonucleotide
gcaagcaacccuaugagg

SEQ ID NO: 21997 - RNA, 18 nt, Artificial Sequence
  Description of Artificial Sequence: Synthetic oligonucleotide
gcagguuuuaguggaagu

SEQ ID NO: 21998 - RNA, 18 nt, Artificial Sequence
  Description of Artificial Sequence: Synthetic oligonucleotide
ugcuagcagguuuuagug

SEQ ID NO: 21999 - RNA, 18 nt, Artificial Sequence
  Description of Artificial Sequence: Synthetic oligonucleotide
auggaugcuagcagguuu

SEQ ID NO: 22000 - RNA, 18 nt, Artificial Sequence
  Description of Artificial Sequence: Synthetic oligonucleotide
auuccauggaugcuagca

SEQ ID NO: 22001 - RNA, 18 nt, Artificial Sequence
  Description of Artificial Sequence: Synthetic oligonucleotide
cacucauuccauggaugc

SEQ ID NO: 22002 - RNA, 18 nt, Artificial Sequence
  Description of Artificial Sequence: Synthetic oligonucleotide
agccacacucauuccaug

SEQ ID NO: 22003 - RNA, 18 nt, Artificial Sequence
  Description of Artificial Sequence: Synthetic oligonucleotide
ccccaagccacacucauu

SEQ ID NO: 22004 - RNA, 18 nt, Artificial Sequence
  Description of Artificial Sequence: Synthetic oligonucleotide
aagaaccccaagccacac

SEQ ID NO: 22005 - RNA, 18 nt, Artificial Sequence
  Description of Artificial Sequence: Synthetic oligonucleotide
uauugaagaaccccaagc

SEQ ID NO: 22006 - RNA, 18 nt, Artificial Sequence
  Description of Artificial Sequence: Synthetic oligonucleotide
auauauauugaagaaccc

SEQ ID NO: 22007 - RNA, 18 nt, Artificial Sequence
  Description of Artificial Sequence: Synthetic oligonucleotide
gaaauauauauauugaag

SEQ ID NO: 22008 - RNA, 18 nt, Artificial Sequence
  Description of Artificial Sequence: Synthetic oligonucleotide
uauaugaaauauauauau

SEQ ID NO: 22009 - RNA, 18 nt, Artificial Sequence
  Description of Artificial Sequence: Synthetic oligonucleotide
auauauauaugaaauaua

SEQ ID NO: 22010 - RNA, 18 nt, Artificial Sequence
  Description of Artificial Sequence: Synthetic oligonucleotide
uauauauauauauaugaa

SEQ ID NO: 22011 - RNA, 18 nt, Artificial Sequence
  Description of Artificial Sequence: Synthetic oligonucleotide
auauauauauauauauau

SEQ ID NO: 22012 - RNA, 18 nt, Artificial Sequence
  Description of Artificial Sequence: Synthetic oligonucleotide
gagagauauauauauaua

SEQ ID NO: 22013 - RNA, 18 nt, Artificial Sequence
  Description of Artificial Sequence: Synthetic oligonucleotide
agagagagagauauauau

SEQ ID NO: 22014 - RNA, 18 nt, Artificial Sequence
  Description of Artificial Sequence: Synthetic oligonucleotide
uagagagagagagagaua

SEQ ID NO: 22015 - RNA, 18 nt, Artificial Sequence
  Description of Artificial Sequence: Synthetic oligonucleotide
uuuuuuagagagagagag

SEQ ID NO: 22016 - RNA, 18 nt, Artificial Sequence
  Description of Artificial Sequence: Synthetic oligonucleotide
ucuguuuuuuuagagaga

SEQ ID NO: 22017 - RNA, 18 nt, Artificial Sequence
  Description of Artificial Sequence: Synthetic oligonucleotide
auggcucuguuuuuuuag

SEQ ID NO: 22018 - RNA, 18 nt, Artificial Sequence
  Description of Artificial Sequence: Synthetic oligonucleotide
gagagauggcucuguuuu

SEQ ID NO: 22019 - RNA, 18 nt, Artificial Sequence
  Description of Artificial Sequence: Synthetic oligonucleotide
agaaagagagauggcucu

SEQ ID NO: 22020 - RNA, 18 nt, Artificial Sequence
  Description of Artificial Sequence: Synthetic oligonucleotide
augcaagaaagagagaug

SEQ ID NO: 22021 - RNA, 18 nt, Artificial Sequence
  Description of Artificial Sequence: Synthetic oligonucleotide
guuuaaugcaagaaagag

SEQ ID NO: 22022 - RNA, 18 nt, Artificial Sequence
  Description of Artificial Sequence: Synthetic oligonucleotide
uucuaguuuaaugcaaga

SEQ ID NO: 22023 - RNA, 18 nt, Artificial Sequence
  Description of Artificial Sequence: Synthetic oligonucleotide
gaguuuucuaguuuaaug

SEQ ID NO: 22024 - RNA, 18 nt, Artificial Sequence
  Description of Artificial Sequence: Synthetic oligonucleotide
uaagagaguuuucuaguu

SEQ ID NO: 22025 - RNA, 18 nt, Artificial Sequence
  Description of Artificial Sequence: Synthetic oligonucleotide
uuggcuaagagaguuuuc

SEQ ID NO: 22026 - RNA, 18 nt, Artificial Sequence
  Description of Artificial Sequence: Synthetic oligonucleotide
uucuguuggcuaagagag

SEQ ID NO: 22027 - RNA, 18 nt, Artificial Sequence
  Description of Artificial Sequence: Synthetic oligonucleotide
cugcauucuguuggcuaa

SEQ ID NO: 22028 - RNA, 18 nt, Artificial Sequence
  Description of Artificial Sequence: Synthetic oligonucleotide
caugacugcauucuguug

SEQ ID NO: 22029 - RNA, 18 nt, Artificial Sequence
  Description of Artificial Sequence: Synthetic oligonucleotide
gucuacaugacugcauuc

SEQ ID NO: 22030 - RNA, 18 nt, Artificial Sequence
  Description of Artificial Sequence: Synthetic oligonucleotide
aucgagucuacaugacug

SEQ ID NO: 22031 - RNA, 18 nt, Artificial Sequence
  Description of Artificial Sequence: Synthetic oligonucleotide
gcuuuaucgagucuacau

SEQ ID NO: 22032 - RNA, 18 nt, Artificial Sequence
  Description of Artificial Sequence: Synthetic oligonucleotide
uccaugcuuuaucgaguc

SEQ ID NO: 22033 - RNA, 18 nt, Artificial Sequence
  Description of Artificial Sequence: Synthetic oligonucleotide
uauguuccaugcuuuauc

SEQ ID NO: 22034 - RNA, 18 nt, Artificial Sequence
  Description of Artificial Sequence: Synthetic oligonucleotide
ggaaauauguuccaugcu

SEQ ID NO: 22035 - RNA, 18 nt, Artificial Sequence
  Description of Artificial Sequence: Synthetic oligonucleotide
aaggaggaaauauguucc

SEQ ID NO: 22036 - RNA, 18 nt, Artificial Sequence
  Description of Artificial Sequence: Synthetic oligonucleotide
aagggaaggaggaaauau

SEQ ID NO: 22037 - RNA, 18 nt, Artificial Sequence
  Description of Artificial Sequence: Synthetic oligonucleotide
ggcugaagggaaggagga

SEQ ID NO: 22038 - RNA, 18 nt, Artificial Sequence
  Description of Artificial Sequence: Synthetic oligonucleotide
cugaaggcugaagggaag

SEQ ID NO: 22039 - RNA, 18 nt, Artificial Sequence
  Description of Artificial Sequence: Synthetic oligonucleotide
gauggcugaaggcugaag

SEQ ID NO: 22040 - RNA, 18 nt, Artificial Sequence
  Description of Artificial Sequence: Synthetic oligonucleotide
gcaaagauggcugaaggc

SEQ ID NO: 22041 - RNA, 18 nt, Artificial Sequence
  Description of Artificial Sequence: Synthetic oligonucleotide
agcaagcaaagauggcug

SEQ ID NO: 22042 - RNA, 18 nt, Artificial Sequence
  Description of Artificial Sequence: Synthetic oligonucleotide
cuaagagcaagcaaagau

SEQ ID NO: 22043 - RNA, 18 nt, Artificial Sequence
  Description of Artificial Sequence: Synthetic oligonucleotide
uucagcuaagagcaagca

SEQ ID NO: 22044 - RNA, 18 nt, Artificial Sequence
  Description of Artificial Sequence: Synthetic oligonucleotide
gcagcuucagcuaagagc

SEQ ID NO: 22045 - RNA, 18 nt, Artificial Sequence
  Description of Artificial Sequence: Synthetic oligonucleotide
gaugggcagcuucagcua

SEQ ID NO: 22046 - RNA, 18 nt, Artificial Sequence
  Description of Artificial Sequence: Synthetic oligonucleotide
cccaggaugggcagcuuc

SEQ ID NO: 22047 - RNA, 18 nt, Artificial Sequence
  Description of Artificial Sequence: Synthetic oligonucleotide
gagaccccaggaugggca

SEQ ID NO: 22048 - RNA, 18 nt, Artificial Sequence
  Description of Artificial Sequence: Synthetic oligonucleotide
ccguggagaccccaggau

SEQ ID NO: 22049 - RNA, 18 nt, Artificial Sequence
  Description of Artificial Sequence: Synthetic oligonucleotide
gggugccguggagacccc

SEQ ID NO: 22050 - RNA, 18 nt, Artificial Sequence
  Description of Artificial Sequence: Synthetic oligonucleotide
gggauguaucugauuugg

SEQ ID NO: 22051 - RNA, 18 nt, Artificial Sequence
  Description of Artificial Sequence: Synthetic oligonucleotide
aguuacaaucccccaggg

SEQ ID NO: 22052 - RNA, 18 nt, Artificial Sequence
  Description of Artificial Sequence: Synthetic oligonucleotide
ugcaaaguuacaaucccc

SEQ ID NO: 22053 - RNA, 18 nt, Artificial Sequence
  Description of Artificial Sequence: Synthetic oligonucleotide
agaaaugcaaaguuacaa

SEQ ID NO: 22054 - RNA, 18 nt, Artificial Sequence
  Description of Artificial Sequence: Synthetic oligonucleotide
gggagaaaugcaaaguua

SEQ ID NO: 22055 - RNA, 18 nt, Artificial Sequence
  Description of Artificial Sequence: Synthetic oligonucleotide
guggaggugaugguuggg

SEQ ID NO: 22056 - RNA, 18 nt, Artificial Sequence
  Description of Artificial Sequence: Synthetic oligonucleotide
agagaguggaggugaugg

SEQ ID NO: 22057 - RNA, 18 nt, Artificial Sequence
  Description of Artificial Sequence: Synthetic oligonucleotide
gggagagaguggagguga

SEQ ID NO: 22058 - RNA, 18 nt, Artificial Sequence
  Description of Artificial Sequence: Synthetic oligonucleotide
ggcuuugggaggugaggg

SEQ ID NO: 22059 - RNA, 18 nt, Artificial Sequence
  Description of Artificial Sequence: Synthetic oligonucleotide
gggcuuugggaggugagg

SEQ ID NO: 22060 - RNA, 18 nt, Artificial Sequence
  Description of Artificial Sequence: Synthetic oligonucleotide
ggccagugccagggaggg

SEQ ID NO: 22061 - RNA, 18 nt, Artificial Sequence
  Description of Artificial Sequence: Synthetic oligonucleotide
gggccagugccagggagg

SEQ ID NO: 22062 - RNA, 18 nt, Artificial Sequence
  Description of Artificial Sequence: Synthetic oligonucleotide
gaggcuggucucugaggg

SEQ ID NO: 22063 - RNA, 18 nt, Artificial Sequence
  Description of Artificial Sequence: Synthetic oligonucleotide
uggcugaggcuggucucu

SEQ ID NO: 22064 - RNA, 18 nt, Artificial Sequence
  Description of Artificial Sequence: Synthetic oligonucleotide
ugguuuggcugaggcugg

SEQ ID NO: 22065 - RNA, 18 nt, Artificial Sequence
  Description of Artificial Sequence: Synthetic oligonucleotide
uucucugguuuggcugag

SEQ ID NO: 22066 - RNA, 18 nt, Artificial Sequence
  Description of Artificial Sequence: Synthetic oligonucleotide
ucacguucucugguuugg

SEQ ID NO: 22067 - RNA, 18 nt, Artificial Sequence
  Description of Artificial Sequence: Synthetic oligonucleotide
uugggucacguucucugg

SEQ ID NO: 22068 - RNA, 18 nt, Artificial Sequence
  Description of Artificial Sequence: Synthetic oligonucleotide
uacaguugggucacguuc

SEQ ID NO: 22069 - RNA, 18 nt, Artificial Sequence
  Description of Artificial Sequence: Synthetic oligonucleotide
auuucuacaguuggguca

SEQ ID NO: 22070 - RNA, 18 nt, Artificial Sequence
  Description of Artificial Sequence: Synthetic oligonucleotide
cuguuauuucuacaguug

SEQ ID NO: 22071 - RNA, 18 nt, Artificial Sequence
  Description of Artificial Sequence: Synthetic oligonucleotide
caucacuguuauuucuac

SEQ ID NO: 22072 - RNA, 18 nt, Artificial Sequence
  Description of Artificial Sequence: Synthetic oligonucleotide
ccggccaucacuguuauu

SEQ ID NO: 22073 - RNA, 18 nt, Artificial Sequence
  Description of Artificial Sequence: Synthetic oligonucleotide
ugcgcccggccaucacug

SEQ ID NO: 22074 - RNA, 18 nt, Artificial Sequence
  Description of Artificial Sequence: Synthetic oligonucleotide
gccacugcgcccggccau

SEQ ID NO: 22075 - RNA, 18 nt, Artificial Sequence
  Description of Artificial Sequence: Synthetic oligonucleotide
caugagccacugcgcccg

SEQ ID NO: 22076 - RNA, 18 nt, Artificial Sequence
  Description of Artificial Sequence: Synthetic oligonucleotide
acaggcaugagccacugc

SEQ ID NO: 22077 - RNA, 18 nt, Artificial Sequence
  Description of Artificial Sequence: Synthetic oligonucleotide
cauuccucugagaagcag

SEQ ID NO: 22078 - RNA, 18 nt, Artificial Sequence
  Description of Artificial Sequence: Synthetic oligonucleotide
cacaucauuccucugaga

SEQ ID NO: 22079 - RNA, 18 nt, Artificial Sequence
  Description of Artificial Sequence: Synthetic oligonucleotide
cagaccacaucauuccuc

SEQ ID NO: 22080 - RNA, 18 nt, Artificial Sequence
  Description of Artificial Sequence: Synthetic oligonucleotide
gggcacagaccacaucau

SEQ ID NO: 22081 - RNA, 18 nt, Artificial Sequence
  Description of Artificial Sequence: Synthetic oligonucleotide
cagaugggcacagaccac

SEQ ID NO: 22082 - RNA, 18 nt, Artificial Sequence
  Description of Artificial Sequence: Synthetic oligonucleotide
cagagcagaugggcacag

SEQ ID NO: 22083 - RNA, 18 nt, Artificial Sequence
  Description of Artificial Sequence: Synthetic oligonucleotide
caggacagagcagauggg

SEQ ID NO: 22084 - RNA, 18 nt, Artificial Sequence
  Description of Artificial Sequence: Synthetic oligonucleotide
cagaccaggacagagcag

SEQ ID NO: 22085 - RNA, 18 nt, Artificial Sequence
  Description of Artificial Sequence: Synthetic oligonucleotide
uggcccagaccaggacag

SEQ ID NO: 22086 - RNA, 18 nt, Artificial Sequence
  Description of Artificial Sequence: Synthetic oligonucleotide
uggcuuggcccagaccag

SEQ ID NO: 22087 - RNA, 18 nt, Artificial Sequence
  Description of Artificial Sequence: Synthetic oligonucleotide
aucccuggcuuggcccag

SEQ ID NO: 22088 - RNA, 18 nt, Artificial Sequence
  Description of Artificial Sequence: Synthetic oligonucleotide
acccaaucccuggcuugg

SEQ ID NO: 22089 - RNA, 18 nt, Artificial Sequence
  Description of Artificial Sequence: Synthetic oligonucleotide
cccacacccaaucccugg

SEQ ID NO: 22090 - RNA, 18 nt, Artificial Sequence
  Description of Artificial Sequence: Synthetic oligonucleotide
ggcuccccacacccaauc

SEQ ID NO: 22091 - RNA, 18 nt, Artificial Sequence
  Description of Artificial Sequence: Synthetic oligonucleotide
ccacuggcuccccacacc

SEQ ID NO: 22092 - RNA, 18 nt, Artificial Sequence
  Description of Artificial Sequence: Synthetic oligonucleotide
gggugccacuggcucccc

SEQ ID NO: 22093 - RNA, 18 nt, Artificial Sequence
  Description of Artificial Sequence: Synthetic oligonucleotide
accacagccgcugguggg

SEQ ID NO: 22094 - RNA, 18 nt, Artificial Sequence
  Description of Artificial Sequence: Synthetic oligonucleotide
aggaccacagccgcuggu

SEQ ID NO: 22095 - RNA, 18 nt, Artificial Sequence
  Description of Artificial Sequence: Synthetic oligonucleotide
gggccaggaccacagccg

SEQ ID NO: 22096 - RNA, 18 nt, Artificial Sequence
  Description of Artificial Sequence: Synthetic oligonucleotide
aacagccaaggcugaggg

SEQ ID NO: 22097 - RNA, 18 nt, Artificial Sequence
  Description of Artificial Sequence: Synthetic oligonucleotide
augcaacagccaaggcug

SEQ ID NO: 22098 - RNA, 18 nt, Artificial Sequence
  Description of Artificial Sequence: Synthetic oligonucleotide
agugcaugcaacagccaa

SEQ ID NO: 22099 - RNA, 18 nt, Artificial Sequence
  Description of Artificial Sequence: Synthetic oligonucleotide
ugagcagugcaugcaaca

SEQ ID NO: 22100 - RNA, 18 nt, Artificial Sequence
  Description of Artificial Sequence: Synthetic oligonucleotide
ggauuugagcagugcaug

SEQ ID NO: 22101 - RNA, 18 nt, Artificial Sequence
  Description of Artificial Sequence: Synthetic oligonucleotide
aagcuggauuugagcagu

SEQ ID NO: 22102 - RNA, 18 nt, Artificial Sequence
  Description of Artificial Sequence: Synthetic oligonucleotide
agcacaagcuggauuuga

SEQ ID NO: 22103 - RNA, 18 nt, Artificial Sequence
  Description of Artificial Sequence: Synthetic oligonucleotide
aaaagagcacaagcugga

SEQ ID NO: 22104 - RNA, 18 nt, Artificial Sequence
  Description of Artificial Sequence: Synthetic oligonucleotide
aaagaaaaagagcacaag

SEQ ID NO: 22105 - RNA, 18 nt, Artificial Sequence
  Description of Artificial Sequence: Synthetic oligonucleotide
accccaaagaaaaagagc

SEQ ID NO: 22106 - RNA, 18 nt, Artificial Sequence
  Description of Artificial Sequence: Synthetic oligonucleotide
gucugaccccaaagaaaa

SEQ ID NO: 22107 - RNA, 18 nt, Artificial Sequence
  Description of Artificial Sequence: Synthetic oligonucleotide
uuucagucugaccccaaa

SEQ ID NO: 22108 - RNA, 18 nt, Artificial Sequence
  Description of Artificial Sequence: Synthetic oligonucleotide
ccccguuucagucugacc

SEQ ID NO: 22109 - RNA, 18 nt, Artificial Sequence
  Description of Artificial Sequence: Synthetic oligonucleotide
gauggccccguuucaguc

SEQ ID NO: 22110 - RNA, 18 nt, Artificial Sequence
  Description of Artificial Sequence: Synthetic oligonucleotide
uucuggauggccccguuu

SEQ ID NO: 22111 - RNA, 18 nt, Artificial Sequence
  Description of Artificial Sequence: Synthetic oligonucleotide
aguucuucuggauggccc

SEQ ID NO: 22112 - RNA, 18 nt, Artificial Sequence
  Description of Artificial Sequence: Synthetic oligonucleotide
cccagaguucuucuggau

SEQ ID NO: 22113 - RNA, 18 nt, Artificial Sequence
  Description of Artificial Sequence: Synthetic oligonucleotide
ccugccccagaguucuuc

SEQ ID NO: 22114 - RNA, 18 nt, Artificial Sequence
  Description of Artificial Sequence: Synthetic oligonucleotide
cccgcccugccccagagu

SEQ ID NO: 22115 - RNA, 18 nt, Artificial Sequence
  Description of Artificial Sequence: Synthetic oligonucleotide
ccacccccgcccugcccc

SEQ ID NO: 22116 - RNA, 18 nt, Artificial Sequence
  Description of Artificial Sequence: Synthetic oligonucleotide
uugccccacccccgcccu

SEQ ID NO: 22117 - RNA, 18 nt, Artificial Sequence
  Description of Artificial Sequence: Synthetic oligonucleotide
aacccuugccccaccccc

SEQ ID NO: 22118 - RNA, 18 nt, Artificial Sequence
  Description of Artificial Sequence: Synthetic oligonucleotide
gccucaacccuugcccca

SEQ ID NO: 22119 - RNA, 18 nt, Artificial Sequence
  Description of Artificial Sequence: Synthetic oligonucleotide
gguuugccucaacccuug

SEQ ID NO: 22120 - RNA, 18 nt, Artificial Sequence
  Description of Artificial Sequence: Synthetic oligonucleotide
uccaggguuugccucaac

SEQ ID NO: 22121 - RNA, 18 nt, Artificial Sequence
  Description of Artificial Sequence: Synthetic oligonucleotide
gcauuuccaggguuugcc

SEQ ID NO: 22122 - RNA, 18 nt, Artificial Sequence
  Description of Artificial Sequence: Synthetic oligonucleotide
agcuggcauuuccagggu

SEQ ID NO: 22123 - RNA, 18 nt, Artificial Sequence
  Description of Artificial Sequence: Synthetic oligonucleotide
cugagagcuggcauuucc

SEQ ID NO: 22124 - RNA, 18 nt, Artificial Sequence
  Description of Artificial Sequence: Synthetic oligonucleotide
uugaccugagagcuggca

SEQ ID NO: 22125 - RNA, 18 nt, Artificial Sequence
  Description of Artificial Sequence: Synthetic oligonucleotide
ccugcuugaccugagagc

SEQ ID NO: 22126 - RNA, 18 nt, Artificial Sequence
  Description of Artificial Sequence: Synthetic oligonucleotide
ccccaccugcuugaccug

SEQ ID NO: 22127 - RNA, 18 nt, Artificial Sequence
  Description of Artificial Sequence: Synthetic oligonucleotide
uuuucccccaccugcuug

SEQ ID NO: 22128 - RNA, 18 nt, Artificial Sequence
  Description of Artificial Sequence: Synthetic oligonucleotide
uccuuuuuucccccaccu

SEQ ID NO: 22129 - RNA, 18 nt, Artificial Sequence
  Description of Artificial Sequence: Synthetic oligonucleotide
cccucuccuuuuuucccc

SEQ ID NO: 22130 - RNA, 18 nt, Artificial Sequence
  Description of Artificial Sequence: Synthetic oligonucleotide
cccugcccucuccuuuuu

SEQ ID NO: 22131 - RNA, 18 nt, Artificial Sequence
  Description of Artificial Sequence: Synthetic oligonucleotide
ugguccccugcccucucc

SEQ ID NO: 22132 - RNA, 18 nt, Artificial Sequence
  Description of Artificial Sequence: Synthetic oligonucleotide
acuucugguccccugccc

SEQ ID NO: 22133 - RNA, 18 nt, Artificial Sequence
  Description of Artificial Sequence: Synthetic oligonucleotide
cuuguacuucuggucccc

SEQ ID NO: 22134 - RNA, 18 nt, Artificial Sequence
  Description of Artificial Sequence: Synthetic oligonucleotide
gcucucuuguacuucugg

SEQ ID NO: 22135 - RNA, 18 nt, Artificial Sequence
  Description of Artificial Sequence: Synthetic oligonucleotide
aaaaggcucucuuguacu

SEQ ID NO: 22136 - RNA, 18 nt, Artificial Sequence
  Description of Artificial Sequence: Synthetic oligonucleotide
ggcacaaaaggcucucuu

SEQ ID NO: 22137 - RNA, 18 nt, Artificial Sequence
  Description of Artificial Sequence: Synthetic oligonucleotide
gggagggcacaaaaggcu

SEQ ID NO: 22138 - RNA, 18 nt, Artificial Sequence
  Description of Artificial Sequence: Synthetic oligonucleotide
ccgcagggagggcacaaa

SEQ ID NO: 22139 - RNA, 18 nt, Artificial Sequence
  Description of Artificial Sequence: Synthetic oligonucleotide
guggcccgcagggagggc

SEQ ID NO: 22140 - RNA, 18 nt, Artificial Sequence
  Description of Artificial Sequence: Synthetic oligonucleotide
ucuugguggcccgcaggg

SEQ ID NO: 22141 - RNA, 18 nt, Artificial Sequence
  Description of Artificial Sequence: Synthetic oligonucleotide
guuucucuugguggcccg

SEQ ID NO: 22142 - RNA, 18 nt, Artificial Sequence
  Description of Artificial Sequence: Synthetic oligonucleotide
acucaguuucucuuggug

SEQ ID NO: 22143 - RNA, 18 nt, Artificial Sequence
  Description of Artificial Sequence: Synthetic oligonucleotide
ccaguacucaguuucucu

SEQ ID NO: 22144 - RNA, 18 nt, Artificial Sequence
  Description of Artificial Sequence: Synthetic oligonucleotide
cugucccaguacucaguu

SEQ ID NO: 22145 - RNA, 18 nt, Artificial Sequence
  Description of Artificial Sequence: Synthetic oligonucleotide
guuaccugucccaguacu

SEQ ID NO: 22146 - RNA, 18 nt, Artificial Sequence
  Description of Artificial Sequence: Synthetic oligonucleotide
cuuagguuaccuguccca

SEQ ID NO: 22147 - RNA, 18 nt, Artificial Sequence
  Description of Artificial Sequence: Synthetic oligonucleotide
ucuuacuuagguuaccug

SEQ ID NO: 22148 - RNA, 18 nt, Artificial Sequence
  Description of Artificial Sequence: Synthetic oligonucleotide
gugucucuuacuuagguu

SEQ ID NO: 22149 - RNA, 18 nt, Artificial Sequence
  Description of Artificial Sequence: Synthetic oligonucleotide
cugaggugucucuuacuu

SEQ ID NO: 22150 - RNA, 18 nt, Artificial Sequence
  Description of Artificial Sequence: Synthetic oligonucleotide
ggcggcugaggugucucu

SEQ ID NO: 22151 - RNA, 18 nt, Artificial Sequence
  Description of Artificial Sequence: Synthetic oligonucleotide
gcuguggcggcugaggug

SEQ ID NO: 22152 - RNA, 18 nt, Artificial Sequence
  Description of Artificial Sequence: Synthetic oligonucleotide
ugaaagcuguggcggcug

SEQ ID NO: 22153 - RNA, 18 nt, Artificial Sequence
  Description of Artificial Sequence: Synthetic oligonucleotide
aacucugaaagcuguggc

SEQ ID NO: 22154 - RNA, 18 nt, Artificial Sequence
  Description of Artificial Sequence: Synthetic oligonucleotide
ggaagaacucugaaagcu

SEQ ID NO: 22155 - RNA, 18 nt, Artificial Sequence
  Description of Artificial Sequence: Synthetic oligonucleotide
ucccaggaagaacucuga

SEQ ID NO: 22156 - RNA, 18 nt, Artificial Sequence
  Description of Artificial Sequence: Synthetic oligonucleotide
gggagucccaggaagaac

SEQ ID NO: 22157 - RNA, 18 nt, Artificial Sequence
  Description of Artificial Sequence: Synthetic oligonucleotide
acccagggagucccagga

SEQ ID NO: 22158 - RNA, 18 nt, Artificial Sequence
  Description of Artificial Sequence: Synthetic oligonucleotide
ccccuacccagggagucc

SEQ ID NO: 22159 - RNA, 18 nt, Artificial Sequence
  Description of Artificial Sequence: Synthetic oligonucleotide
gcccgccccuacccaggg

SEQ ID NO: 22160 - RNA, 18 nt, Artificial Sequence
  Description of Artificial Sequence: Synthetic oligonucleotide
gccgcgcccgccccuacc

SEQ ID NO: 22161 - RNA, 18 nt, Artificial Sequence
  Description of Artificial Sequence: Synthetic oligonucleotide
cgugagccgcgcccgccc

SEQ ID NO: 22162 - RNA, 18 nt, Artificial Sequence
  Description of Artificial Sequence: Synthetic oligonucleotide
ucucccgugagccgcgcc

SEQ ID NO: 22163 - RNA, 18 nt, Artificial Sequence
  Description of Artificial Sequence: Synthetic oligonucleotide
cugggucucccgugagcc

SEQ ID NO: 22164 - RNA, 18 nt, Artificial Sequence
  Description of Artificial Sequence: Synthetic oligonucleotide
cccuccugggucucccgu

SEQ ID NO: 22165 - RNA, 18 nt, Artificial Sequence
  Description of Artificial Sequence: Synthetic oligonucleotide
ggcaucccuccugggucu

SEQ ID NO: 22166 - RNA, 18 nt, Artificial Sequence
  Description of Artificial Sequence: Synthetic oligonucleotide
ucccaggcaucccuccug

SEQ ID NO: 22167 - RNA, 18 nt, Artificial Sequence
  Description of Artificial Sequence: Synthetic oligonucleotide
gucauucccaggcauccc

SEQ ID NO: 22168 - RNA, 18 nt, Artificial Sequence
  Description of Artificial Sequence: Synthetic oligonucleotide
gcgcagucauucccaggc

SEQ ID NO: 22169 - RNA, 18 nt, Artificial Sequence
  Description of Artificial Sequence: Synthetic oligonucleotide
ggcaagcgcagucauucc

SEQ ID NO: 22170 - RNA, 18 nt, Artificial Sequence
  Description of Artificial Sequence: Synthetic oligonucleotide
gguccauccgcagaagcc

SEQ ID NO: 22171 - RNA, 18 nt, Artificial Sequence
  Description of Artificial Sequence: Synthetic oligonucleotide
gggcagguccauccgcag

SEQ ID NO: 22172 - RNA, 18 nt, Artificial Sequence
  Description of Artificial Sequence: Synthetic oligonucleotide
gcgacgggcagguccauc

SEQ ID NO: 22173 - RNA, 18 nt, Artificial Sequence
  Description of Artificial Sequence: Synthetic oligonucleotide
caucugcgacgggcaggu

SEQ ID NO: 22174 - RNA, 18 nt, Artificial Sequence
  Description of Artificial Sequence: Synthetic oligonucleotide
guugucaucugcgacggg

SEQ ID NO: 22175 - RNA, 18 nt, Artificial Sequence
  Description of Artificial Sequence: Synthetic oligonucleotide
acgguguugucaucugcg

SEQ ID NO: 22176 - RNA, 18 nt, Artificial Sequence
  Description of Artificial Sequence: Synthetic oligonucleotide
aguggacgguguugucau

SEQ ID NO: 22177 - RNA, 18 nt, Artificial Sequence
  Description of Artificial Sequence: Synthetic oligonucleotide
auugaaguggacgguguu

SEQ ID NO: 22178 - RNA, 18 nt, Artificial Sequence
  Description of Artificial Sequence: Synthetic oligonucleotide
guggaauugaaguggacg

SEQ ID NO: 22179 - RNA, 18 nt, Artificial Sequence
  Description of Artificial Sequence: Synthetic oligonucleotide
ugaggguggaauugaagu

SEQ ID NO: 22180 - RNA, 18 nt, Artificial Sequence
  Description of Artificial Sequence: Synthetic oligonucleotide
agccaugaggguggaauu

SEQ ID NO: 22181 - RNA, 18 nt, Artificial Sequence
  Description of Artificial Sequence: Synthetic oligonucleotide
aucagagccaugagggug

SEQ ID NO: 22182 - RNA, 18 nt, Artificial Sequence
  Description of Artificial Sequence: Synthetic oligonucleotide
ugcggaucagagccauga

SEQ ID NO: 22183 - RNA, 18 nt, Artificial Sequence
  Description of Artificial Sequence: Synthetic oligonucleotide
ggcugugcggaucagagc

SEQ ID NO: 22184 - RNA, 18 nt, Artificial Sequence
  Description of Artificial Sequence: Synthetic oligonucleotide
uccagggcugugcggauc

SEQ ID NO: 22185 - RNA, 18 nt, Artificial Sequence
  Description of Artificial Sequence: Synthetic oligonucleotide
ugauguccagggcugugc

SEQ ID NO: 22186 - RNA, 18 nt, Artificial Sequence
  Description of Artificial Sequence: Synthetic oligonucleotide
aaucuugauguccagggc

SEQ ID NO: 22187 - RNA, 18 nt, Artificial Sequence
  Description of Artificial Sequence: Synthetic oligonucleotide
uuggcaaucuugaugucc

SEQ ID NO: 22188 - RNA, 18 nt, Artificial Sequence
  Description of Artificial Sequence: Synthetic oligonucleotide
gacuuguggguguucuca

SEQ ID NO: 22189 - RNA, 18 nt, Artificial Sequence
  Description of Artificial Sequence: Synthetic oligonucleotide
gaguggacuugugggugu

SEQ ID NO: 22190 - RNA, 18 nt, Artificial Sequence
  Description of Artificial Sequence: Synthetic oligonucleotide
cgcuggaguggacuugug

SEQ ID NO: 22191 - RNA, 18 nt, Artificial Sequence
  Description of Artificial Sequence: Synthetic oligonucleotide
uagcucgcuggaguggac

SEQ ID NO: 22192 - RNA, 18 nt, Artificial Sequence
  Description of Artificial Sequence: Synthetic oligonucleotide
cgugguagcucgcuggag

SEQ ID NO: 22193 - RNA, 18 nt, Artificial Sequence
  Description of Artificial Sequence: Synthetic oligonucleotide
gucugcgugguagcucgc

SEQ ID NO: 22194 - RNA, 18 nt, Artificial Sequence
  Description of Artificial Sequence: Synthetic oligonucleotide
uugaugucugcgugguag

SEQ ID NO: 22195 - RNA, 18 nt, Artificial Sequence
  Description of Artificial Sequence: Synthetic oligonucleotide
gcagguugaugucugcgu

SEQ ID NO: 22196 - RNA, 18 nt, Artificial Sequence
  Description of Artificial Sequence: Synthetic oligonucleotide
guagagcagguugauguc

SEQ ID NO: 22197 - RNA, 18 nt, Artificial Sequence
  Description of Artificial Sequence: Synthetic oligonucleotide
cuccaguagagcagguug

SEQ ID NO: 22198 - RNA, 18 nt, Artificial Sequence
  Description of Artificial Sequence: Synthetic oligonucleotide
cgucgcuccaguagagca

SEQ ID NO: 22199 - RNA, 18 nt, Artificial Sequence
  Description of Artificial Sequence: Synthetic oligonucleotide
cuccucgucgcuccagua

SEQ ID NO: 22200 - RNA, 18 nt, Artificial Sequence
  Description of Artificial Sequence: Synthetic oligonucleotide
acggccuccucgucgcuc

SEQ ID NO: 22201 - RNA, 18 nt, Artificial Sequence
  Description of Artificial Sequence: Synthetic oligonucleotide
ccaccacggccuccucgu

SEQ ID NO: 22202 - RNA, 18 nt, Artificial Sequence
  Description of Artificial Sequence: Synthetic oligonucleotide
gaaguccaccacggccuc

SEQ ID NO: 22203 - RNA, 18 nt, Artificial Sequence
  Description of Artificial Sequence: Synthetic oligonucleotide
gccuugaaguccaccacg

SEQ ID NO: 22204 - RNA, 18 nt, Artificial Sequence
  Description of Artificial Sequence: Synthetic oligonucleotide
gcacagccuugaagucca

SEQ ID NO: 22205 - RNA, 18 nt, Artificial Sequence
  Description of Artificial Sequence: Synthetic oligonucleotide
gcccugcacagccuugaa

SEQ ID NO: 22206 - RNA, 18 nt, Artificial Sequence
  Description of Artificial Sequence: Synthetic oligonucleotide
cagcggcccugcacagcc

SEQ ID NO: 22207 - RNA, 18 nt, Artificial Sequence
  Description of Artificial Sequence: Synthetic oligonucleotide
cggugcagcggcccugca

SEQ ID NO: 22208 - RNA, 18 nt, Artificial Sequence
  Description of Artificial Sequence: Synthetic oligonucleotide
cuccacggugcagcggcc

SEQ ID NO: 22209 - RNA, 18 nt, Artificial Sequence
  Description of Artificial Sequence: Synthetic oligonucleotide
ccauacuccacggugcag

SEQ ID NO: 22210 - RNA, 18 nt, Artificial Sequence
  Description of Artificial Sequence: Synthetic oligonucleotide
ccuccccauacuccacgg

SEQ ID NO: 22211 - RNA, 18 nt, Artificial Sequence
  Description of Artificial Sequence: Synthetic oligonucleotide
cagguccuccccauacuc

SEQ ID NO: 22212 - RNA, 18 nt, Artificial Sequence
  Description of Artificial Sequence: Synthetic oligonucleotide
ucgggcagguccucccca

SEQ ID NO: 22213 - RNA, 18 nt, Artificial Sequence
  Description of Artificial Sequence: Synthetic oligonucleotide
cgcacucgggcagguccu

SEQ ID NO: 22214 - RNA, 18 nt, Artificial Sequence
  Description of Artificial Sequence: Synthetic oligonucleotide
cuggacgcacucgggcag

SEQ ID NO: 22215 - RNA, 18 nt, Artificial Sequence
  Description of Artificial Sequence: Synthetic oligonucleotide
uacaccuggacgcacucg

SEQ ID NO: 22216 - RNA, 18 nt, Artificial Sequence
  Description of Artificial Sequence: Synthetic oligonucleotide
uggaguacaccuggacgc

SEQ ID NO: 22217 - RNA, 18 nt, Artificial Sequence
  Description of Artificial Sequence: Synthetic oligonucleotide
gcccauggaguacaccug

SEQ ID NO: 22218 - RNA, 18 nt, Artificial Sequence
  Description of Artificial Sequence: Synthetic oligonucleotide
gggccgcccauggaguac

SEQ ID NO: 22219 - RNA, 18 nt, Artificial Sequence
  Description of Artificial Sequence: Synthetic oligonucleotide
gaaguagaagcgguuggg

SEQ ID NO: 22220 - RNA, 18 nt, Artificial Sequence
  Description of Artificial Sequence: Synthetic oligonucleotide
gaggaaguagaagcgguu

SEQ ID NO: 22221 - RNA, 18 nt, Artificial Sequence
  Description of Artificial Sequence: Synthetic oligonucleotide
ccuucccucuagcaagca

SEQ ID NO: 22222 - RNA, 18 nt, Artificial Sequence
  Description of Artificial Sequence: Synthetic oligonucleotide
cgaagccuucccucuagc

SEQ ID NO: 22223 - RNA, 18 nt, Artificial Sequence
  Description of Artificial Sequence: Synthetic oligonucleotide
gaccccgaagccuucccu

SEQ ID NO: 22224 - RNA, 18 nt, Artificial Sequence
  Description of Artificial Sequence: Synthetic oligonucleotide
acuuugaccccgaagccu

SEQ ID NO: 22225 - RNA, 18 nt, Artificial Sequence
  Description of Artificial Sequence: Synthetic oligonucleotide
ggccaacuuugaccccga

SEQ ID NO: 22226 - RNA, 18 nt, Artificial Sequence
  Description of Artificial Sequence: Synthetic oligonucleotide
cuucuggccaacuuugac

SEQ ID NO: 22227 - RNA, 18 nt, Artificial Sequence
  Description of Artificial Sequence: Synthetic oligonucleotide
gacuccuucuggccaacu

SEQ ID NO: 22228 - RNA, 18 nt, Artificial Sequence
  Description of Artificial Sequence: Synthetic oligonucleotide
caucagacuccuucuggc

SEQ ID NO: 22229 - RNA, 18 nt, Artificial Sequence
  Description of Artificial Sequence: Synthetic oligonucleotide
cccgacaucagacuccuu

SEQ ID NO: 22230 - RNA, 18 nt, Artificial Sequence
  Description of Artificial Sequence: Synthetic oligonucleotide
uauaacccgacaucagac

SEQ ID NO: 22231 - RNA, 18 nt, Artificial Sequence
  Description of Artificial Sequence: Synthetic oligonucleotide
uuguguauaacccgacau

SEQ ID NO: 22232 - RNA, 18 nt, Artificial Sequence
  Description of Artificial Sequence: Synthetic oligonucleotide
ccgccuuguguauaaccc

SEQ ID NO: 22233 - RNA, 18 nt, Artificial Sequence
  Description of Artificial Sequence: Synthetic oligonucleotide
ccaagccgccuuguguau

SEQ ID NO: 22234 - RNA, 18 nt, Artificial Sequence
  Description of Artificial Sequence: Synthetic oligonucleotide
ugcagccaagccgccuug

SEQ ID NO: 22235 - RNA, 18 nt, Artificial Sequence
  Description of Artificial Sequence: Synthetic oligonucleotide
aacccugcagccaagccg

SEQ ID NO: 22236 - RNA, 18 nt, Artificial Sequence
  Description of Artificial Sequence: Synthetic oligonucleotide
gcugaaacccugcagcca

SEQ ID NO: 22237 - RNA, 18 nt, Artificial Sequence
  Description of Artificial Sequence: Synthetic oligonucleotide
caaaagcugaaacccugc

SEQ ID NO: 22238 - RNA, 18 nt, Artificial Sequence
  Description of Artificial Sequence: Synthetic oligonucleotide
ucuuacaaaagcugaaac

SEQ ID NO: 22239 - RNA, 18 nt, Artificial Sequence
  Description of Artificial Sequence: Synthetic oligonucleotide
ccacuucuuacaaaagcu

SEQ ID NO: 22240 - RNA, 18 nt, Artificial Sequence
  Description of Artificial Sequence: Synthetic oligonucleotide
accacccacuucuuacaa

SEQ ID NO: 22241 - RNA, 18 nt, Artificial Sequence
  Description of Artificial Sequence: Synthetic oligonucleotide
agccaaccacccacuucu

SEQ ID NO: 22242 - RNA, 18 nt, Artificial Sequence
  Description of Artificial Sequence: Synthetic oligonucleotide
acgucagccaaccaccca

SEQ ID NO: 22243 - RNA, 18 nt, Artificial Sequence
  Description of Artificial Sequence: Synthetic oligonucleotide
gcuucacgucagccaacc

SEQ ID NO: 22244 - RNA, 18 nt, Artificial Sequence
  Description of Artificial Sequence: Synthetic oligonucleotide
gaacagcuucacgucagc

SEQ ID NO: 22245 - RNA, 18 nt, Artificial Sequence
  Description of Artificial Sequence: Synthetic oligonucleotide
cugcagaacagcuucacg

SEQ ID NO: 22246 - RNA, 18 nt, Artificial Sequence
  Description of Artificial Sequence: Synthetic oligonucleotide
agcuccugcagaacagcu

SEQ ID NO: 22247 - RNA, 18 nt, Artificial Sequence
  Description of Artificial Sequence: Synthetic oligonucleotide
cguaaagcuccugcagaa

SEQ ID NO: 22248 - RNA, 18 nt, Artificial Sequence
  Description of Artificial Sequence: Synthetic oligonucleotide
acccccguaaagcuccug

SEQ ID NO: 22249 - RNA, 18 nt, Artificial Sequence
  Description of Artificial Sequence: Synthetic oligonucleotide
cucagacccccguaaagc

SEQ ID NO: 22250 - RNA, 18 nt, Artificial Sequence
  Description of Artificial Sequence: Synthetic oligonucleotide
cccugcucagacccccgu

SEQ ID NO: 22251 - RNA, 18 nt, Artificial Sequence
  Description of Artificial Sequence: Synthetic oligonucleotide
gagaacccugcucagacc

SEQ ID NO: 22252 - RNA, 18 nt, Artificial Sequence
  Description of Artificial Sequence: Synthetic oligonucleotide
cucuggagaacccugcuc

SEQ ID NO: 22253 - RNA, 18 nt, Artificial Sequence
  Description of Artificial Sequence: Synthetic oligonucleotide
uugugcucuggagaaccc

SEQ ID NO: 22254 - RNA, 18 nt, Artificial Sequence
  Description of Artificial Sequence: Synthetic oligonucleotide
acaacuugugcucuggag

SEQ ID NO: 22255 - RNA, 18 nt, Artificial Sequence
  Description of Artificial Sequence: Synthetic oligonucleotide
cucauacaacuugugcuc

SEQ ID NO: 22256 - RNA, 18 nt, Artificial Sequence
  Description of Artificial Sequence: Synthetic oligonucleotide
ugaaucucauacaacuug

SEQ ID NO: 22257 - RNA, 18 nt, Artificial Sequence
  Description of Artificial Sequence: Synthetic oligonucleotide
ccacuugaaucucauaca

SEQ ID NO: 22258 - RNA, 18 nt, Artificial Sequence
  Description of Artificial Sequence: Synthetic oligonucleotide
cgggaccacuugaaucuc

SEQ ID NO: 22259 - RNA, 18 nt, Artificial Sequence
  Description of Artificial Sequence: Synthetic oligonucleotide
aacuccgggaccacuuga

SEQ ID NO: 22260 - RNA, 18 nt, Artificial Sequence
  Description of Artificial Sequence: Synthetic oligonucleotide
uguuaaacuccgggacca

SEQ ID NO: 22261 - RNA, 18 nt, Artificial Sequence
  Description of Artificial Sequence: Synthetic oligonucleotide
aggaguguuaaacuccgg

SEQ ID NO: 22262 - RNA, 18 nt, Artificial Sequence
  Description of Artificial Sequence: Synthetic oligonucleotide
aaaccaggaguguuaaac

SEQ ID NO: 22263 - RNA, 18 nt, Artificial Sequence
  Description of Artificial Sequence: Synthetic oligonucleotide
uuuaaaaaccaggagugu

SEQ ID NO: 22264 - RNA, 18 nt, Artificial Sequence
  Description of Artificial Sequence: Synthetic oligonucleotide
uacuuuuuaaaaaccagg

SEQ ID NO: 22265 - RNA, 18 nt, Artificial Sequence
  Description of Artificial Sequence: Synthetic oligonucleotide
ugacguacuuuuuaaaaa

SEQ ID NO: 22266 - RNA, 18 nt, Artificial Sequence
  Description of Artificial Sequence: Synthetic oligonucleotide
ucuaaugacguacuuuuu

SEQ ID NO: 22267 - RNA, 18 nt, Artificial Sequence
  Description of Artificial Sequence: Synthetic oligonucleotide
gguucucuaaugacguac

SEQ ID NO: 22268 - RNA, 18 nt, Artificial Sequence
  Description of Artificial Sequence: Synthetic oligonucleotide
cguuagguucucuaauga

SEQ ID NO: 22269 - RNA, 18 nt, Artificial Sequence
  Description of Artificial Sequence: Synthetic oligonucleotide
uaaaacguuagguucucu

SEQ ID NO: 22270 - RNA, 18 nt, Artificial Sequence
  Description of Artificial Sequence: Synthetic oligonucleotide
gacacuaaaacguuaggu

SEQ ID NO: 22271 - RNA, 18 nt, Artificial Sequence
  Description of Artificial Sequence: Synthetic oligonucleotide
accaagacacuaaaacgu

SEQ ID NO: 22272 - RNA, 18 nt, Artificial Sequence
  Description of Artificial Sequence: Synthetic oligonucleotide
guugcaccaagacacuaa

SEQ ID NO: 22273 - RNA, 18 nt, Artificial Sequence
  Description of Artificial Sequence: Synthetic oligonucleotide
guucaguugcaccaagac

SEQ ID NO: 22274 - RNA, 18 nt, Artificial Sequence
  Description of Artificial Sequence: Synthetic oligonucleotide
ucaacguucaguugcacc

SEQ ID NO: 22275 - RNA, 18 nt, Artificial Sequence
  Description of Artificial Sequence: Synthetic oligonucleotide
gguccucaacguucaguu

SEQ ID NO: 22276 - RNA, 18 nt, Artificial Sequence
  Description of Artificial Sequence: Synthetic oligonucleotide
cucaugguccucaacguu

SEQ ID NO: 22277 - RNA, 18 nt, Artificial Sequence
  Description of Artificial Sequence: Synthetic oligonucleotide
gcugccucaugguccuca

SEQ ID NO: 22278 - RNA, 18 nt, Artificial Sequence
  Description of Artificial Sequence: Synthetic oligonucleotide
uggaagcugccucauggu

SEQ ID NO: 22279 - RNA, 18 nt, Artificial Sequence
  Description of Artificial Sequence: Synthetic oligonucleotide
gcugguggaagcugccuc

SEQ ID NO: 22280 - RNA, 18 nt, Artificial Sequence
  Description of Artificial Sequence: Synthetic oligonucleotide
gucaggcugguggaagcu

SEQ ID NO: 22281 - RNA, 18 nt, Artificial Sequence
  Description of Artificial Sequence: Synthetic oligonucleotide
caccagucaggcuggugg

SEQ ID NO: 22282 - RNA, 18 nt, Artificial Sequence
  Description of Artificial Sequence: Synthetic oligonucleotide
uaagacaccagucaggcu

SEQ ID NO: 22283 - RNA, 18 nt, Artificial Sequence
  Description of Artificial Sequence: Synthetic oligonucleotide
cauacuaagacaccaguc

SEQ ID NO: 22284 - RNA, 18 nt, Artificial Sequence
  Description of Artificial Sequence: Synthetic oligonucleotide
caacucauacuaagacac

SEQ ID NO: 22285 - RNA, 18 nt, Artificial Sequence
  Description of Artificial Sequence: Synthetic oligonucleotide
uucuccaacucauacuaa

SEQ ID NO: 22286 - RNA, 18 nt, Artificial Sequence
  Description of Artificial Sequence: Synthetic oligonucleotide
gcaccuucuccaacucau

SEQ ID NO: 22287 - RNA, 18 nt, Artificial Sequence
  Description of Artificial Sequence: Synthetic oligonucleotide
gggcaccuucuccaacuc

SEQ ID NO: 22288 - RNA, 18 nt, Artificial Sequence
  Description of Artificial Sequence: Synthetic oligonucleotide
agggacccaggagcaggg

SEQ ID NO: 22289 - RNA, 18 nt, Artificial Sequence
  Description of Artificial Sequence: Synthetic oligonucleotide
gcccaagggacccaggag

SEQ ID NO: 22290 - RNA, 18 nt, Artificial Sequence
  Description of Artificial Sequence: Synthetic oligonucleotide
gccuggcccaagggaccc

SEQ ID NO: 22291 - RNA, 18 nt, Artificial Sequence
  Description of Artificial Sequence: Synthetic oligonucleotide
uaggcgccuggcccaagg

SEQ ID NO: 22292 - RNA, 18 nt, Artificial Sequence
  Description of Artificial Sequence: Synthetic oligonucleotide
ggacguaggcgccuggcc

SEQ ID NO: 22293 - RNA, 18 nt, Artificial Sequence
  Description of Artificial Sequence: Synthetic oligonucleotide
ggccuggacguaggcgcc

SEQ ID NO: 22294 - RNA, 18 nt, Artificial Sequence
  Description of Artificial Sequence: Synthetic oligonucleotide
ggcugggccuggacguag

SEQ ID NO: 22295 - RNA, 18 nt, Artificial Sequence
  Description of Artificial Sequence: Synthetic oligonucleotide
augugggcugggccugga

SEQ ID NO: 22296 - RNA, 18 nt, Artificial Sequence
  Description of Artificial Sequence: Synthetic oligonucleotide
caggcaugugggcugggc

SEQ ID NO: 22297 - RNA, 18 nt, Artificial Sequence
  Description of Artificial Sequence: Synthetic oligonucleotide
ccgcacaggcaugugggc

SEQ ID NO: 22298 - RNA, 18 nt, Artificial Sequence
  Description of Artificial Sequence: Synthetic oligonucleotide
gccacccgcacaggcaug

SEQ ID NO: 22299 - RNA, 18 nt, Artificial Sequence
  Description of Artificial Sequence: Synthetic oligonucleotide
cgagggccacccgcacag

SEQ ID NO: 22300 - RNA, 18 nt, Artificial Sequence
  Description of Artificial Sequence: Synthetic oligonucleotide
cauaacgagggccacccg

SEQ ID NO: 22301 - RNA, 18 nt, Artificial Sequence
  Description of Artificial Sequence: Synthetic oligonucleotide
cucuccauaacgagggcc

SEQ ID NO: 22302 - RNA, 18 nt, Artificial Sequence
  Description of Artificial Sequence: Synthetic oligonucleotide
gggcccucuccauaacga

SEQ ID NO: 22303 - RNA, 18 nt, Artificial Sequence
  Description of Artificial Sequence: Synthetic oligonucleotide
cucgugggcccucuccau

SEQ ID NO: 22304 - RNA, 18 nt, Artificial Sequence
  Description of Artificial Sequence: Synthetic oligonucleotide
augugggcugggccugga

SEQ ID NO: 22305 - RNA, 18 nt, Artificial Sequence
  Description of Artificial Sequence: Synthetic oligonucleotide
caggcaugugggcugggc

SEQ ID NO: 22306 - RNA, 18 nt, Artificial Sequence
  Description of Artificial Sequence: Synthetic oligonucleotide
ccgcacaggcaugugggc

SEQ ID NO: 22307 - RNA, 18 nt, Artificial Sequence
  Description of Artificial Sequence: Synthetic oligonucleotide
gccacccgcacaggcaug

SEQ ID NO: 22308 - RNA, 18 nt, Artificial Sequence
  Description of Artificial Sequence: Synthetic oligonucleotide
cgagggccacccgcacag

SEQ ID NO: 22309 - RNA, 18 nt, Artificial Sequence
  Description of Artificial Sequence: Synthetic oligonucleotide
cauaacgagggccacccg

SEQ ID NO: 22310 - RNA, 18 nt, Artificial Sequence
  Description of Artificial Sequence: Synthetic oligonucleotide
cucuccauaacgagggcc

SEQ ID NO: 22311 - RNA, 18 nt, Artificial Sequence
  Description of Artificial Sequence: Synthetic oligonucleotide
gggcccucuccauaacga

SEQ ID NO: 22312 - RNA, 18 nt, Artificial Sequence
  Description of Artificial Sequence: Synthetic oligonucleotide
cucgugggcccucuccau

SEQ ID NO: 22313 - RNA, 18 nt, Artificial Sequence
  Description of Artificial Sequence: Synthetic oligonucleotide
gcugacucgugggcccuc

SEQ ID NO: 22314 - RNA, 18 nt, Artificial Sequence
  Description of Artificial Sequence: Synthetic oligonucleotide
gaucagcugacucguggg

SEQ ID NO: 22315 - RNA, 18 nt, Artificial Sequence
  Description of Artificial Sequence: Synthetic oligonucleotide
agcuugaucagcugacuc

SEQ ID NO: 22316 - RNA, 18 nt, Artificial Sequence
  Description of Artificial Sequence: Synthetic oligonucleotide
ucaugagcuugaucagcu

SEQ ID NO: 22317 - RNA, 18 nt, Artificial Sequence
  Description of Artificial Sequence: Synthetic oligonucleotide
acaagucaugagcuugau

SEQ ID NO: 22318 - RNA, 18 nt, Artificial Sequence
  Description of Artificial Sequence: Synthetic oligonucleotide
aauuuacaagucaugagc

SEQ ID NO: 22319 - RNA, 18 nt, Artificial Sequence
  Description of Artificial Sequence: Synthetic oligonucleotide
ccaacaauuuacaaguca

SEQ ID NO: 22320 - RNA, 18 nt, Artificial Sequence
  Description of Artificial Sequence: Synthetic oligonucleotide
aagccccaacaauuuaca

SEQ ID NO: 22321 - RNA, 18 nt, Artificial Sequence
  Description of Artificial Sequence: Synthetic oligonucleotide
aggccaagccccaacaau

SEQ ID NO: 22322 - RNA, 18 nt, Artificial Sequence
  Description of Artificial Sequence: Synthetic oligonucleotide
cggaaaggccaagcccca

SEQ ID NO: 22323 - RNA, 18 nt, Artificial Sequence
  Description of Artificial Sequence: Synthetic oligonucleotide
caacacggaaaggccaag

SEQ ID NO: 22324 - RNA, 18 nt, Artificial Sequence
  Description of Artificial Sequence: Synthetic oligonucleotide
gguaacaacacggaaagg

SEQ ID NO: 22325 - RNA, 18 nt, Artificial Sequence
  Description of Artificial Sequence: Synthetic oligonucleotide
uuuaagguaacaacacgg

SEQ ID NO: 22326 - RNA, 18 nt, Artificial Sequence
  Description of Artificial Sequence: Synthetic oligonucleotide
aucguuuuaagguaacaa

SEQ ID NO: 22327 - RNA, 18 nt, Artificial Sequence
  Description of Artificial Sequence: Synthetic oligonucleotide
gauguaucguuuuaaggu

SEQ ID NO: 22328 - RNA, 18 nt, Artificial Sequence
  Description of Artificial Sequence: Synthetic oligonucleotide
acguggauguaucguuuu

SEQ ID NO: 22329 - RNA, 18 nt, Artificial Sequence
  Description of Artificial Sequence: Synthetic oligonucleotide
ggagaacguggauguauc

SEQ ID NO: 22330 - RNA, 18 nt, Artificial Sequence
  Description of Artificial Sequence: Synthetic oligonucleotide
gccugggagaacguggau

SEQ ID NO: 22331 - RNA, 18 nt, Artificial Sequence
  Description of Artificial Sequence: Synthetic oligonucleotide
uccaugccugggagaacg

SEQ ID NO: 22332 - RNA, 18 nt, Artificial Sequence
  Description of Artificial Sequence: Synthetic oligonucleotide
ccucauccaugccuggga

SEQ ID NO: 22333 - RNA, 18 nt, Artificial Sequence
  Description of Artificial Sequence: Synthetic oligonucleotide
ggcuaccucauccaugcc

SEQ ID NO: 22334 - RNA, 18 nt, Artificial Sequence
  Description of Artificial Sequence: Synthetic oligonucleotide
aauugggcuaccucaucc

SEQ ID NO: 22335 - RNA, 18 nt, Artificial Sequence
  Description of Artificial Sequence: Synthetic oligonucleotide
uguccaauugggcuaccu

SEQ ID NO: 22336 - RNA, 18 nt, Artificial Sequence
  Description of Artificial Sequence: Synthetic oligonucleotide
ucugcuguccaauugggc

SEQ ID NO: 22337 - RNA, 18 nt, Artificial Sequence
  Description of Artificial Sequence: Synthetic oligonucleotide
cagaaucugcuguccaau

SEQ ID NO: 22338 - RNA, 18 nt, Artificial Sequence
  Description of Artificial Sequence: Synthetic oligonucleotide
cuaugcagaaucugcugu

SEQ ID NO: 22339 - RNA, 18 nt, Artificial Sequence
  Description of Artificial Sequence: Synthetic oligonucleotide
aagugcuaugcagaaucu

SEQ ID NO: 22340 - RNA, 18 nt, Artificial Sequence
  Description of Artificial Sequence: Synthetic oligonucleotide
ggaaaaagugcuaugcag

SEQ ID NO: 22341 - RNA, 18 nt, Artificial Sequence
  Description of Artificial Sequence: Synthetic oligonucleotide
gaacaggaaaaagugcua

SEQ ID NO: 22342 - RNA, 18 nt, Artificial Sequence
  Description of Artificial Sequence: Synthetic oligonucleotide
uucuagaacaggaaaaag

SEQ ID NO: 22343 - RNA, 18 nt, Artificial Sequence
  Description of Artificial Sequence: Synthetic oligonucleotide
guaccuucuagaacagga

SEQ ID NO: 22344 - RNA, 18 nt, Artificial Sequence
  Description of Artificial Sequence: Synthetic oligonucleotide
ugagaguaccuucuagaa

SEQ ID NO: 22345 - RNA, 18 nt, Artificial Sequence
  Description of Artificial Sequence: Synthetic oligonucleotide
gcacuugagaguaccuuc

SEQ ID NO: 22346 - RNA, 18 nt, Artificial Sequence
  Description of Artificial Sequence: Synthetic oligonucleotide
uacaagcacuugagagua

SEQ ID NO: 22347 - RNA, 18 nt, Artificial Sequence
  Description of Artificial Sequence: Synthetic oligonucleotide
ccuauuacaagcacuuga

SEQ ID NO: 22348 - RNA, 18 nt, Artificial Sequence
  Description of Artificial Sequence: Synthetic oligonucleotide
aaaugccuauuacaagca

SEQ ID NO: 22349 - RNA, 18 nt, Artificial Sequence
  Description of Artificial Sequence: Synthetic oligonucleotide
cacugaaaugccuauuac

SEQ ID NO: 22350 - RNA, 18 nt, Artificial Sequence
  Description of Artificial Sequence: Synthetic oligonucleotide
gcugacacugaaaugccu

SEQ ID NO: 22351 - RNA, 18 nt, Artificial Sequence
  Description of Artificial Sequence: Synthetic oligonucleotide
aucuggcugacacugaaa

SEQ ID NO: 22352 - RNA, 18 nt, Artificial Sequence
  Description of Artificial Sequence: Synthetic oligonucleotide
auuugaucuggcugacac

SEQ ID NO: 22353 - RNA, 18 nt, Artificial Sequence
  Description of Artificial Sequence: Synthetic oligonucleotide
cuaacauuugaucuggcu

SEQ ID NO: 22354 - RNA, 18 nt, Artificial Sequence
  Description of Artificial Sequence: Synthetic oligonucleotide
uaauacuaacauuugauc

SEQ ID NO: 22355 - RNA, 18 nt, Artificial Sequence
  Description of Artificial Sequence: Synthetic oligonucleotide
uuuauuaauacuaacauu

SEQ ID NO: 22356 - RNA, 18 nt, Artificial Sequence
  Description of Artificial Sequence: Synthetic oligonucleotide
uccauuuuauuaauacua

SEQ ID NO: 22357 - RNA, 18 nt, Artificial Sequence
  Description of Artificial Sequence: Synthetic oligonucleotide
aacaauccauuuuauuaa

SEQ ID NO: 22358 - RNA, 18 nt, Artificial Sequence
  Description of Artificial Sequence: Synthetic oligonucleotide
cuuaaaacaauccauuuu

SEQ ID NO: 22359 - RNA, 18 nt, Artificial Sequence
  Description of Artificial Sequence: Synthetic oligonucleotide
agaaacuuaaaacaaucc

SEQ ID NO: 22360 - RNA, 18 nt, Artificial Sequence
  Description of Artificial Sequence: Synthetic oligonucleotide
acaauagaaacuuaaaac

SEQ ID NO: 22361 - RNA, 18 nt, Artificial Sequence
  Description of Artificial Sequence: Synthetic oligonucleotide
uugcuacaauagaaacuu

SEQ ID NO: 22362 - RNA, 18 nt, Artificial Sequence
  Description of Artificial Sequence: Synthetic oligonucleotide
ugacuuugcuacaauaga

SEQ ID NO: 22363 - RNA, 18 nt, Artificial Sequence
  Description of Artificial Sequence: Synthetic oligonucleotide
uaguuugacuuugcuaca

SEQ ID NO: 22364 - RNA, 18 nt, Artificial Sequence
  Description of Artificial Sequence: Synthetic oligonucleotide
aagaguaguuugacuuug

SEQ ID NO: 22365 - RNA, 18 nt, Artificial Sequence
  Description of Artificial Sequence: Synthetic oligonucleotide
ccaauaagaguaguuuga

SEQ ID NO: 22366 - RNA, 18 nt, Artificial Sequence
  Description of Artificial Sequence: Synthetic oligonucleotide
agccaccaauaagaguag

SEQ ID NO: 22367 - RNA, 18 nt, Artificial Sequence
  Description of Artificial Sequence: Synthetic oligonucleotide
caauuagccaccaauaag

SEQ ID NO: 22368 - RNA, 18 nt, Artificial Sequence
  Description of Artificial Sequence: Synthetic oligonucleotide
augaccaauuagccacca

SEQ ID NO: 22369 - RNA, 18 nt, Artificial Sequence
  Description of Artificial Sequence: Synthetic oligonucleotide
gggccaugaccaauuagc

SEQ ID NO: 22370 - RNA, 18 nt, Artificial Sequence
  Description of Artificial Sequence: Synthetic oligonucleotide
aauuucucccucaguggg

SEQ ID NO: 22371 - RNA, 18 nt, Artificial Sequence
  Description of Artificial Sequence: Synthetic oligonucleotide
uaauuucucccucagugg

SEQ ID NO: 22372 - RNA, 18 nt, Artificial Sequence
  Description of Artificial Sequence: Synthetic oligonucleotide
ucacuuaauuucucccuc

SEQ ID NO: 22373 - RNA, 18 nt, Artificial Sequence
  Description of Artificial Sequence: Synthetic oligonucleotide
gauagucacuuaauuucu

SEQ ID NO: 22374 - RNA, 18 nt, Artificial Sequence
  Description of Artificial Sequence: Synthetic oligonucleotide
aauuugauagucacuuaa

SEQ ID NO: 22375 - RNA, 18 nt, Artificial Sequence
  Description of Artificial Sequence: Synthetic oligonucleotide
aaggcaauuugauaguca

SEQ ID NO: 22376 - RNA, 18 nt, Artificial Sequence
  Description of Artificial Sequence: Synthetic oligonucleotide
guaagaaggcaauuugau

SEQ ID NO: 22377 - RNA, 18 nt, Artificial Sequence
  Description of Artificial Sequence: Synthetic oligonucleotide
gacuaguaagaaggcaau

SEQ ID NO: 22378 - RNA, 18 nt, Artificial Sequence
  Description of Artificial Sequence: Synthetic oligonucleotide
acgcagacuaguaagaag

SEQ ID NO: 22379 - RNA, 18 nt, Artificial Sequence
  Description of Artificial Sequence: Synthetic oligonucleotide
cucuaacgcagacuagua

SEQ ID NO: 22380 - RNA, 18 nt, Artificial Sequence
  Description of Artificial Sequence: Synthetic oligonucleotide
ccccucucuaacgcagac

SEQ ID NO: 22381 - RNA, 18 nt, Artificial Sequence
  Description of Artificial Sequence: Synthetic oligonucleotide
acuguccccucucuaacg

SEQ ID NO: 22382 - RNA, 18 nt, Artificial Sequence
  Description of Artificial Sequence: Synthetic oligonucleotide
aacgcacuguccccucuc

SEQ ID NO: 22383 - RNA, 18 nt, Artificial Sequence
  Description of Artificial Sequence: Synthetic oligonucleotide
agagaaacgcacuguccc

SEQ ID NO: 22384 - RNA, 18 nt, Artificial Sequence
  Description of Artificial Sequence: Synthetic oligonucleotide
uugggagagaaacgcacu

SEQ ID NO: 22385 - RNA, 18 nt, Artificial Sequence
  Description of Artificial Sequence: Synthetic oligonucleotide
aucguuugggagagaaac

SEQ ID NO: 22386 - RNA, 18 nt, Artificial Sequence
  Description of Artificial Sequence: Synthetic oligonucleotide
cugcaaucguuugggaga

SEQ ID NO: 22387 - RNA, 18 nt, Artificial Sequence
  Description of Artificial Sequence: Synthetic oligonucleotide
ugcucuuugcauuauagg

SEQ ID NO: 22388 - RNA, 18 nt, Artificial Sequence
  Description of Artificial Sequence: Synthetic oligonucleotide
gcuuuugcucuuugcauu

SEQ ID NO: 22389 - RNA, 18 nt, Artificial Sequence
  Description of Artificial Sequence: Synthetic oligonucleotide
ucaaagcuuuugcucuuu

SEQ ID NO: 22390 - RNA, 18 nt, Artificial Sequence
  Description of Artificial Sequence: Synthetic oligonucleotide
gaucuucaaagcuuuugc

SEQ ID NO: 22391 - RNA, 18 nt, Artificial Sequence
  Description of Artificial Sequence: Synthetic oligonucleotide
gggaggaucuucaaagcu

SEQ ID NO: 22392 - RNA, 18 nt, Artificial Sequence
  Description of Artificial Sequence: Synthetic oligonucleotide
ugguugggaggaucuuca

SEQ ID NO: 22393 - RNA, 18 nt, Artificial Sequence
  Description of Artificial Sequence: Synthetic oligonucleotide
gggcaugguugggaggau

SEQ ID NO: 22394 - RNA, 18 nt, Artificial Sequence
  Description of Artificial Sequence: Synthetic oligonucleotide
gcuacgggcaugguuggg

SEQ ID NO: 22395 - RNA, 18 nt, Artificial Sequence
  Description of Artificial Sequence: Synthetic oligonucleotide
ccagggcuacgggcaugg

SEQ ID NO: 22396 - RNA, 18 nt, Artificial Sequence
  Description of Artificial Sequence: Synthetic oligonucleotide
uguuuccagggcuacggg

SEQ ID NO: 22397 - RNA, 18 nt, Artificial Sequence
  Description of Artificial Sequence: Synthetic oligonucleotide
cccuuuguuuccagggcu

SEQ ID NO: 22398 - RNA, 18 nt, Artificial Sequence
  Description of Artificial Sequence: Synthetic oligonucleotide
cccuucccuuuguuucca

SEQ ID NO: 22399 - RNA, 18 nt, Artificial Sequence
  Description of Artificial Sequence: Synthetic oligonucleotide
ccuugcccuucccuuugu

SEQ ID NO: 22400 - RNA, 18 nt, Artificial Sequence
  Description of Artificial Sequence: Synthetic oligonucleotide
uuuucccuugcccuuccc

SEQ ID NO: 22401 - RNA, 18 nt, Artificial Sequence
  Description of Artificial Sequence: Synthetic oligonucleotide
gccauuuuuuucuccguu

SEQ ID NO: 22402 - RNA, 18 nt, Artificial Sequence
  Description of Artificial Sequence: Synthetic oligonucleotide
cgcgagccauuuuuuucu

SEQ ID NO: 22403 - RNA, 18 nt, Artificial Sequence
  Description of Artificial Sequence: Synthetic oligonucleotide
uuuggcgcgagccauuuu

SEQ ID NO: 22404 - RNA, 18 nt, Artificial Sequence
  Description of Artificial Sequence: Synthetic oligonucleotide
acuguuuuggcgcgagcc

SEQ ID NO: 22405 - RNA, 18 nt, Artificial Sequence
  Description of Artificial Sequence: Synthetic oligonucleotide
ucaugacuguuuuggcgc

SEQ ID NO: 22406 - RNA, 18 nt, Artificial Sequence
  Description of Artificial Sequence: Synthetic oligonucleotide
ggaguucaugacuguuuu

SEQ ID NO: 22407 - RNA, 18 nt, Artificial Sequence
  Description of Artificial Sequence: Synthetic oligonucleotide
cuuuauucccggcagaug

SEQ ID NO: 22408 - RNA, 18 nt, Artificial Sequence
  Description of Artificial Sequence: Synthetic oligonucleotide
accggcuuuauucccggc

SEQ ID NO: 22409 - RNA, 18 nt, Artificial Sequence
  Description of Artificial Sequence: Synthetic oligonucleotide
ccgccaccggcuuuauuc

SEQ ID NO: 22410 - RNA, 18 nt, Artificial Sequence
  Description of Artificial Sequence: Synthetic oligonucleotide
gagcgccgccaccggcuu

SEQ ID NO: 22411 - RNA, 18 nt, Artificial Sequence
  Description of Artificial Sequence: Synthetic oligonucleotide
cucgugagcgccgccacc

SEQ ID NO: 22412 - RNA, 18 nt, Artificial Sequence
  Description of Artificial Sequence: Synthetic oligonucleotide
gccgccucgugagcgccg

SEQ ID NO: 22413 - RNA, 18 nt, Artificial Sequence
  Description of Artificial Sequence: Synthetic oligonucleotide
ucccagccgccucgugag

SEQ ID NO: 22414 - RNA, 18 nt, Artificial Sequence
  Description of Artificial Sequence: Synthetic oligonucleotide
gcagcucccagccgccuc

SEQ ID NO: 22415 - RNA, 18 nt, Artificial Sequence
  Description of Artificial Sequence: Synthetic oligonucleotide
agagagcagcucccagcc

SEQ ID NO: 22416 - RNA, 18 nt, Artificial Sequence
  Description of Artificial Sequence: Synthetic oligonucleotide
cacucagagagcagcucc

SEQ ID NO: 22417 - RNA, 18 nt, Artificial Sequence
  Description of Artificial Sequence: Synthetic oligonucleotide
gauggcacucagagagca

SEQ ID NO: 22418 - RNA, 18 nt, Artificial Sequence
  Description of Artificial Sequence: Synthetic oligonucleotide
cagaugauggcacucaga

SEQ ID NO: 22419 - RNA, 18 nt, Artificial Sequence
  Description of Artificial Sequence: Synthetic oligonucleotide
cgccgccaccggcuuuau

SEQ ID NO: 22420 - RNA, 18 nt, Artificial Sequence
  Description of Artificial Sequence: Synthetic oligonucleotide
gugagcgccgccaccggc

SEQ ID NO: 22421 - RNA, 18 nt, Artificial Sequence
  Description of Artificial Sequence: Synthetic oligonucleotide
gccucgugagcgccgcca

SEQ ID NO: 22422 - RNA, 18 nt, Artificial Sequence
  Description of Artificial Sequence: Synthetic oligonucleotide
cagccgccucgugagcgc

SEQ ID NO: 22423 - RNA, 18 nt, Artificial Sequence
  Description of Artificial Sequence: Synthetic oligonucleotide
gcucccagccgccucgug

SEQ ID NO: 22424 - RNA, 18 nt, Artificial Sequence
  Description of Artificial Sequence: Synthetic oligonucleotide
gagcagcucccagccgcc

SEQ ID NO: 22425 - RNA, 18 nt, Artificial Sequence
  Description of Artificial Sequence: Synthetic oligonucleotide
ucagagagcagcucccag

SEQ ID NO: 22426 - RNA, 18 nt, Artificial Sequence
  Description of Artificial Sequence: Synthetic oligonucleotide
ggcacucagagagcagcu

SEQ ID NO: 22427 - RNA, 18 nt, Artificial Sequence
  Description of Artificial Sequence: Synthetic oligonucleotide
augauggcacucagagag

SEQ ID NO: 22428 - RNA, 18 nt, Artificial Sequence
  Description of Artificial Sequence: Synthetic oligonucleotide
cacagaugauggcacuca

SEQ ID NO: 22429 - RNA, 18 nt, Artificial Sequence
  Description of Artificial Sequence: Synthetic oligonucleotide
ugcacuugggaggguggg

SEQ ID NO: 22430 - RNA, 18 nt, Artificial Sequence
  Description of Artificial Sequence: Synthetic oligonucleotide
cugaaugcacuugggagg

SEQ ID NO: 22431 - RNA, 18 nt, Artificial Sequence
  Description of Artificial Sequence: Synthetic oligonucleotide
ccgcacugaaugcacuug

SEQ ID NO: 22432 - RNA, 18 nt, Artificial Sequence
  Description of Artificial Sequence: Synthetic oligonucleotide
acugcccgcacugaaugc

SEQ ID NO: 22433 - RNA, 18 nt, Artificial Sequence
  Description of Artificial Sequence: Synthetic oligonucleotide
cagguacugcccgcacug

SEQ ID NO: 22434 - RNA, 18 nt, Artificial Sequence
  Description of Artificial Sequence: Synthetic oligonucleotide
ucguccagguacugcccg

SEQ ID NO: 22435 - RNA, 18 nt, Artificial Sequence
  Description of Artificial Sequence: Synthetic oligonucleotide
cagggucguccagguacu

SEQ ID NO: 22436 - RNA, 18 nt, Artificial Sequence
  Description of Artificial Sequence: Synthetic oligonucleotide
gaggucagggucguccag

SEQ ID NO: 22437 - RNA, 18 nt, Artificial Sequence
  Description of Artificial Sequence: Synthetic oligonucleotide
uauuugaggucagggucg

SEQ ID NO: 22438 - RNA, 18 nt, Artificial Sequence
  Description of Artificial Sequence: Synthetic oligonucleotide
gcccauauuugaggucag

SEQ ID NO: 22439 - RNA, 18 nt, Artificial Sequence
  Description of Artificial Sequence: Synthetic oligonucleotide
gugcugcccauauuugag

SEQ ID NO: 22440 - RNA, 18 nt, Artificial Sequence
  Description of Artificial Sequence: Synthetic oligonucleotide
ggugggugcugcccauau

SEQ ID NO: 22441 - RNA, 18 nt, Artificial Sequence
  Description of Artificial Sequence: Synthetic oligonucleotide
cgucuggugggugcugcc

SEQ ID NO: 22442 - RNA, 18 nt, Artificial Sequence
  Description of Artificial Sequence: Synthetic oligonucleotide
gacuuguggguguucuca

SEQ ID NO: 22443 - RNA, 18 nt, Artificial Sequence
  Description of Artificial Sequence: Synthetic oligonucleotide
gaguggacuugugggugu

SEQ ID NO: 22444 - RNA, 18 nt, Artificial Sequence
  Description of Artificial Sequence: Synthetic oligonucleotide
cgcuggaguggacuugug

SEQ ID NO: 22445 - RNA, 18 nt, Artificial Sequence
  Description of Artificial Sequence: Synthetic oligonucleotide
uagcucgcuggaguggac

SEQ ID NO: 22446 - RNA, 18 nt, Artificial Sequence
  Description of Artificial Sequence: Synthetic oligonucleotide
cgugguagcucgcuggag

SEQ ID NO: 22447 - RNA, 18 nt, Artificial Sequence
  Description of Artificial Sequence: Synthetic oligonucleotide
gucugcgugguagcucgc

SEQ ID NO: 22448 - RNA, 18 nt, Artificial Sequence
  Description of Artificial Sequence: Synthetic oligonucleotide
uugaugucugcgugguag

SEQ ID NO: 22449 - RNA, 18 nt, Artificial Sequence
  Description of Artificial Sequence: Synthetic oligonucleotide
gcagguugaugucugcgu

SEQ ID NO: 22450 - RNA, 18 nt, Artificial Sequence
  Description of Artificial Sequence: Synthetic oligonucleotide
guagagcagguugauguc

SEQ ID NO: 22451 - RNA, 18 nt, Artificial Sequence
  Description of Artificial Sequence: Synthetic oligonucleotide
cuccaguagagcagguug

SEQ ID NO: 22452 - RNA, 18 nt, Artificial Sequence
  Description of Artificial Sequence: Synthetic oligonucleotide
cgucgcuccaguagagca

SEQ ID NO: 22453 - RNA, 18 nt, Artificial Sequence
  Description of Artificial Sequence: Synthetic oligonucleotide
cuccucgucgcuccagua

SEQ ID NO: 22454 - RNA, 18 nt, Artificial Sequence
  Description of Artificial Sequence: Synthetic oligonucleotide
acggccuccucgucgcuc

SEQ ID NO: 22455 - RNA, 18 nt, Artificial Sequence
  Description of Artificial Sequence: Synthetic oligonucleotide
ccaccacggccuccucgu

SEQ ID NO: 22456 - RNA, 18 nt, Artificial Sequence
  Description of Artificial Sequence: Synthetic oligonucleotide
gaaguccaccacggccuc

SEQ ID NO: 22457 - RNA, 18 nt, Artificial Sequence
  Description of Artificial Sequence: Synthetic oligonucleotide
gccuugaaguccaccacg

SEQ ID NO: 22458 - RNA, 18 nt, Artificial Sequence
  Description of Artificial Sequence: Synthetic oligonucleotide
gcacagccuugaagucca

SEQ ID NO: 22459 - RNA, 18 nt, Artificial Sequence
  Description of Artificial Sequence: Synthetic oligonucleotide
gcccugcacagccuugaa

SEQ ID NO: 22460 - RNA, 18 nt, Artificial Sequence
  Description of Artificial Sequence: Synthetic oligonucleotide
cagcggcccugcacagcc

SEQ ID NO: 22461 - RNA, 18 nt, Artificial Sequence
  Description of Artificial Sequence: Synthetic oligonucleotide
cggugcagcggcccugca

SEQ ID NO: 22462 - RNA, 18 nt, Artificial Sequence
  Description of Artificial Sequence: Synthetic oligonucleotide
cuccacggugcagcggcc

SEQ ID NO: 22463 - RNA, 18 nt, Artificial Sequence
  Description of Artificial Sequence: Synthetic oligonucleotide
ccauacuccacggugcag

SEQ ID NO: 22464 - RNA, 18 nt, Artificial Sequence
  Description of Artificial Sequence: Synthetic oligonucleotide
ccuccccauacuccacgg

SEQ ID NO: 22465 - RNA, 18 nt, Artificial Sequence
  Description of Artificial Sequence: Synthetic oligonucleotide
cagguccuccccauacuc

SEQ ID NO: 22466 - RNA, 18 nt, Artificial Sequence
  Description of Artificial Sequence: Synthetic oligonucleotide
ucgggcagguccucccca

SEQ ID NO: 22467 - RNA, 18 nt, Artificial Sequence
  Description of Artificial Sequence: Synthetic oligonucleotide
cgcacucgggcagguccu

SEQ ID NO: 22468 - RNA, 18 nt, Artificial Sequence
  Description of Artificial Sequence: Synthetic oligonucleotide
cuggacgcacucgggcag

SEQ ID NO: 22469 - RNA, 18 nt, Artificial Sequence
  Description of Artificial Sequence: Synthetic oligonucleotide
uacaccuggacgcacucg

SEQ ID NO: 22470 - RNA, 18 nt, Artificial Sequence
  Description of Artificial Sequence: Synthetic oligonucleotide
uggaguacaccuggacgc

SEQ ID NO: 22471 - RNA, 18 nt, Artificial Sequence
  Description of Artificial Sequence: Synthetic oligonucleotide
gcccauggaguacaccug

SEQ ID NO: 22472 - RNA, 18 nt, Artificial Sequence
  Description of Artificial Sequence: Synthetic oligonucleotide
gggccgcccauggaguac

SEQ ID NO: 22473 - RNA, 18 nt, Artificial Sequence
  Description of Artificial Sequence: Synthetic oligonucleotide
gaaguagaagcgguuggg

SEQ ID NO: 22474 - RNA, 18 nt, Artificial Sequence
  Description of Artificial Sequence: Synthetic oligonucleotide
gaggaaguagaagcgguu

SEQ ID NO: 22475 - RNA, 18 nt, Artificial Sequence
  Description of Artificial Sequence: Synthetic oligonucleotide
ccuucccucuagcaagca

SEQ ID NO: 22476 - RNA, 18 nt, Artificial Sequence
  Description of Artificial Sequence: Synthetic oligonucleotide
cgaagccuucccucuagc

SEQ ID NO: 22477 - RNA, 18 nt, Artificial Sequence
  Description of Artificial Sequence: Synthetic oligonucleotide
gaccccgaagccuucccu

SEQ ID NO: 22478 - RNA, 18 nt, Artificial Sequence
  Description of Artificial Sequence: Synthetic oligonucleotide
acuuugaccccgaagccu

SEQ ID NO: 22479 - RNA, 18 nt, Artificial Sequence
  Description of Artificial Sequence: Synthetic oligonucleotide
ggccaacuuugaccccga

SEQ ID NO: 22480 - RNA, 18 nt, Artificial Sequence
  Description of Artificial Sequence: Synthetic oligonucleotide
cuucuggccaacuuugac

SEQ ID NO: 22481 - RNA, 18 nt, Artificial Sequence
  Description of Artificial Sequence: Synthetic oligonucleotide
gacuccuucuggccaacu

SEQ ID NO: 22482 - RNA, 18 nt, Artificial Sequence
  Description of Artificial Sequence: Synthetic oligonucleotide
caucagacuccuucuggc

SEQ ID NO: 22483 - RNA, 18 nt, Artificial Sequence
  Description of Artificial Sequence: Synthetic oligonucleotide
cccgacaucagacuccuu

SEQ ID NO: 22484 - RNA, 18 nt, Artificial Sequence
  Description of Artificial Sequence: Synthetic oligonucleotide
uauaacccgacaucagac

SEQ ID NO: 22485 - RNA, 18 nt, Artificial Sequence
  Description of Artificial Sequence: Synthetic oligonucleotide
uuguguauaacccgacau

SEQ ID NO: 22486 - RNA, 18 nt, Artificial Sequence
  Description of Artificial Sequence: Synthetic oligonucleotide
ccgccuuguguauaaccc

SEQ ID NO: 22487 - RNA, 18 nt, Artificial Sequence
  Description of Artificial Sequence: Synthetic oligonucleotide
ccaagccgccuuguguau

SEQ ID NO: 22488 - RNA, 18 nt, Artificial Sequence
  Description of Artificial Sequence: Synthetic oligonucleotide
ugcagccaagccgccuug

SEQ ID NO: 22489 - RNA, 18 nt, Artificial Sequence
  Description of Artificial Sequence: Synthetic oligonucleotide
aacccugcagccaagccg

SEQ ID NO: 22490 - RNA, 18 nt, Artificial Sequence
  Description of Artificial Sequence: Synthetic oligonucleotide
gcugaaacccugcagcca

SEQ ID NO: 22491 - RNA, 18 nt, Artificial Sequence
  Description of Artificial Sequence: Synthetic oligonucleotide
caaaagcugaaacccugc

SEQ ID NO: 22492 - RNA, 18 nt, Artificial Sequence
  Description of Artificial Sequence: Synthetic oligonucleotide
ucuuacaaaagcugaaac

SEQ ID NO: 22493 - RNA, 18 nt, Artificial Sequence
  Description of Artificial Sequence: Synthetic oligonucleotide
ccacuucuuacaaaagcu

SEQ ID NO: 22494 - RNA, 18 nt, Artificial Sequence
  Description of Artificial Sequence: Synthetic oligonucleotide
accacccacuucuuacaa

SEQ ID NO: 22495 - RNA, 18 nt, Artificial Sequence
  Description of Artificial Sequence: Synthetic oligonucleotide
agccaaccacccacuucu

SEQ ID NO: 22496 - RNA, 18 nt, Artificial Sequence
  Description of Artificial Sequence: Synthetic oligonucleotide
acgucagccaaccaccca

SEQ ID NO: 22497 - RNA, 18 nt, Artificial Sequence
  Description of Artificial Sequence: Synthetic oligonucleotide
gcuucacgucagccaacc

SEQ ID NO: 22498 - RNA, 18 nt, Artificial Sequence
  Description of Artificial Sequence: Synthetic oligonucleotide
gaacagcuucacgucagc

SEQ ID NO: 22499 - RNA, 18 nt, Artificial Sequence
  Description of Artificial Sequence: Synthetic oligonucleotide
cugcagaacagcuucacg

SEQ ID NO: 22500 - RNA, 18 nt, Artificial Sequence
  Description of Artificial Sequence: Synthetic oligonucleotide
agcuccugcagaacagcu

SEQ ID NO: 22501 - RNA, 18 nt, Artificial Sequence
  Description of Artificial Sequence: Synthetic oligonucleotide
cguaaagcuccugcagaa

SEQ ID NO: 22502 - RNA, 18 nt, Artificial Sequence
  Description of Artificial Sequence: Synthetic oligonucleotide
acccccguaaagcuccug

SEQ ID NO: 22503 - RNA, 18 nt, Artificial Sequence
  Description of Artificial Sequence: Synthetic oligonucleotide
cucagacccccguaaagc

SEQ ID NO: 22504 - RNA, 18 nt, Artificial Sequence
  Description of Artificial Sequence: Synthetic oligonucleotide
cccugcucagacccccgu

SEQ ID NO: 22505 - RNA, 18 nt, Artificial Sequence
  Description of Artificial Sequence: Synthetic oligonucleotide
gagaacccugcucagacc

SEQ ID NO: 22506 - RNA, 18 nt, Artificial Sequence
  Description of Artificial Sequence: Synthetic oligonucleotide
cucuggagaacccugcuc

SEQ ID NO: 22507 - RNA, 18 nt, Artificial Sequence
  Description of Artificial Sequence: Synthetic oligonucleotide
uugugcucuggagaaccc

SEQ ID NO: 22508 - RNA, 18 nt, Artificial Sequence
  Description of Artificial Sequence: Synthetic oligonucleotide
acaacuugugcucuggag

SEQ ID NO: 22509 - RNA, 18 nt, Artificial Sequence
  Description of Artificial Sequence: Synthetic oligonucleotide
cucauacaacuugugcuc

SEQ ID NO: 22510 - RNA, 18 nt, Artificial Sequence
  Description of Artificial Sequence: Synthetic oligonucleotide
ugaaucucauacaacuug

SEQ ID NO: 22511 - RNA, 18 nt, Artificial Sequence
  Description of Artificial Sequence: Synthetic oligonucleotide
ccacuugaaucucauaca

SEQ ID NO: 22512 - RNA, 18 nt, Artificial Sequence
  Description of Artificial Sequence: Synthetic oligonucleotide
cgggaccacuugaaucuc

SEQ ID NO: 22513 - RNA, 18 nt, Artificial Sequence
  Description of Artificial Sequence: Synthetic oligonucleotide
aacuccgggaccacuuga

SEQ ID NO: 22514 - RNA, 18 nt, Artificial Sequence
  Description of Artificial Sequence: Synthetic oligonucleotide
uguuaaacuccgggacca

SEQ ID NO: 22515 - RNA, 18 nt, Artificial Sequence
  Description of Artificial Sequence: Synthetic oligonucleotide
aggaguguuaaacuccgg

SEQ ID NO: 22516 - RNA, 18 nt, Artificial Sequence
  Description of Artificial Sequence: Synthetic oligonucleotide
aaaccaggaguguuaaac

SEQ ID NO: 22517 - RNA, 18 nt, Artificial Sequence
  Description of Artificial Sequence: Synthetic oligonucleotide
uuuaaaaaccaggagugu

SEQ ID NO: 22518 - RNA, 18 nt, Artificial Sequence
  Description of Artificial Sequence: Synthetic oligonucleotide
uacuuuuuaaaaaccagg

SEQ ID NO: 22519 - RNA, 18 nt, Artificial Sequence
  Description of Artificial Sequence: Synthetic oligonucleotide
ugacguacuuuuuaaaaa

SEQ ID NO: 22520 - RNA, 18 nt, Artificial Sequence
  Description of Artificial Sequence: Synthetic oligonucleotide
ucuaaugacguacuuuuu

SEQ ID NO: 22521 - RNA, 18 nt, Artificial Sequence
  Description of Artificial Sequence: Synthetic oligonucleotide
gguucucuaaugacguac

SEQ ID NO: 22522 - RNA, 18 nt, Artificial Sequence
  Description of Artificial Sequence: Synthetic oligonucleotide
cguuagguucucuaauga

SEQ ID NO: 22523 - RNA, 18 nt, Artificial Sequence
  Description of Artificial Sequence: Synthetic oligonucleotide
uaaaacguuagguucucu

SEQ ID NO: 22524 - RNA, 18 nt, Artificial Sequence
  Description of Artificial Sequence: Synthetic oligonucleotide
gacacuaaaacguuaggu

SEQ ID NO: 22525 - RNA, 18 nt, Artificial Sequence
  Description of Artificial Sequence: Synthetic oligonucleotide
accaagacacuaaaacgu

SEQ ID NO: 22526 - RNA, 18 nt, Artificial Sequence
  Description of Artificial Sequence: Synthetic oligonucleotide
guugcaccaagacacuaa

SEQ ID NO: 22527 - RNA, 18 nt, Artificial Sequence
  Description of Artificial Sequence: Synthetic oligonucleotide
guucaguugcaccaagac

SEQ ID NO: 22528 - RNA, 18 nt, Artificial Sequence
  Description of Artificial Sequence: Synthetic oligonucleotide
ucaacguucaguugcacc

SEQ ID NO: 22529 - RNA, 18 nt, Artificial Sequence
  Description of Artificial Sequence: Synthetic oligonucleotide
gguccucaacguucaguu

SEQ ID NO: 22530 - RNA, 18 nt, Artificial Sequence
  Description of Artificial Sequence: Synthetic oligonucleotide
cucaugguccucaacguu

SEQ ID NO: 22531 - RNA, 18 nt, Artificial Sequence
  Description of Artificial Sequence: Synthetic oligonucleotide
gcugccucaugguccuca

SEQ ID NO: 22532 - RNA, 18 nt, Artificial Sequence
  Description of Artificial Sequence: Synthetic oligonucleotide
uggaagcugccucauggu

SEQ ID NO: 22533 - RNA, 18 nt, Artificial Sequence
  Description of Artificial Sequence: Synthetic oligonucleotide
gcugguggaagcugccuc

SEQ ID NO: 22534 - RNA, 18 nt, Artificial Sequence
  Description of Artificial Sequence: Synthetic oligonucleotide
gucaggcugguggaagcu

SEQ ID NO: 22535 - RNA, 18 nt, Artificial Sequence
  Description of Artificial Sequence: Synthetic oligonucleotide
caccagucaggcuggugg

SEQ ID NO: 22536 - RNA, 18 nt, Artificial Sequence
  Description of Artificial Sequence: Synthetic oligonucleotide
uaagacaccagucaggcu

SEQ ID NO: 22537 - RNA, 18 nt, Artificial Sequence
  Description of Artificial Sequence: Synthetic oligonucleotide
cauacuaagacaccaguc

SEQ ID NO: 22538 - RNA, 18 nt, Artificial Sequence
  Description of Artificial Sequence: Synthetic oligonucleotide
caacucauacuaagacac

SEQ ID NO: 22539 - RNA, 18 nt, Artificial Sequence
  Description of Artificial Sequence: Synthetic oligonucleotide
uucuccaacucauacuaa

SEQ ID NO: 22540 - RNA, 18 nt, Artificial Sequence
  Description of Artificial Sequence: Synthetic oligonucleotide
gcaccuucuccaacucau

SEQ ID NO: 22541 - RNA, 18 nt, Artificial Sequence
  Description of Artificial Sequence: Synthetic oligonucleotide
gggcaccuucuccaacuc

SEQ ID NO: 22542 - RNA, 18 nt, Artificial Sequence
  Description of Artificial Sequence: Synthetic oligonucleotide
agggacccaggagcaggg

SEQ ID NO: 22543 - RNA, 18 nt, Artificial Sequence
  Description of Artificial Sequence: Synthetic oligonucleotide
gcccaagggacccaggag

SEQ ID NO: 22544 - RNA, 18 nt, Artificial Sequence
  Description of Artificial Sequence: Synthetic oligonucleotide
gccuggcccaagggaccc

SEQ ID NO: 22545 - RNA, 18 nt, Artificial Sequence
  Description of Artificial Sequence: Synthetic oligonucleotide
uaggcgccuggcccaagg

SEQ ID NO: 22546 - RNA, 18 nt, Artificial Sequence
  Description of Artificial Sequence: Synthetic oligonucleotide
ggacguaggcgccuggcc

SEQ ID NO: 22547 - RNA, 18 nt, Artificial Sequence
  Description of Artificial Sequence: Synthetic oligonucleotide
ggccuggacguaggcgcc

SEQ ID NO: 22548 - RNA, 18 nt, Artificial Sequence
  Description of Artificial Sequence: Synthetic oligonucleotide
ggcugggccuggacguag

SEQ ID NO: 22549 - RNA, 18 nt, Artificial Sequence
  Description of Artificial Sequence: Synthetic oligonucleotide
augugggcugggccugga

SEQ ID NO: 22550 - RNA, 18 nt, Artificial Sequence
  Description of Artificial Sequence: Synthetic oligonucleotide
caggcaugugggcugggc

SEQ ID NO: 22551 - RNA, 18 nt, Artificial Sequence
  Description of Artificial Sequence: Synthetic oligonucleotide
ccgcacaggcaugugggc

SEQ ID NO: 22552 - RNA, 18 nt, Artificial Sequence
  Description of Artificial Sequence: Synthetic oligonucleotide
gccacccgcacaggcaug

SEQ ID NO: 22553 - RNA, 18 nt, Artificial Sequence
  Description of Artificial Sequence: Synthetic oligonucleotide
cgagggccacccgcacag

SEQ ID NO: 22554 - RNA, 18 nt, Artificial Sequence
  Description of Artificial Sequence: Synthetic oligonucleotide
cauaacgagggccacccg

SEQ ID NO: 22555 - RNA, 18 nt, Artificial Sequence
  Description of Artificial Sequence: Synthetic oligonucleotide
cucuccauaacgagggcc

SEQ ID NO: 22556 - RNA, 18 nt, Artificial Sequence
  Description of Artificial Sequence: Synthetic oligonucleotide
gggcccucuccauaacga

SEQ ID NO: 22557 - RNA, 18 nt, Artificial Sequence
  Description of Artificial Sequence: Synthetic oligonucleotide
cucgugggcccucuccau

SEQ ID NO: 22558 - RNA, 18 nt, Artificial Sequence
  Description of Artificial Sequence: Synthetic oligonucleotide
augugggcugggccugga

SEQ ID NO: 22559 - RNA, 18 nt, Artificial Sequence
  Description of Artificial Sequence: Synthetic oligonucleotide
caggcaugugggcugggc

SEQ ID NO: 22560 - RNA, 18 nt, Artificial Sequence
  Description of Artificial Sequence: Synthetic oligonucleotide
ccgcacaggcaugugggc

SEQ ID NO: 22561 - RNA, 18 nt, Artificial Sequence
  Description of Artificial Sequence: Synthetic oligonucleotide
gccacccgcacaggcaug

SEQ ID NO: 22562 - RNA, 18 nt, Artificial Sequence
  Description of Artificial Sequence: Synthetic oligonucleotide
cgagggccacccgcacag

SEQ ID NO: 22563 - RNA, 18 nt, Artificial Sequence
  Description of Artificial Sequence: Synthetic oligonucleotide
cauaacgagggccacccg

SEQ ID NO: 22564 - RNA, 18 nt, Artificial Sequence
  Description of Artificial Sequence: Synthetic oligonucleotide
cucuccauaacgagggcc

SEQ ID NO: 22565 - RNA, 18 nt, Artificial Sequence
  Description of Artificial Sequence: Synthetic oligonucleotide
gggcccucuccauaacga

SEQ ID NO: 22566 - RNA, 18 nt, Artificial Sequence
  Description of Artificial Sequence: Synthetic oligonucleotide
cucgugggcccucuccau

SEQ ID NO: 22567 - RNA, 18 nt, Artificial Sequence
  Description of Artificial Sequence: Synthetic oligonucleotide
gcugacucgugggcccuc

SEQ ID NO: 22568 - RNA, 18 nt, Artificial Sequence
  Description of Artificial Sequence: Synthetic oligonucleotide
gaucagcugacucguggg

SEQ ID NO: 22569 - RNA, 18 nt, Artificial Sequence
  Description of Artificial Sequence: Synthetic oligonucleotide
agcuugaucagcugacuc

SEQ ID NO: 22570 - RNA, 18 nt, Artificial Sequence
  Description of Artificial Sequence: Synthetic oligonucleotide
ucaugagcuugaucagcu

SEQ ID NO: 22571 - RNA, 18 nt, Artificial Sequence
  Description of Artificial Sequence: Synthetic oligonucleotide
acaagucaugagcuugau

SEQ ID NO: 22572 - RNA, 18 nt, Artificial Sequence
  Description of Artificial Sequence: Synthetic oligonucleotide
aauuuacaagucaugagc

SEQ ID NO: 22573 - RNA, 18 nt, Artificial Sequence
  Description of Artificial Sequence: Synthetic oligonucleotide
ccaacaauuuacaaguca

SEQ ID NO: 22574 - RNA, 18 nt, Artificial Sequence
  Description of Artificial Sequence: Synthetic oligonucleotide
aagccccaacaauuuaca

SEQ ID NO: 22575 - RNA, 18 nt, Artificial Sequence
  Description of Artificial Sequence: Synthetic oligonucleotide
aggccaagccccaacaau

SEQ ID NO: 22576 - RNA, 18 nt, Artificial Sequence
  Description of Artificial Sequence: Synthetic oligonucleotide
cggaaaggccaagcccca

SEQ ID NO: 22577 - RNA, 18 nt, Artificial Sequence
  Description of Artificial Sequence: Synthetic oligonucleotide
caacacggaaaggccaag

SEQ ID NO: 22578 - RNA, 18 nt, Artificial Sequence
  Description of Artificial Sequence: Synthetic oligonucleotide
gguaacaacacggaaagg

SEQ ID NO: 22579 - RNA, 18 nt, Artificial Sequence
  Description of Artificial Sequence: Synthetic oligonucleotide
uuuaagguaacaacacgg

SEQ ID NO: 22580 - RNA, 18 nt, Artificial Sequence
  Description of Artificial Sequence: Synthetic oligonucleotide
aucguuuuaagguaacaa

SEQ ID NO: 22581 - RNA, 18 nt, Artificial Sequence
  Description of Artificial Sequence: Synthetic oligonucleotide
gauguaucguuuuaaggu

SEQ ID NO: 22582 - RNA, 18 nt, Artificial Sequence
  Description of Artificial Sequence: Synthetic oligonucleotide
acguggauguaucguuuu

SEQ ID NO: 22583 - RNA, 18 nt, Artificial Sequence
  Description of Artificial Sequence: Synthetic oligonucleotide
ggagaacguggauguauc

SEQ ID NO: 22584 - RNA, 18 nt, Artificial Sequence
  Description of Artificial Sequence: Synthetic oligonucleotide
gccugggagaacguggau

SEQ ID NO: 22585 - RNA, 18 nt, Artificial Sequence
  Description of Artificial Sequence: Synthetic oligonucleotide
uccaugccugggagaacg

SEQ ID NO: 22586 - RNA, 18 nt, Artificial Sequence
  Description of Artificial Sequence: Synthetic oligonucleotide
ccucauccaugccuggga

SEQ ID NO: 22587 - RNA, 18 nt, Artificial Sequence
  Description of Artificial Sequence: Synthetic oligonucleotide
ggcuaccucauccaugcc

SEQ ID NO: 22588 - RNA, 18 nt, Artificial Sequence
  Description of Artificial Sequence: Synthetic oligonucleotide
aauugggcuaccucaucc

SEQ ID NO: 22589 - RNA, 18 nt, Artificial Sequence
  Description of Artificial Sequence: Synthetic oligonucleotide
uguccaauugggcuaccu

SEQ ID NO: 22590 - RNA, 18 nt, Artificial Sequence
  Description of Artificial Sequence: Synthetic oligonucleotide
ucugcuguccaauugggc

SEQ ID NO: 22591 - RNA, 18 nt, Artificial Sequence
  Description of Artificial Sequence: Synthetic oligonucleotide
cagaaucugcuguccaau

SEQ ID NO: 22592 - RNA, 18 nt, Artificial Sequence
  Description of Artificial Sequence: Synthetic oligonucleotide
cuaugcagaaucugcugu

SEQ ID NO: 22593 - RNA, 18 nt, Artificial Sequence
  Description of Artificial Sequence: Synthetic oligonucleotide
aagugcuaugcagaaucu

SEQ ID NO: 22594 - RNA, 18 nt, Artificial Sequence
  Description of Artificial Sequence: Synthetic oligonucleotide
ggaaaaagugcuaugcag

SEQ ID NO: 22595 - RNA, 18 nt, Artificial Sequence
  Description of Artificial Sequence: Synthetic oligonucleotide
gaacaggaaaaagugcua

SEQ ID NO: 22596 - RNA, 18 nt, Artificial Sequence
  Description of Artificial Sequence: Synthetic oligonucleotide
uucuagaacaggaaaaag

SEQ ID NO: 22597 - RNA, 18 nt, Artificial Sequence
  Description of Artificial Sequence: Synthetic oligonucleotide
guaccuucuagaacagga

SEQ ID NO: 22598 - RNA, 18 nt, Artificial Sequence
  Description of Artificial Sequence: Synthetic oligonucleotide
ugagaguaccuucuagaa

SEQ ID NO: 22599 - RNA, 18 nt, Artificial Sequence
  Description of Artificial Sequence: Synthetic oligonucleotide
gcacuugagaguaccuuc

SEQ ID NO: 22600 - RNA, 18 nt, Artificial Sequence
  Description of Artificial Sequence: Synthetic oligonucleotide
uacaagcacuugagagua

SEQ ID NO: 22601 - RNA, 18 nt, Artificial Sequence
  Description of Artificial Sequence: Synthetic oligonucleotide
ccuauuacaagcacuuga

SEQ ID NO: 22602 - RNA, 18 nt, Artificial Sequence
  Description of Artificial Sequence: Synthetic oligonucleotide
aaaugccuauuacaagca

SEQ ID NO: 22603 - RNA, 18 nt, Artificial Sequence
  Description of Artificial Sequence: Synthetic oligonucleotide
cacugaaaugccuauuac

SEQ ID NO: 22604 - RNA, 18 nt, Artificial Sequence
  Description of Artificial Sequence: Synthetic oligonucleotide
gcugacacugaaaugccu

SEQ ID NO: 22605 - RNA, 18 nt, Artificial Sequence
  Description of Artificial Sequence: Synthetic oligonucleotide
aucuggcugacacugaaa

SEQ ID NO: 22606 - RNA, 18 nt, Artificial Sequence
  Description of Artificial Sequence: Synthetic oligonucleotide
auuugaucuggcugacac

SEQ ID NO: 22607 - RNA, 18 nt, Artificial Sequence
  Description of Artificial Sequence: Synthetic oligonucleotide
cuaacauuugaucuggcu

SEQ ID NO: 22608 - RNA, 18 nt, Artificial Sequence
  Description of Artificial Sequence: Synthetic oligonucleotide
uaauacuaacauuugauc

SEQ ID NO: 22609 - RNA, 18 nt, Artificial Sequence
  Description of Artificial Sequence: Synthetic oligonucleotide
uuuauuaauacuaacauu

SEQ ID NO: 22610 - RNA, 18 nt, Artificial Sequence
  Description of Artificial Sequence: Synthetic oligonucleotide
uccauuuuauuaauacua

SEQ ID NO: 22611 - RNA, 18 nt, Artificial Sequence
  Description of Artificial Sequence: Synthetic oligonucleotide
aacaauccauuuuauuaa

SEQ ID NO: 22612 - RNA, 18 nt, Artificial Sequence
  Description of Artificial Sequence: Synthetic oligonucleotide
cuuaaaacaauccauuuu

SEQ ID NO: 22613 - RNA, 18 nt, Artificial Sequence
  Description of Artificial Sequence: Synthetic oligonucleotide
agaaacuuaaaacaaucc

SEQ ID NO: 22614 - RNA, 18 nt, Artificial Sequence
  Description of Artificial Sequence: Synthetic oligonucleotide
acaauagaaacuuaaaac

SEQ ID NO: 22615 - RNA, 18 nt, Artificial Sequence
  Description of Artificial Sequence: Synthetic oligonucleotide
uugcuacaauagaaacuu

SEQ ID NO: 22616 - RNA, 18 nt, Artificial Sequence
  Description of Artificial Sequence: Synthetic oligonucleotide
ugacuuugcuacaauaga

SEQ ID NO: 22617 - RNA, 18 nt, Artificial Sequence
  Description of Artificial Sequence: Synthetic oligonucleotide
uaguuugacuuugcuaca

SEQ ID NO: 22618 - RNA, 18 nt, Artificial Sequence
  Description of Artificial Sequence: Synthetic oligonucleotide
aagaguaguuugacuuug

SEQ ID NO: 22619 - RNA, 18 nt, Artificial Sequence
  Description of Artificial Sequence: Synthetic oligonucleotide
ccaauaagaguaguuuga

SEQ ID NO: 22620 - RNA, 18 nt, Artificial Sequence
  Description of Artificial Sequence: Synthetic oligonucleotide
agccaccaauaagaguag

SEQ ID NO: 22621 - RNA, 18 nt, Artificial Sequence
  Description of Artificial Sequence: Synthetic oligonucleotide
caauuagccaccaauaag

SEQ ID NO: 22622 - RNA, 18 nt, Artificial Sequence
  Description of Artificial Sequence: Synthetic oligonucleotide
augaccaauuagccacca

SEQ ID NO: 22623 - RNA, 18 nt, Artificial Sequence
  Description of Artificial Sequence: Synthetic oligonucleotide
gggccaugaccaauuagc

SEQ ID NO: 22624 - RNA, 18 nt, Artificial Sequence
  Description of Artificial Sequence: Synthetic oligonucleotide
aauuucucccucaguggg

SEQ ID NO: 22625 - RNA, 18 nt, Artificial Sequence
  Description of Artificial Sequence: Synthetic oligonucleotide
uaauuucucccucagugg

SEQ ID NO: 22626 - RNA, 18 nt, Artificial Sequence
  Description of Artificial Sequence: Synthetic oligonucleotide
ucacuuaauuucucccuc

SEQ ID NO: 22627 - RNA, 18 nt, Artificial Sequence
  Description of Artificial Sequence: Synthetic oligonucleotide
gauagucacuuaauuucu

SEQ ID NO: 22628 - RNA, 18 nt, Artificial Sequence
  Description of Artificial Sequence: Synthetic oligonucleotide
aauuugauagucacuuaa

SEQ ID NO: 22629 - RNA, 18 nt, Artificial Sequence
  Description of Artificial Sequence: Synthetic oligonucleotide
aaggcaauuugauaguca

SEQ ID NO: 22630 - RNA, 18 nt, Artificial Sequence
  Description of Artificial Sequence: Synthetic oligonucleotide
guaagaaggcaauuugau

SEQ ID NO: 22631 - RNA, 18 nt, Artificial Sequence
  Description of Artificial Sequence: Synthetic oligonucleotide
gacuaguaagaaggcaau

SEQ ID NO: 22632 - RNA, 18 nt, Artificial Sequence
  Description of Artificial Sequence: Synthetic oligonucleotide
acgcagacuaguaagaag

SEQ ID NO: 22633 - RNA, 18 nt, Artificial Sequence
  Description of Artificial Sequence: Synthetic oligonucleotide
cucuaacgcagacuagua

SEQ ID NO: 22634 - RNA, 18 nt, Artificial Sequence
  Description of Artificial Sequence: Synthetic oligonucleotide
ccccucucuaacgcagac

SEQ ID NO: 22635 - RNA, 18 nt, Artificial Sequence
  Description of Artificial Sequence: Synthetic oligonucleotide
acuguccccucucuaacg

SEQ ID NO: 22636 - RNA, 18 nt, Artificial Sequence
  Description of Artificial Sequence: Synthetic oligonucleotide
aacgcacuguccccucuc

SEQ ID NO: 22637 - RNA, 18 nt, Artificial Sequence
  Description of Artificial Sequence: Synthetic oligonucleotide
agagaaacgcacuguccc

SEQ ID NO: 22638 - RNA, 18 nt, Artificial Sequence
  Description of Artificial Sequence: Synthetic oligonucleotide
uugggagagaaacgcacu

SEQ ID NO: 22639 - RNA, 18 nt, Artificial Sequence
  Description of Artificial Sequence: Synthetic oligonucleotide
aucguuugggagagaaac

SEQ ID NO: 22640 - RNA, 18 nt, Artificial Sequence
  Description of Artificial Sequence: Synthetic oligonucleotide
cugcaaucguuugggaga

SEQ ID NO: 22641 - RNA, 18 nt, Artificial Sequence
  Description of Artificial Sequence: Synthetic oligonucleotide
ugcucuuugcauuauagg

SEQ ID NO: 22642 - RNA, 18 nt, Artificial Sequence
  Description of Artificial Sequence: Synthetic oligonucleotide
gcuuuugcucuuugcauu

SEQ ID NO: 22643 - RNA, 18 nt, Artificial Sequence
  Description of Artificial Sequence: Synthetic oligonucleotide
ucaaagcuuuugcucuuu

SEQ ID NO: 22644 - RNA, 18 nt, Artificial Sequence
  Description of Artificial Sequence: Synthetic oligonucleotide
gaucuucaaagcuuuugc

SEQ ID NO: 22645 - RNA, 18 nt, Artificial Sequence
  Description of Artificial Sequence: Synthetic oligonucleotide
gggaggaucuucaaagcu

SEQ ID NO: 22646 - RNA, 18 nt, Artificial Sequence
  Description of Artificial Sequence: Synthetic oligonucleotide
ugguugggaggaucuuca

SEQ ID NO: 22647 - RNA, 18 nt, Artificial Sequence
  Description of Artificial Sequence: Synthetic oligonucleotide
gggcaugguugggaggau

SEQ ID NO: 22648 - RNA, 18 nt, Artificial Sequence
  Description of Artificial Sequence: Synthetic oligonucleotide
gcuacgggcaugguuggg

SEQ ID NO: 22649 - RNA, 18 nt, Artificial Sequence
  Description of Artificial Sequence: Synthetic oligonucleotide
ccagggcuacgggcaugg

SEQ ID NO: 22650 - RNA, 18 nt, Artificial Sequence
  Description of Artificial Sequence: Synthetic oligonucleotide
uguuuccagggcuacggg

SEQ ID NO: 22651 - RNA, 18 nt, Artificial Sequence
  Description of Artificial Sequence: Synthetic oligonucleotide
cccuuuguuuccagggcu

SEQ ID NO: 22652 - RNA, 18 nt, Artificial Sequence
  Description of Artificial Sequence: Synthetic oligonucleotide
cccuucccuuuguuucca

SEQ ID NO: 22653 - RNA, 18 nt, Artificial Sequence
  Description of Artificial Sequence: Synthetic oligonucleotide
ccuugcccuucccuuugu

SEQ ID NO: 22654 - RNA, 18 nt, Artificial Sequence
  Description of Artificial Sequence: Synthetic oligonucleotide
uuuucccuugcccuuccc

SEQ ID NO: 22655 - RNA, 18 nt, Artificial Sequence
  Description of Artificial Sequence: Synthetic oligonucleotide
gccauuuuuuucuccguu

SEQ ID NO: 22656 - RNA, 18 nt, Artificial Sequence
  Description of Artificial Sequence: Synthetic oligonucleotide
cgcgagccauuuuuuucu

SEQ ID NO: 22657 - RNA, 18 nt, Artificial Sequence
  Description of Artificial Sequence: Synthetic oligonucleotide
uuuggcgcgagccauuuu

SEQ ID NO: 22658 - RNA, 18 nt, Artificial Sequence
  Description of Artificial Sequence: Synthetic oligonucleotide
acuguuuuggcgcgagcc

SEQ ID NO: 22659 - RNA, 18 nt, Artificial Sequence
  Description of Artificial Sequence: Synthetic oligonucleotide
ucaugacuguuuuggcgc

SEQ ID NO: 22660 - RNA, 18 nt, Artificial Sequence
  Description of Artificial Sequence: Synthetic oligonucleotide
ggaguucaugacuguuuu

SEQ ID NO: 22661 - RNA, 18 nt, Artificial Sequence
  Description of Artificial Sequence: Synthetic oligonucleotide
cuuuauucccggcagaug

SEQ ID NO: 22662 - RNA, 18 nt, Artificial Sequence
  Description of Artificial Sequence: Synthetic oligonucleotide
accggcuuuauucccggc

SEQ ID NO: 22663 - RNA, 18 nt, Artificial Sequence
  Description of Artificial Sequence: Synthetic oligonucleotide
ccgccaccggcuuuauuc

SEQ ID NO: 22664 - RNA, 18 nt, Artificial Sequence
  Description of Artificial Sequence: Synthetic oligonucleotide
gagcgccgccaccggcuu

SEQ ID NO: 22665 - RNA, 18 nt, Artificial Sequence
  Description of Artificial Sequence: Synthetic oligonucleotide
cucgugagcgccgccacc

SEQ ID NO: 22666 - RNA, 18 nt, Artificial Sequence
  Description of Artificial Sequence: Synthetic oligonucleotide
gccgccucgugagcgccg

SEQ ID NO: 22667 - RNA, 18 nt, Artificial Sequence
  Description of Artificial Sequence: Synthetic oligonucleotide
ucccagccgccucgugag

SEQ ID NO: 22668 - RNA, 18 nt, Artificial Sequence
  Description of Artificial Sequence: Synthetic oligonucleotide
gcagcucccagccgccuc

SEQ ID NO: 22669 - RNA, 18 nt, Artificial Sequence
  Description of Artificial Sequence: Synthetic oligonucleotide
agagagcagcucccagcc

SEQ ID NO: 22670 - RNA, 18 nt, Artificial Sequence
  Description of Artificial Sequence: Synthetic oligonucleotide
cacucagagagcagcucc

SEQ ID NO: 22671 - RNA, 18 nt, Artificial Sequence
  Description of Artificial Sequence: Synthetic oligonucleotide
gauggcacucagagagca

SEQ ID NO: 22672 - RNA, 18 nt, Artificial Sequence
  Description of Artificial Sequence: Synthetic oligonucleotide
cagaugauggcacucaga

SEQ ID NO: 22673 - RNA, 18 nt, Artificial Sequence
  Description of Artificial Sequence: Synthetic oligonucleotide
cgccgccaccggcuuuau

SEQ ID NO: 22674 - RNA, 18 nt, Artificial Sequence
  Description of Artificial Sequence: Synthetic oligonucleotide
gugagcgccgccaccggc

SEQ ID NO: 22675 - RNA, 18 nt, Artificial Sequence
  Description of Artificial Sequence: Synthetic oligonucleotide
gccucgugagcgccgcca

SEQ ID NO: 22676 - RNA, 18 nt, Artificial Sequence
  Description of Artificial Sequence: Synthetic oligonucleotide
cagccgccucgugagcgc

SEQ ID NO: 22677 - RNA, 18 nt, Artificial Sequence
  Description of Artificial Sequence: Synthetic oligonucleotide
gcucccagccgccucgug

SEQ ID NO: 22678 - RNA, 18 nt, Artificial Sequence
  Description of Artificial Sequence: Synthetic oligonucleotide
gagcagcucccagccgcc

SEQ ID NO: 22679 - RNA, 18 nt, Artificial Sequence
  Description of Artificial Sequence: Synthetic oligonucleotide
ucagagagcagcucccag

SEQ ID NO: 22680 - RNA, 18 nt, Artificial Sequence
  Description of Artificial Sequence: Synthetic oligonucleotide
ggcacucagagagcagcu

SEQ ID NO: 22681 - RNA, 18 nt, Artificial Sequence
  Description of Artificial Sequence: Synthetic oligonucleotide
augauggcacucagagag

SEQ ID NO: 22682 - RNA, 18 nt, Artificial Sequence
  Description of Artificial Sequence: Synthetic oligonucleotide
cacagaugauggcacuca

SEQ ID NO: 22683 - RNA, 18 nt, Artificial Sequence
  Description of Artificial Sequence: Synthetic oligonucleotide
ugcacuugggaggguggg

SEQ ID NO: 22684 - RNA, 18 nt, Artificial Sequence
  Description of Artificial Sequence: Synthetic oligonucleotide
cugaaugcacuugggagg

SEQ ID NO: 22685 - RNA, 18 nt, Artificial Sequence
  Description of Artificial Sequence: Synthetic oligonucleotide
ccgcacugaaugcacuug

SEQ ID NO: 22686 - RNA, 18 nt, Artificial Sequence
  Description of Artificial Sequence: Synthetic oligonucleotide
acugcccgcacugaaugc

SEQ ID NO: 22687 - RNA, 18 nt, Artificial Sequence
  Description of Artificial Sequence: Synthetic oligonucleotide
cagguacugcccgcacug

SEQ ID NO: 22688 - RNA, 18 nt, Artificial Sequence
  Description of Artificial Sequence: Synthetic oligonucleotide
ucguccagguacugcccg

SEQ ID NO: 22689 - RNA, 18 nt, Artificial Sequence
  Description of Artificial Sequence: Synthetic oligonucleotide
cagggucguccagguacu

SEQ ID NO: 22690 - RNA, 18 nt, Artificial Sequence
  Description of Artificial Sequence: Synthetic oligonucleotide
gaggucagggucguccag

SEQ ID NO: 22691 - RNA, 18 nt, Artificial Sequence
  Description of Artificial Sequence: Synthetic oligonucleotide
uauuugaggucagggucg

SEQ ID NO: 22692 - RNA, 18 nt, Artificial Sequence
  Description of Artificial Sequence: Synthetic oligonucleotide
gcccauauuugaggucag

SEQ ID NO: 22693 - RNA, 18 nt, Artificial Sequence
  Description of Artificial Sequence: Synthetic oligonucleotide
gugcugcccauauuugag

SEQ ID NO: 22694 - RNA, 18 nt, Artificial Sequence
  Description of Artificial Sequence: Synthetic oligonucleotide
ggugggugcugcccauau

SEQ ID NO: 22695 - RNA, 18 nt, Artificial Sequence
  Description of Artificial Sequence: Synthetic oligonucleotide
cgucuggugggugcugcc

SEQ ID NO: 22696 - RNA, 18 nt, Artificial Sequence
  Description of Artificial Sequence: Synthetic oligonucleotide
gacuuguggguguucuca

SEQ ID NO: 22697 - RNA, 18 nt, Artificial Sequence
  Description of Artificial Sequence: Synthetic oligonucleotide
gaguggacuugugggugu

SEQ ID NO: 22698 - RNA, 18 nt, Artificial Sequence
  Description of Artificial Sequence: Synthetic oligonucleotide
cgcuggaguggacuugug

SEQ ID NO: 22699 - RNA, 18 nt, Artificial Sequence
  Description of Artificial Sequence: Synthetic oligonucleotide
uagcucgcuggaguggac

SEQ ID NO: 22700 - RNA, 18 nt, Artificial Sequence
  Description of Artificial Sequence: Synthetic oligonucleotide
cgugguagcucgcuggag

SEQ ID NO: 22701 - RNA, 18 nt, Artificial Sequence
  Description of Artificial Sequence: Synthetic oligonucleotide
gucugcgugguagcucgc

SEQ ID NO: 22702 - RNA, 18 nt, Artificial Sequence
  Description of Artificial Sequence: Synthetic oligonucleotide
uugaugucugcgugguag

SEQ ID NO: 22703 - RNA, 18 nt, Artificial Sequence
  Description of Artificial Sequence: Synthetic oligonucleotide
gcagguugaugucugcgu

SEQ ID NO: 22704 - RNA, 18 nt, Artificial Sequence
  Description of Artificial Sequence: Synthetic oligonucleotide
guagagcagguugauguc

SEQ ID NO: 22705 - RNA, 18 nt, Artificial Sequence
  Description of Artificial Sequence: Synthetic oligonucleotide
cuccaguagagcagguug

SEQ ID NO: 22706 - RNA, 18 nt, Artificial Sequence
  Description of Artificial Sequence: Synthetic oligonucleotide
cgucgcuccaguagagca

SEQ ID NO: 22707 - RNA, 18 nt, Artificial Sequence
  Description of Artificial Sequence: Synthetic oligonucleotide
cuccucgucgcuccagua

SEQ ID NO: 22708 - RNA, 18 nt, Artificial Sequence
  Description of Artificial Sequence: Synthetic oligonucleotide
acggccuccucgucgcuc

SEQ ID NO: 22709 - RNA, 18 nt, Artificial Sequence
  Description of Artificial Sequence: Synthetic oligonucleotide
ccaccacggccuccucgu

SEQ ID NO: 22710 - RNA, 18 nt, Artificial Sequence
  Description of Artificial Sequence: Synthetic oligonucleotide
gaaguccaccacggccuc

SEQ ID NO: 22711 - RNA, 18 nt, Artificial Sequence
  Description of Artificial Sequence: Synthetic oligonucleotide
gccuugaaguccaccacg

SEQ ID NO: 22712 - RNA, 18 nt, Artificial Sequence
  Description of Artificial Sequence: Synthetic oligonucleotide
gcacagccuugaagucca

SEQ ID NO: 22713 - RNA, 18 nt, Artificial Sequence
  Description of Artificial Sequence: Synthetic oligonucleotide
gcccugcacagccuugaa

SEQ ID NO: 22714 - RNA, 18 nt, Artificial Sequence
  Description of Artificial Sequence: Synthetic oligonucleotide
cagcggcccugcacagcc

SEQ ID NO: 22715 - RNA, 18 nt, Artificial Sequence
  Description of Artificial Sequence: Synthetic oligonucleotide
cggugcagcggcccugca

SEQ ID NO: 22716 - RNA, 18 nt, Artificial Sequence
  Description of Artificial Sequence: Synthetic oligonucleotide
cuccacggugcagcggcc

SEQ ID NO: 22717 - RNA, 18 nt, Artificial Sequence
  Description of Artificial Sequence: Synthetic oligonucleotide
ccauacuccacggugcag

SEQ ID NO: 22718 - RNA, 18 nt, Artificial Sequence
  Description of Artificial Sequence: Synthetic oligonucleotide
ccuccccauacuccacgg

SEQ ID NO: 22719 - RNA, 18 nt, Artificial Sequence
  Description of Artificial Sequence: Synthetic oligonucleotide
cagguccuccccauacuc

SEQ ID NO: 22720 - RNA, 18 nt, Artificial Sequence
  Description of Artificial Sequence: Synthetic oligonucleotide
ucgggcagguccucccca

SEQ ID NO: 22721 - RNA, 18 nt, Artificial Sequence
  Description of Artificial Sequence: Synthetic oligonucleotide
cgcacucgggcagguccu

SEQ ID NO: 22722 - RNA, 18 nt, Artificial Sequence
  Description of Artificial Sequence: Synthetic oligonucleotide
cuggacgcacucgggcag

SEQ ID NO: 22723 - RNA, 18 nt, Artificial Sequence
  Description of Artificial Sequence: Synthetic oligonucleotide
uacaccuggacgcacucg

SEQ ID NO: 22724 - RNA, 18 nt, Artificial Sequence
  Description of Artificial Sequence: Synthetic oligonucleotide
uggaguacaccuggacgc

SEQ ID NO: 22725 - RNA, 18 nt, Artificial Sequence
  Description of Artificial Sequence: Synthetic oligonucleotide
gcccauggaguacaccug

SEQ ID NO: 22726 - RNA, 18 nt, Artificial Sequence
  Description of Artificial Sequence: Synthetic oligonucleotide
gggccgcccauggaguac

SEQ ID NO: 22727 - RNA, 18 nt, Artificial Sequence
  Description of Artificial Sequence: Synthetic oligonucleotide
gaaguagaagcgguuggg

SEQ ID NO: 22728 - RNA, 18 nt, Artificial Sequence
  Description of Artificial Sequence: Synthetic oligonucleotide
gaggaaguagaagcgguu

SEQ ID NO: 22729 - RNA, 18 nt, Artificial Sequence
  Description of Artificial Sequence: Synthetic oligonucleotide
ccuucccucuagcaagca

SEQ ID NO: 22730 - RNA, 18 nt, Artificial Sequence
  Description of Artificial Sequence: Synthetic oligonucleotide
cgaagccuucccucuagc

SEQ ID NO: 22731 - RNA, 18 nt, Artificial Sequence
  Description of Artificial Sequence: Synthetic oligonucleotide
gaccccgaagccuucccu

SEQ ID NO: 22732 - RNA, 18 nt, Artificial Sequence
  Description of Artificial Sequence: Synthetic oligonucleotide
acuuugaccccgaagccu

SEQ ID NO: 22733 - RNA, 18 nt, Artificial Sequence
  Description of Artificial Sequence: Synthetic oligonucleotide
ggccaacuuugaccccga

SEQ ID NO: 22734 - RNA, 18 nt, Artificial Sequence
  Description of Artificial Sequence: Synthetic oligonucleotide
cuucuggccaacuuugac

SEQ ID NO: 22735 - RNA, 18 nt, Artificial Sequence
  Description of Artificial Sequence: Synthetic oligonucleotide
gacuccuucuggccaacu

SEQ ID NO: 22736 - RNA, 18 nt, Artificial Sequence
  Description of Artificial Sequence: Synthetic oligonucleotide
caucagacuccuucuggc

SEQ ID NO: 22737 - RNA, 18 nt, Artificial Sequence
  Description of Artificial Sequence: Synthetic oligonucleotide
cccgacaucagacuccuu

SEQ ID NO: 22738 - RNA, 18 nt, Artificial Sequence
  Description of Artificial Sequence: Synthetic oligonucleotide
uauaacccgacaucagac

SEQ ID NO: 22739 - RNA, 18 nt, Artificial Sequence
  Description of Artificial Sequence: Synthetic oligonucleotide
uuguguauaacccgacau

SEQ ID NO: 22740 - RNA, 18 nt, Artificial Sequence
  Description of Artificial Sequence: Synthetic oligonucleotide
ccgccuuguguauaaccc

SEQ ID NO: 22741 - RNA, 18 nt, Artificial Sequence
  Description of Artificial Sequence: Synthetic oligonucleotide
ccaagccgccuuguguau

SEQ ID NO: 22742 - RNA, 18 nt, Artificial Sequence
  Description of Artificial Sequence: Synthetic oligonucleotide
ugcagccaagccgccuug

SEQ ID NO: 22743 - RNA, 18 nt, Artificial Sequence
  Description of Artificial Sequence: Synthetic oligonucleotide
aacccugcagccaagccg

SEQ ID NO: 22744 - RNA, 18 nt, Artificial Sequence
  Description of Artificial Sequence: Synthetic oligonucleotide
gcugaaacccugcagcca

SEQ ID NO: 22745 - RNA, 18 nt, Artificial Sequence
  Description of Artificial Sequence: Synthetic oligonucleotide
caaaagcugaaacccugc

SEQ ID NO: 22746 - RNA, 18 nt, Artificial Sequence
  Description of Artificial Sequence: Synthetic oligonucleotide
ucuuacaaaagcugaaac

SEQ ID NO: 22747 - RNA, 18 nt, Artificial Sequence
  Description of Artificial Sequence: Synthetic oligonucleotide
ccacuucuuacaaaagcu

SEQ ID NO: 22748 - RNA, 18 nt, Artificial Sequence
  Description of Artificial Sequence: Synthetic oligonucleotide
accacccacuucuuacaa

SEQ ID NO: 22749 - RNA, 18 nt, Artificial Sequence
  Description of Artificial Sequence: Synthetic oligonucleotide
agccaaccacccacuucu

SEQ ID NO: 22750 - RNA, 18 nt, Artificial Sequence
  Description of Artificial Sequence: Synthetic oligonucleotide
acgucagccaaccaccca

SEQ ID NO: 22751 - RNA, 18 nt, Artificial Sequence
  Description of Artificial Sequence: Synthetic oligonucleotide
gcuucacgucagccaacc

SEQ ID NO: 22752 - RNA, 18 nt, Artificial Sequence
  Description of Artificial Sequence: Synthetic oligonucleotide
gaacagcuucacgucagc

SEQ ID NO: 22753 - RNA, 18 nt, Artificial Sequence
  Description of Artificial Sequence: Synthetic oligonucleotide
cugcagaacagcuucacg

SEQ ID NO: 22754 - RNA, 18 nt, Artificial Sequence
  Description of Artificial Sequence: Synthetic oligonucleotide
agcuccugcagaacagcu

SEQ ID NO: 22755 - RNA, 18 nt, Artificial Sequence
  Description of Artificial Sequence: Synthetic oligonucleotide
cguaaagcuccugcagaa

SEQ ID NO: 22756 - RNA, 18 nt, Artificial Sequence
  Description of Artificial Sequence: Synthetic oligonucleotide
acccccguaaagcuccug

SEQ ID NO: 22757 - RNA, 18 nt, Artificial Sequence
  Description of Artificial Sequence: Synthetic oligonucleotide
cucagacccccguaaagc

SEQ ID NO: 22758 - RNA, 18 nt, Artificial Sequence
  Description of Artificial Sequence: Synthetic oligonucleotide
cccugcucagacccccgu

SEQ ID NO: 22759 - RNA, 18 nt, Artificial Sequence
  Description of Artificial Sequence: Synthetic oligonucleotide
gagaacccugcucagacc

SEQ ID NO: 22760 - RNA, 18 nt, Artificial Sequence
  Description of Artificial Sequence: Synthetic oligonucleotide
cucuggagaacccugcuc

SEQ ID NO: 22761 - RNA, 18 nt, Artificial Sequence
  Description of Artificial Sequence: Synthetic oligonucleotide
uugugcucuggagaaccc

SEQ ID NO: 22762 - RNA, 18 nt, Artificial Sequence
  Description of Artificial Sequence: Synthetic oligonucleotide
acaacuugugcucuggag

SEQ ID NO: 22763 - RNA, 18 nt, Artificial Sequence
  Description of Artificial Sequence: Synthetic oligonucleotide
cucauacaacuugugcuc

SEQ ID NO: 22764 - RNA, 18 nt, Artificial Sequence
  Description of Artificial Sequence: Synthetic oligonucleotide
ugaaucucauacaacuug

SEQ ID NO: 22765 - RNA, 18 nt, Artificial Sequence
  Description of Artificial Sequence: Synthetic oligonucleotide
ccacuugaaucucauaca

SEQ ID NO: 22766 - RNA, 18 nt, Artificial Sequence
  Description of Artificial Sequence: Synthetic oligonucleotide
cgggaccacuugaaucuc

SEQ ID NO: 22767 - RNA, 18 nt, Artificial Sequence
  Description of Artificial Sequence: Synthetic oligonucleotide
aacuccgggaccacuuga

SEQ ID NO: 22768 - RNA, 18 nt, Artificial Sequence
  Description of Artificial Sequence: Synthetic oligonucleotide
uguuaaacuccgggacca

SEQ ID NO: 22769 - RNA, 18 nt, Artificial Sequence
  Description of Artificial Sequence: Synthetic oligonucleotide
aggaguguuaaacuccgg

SEQ ID NO: 22770 - RNA, 18 nt, Artificial Sequence
  Description of Artificial Sequence: Synthetic oligonucleotide
aaaccaggaguguuaaac

SEQ ID NO: 22771 - RNA, 18 nt, Artificial Sequence
  Description of Artificial Sequence: Synthetic oligonucleotide
uuuaaaaaccaggagugu

SEQ ID NO: 22772 - RNA, 18 nt, Artificial Sequence
  Description of Artificial Sequence: Synthetic oligonucleotide
uacuuuuuaaaaaccagg

SEQ ID NO: 22773 - RNA, 18 nt, Artificial Sequence
  Description of Artificial Sequence: Synthetic oligonucleotide
ugacguacuuuuuaaaaa

SEQ ID NO: 22774 - RNA, 18 nt, Artificial Sequence
  Description of Artificial Sequence: Synthetic oligonucleotide
ucuaaugacguacuuuuu

SEQ ID NO: 22775 - RNA, 18 nt, Artificial Sequence
  Description of Artificial Sequence: Synthetic oligonucleotide
gguucucuaaugacguac

SEQ ID NO: 22776 - RNA, 18 nt, Artificial Sequence
  Description of Artificial Sequence: Synthetic oligonucleotide
cguuagguucucuaauga

SEQ ID NO: 22777 - RNA, 18 nt, Artificial Sequence
  Description of Artificial Sequence: Synthetic oligonucleotide
uaaaacguuagguucucu

SEQ ID NO: 22778 - RNA, 18 nt, Artificial Sequence
  Description of Artificial Sequence: Synthetic oligonucleotide
gacacuaaaacguuaggu

SEQ ID NO: 22779 - RNA, 18 nt, Artificial Sequence
  Description of Artificial Sequence: Synthetic oligonucleotide
accaagacacuaaaacgu

SEQ ID NO: 22780 - RNA, 18 nt, Artificial Sequence
  Description of Artificial Sequence: Synthetic oligonucleotide
guugcaccaagacacuaa

SEQ ID NO: 22781 - RNA, 18 nt, Artificial Sequence
  Description of Artificial Sequence: Synthetic oligonucleotide
guucaguugcaccaagac

SEQ ID NO: 22782 - RNA, 18 nt, Artificial Sequence
  Description of Artificial Sequence: Synthetic oligonucleotide
ucaacguucaguugcacc

SEQ ID NO: 22783 - RNA, 18 nt, Artificial Sequence
  Description of Artificial Sequence: Synthetic oligonucleotide
gguccucaacguucaguu

SEQ ID NO: 22784 - RNA, 18 nt, Artificial Sequence
  Description of Artificial Sequence: Synthetic oligonucleotide
cucaugguccucaacguu

SEQ ID NO: 22785 - RNA, 18 nt, Artificial Sequence
  Description of Artificial Sequence: Synthetic oligonucleotide
gcugccucaugguccuca

SEQ ID NO: 22786 - RNA, 18 nt, Artificial Sequence
  Description of Artificial Sequence: Synthetic oligonucleotide
uggaagcugccucauggu

SEQ ID NO: 22787 - RNA, 18 nt, Artificial Sequence
  Description of Artificial Sequence: Synthetic oligonucleotide
gcugguggaagcugccuc

SEQ ID NO: 22788 - RNA, 18 nt, Artificial Sequence
  Description of Artificial Sequence: Synthetic oligonucleotide
gucaggcugguggaagcu

SEQ ID NO: 22789 - RNA, 18 nt, Artificial Sequence
  Description of Artificial Sequence: Synthetic oligonucleotide
caccagucaggcuggugg

SEQ ID NO: 22790 - RNA, 18 nt, Artificial Sequence
  Description of Artificial Sequence: Synthetic oligonucleotide
uaagacaccagucaggcu

SEQ ID NO: 22791 - RNA, 18 nt, Artificial Sequence
  Description of Artificial Sequence: Synthetic oligonucleotide
cauacuaagacaccaguc

SEQ ID NO: 22792 - RNA, 18 nt, Artificial Sequence
  Description of Artificial Sequence: Synthetic oligonucleotide
caacucauacuaagacac

SEQ ID NO: 22793 - RNA, 18 nt, Artificial Sequence
  Description of Artificial Sequence: Synthetic oligonucleotide
uucuccaacucauacuaa

SEQ ID NO: 22794 - RNA, 18 nt, Artificial Sequence
  Description of Artificial Sequence: Synthetic oligonucleotide
gcaccuucuccaacucau

SEQ ID NO: 22795 - RNA, 18 nt, Artificial Sequence
  Description of Artificial Sequence: Synthetic oligonucleotide
gggcaccuucuccaacuc

SEQ ID NO: 22796 - RNA, 18 nt, Artificial Sequence
  Description of Artificial Sequence: Synthetic oligonucleotide
agggacccaggagcaggg

SEQ ID NO: 22797 - RNA, 18 nt, Artificial Sequence
  Description of Artificial Sequence: Synthetic oligonucleotide
gcccaagggacccaggag

SEQ ID NO: 22798 - RNA, 18 nt, Artificial Sequence
  Description of Artificial Sequence: Synthetic oligonucleotide
gccuggcccaagggaccc

SEQ ID NO: 22799 - RNA, 18 nt, Artificial Sequence
  Description of Artificial Sequence: Synthetic oligonucleotide
uaggcgccuggcccaagg

SEQ ID NO: 22800 - RNA, 18 nt, Artificial Sequence
  Description of Artificial Sequence: Synthetic oligonucleotide
ggacguaggcgccuggcc

SEQ ID NO: 22801 - RNA, 18 nt, Artificial Sequence
  Description of Artificial Sequence: Synthetic oligonucleotide
ggccuggacguaggcgcc

SEQ ID NO: 22802 - RNA, 18 nt, Artificial Sequence
  Description of Artificial Sequence: Synthetic oligonucleotide
ggcugggccuggacguag

SEQ ID NO: 22803 - RNA, 18 nt, Artificial Sequence
  Description of Artificial Sequence: Synthetic oligonucleotide
augugggcugggccugga

SEQ ID NO: 22804 - RNA, 18 nt, Artificial Sequence
  Description of Artificial Sequence: Synthetic oligonucleotide
caggcaugugggcugggc

SEQ ID NO: 22805 - RNA, 18 nt, Artificial Sequence
  Description of Artificial Sequence: Synthetic oligonucleotide
ccgcacaggcaugugggc

SEQ ID NO: 22806 - RNA, 18 nt, Artificial Sequence
  Description of Artificial Sequence: Synthetic oligonucleotide
gccacccgcacaggcaug

SEQ ID NO: 22807 - RNA, 18 nt, Artificial Sequence
  Description of Artificial Sequence: Synthetic oligonucleotide
cgagggccacccgcacag

SEQ ID NO: 22808 - RNA, 18 nt, Artificial Sequence
  Description of Artificial Sequence: Synthetic oligonucleotide
cauaacgagggccacccg

SEQ ID NO: 22809 - RNA, 18 nt, Artificial Sequence
  Description of Artificial Sequence: Synthetic oligonucleotide
cucuccauaacgagggcc

SEQ ID NO: 22810 - RNA, 18 nt, Artificial Sequence
  Description of Artificial Sequence: Synthetic oligonucleotide
gggcccucuccauaacga

SEQ ID NO: 22811 - RNA, 18 nt, Artificial Sequence
  Description of Artificial Sequence: Synthetic oligonucleotide
cucgugggcccucuccau

SEQ ID NO: 22812 - RNA, 18 nt, Artificial Sequence
  Description of Artificial Sequence: Synthetic oligonucleotide
augugggcugggccugga

SEQ ID NO: 22813 - RNA, 18 nt, Artificial Sequence
  Description of Artificial Sequence: Synthetic oligonucleotide
caggcaugugggcugggc

SEQ ID NO: 22814 - RNA, 18 nt, Artificial Sequence
  Description of Artificial Sequence: Synthetic oligonucleotide
ccgcacaggcaugugggc

SEQ ID NO: 22815 - RNA, 18 nt, Artificial Sequence
  Description of Artificial Sequence: Synthetic oligonucleotide
gccacccgcacaggcaug

SEQ ID NO: 22816 - RNA, 18 nt, Artificial Sequence
  Description of Artificial Sequence: Synthetic oligonucleotide
cgagggccacccgcacag

SEQ ID NO: 22817 - RNA, 18 nt, Artificial Sequence
  Description of Artificial Sequence: Synthetic oligonucleotide
cauaacgagggccacccg

SEQ ID NO: 22818 - RNA, 18 nt, Artificial Sequence
  Description of Artificial Sequence: Synthetic oligonucleotide
cucuccauaacgagggcc

SEQ ID NO: 22819 - RNA, 18 nt, Artificial Sequence
  Description of Artificial Sequence: Synthetic oligonucleotide
gggcccucuccauaacga

SEQ ID NO: 22820 - RNA, 18 nt, Artificial Sequence
  Description of Artificial Sequence: Synthetic oligonucleotide
cucgugggcccucuccau

SEQ ID NO: 22821 - RNA, 18 nt, Artificial Sequence
  Description of Artificial Sequence: Synthetic oligonucleotide
gcugacucgugggcccuc

SEQ ID NO: 22822 - RNA, 18 nt, Artificial Sequence
  Description of Artificial Sequence: Synthetic oligonucleotide
gaucagcugacucguggg

SEQ ID NO: 22823 - RNA, 18 nt, Artificial Sequence
  Description of Artificial Sequence: Synthetic oligonucleotide
agcuugaucagcugacuc

SEQ ID NO: 22824 - RNA, 18 nt, Artificial Sequence
  Description of Artificial Sequence: Synthetic oligonucleotide
ucaugagcuugaucagcu

SEQ ID NO: 22825 - RNA, 18 nt, Artificial Sequence
  Description of Artificial Sequence: Synthetic oligonucleotide
acaagucaugagcuugau

SEQ ID NO: 22826 - RNA, 18 nt, Artificial Sequence
  Description of Artificial Sequence: Synthetic oligonucleotide
aauuuacaagucaugagc

SEQ ID NO: 22827 - RNA, 18 nt, Artificial Sequence
  Description of Artificial Sequence: Synthetic oligonucleotide
ccaacaauuuacaaguca

SEQ ID NO: 22828 - RNA, 18 nt, Artificial Sequence
  Description of Artificial Sequence: Synthetic oligonucleotide
aagccccaacaauuuaca

SEQ ID NO: 22829 - RNA, 18 nt, Artificial Sequence
  Description of Artificial Sequence: Synthetic oligonucleotide
aggccaagccccaacaau

SEQ ID NO: 22830 - RNA, 18 nt, Artificial Sequence
  Description of Artificial Sequence: Synthetic oligonucleotide
cggaaaggccaagcccca

SEQ ID NO: 22831 - RNA, 18 nt, Artificial Sequence
  Description of Artificial Sequence: Synthetic oligonucleotide
caacacggaaaggccaag

SEQ ID NO: 22832 - RNA, 18 nt, Artificial Sequence
  Description of Artificial Sequence: Synthetic oligonucleotide
gguaacaacacggaaagg

SEQ ID NO: 22833 - RNA, 18 nt, Artificial Sequence
  Description of Artificial Sequence: Synthetic oligonucleotide
uuuaagguaacaacacgg

SEQ ID NO: 22834 - RNA, 18 nt, Artificial Sequence
  Description of Artificial Sequence: Synthetic oligonucleotide
aucguuuuaagguaacaa

SEQ ID NO: 22835 - RNA, 18 nt, Artificial Sequence
  Description of Artificial Sequence: Synthetic oligonucleotide
gauguaucguuuuaaggu

SEQ ID NO: 22836 - RNA, 18 nt, Artificial Sequence
  Description of Artificial Sequence: Synthetic oligonucleotide
acguggauguaucguuuu

SEQ ID NO: 22837 - RNA, 18 nt, Artificial Sequence
  Description of Artificial Sequence: Synthetic oligonucleotide
ggagaacguggauguauc

SEQ ID NO: 22838 - RNA, 18 nt, Artificial Sequence
  Description of Artificial Sequence: Synthetic oligonucleotide
gccugggagaacguggau

SEQ ID NO: 22839 - RNA, 18 nt, Artificial Sequence
  Description of Artificial Sequence: Synthetic oligonucleotide
uccaugccugggagaacg

SEQ ID NO: 22840 - RNA, 18 nt, Artificial Sequence
  Description of Artificial Sequence: Synthetic oligonucleotide
ccucauccaugccuggga

SEQ ID NO: 22841 - RNA, 18 nt, Artificial Sequence
  Description of Artificial Sequence: Synthetic oligonucleotide
ggcuaccucauccaugcc

SEQ ID NO: 22842 - RNA, 18 nt, Artificial Sequence
  Description of Artificial Sequence: Synthetic oligonucleotide
aauugggcuaccucaucc

SEQ ID NO: 22843 - RNA, 18 nt, Artificial Sequence
  Description of Artificial Sequence: Synthetic oligonucleotide
uguccaauugggcuaccu

SEQ ID NO: 22844 - RNA, 18 nt, Artificial Sequence
  Description of Artificial Sequence: Synthetic oligonucleotide
ucugcuguccaauugggc

SEQ ID NO: 22845 - RNA, 18 nt, Artificial Sequence
  Description of Artificial Sequence: Synthetic oligonucleotide
cagaaucugcuguccaau

SEQ ID NO: 22846 - RNA, 18 nt, Artificial Sequence
  Description of Artificial Sequence: Synthetic oligonucleotide
cuaugcagaaucugcugu

SEQ ID NO: 22847 - RNA, 18 nt, Artificial Sequence
  Description of Artificial Sequence: Synthetic oligonucleotide
aagugcuaugcagaaucu

SEQ ID NO: 22848 - RNA, 18 nt, Artificial Sequence
  Description of Artificial Sequence: Synthetic oligonucleotide
ggaaaaagugcuaugcag

SEQ ID NO: 22849 - RNA, 18 nt, Artificial Sequence
  Description of Artificial Sequence: Synthetic oligonucleotide
gaacaggaaaaagugcua

SEQ ID NO: 22850 - RNA, 18 nt, Artificial Sequence
  Description of Artificial Sequence: Synthetic oligonucleotide
uucuagaacaggaaaaag

SEQ ID NO: 22851 - RNA, 18 nt, Artificial Sequence
  Description of Artificial Sequence: Synthetic oligonucleotide
guaccuucuagaacagga

SEQ ID NO: 22852 - RNA, 18 nt, Artificial Sequence
  Description of Artificial Sequence: Synthetic oligonucleotide
ugagaguaccuucuagaa

SEQ ID NO: 22853 - RNA, 18 nt, Artificial Sequence
  Description of Artificial Sequence: Synthetic oligonucleotide
gcacuugagaguaccuuc

SEQ ID NO: 22854 - RNA, 18 nt, Artificial Sequence
  Description of Artificial Sequence: Synthetic oligonucleotide
uacaagcacuugagagua

SEQ ID NO: 22855 - RNA, 18 nt, Artificial Sequence
  Description of Artificial Sequence: Synthetic oligonucleotide
ccuauuacaagcacuuga

SEQ ID NO: 22856 - RNA, 18 nt, Artificial Sequence
  Description of Artificial Sequence: Synthetic oligonucleotide
aaaugccuauuacaagca

SEQ ID NO: 22857 - RNA, 18 nt, Artificial Sequence
  Description of Artificial Sequence: Synthetic oligonucleotide
cacugaaaugccuauuac

SEQ ID NO: 22858 - RNA, 18 nt, Artificial Sequence
  Description of Artificial Sequence: Synthetic oligonucleotide
gcugacacugaaaugccu

SEQ ID NO: 22859 - RNA, 18 nt, Artificial Sequence
  Description of Artificial Sequence: Synthetic oligonucleotide
aucuggcugacacugaaa

SEQ ID NO: 22860 - RNA, 18 nt, Artificial Sequence
  Description of Artificial Sequence: Synthetic oligonucleotide
auuugaucuggcugacac

SEQ ID NO: 22861 - RNA, 18 nt, Artificial Sequence
  Description of Artificial Sequence: Synthetic oligonucleotide
cuaacauuugaucuggcu

SEQ ID NO: 22862 - RNA, 18 nt, Artificial Sequence
  Description of Artificial Sequence: Synthetic oligonucleotide
uaauacuaacauuugauc

SEQ ID NO: 22863 - RNA, 18 nt, Artificial Sequence
  Description of Artificial Sequence: Synthetic oligonucleotide
uuuauuaauacuaacauu

SEQ ID NO: 22864 - RNA, 18 nt, Artificial Sequence
  Description of Artificial Sequence: Synthetic oligonucleotide
uccauuuuauuaauacua

SEQ ID NO: 22865 - RNA, 18 nt, Artificial Sequence
  Description of Artificial Sequence: Synthetic oligonucleotide
aacaauccauuuuauuaa

SEQ ID NO: 22866 - RNA, 18 nt, Artificial Sequence
  Description of Artificial Sequence: Synthetic oligonucleotide
cuuaaaacaauccauuuu

SEQ ID NO: 22867 - RNA, 18 nt, Artificial Sequence
  Description of Artificial Sequence: Synthetic oligonucleotide
agaaacuuaaaacaaucc

SEQ ID NO: 22868 - RNA, 18 nt, Artificial Sequence
  Description of Artificial Sequence: Synthetic oligonucleotide
acaauagaaacuuaaaac

SEQ ID NO: 22869 - RNA, 18 nt, Artificial Sequence
  Description of Artificial Sequence: Synthetic oligonucleotide
uugcuacaauagaaacuu

SEQ ID NO: 22870 - RNA, 18 nt, Artificial Sequence
  Description of Artificial Sequence: Synthetic oligonucleotide
ugacuuugcuacaauaga

SEQ ID NO: 22871 - RNA, 18 nt, Artificial Sequence
  Description of Artificial Sequence: Synthetic oligonucleotide
uaguuugacuuugcuaca

SEQ ID NO: 22872 - RNA, 18 nt, Artificial Sequence
  Description of Artificial Sequence: Synthetic oligonucleotide
aagaguaguuugacuuug

SEQ ID NO: 22873 - RNA, 18 nt, Artificial Sequence
  Description of Artificial Sequence: Synthetic oligonucleotide
ccaauaagaguaguuuga

SEQ ID NO: 22874 - RNA, 18 nt, Artificial Sequence
  Description of Artificial Sequence: Synthetic oligonucleotide
agccaccaauaagaguag

SEQ ID NO: 22875 - RNA, 18 nt, Artificial Sequence
  Description of Artificial Sequence: Synthetic oligonucleotide
caauuagccaccaauaag

SEQ ID NO: 22876 - RNA, 18 nt, Artificial Sequence
  Description of Artificial Sequence: Synthetic oligonucleotide
augaccaauuagccacca

SEQ ID NO: 22877 - RNA, 18 nt, Artificial Sequence
  Description of Artificial Sequence: Synthetic oligonucleotide
gggccaugaccaauuagc

SEQ ID NO: 22878 - RNA, 18 nt, Artificial Sequence
  Description of Artificial Sequence: Synthetic oligonucleotide
aauuucucccucaguggg

SEQ ID NO: 22879 - RNA, 18 nt, Artificial Sequence
  Description of Artificial Sequence: Synthetic oligonucleotide
uaauuucucccucagugg

SEQ ID NO: 22880 - RNA, 18 nt, Artificial Sequence
  Description of Artificial Sequence: Synthetic oligonucleotide
ucacuuaauuucucccuc

SEQ ID NO: 22881 - RNA, 18 nt, Artificial Sequence
  Description of Artificial Sequence: Synthetic oligonucleotide
gauagucacuuaauuucu

SEQ ID NO: 22882 - RNA, 18 nt, Artificial Sequence
  Description of Artificial Sequence: Synthetic oligonucleotide
aauuugauagucacuuaa

SEQ ID NO: 22883 - RNA, 18 nt, Artificial Sequence
  Description of Artificial Sequence: Synthetic oligonucleotide
aaggcaauuugauaguca

SEQ ID NO: 22884 - RNA, 18 nt, Artificial Sequence
  Description of Artificial Sequence: Synthetic oligonucleotide
guaagaaggcaauuugau

SEQ ID NO: 22885 - RNA, 18 nt, Artificial Sequence
  Description of Artificial Sequence: Synthetic oligonucleotide
gacuaguaagaaggcaau

SEQ ID NO: 22886 - RNA, 18 nt, Artificial Sequence
  Description of Artificial Sequence: Synthetic oligonucleotide
acgcagacuaguaagaag

SEQ ID NO: 22887 - RNA, 18 nt, Artificial Sequence
  Description of Artificial Sequence: Synthetic oligonucleotide
cucuaacgcagacuagua

SEQ ID NO: 22888 - RNA, 18 nt, Artificial Sequence
  Description of Artificial Sequence: Synthetic oligonucleotide
ccccucucuaacgcagac

SEQ ID NO: 22889 - RNA, 18 nt, Artificial Sequence
  Description of Artificial Sequence: Synthetic oligonucleotide
acuguccccucucuaacg

SEQ ID NO: 22890 - RNA, 18 nt, Artificial Sequence
  Description of Artificial Sequence: Synthetic oligonucleotide
aacgcacuguccccucuc

SEQ ID NO: 22891 - RNA, 18 nt, Artificial Sequence
  Description of Artificial Sequence: Synthetic oligonucleotide
agagaaacgcacuguccc

SEQ ID NO: 22892 - RNA, 18 nt, Artificial Sequence
  Description of Artificial Sequence: Synthetic oligonucleotide
uugggagagaaacgcacu

SEQ ID NO: 22893 - RNA, 18 nt, Artificial Sequence
  Description of Artificial Sequence: Synthetic oligonucleotide
aucguuugggagagaaac

SEQ ID NO: 22894 - RNA, 18 nt, Artificial Sequence
  Description of Artificial Sequence: Synthetic oligonucleotide
cugcaaucguuugggaga

SEQ ID NO: 22895 - RNA, 18 nt, Artificial Sequence
  Description of Artificial Sequence: Synthetic oligonucleotide
ugcucuuugcauuauagg

SEQ ID NO: 22896 - RNA, 18 nt, Artificial Sequence
  Description of Artificial Sequence: Synthetic oligonucleotide
gcuuuugcucuuugcauu

SEQ ID NO: 22897 - RNA, 18 nt, Artificial Sequence
  Description of Artificial Sequence: Synthetic oligonucleotide
ucaaagcuuuugcucuuu

SEQ ID NO: 22898 - RNA, 18 nt, Artificial Sequence
  Description of Artificial Sequence: Synthetic oligonucleotide
gaucuucaaagcuuuugc

SEQ ID NO: 22899 - RNA, 18 nt, Artificial Sequence
  Description of Artificial Sequence: Synthetic oligonucleotide
gggaggaucuucaaagcu

SEQ ID NO: 22900 - RNA, 18 nt, Artificial Sequence
  Description of Artificial Sequence: Synthetic oligonucleotide
ugguugggaggaucuuca

SEQ ID NO: 22901 - RNA, 18 nt, Artificial Sequence
  Description of Artificial Sequence: Synthetic oligonucleotide
gggcaugguugggaggau

SEQ ID NO: 22902 - RNA, 18 nt, Artificial Sequence
  Description of Artificial Sequence: Synthetic oligonucleotide
gcuacgggcaugguuggg

SEQ ID NO: 22903 - RNA, 18 nt, Artificial Sequence
  Description of Artificial Sequence: Synthetic oligonucleotide
ccagggcuacgggcaugg

SEQ ID NO: 22904 - RNA, 18 nt, Artificial Sequence
  Description of Artificial Sequence: Synthetic oligonucleotide
uguuuccagggcuacggg

SEQ ID NO: 22905 - RNA, 18 nt, Artificial Sequence
  Description of Artificial Sequence: Synthetic oligonucleotide
cccuuuguuuccagggcu

SEQ ID NO: 22906 - RNA, 18 nt, Artificial Sequence
  Description of Artificial Sequence: Synthetic oligonucleotide
cccuucccuuuguuucca

SEQ ID NO: 22907 - RNA, 18 nt, Artificial Sequence
  Description of Artificial Sequence: Synthetic oligonucleotide
ccuugcccuucccuuugu

SEQ ID NO: 22908 - RNA, 18 nt, Artificial Sequence
  Description of Artificial Sequence: Synthetic oligonucleotide
uuuucccuugcccuuccc

SEQ ID NO: 22909 - RNA, 18 nt, Artificial Sequence
  Description of Artificial Sequence: Synthetic oligonucleotide
gccauuuuuuucuccguu

SEQ ID NO: 22910 - RNA, 18 nt, Artificial Sequence
  Description of Artificial Sequence: Synthetic oligonucleotide
cgcgagccauuuuuuucu

SEQ ID NO: 22911 - RNA, 18 nt, Artificial Sequence
  Description of Artificial Sequence: Synthetic oligonucleotide
uuuggcgcgagccauuuu

SEQ ID NO: 22912 - RNA, 18 nt, Artificial Sequence
  Description of Artificial Sequence: Synthetic oligonucleotide
acuguuuuggcgcgagcc

SEQ ID NO: 22913 - RNA, 18 nt, Artificial Sequence
  Description of Artificial Sequence: Synthetic oligonucleotide
ucaugacuguuuuggcgc

SEQ ID NO: 22914 - RNA, 18 nt, Artificial Sequence
  Description of Artificial Sequence: Synthetic oligonucleotide
ggaguucaugacuguuuu

SEQ ID NO: 22915 - RNA, 18 nt, Artificial Sequence
  Description of Artificial Sequence: Synthetic oligonucleotide
cuuuauucccggcagaug

SEQ ID NO: 22916 - RNA, 18 nt, Artificial Sequence
  Description of Artificial Sequence: Synthetic oligonucleotide
accggcuuuauucccggc

SEQ ID NO: 22917 - RNA, 18 nt, Artificial Sequence
  Description of Artificial Sequence: Synthetic oligonucleotide
ccgccaccggcuuuauuc

SEQ ID NO: 22918 - RNA, 18 nt, Artificial Sequence
  Description of Artificial Sequence: Synthetic oligonucleotide
gagcgccgccaccggcuu

SEQ ID NO: 22919 - RNA, 18 nt, Artificial Sequence
  Description of Artificial Sequence: Synthetic oligonucleotide
cucgugagcgccgccacc

SEQ ID NO: 22920 - RNA, 18 nt, Artificial Sequence
  Description of Artificial Sequence: Synthetic oligonucleotide
gccgccucgugagcgccg

SEQ ID NO: 22921 - RNA, 18 nt, Artificial Sequence
  Description of Artificial Sequence: Synthetic oligonucleotide
ucccagccgccucgugag

SEQ ID NO: 22922 - RNA, 18 nt, Artificial Sequence
  Description of Artificial Sequence: Synthetic oligonucleotide
gcagcucccagccgccuc

SEQ ID NO: 22923 - RNA, 18 nt, Artificial Sequence
  Description of Artificial Sequence: Synthetic oligonucleotide
agagagcagcucccagcc

SEQ ID NO: 22924 - RNA, 18 nt, Artificial Sequence
  Description of Artificial Sequence: Synthetic oligonucleotide
cacucagagagcagcucc

SEQ ID NO: 22925 - RNA, 18 nt, Artificial Sequence
  Description of Artificial Sequence: Synthetic oligonucleotide
gauggcacucagagagca

SEQ ID NO: 22926 - RNA, 18 nt, Artificial Sequence
  Description of Artificial Sequence: Synthetic oligonucleotide
cagaugauggcacucaga

SEQ ID NO: 22927 - RNA, 18 nt, Artificial Sequence
  Description of Artificial Sequence: Synthetic oligonucleotide
cgccgccaccggcuuuau

SEQ ID NO: 22928 - RNA, 18 nt, Artificial Sequence
  Description of Artificial Sequence: Synthetic oligonucleotide
gugagcgccgccaccggc

SEQ ID NO: 22929 - RNA, 18 nt, Artificial Sequence
  Description of Artificial Sequence: Synthetic oligonucleotide
gccucgugagcgccgcca

SEQ ID NO: 22930 - RNA, 18 nt, Artificial Sequence
  Description of Artificial Sequence: Synthetic oligonucleotide
cagccgccucgugagcgc

SEQ ID NO: 22931 - RNA, 18 nt, Artificial Sequence
  Description of Artificial Sequence: Synthetic oligonucleotide
gcucccagccgccucgug

SEQ ID NO: 22932 - RNA, 18 nt, Artificial Sequence
  Description of Artificial Sequence: Synthetic oligonucleotide
gagcagcucccagccgcc

SEQ ID NO: 22933 - RNA, 18 nt, Artificial Sequence
  Description of Artificial Sequence: Synthetic oligonucleotide
ucagagagcagcucccag

SEQ ID NO: 22934 - RNA, 18 nt, Artificial Sequence
  Description of Artificial Sequence: Synthetic oligonucleotide
ggcacucagagagcagcu

SEQ ID NO: 22935 - RNA, 18 nt, Artificial Sequence
  Description of Artificial Sequence: Synthetic oligonucleotide
augauggcacucagagag

SEQ ID NO: 22936 - RNA, 18 nt, Artificial Sequence
  Description of Artificial Sequence: Synthetic oligonucleotide
cacagaugauggcacuca

SEQ ID NO: 22937 - RNA, 18 nt, Artificial Sequence
  Description of Artificial Sequence: Synthetic oligonucleotide
ugcacuugggaggguggg

SEQ ID NO: 22938 - RNA, 18 nt, Artificial Sequence
  Description of Artificial Sequence: Synthetic oligonucleotide
cugaaugcacuugggagg

SEQ ID NO: 22939 - RNA, 18 nt, Artificial Sequence
  Description of Artificial Sequence: Synthetic oligonucleotide
ccgcacugaaugcacuug

SEQ ID NO: 22940 - RNA, 18 nt, Artificial Sequence
  Description of Artificial Sequence: Synthetic oligonucleotide
acugcccgcacugaaugc

SEQ ID NO: 22941 - RNA, 18 nt, Artificial Sequence
  Description of Artificial Sequence: Synthetic oligonucleotide
cagguacugcccgcacug

SEQ ID NO: 22942 - RNA, 18 nt, Artificial Sequence
  Description of Artificial Sequence: Synthetic oligonucleotide
ucguccagguacugcccg

SEQ ID NO: 22943 - RNA, 18 nt, Artificial Sequence
  Description of Artificial Sequence: Synthetic oligonucleotide
cagggucguccagguacu

SEQ ID NO: 22944 - RNA, 18 nt, Artificial Sequence
  Description of Artificial Sequence: Synthetic oligonucleotide
gaggucagggucguccag

SEQ ID NO: 22945 - RNA, 18 nt, Artificial Sequence
  Description of Artificial Sequence: Synthetic oligonucleotide
uauuugaggucagggucg

SEQ ID NO: 22946 - RNA, 18 nt, Artificial Sequence
  Description of Artificial Sequence: Synthetic oligonucleotide
gcccauauuugaggucag

SEQ ID NO: 22947 - RNA, 18 nt, Artificial Sequence
  Description of Artificial Sequence: Synthetic oligonucleotide
gugcugcccauauuugag

SEQ ID NO: 22948 - RNA, 18 nt, Artificial Sequence
  Description of Artificial Sequence: Synthetic oligonucleotide
ggugggugcugcccauau

SEQ ID NO: 22949 - RNA, 18 nt, Artificial Sequence
  Description of Artificial Sequence: Synthetic oligonucleotide
cgucuggugggugcugcc

SEQ ID NO: 22950 - RNA, 18 nt, Artificial Sequence
  Description of Artificial Sequence: Synthetic oligonucleotide
gacuuguggguguucuca

SEQ ID NO: 22951 - RNA, 18 nt, Artificial Sequence
  Description of Artificial Sequence: Synthetic oligonucleotide
gaguggacuugugggugu

SEQ ID NO: 22952 - RNA, 18 nt, Artificial Sequence
  Description of Artificial Sequence: Synthetic oligonucleotide
cgcuggaguggacuugug

SEQ ID NO: 22953 - RNA, 18 nt, Artificial Sequence
  Description of Artificial Sequence: Synthetic oligonucleotide
uagcucgcuggaguggac

SEQ ID NO: 22954 - RNA, 18 nt, Artificial Sequence
  Description of Artificial Sequence: Synthetic oligonucleotide
cgugguagcucgcuggag

SEQ ID NO: 22955 - RNA, 18 nt, Artificial Sequence
  Description of Artificial Sequence: Synthetic oligonucleotide
gucugcgugguagcucgc

SEQ ID NO: 22956 - RNA, 18 nt, Artificial Sequence
  Description of Artificial Sequence: Synthetic oligonucleotide
uugaugucugcgugguag

SEQ ID NO: 22957 - RNA, 18 nt, Artificial Sequence
  Description of Artificial Sequence: Synthetic oligonucleotide
gcagguugaugucugcgu

SEQ ID NO: 22958 - RNA, 18 nt, Artificial Sequence
  Description of Artificial Sequence: Synthetic oligonucleotide
guagagcagguugauguc

SEQ ID NO: 22959 - RNA, 18 nt, Artificial Sequence
  Description of Artificial Sequence: Synthetic oligonucleotide
cuccaguagagcagguug

SEQ ID NO: 22960 - RNA, 18 nt, Artificial Sequence
  Description of Artificial Sequence: Synthetic oligonucleotide
cgucgcuccaguagagca

SEQ ID NO: 22961 - RNA, 18 nt, Artificial Sequence
  Description of Artificial Sequence: Synthetic oligonucleotide
cuccucgucgcuccagua

SEQ ID NO: 22962 - RNA, 18 nt, Artificial Sequence
  Description of Artificial Sequence: Synthetic oligonucleotide
acggccuccucgucgcuc

SEQ ID NO: 22963 - RNA, 18 nt, Artificial Sequence
  Description of Artificial Sequence: Synthetic oligonucleotide
ccaccacggccuccucgu

SEQ ID NO: 22964 - RNA, 18 nt, Artificial Sequence
  Description of Artificial Sequence: Synthetic oligonucleotide
gaaguccaccacggccuc

SEQ ID NO: 22965 - RNA, 18 nt, Artificial Sequence
  Description of Artificial Sequence: Synthetic oligonucleotide
gccuugaaguccaccacg

SEQ ID NO: 22966 - RNA, 18 nt, Artificial Sequence
  Description of Artificial Sequence: Synthetic oligonucleotide
gcacagccuugaagucca

SEQ ID NO: 22967 - RNA, 18 nt, Artificial Sequence
  Description of Artificial Sequence: Synthetic oligonucleotide
gcccugcacagccuugaa

SEQ ID NO: 22968 - RNA, 18 nt, Artificial Sequence
  Description of Artificial Sequence: Synthetic oligonucleotide
cagcggcccugcacagcc

SEQ ID NO: 22969 - RNA, 18 nt, Artificial Sequence
  Description of Artificial Sequence: Synthetic oligonucleotide
cggugcagcggcccugca

SEQ ID NO: 22970 - RNA, 18 nt, Artificial Sequence
  Description of Artificial Sequence: Synthetic oligonucleotide
cuccacggugcagcggcc

SEQ ID NO: 22971 - RNA, 18 nt, Artificial Sequence
  Description of Artificial Sequence: Synthetic oligonucleotide
ccauacuccacggugcag

SEQ ID NO: 22972 - RNA, 18 nt, Artificial Sequence
  Description of Artificial Sequence: Synthetic oligonucleotide
ccuccccauacuccacgg

SEQ ID NO: 22973 - RNA, 18 nt, Artificial Sequence
  Description of Artificial Sequence: Synthetic oligonucleotide
cagguccuccccauacuc

SEQ ID NO: 22974 - RNA, 18 nt, Artificial Sequence
  Description of Artificial Sequence: Synthetic oligonucleotide
ucgggcagguccucccca

SEQ ID NO: 22975 - RNA, 18 nt, Artificial Sequence
  Description of Artificial Sequence: Synthetic oligonucleotide
cgcacucgggcagguccu

SEQ ID NO: 22976 - RNA, 18 nt, Artificial Sequence
  Description of Artificial Sequence: Synthetic oligonucleotide
cuggacgcacucgggcag

SEQ ID NO: 22977 - RNA, 18 nt, Artificial Sequence
  Description of Artificial Sequence: Synthetic oligonucleotide
uacaccuggacgcacucg

SEQ ID NO: 22978 - RNA, 18 nt, Artificial Sequence
  Description of Artificial Sequence: Synthetic oligonucleotide
uggaguacaccuggacgc

SEQ ID NO: 22979 - RNA, 18 nt, Artificial Sequence
  Description of Artificial Sequence: Synthetic oligonucleotide
gcccauggaguacaccug

SEQ ID NO: 22980 - RNA, 18 nt, Artificial Sequence
  Description of Artificial Sequence: Synthetic oligonucleotide
gggccgcccauggaguac

SEQ ID NO: 22981 - RNA, 18 nt, Artificial Sequence
  Description of Artificial Sequence: Synthetic oligonucleotide
gaaguagaagcgguuggg

SEQ ID NO: 22982 - RNA, 18 nt, Artificial Sequence
  Description of Artificial Sequence: Synthetic oligonucleotide
gaggaaguagaagcgguu

SEQ ID NO: 22983 - RNA, 18 nt, Artificial Sequence
  Description of Artificial Sequence: Synthetic oligonucleotide
ccuucccucuagcaagca

SEQ ID NO: 22984 - RNA, 18 nt, Artificial Sequence
  Description of Artificial Sequence: Synthetic oligonucleotide
cgaagccuucccucuagc

SEQ ID NO: 22985 - RNA, 18 nt, Artificial Sequence
  Description of Artificial Sequence: Synthetic oligonucleotide
gaccccgaagccuucccu

SEQ ID NO: 22986 - RNA, 18 nt, Artificial Sequence
  Description of Artificial Sequence: Synthetic oligonucleotide
acuuugaccccgaagccu

SEQ ID NO: 22987 - RNA, 18 nt, Artificial Sequence
  Description of Artificial Sequence: Synthetic oligonucleotide
ggccaacuuugaccccga

SEQ ID NO: 22988 - RNA, 18 nt, Artificial Sequence
  Description of Artificial Sequence: Synthetic oligonucleotide
cuucuggccaacuuugac

SEQ ID NO: 22989 - RNA, 18 nt, Artificial Sequence
  Description of Artificial Sequence: Synthetic oligonucleotide
gacuccuucuggccaacu

SEQ ID NO: 22990 - RNA, 18 nt, Artificial Sequence
  Description of Artificial Sequence: Synthetic oligonucleotide
caucagacuccuucuggc

SEQ ID NO: 22991 - RNA, 18 nt, Artificial Sequence
  Description of Artificial Sequence: Synthetic oligonucleotide
cccgacaucagacuccuu

SEQ ID NO: 22992 - RNA, 18 nt, Artificial Sequence
  Description of Artificial Sequence: Synthetic oligonucleotide
uauaacccgacaucagac

SEQ ID NO: 22993 - RNA, 18 nt, Artificial Sequence
  Description of Artificial Sequence: Synthetic oligonucleotide
uuguguauaacccgacau

SEQ ID NO: 22994 - RNA, 18 nt, Artificial Sequence
  Description of Artificial Sequence: Synthetic oligonucleotide
ccgccuuguguauaaccc

SEQ ID NO: 22995 - RNA, 18 nt, Artificial Sequence
  Description of Artificial Sequence: Synthetic oligonucleotide
ccaagccgccuuguguau

SEQ ID NO: 22996 - RNA, 18 nt, Artificial Sequence
  Description of Artificial Sequence: Synthetic oligonucleotide
ugcagccaagccgccuug

SEQ ID NO: 22997 - RNA, 18 nt, Artificial Sequence
  Description of Artificial Sequence: Synthetic oligonucleotide
aacccugcagccaagccg

SEQ ID NO: 22998 - RNA, 18 nt, Artificial Sequence
  Description of Artificial Sequence: Synthetic oligonucleotide
gcugaaacccugcagcca

SEQ ID NO: 22999 - RNA, 18 nt, Artificial Sequence
  Description of Artificial Sequence: Synthetic oligonucleotide
caaaagcugaaacccugc

SEQ ID NO: 23000 - RNA, 18 nt, Artificial Sequence
  Description of Artificial Sequence: Synthetic oligonucleotide
ucuuacaaaagcugaaac

SEQ ID NO: 23001 - RNA, 18 nt, Artificial Sequence
  Description of Artificial Sequence: Synthetic oligonucleotide
ccacuucuuacaaaagcu

SEQ ID NO: 23002 - RNA, 18 nt, Artificial Sequence
  Description of Artificial Sequence: Synthetic oligonucleotide
accacccacuucuuacaa

SEQ ID NO: 23003 - RNA, 18 nt, Artificial Sequence
  Description of Artificial Sequence: Synthetic oligonucleotide
agccaaccacccacuucu

SEQ ID NO: 23004 - RNA, 18 nt, Artificial Sequence
  Description of Artificial Sequence: Synthetic oligonucleotide
acgucagccaaccaccca

SEQ ID NO: 23005 - RNA, 18 nt, Artificial Sequence
  Description of Artificial Sequence: Synthetic oligonucleotide
gcuucacgucagccaacc

SEQ ID NO: 23006 - RNA, 18 nt, Artificial Sequence
  Description of Artificial Sequence: Synthetic oligonucleotide
gaacagcuucacgucagc

SEQ ID NO: 23007 - RNA, 18 nt, Artificial Sequence
  Description of Artificial Sequence: Synthetic oligonucleotide
cugcagaacagcuucacg

SEQ ID NO: 23008 - RNA, 18 nt, Artificial Sequence
  Description of Artificial Sequence: Synthetic oligonucleotide
agcuccugcagaacagcu

SEQ ID NO: 23009 - RNA, 18 nt, Artificial Sequence
  Description of Artificial Sequence: Synthetic oligonucleotide
cguaaagcuccugcagaa

SEQ ID NO: 23010 - RNA, 18 nt, Artificial Sequence
  Description of Artificial Sequence: Synthetic oligonucleotide
acccccguaaagcuccug

SEQ ID NO: 23011 - RNA, 18 nt, Artificial Sequence
  Description of Artificial Sequence: Synthetic oligonucleotide
cucagacccccguaaagc

SEQ ID NO: 23012 - RNA, 18 nt, Artificial Sequence
  Description of Artificial Sequence: Synthetic oligonucleotide
cccugcucagacccccgu

SEQ ID NO: 23013 - RNA, 18 nt, Artificial Sequence
  Description of Artificial Sequence: Synthetic oligonucleotide
gagaacccugcucagacc

SEQ ID NO: 23014 - RNA, 18 nt, Artificial Sequence
  Description of Artificial Sequence: Synthetic oligonucleotide
cucuggagaacccugcuc

SEQ ID NO: 23015 - RNA, 18 nt, Artificial Sequence
  Description of Artificial Sequence: Synthetic oligonucleotide
uugugcucuggagaaccc

SEQ ID NO: 23016 - RNA, 18 nt, Artificial Sequence
  Description of Artificial Sequence: Synthetic oligonucleotide
acaacuugugcucuggag

SEQ ID NO: 23017 - RNA, 18 nt, Artificial Sequence
  Description of Artificial Sequence: Synthetic oligonucleotide
cucauacaacuugugcuc

SEQ ID NO: 23018 - RNA, 18 nt, Artificial Sequence
  Description of Artificial Sequence: Synthetic oligonucleotide
ugaaucucauacaacuug

SEQ ID NO: 23019 - RNA, 18 nt, Artificial Sequence
  Description of Artificial Sequence: Synthetic oligonucleotide
ccacuugaaucucauaca

SEQ ID NO: 23020 - RNA, 18 nt, Artificial Sequence
  Description of Artificial Sequence: Synthetic oligonucleotide
cgggaccacuugaaucuc

SEQ ID NO: 23021 - RNA, 18 nt, Artificial Sequence
  Description of Artificial Sequence: Synthetic oligonucleotide
aacuccgggaccacuuga

SEQ ID NO: 23022 - RNA, 18 nt, Artificial Sequence
  Description of Artificial Sequence: Synthetic oligonucleotide
uguuaaacuccgggacca

SEQ ID NO: 23023 - RNA, 18 nt, Artificial Sequence
  Description of Artificial Sequence: Synthetic oligonucleotide
aggaguguuaaacuccgg

SEQ ID NO: 23024 - RNA, 18 nt, Artificial Sequence
  Description of Artificial Sequence: Synthetic oligonucleotide
aaaccaggaguguuaaac

SEQ ID NO: 23025 - RNA, 18 nt, Artificial Sequence
  Description of Artificial Sequence: Synthetic oligonucleotide
uuuaaaaaccaggagugu

SEQ ID NO: 23026 - RNA, 18 nt, Artificial Sequence
  Description of Artificial Sequence: Synthetic oligonucleotide
uacuuuuuaaaaaccagg

SEQ ID NO: 23027 - RNA, 18 nt, Artificial Sequence
  Description of Artificial Sequence: Synthetic oligonucleotide
ugacguacuuuuuaaaaa

SEQ ID NO: 23028 - RNA, 18 nt, Artificial Sequence
  Description of Artificial Sequence: Synthetic oligonucleotide
ucuaaugacguacuuuuu

SEQ ID NO: 23029 - RNA, 18 nt, Artificial Sequence
  Description of Artificial Sequence: Synthetic oligonucleotide
gguucucuaaugacguac

SEQ ID NO: 23030 - RNA, 18 nt, Artificial Sequence
  Description of Artificial Sequence: Synthetic oligonucleotide
cguuagguucucuaauga

SEQ ID NO: 23031 - RNA, 18 nt, Artificial Sequence
  Description of Artificial Sequence: Synthetic oligonucleotide
uaaaacguuagguucucu

SEQ ID NO: 23032 - RNA, 18 nt, Artificial Sequence
  Description of Artificial Sequence: Synthetic oligonucleotide
gacacuaaaacguuaggu

SEQ ID NO: 23033 - RNA, 18 nt, Artificial Sequence
  Description of Artificial Sequence: Synthetic oligonucleotide
accaagacacuaaaacgu

SEQ ID NO: 23034 - RNA, 18 nt, Artificial Sequence
  Description of Artificial Sequence: Synthetic oligonucleotide
guugcaccaagacacuaa

SEQ ID NO: 23035 - RNA, 18 nt, Artificial Sequence
  Description of Artificial Sequence: Synthetic oligonucleotide
guucaguugcaccaagac

SEQ ID NO: 23036 - RNA, 18 nt, Artificial Sequence
  Description of Artificial Sequence: Synthetic oligonucleotide
ucaacguucaguugcacc

SEQ ID NO: 23037 - RNA, 18 nt, Artificial Sequence
  Description of Artificial Sequence: Synthetic oligonucleotide
gguccucaacguucaguu

SEQ ID NO: 23038 - RNA, 18 nt, Artificial Sequence
  Description of Artificial Sequence: Synthetic oligonucleotide
cucaugguccucaacguu

SEQ ID NO: 23039 - RNA, 18 nt, Artificial Sequence
  Description of Artificial Sequence: Synthetic oligonucleotide
gcugccucaugguccuca

SEQ ID NO: 23040 - RNA, 18 nt, Artificial Sequence
  Description of Artificial Sequence: Synthetic oligonucleotide
uggaagcugccucauggu

SEQ ID NO: 23041 - RNA, 18 nt, Artificial Sequence
  Description of Artificial Sequence: Synthetic oligonucleotide
gcugguggaagcugccuc

SEQ ID NO: 23042 - RNA, 18 nt, Artificial Sequence
  Description of Artificial Sequence: Synthetic oligonucleotide
gucaggcugguggaagcu

SEQ ID NO: 23043 - RNA, 18 nt, Artificial Sequence
  Description of Artificial Sequence: Synthetic oligonucleotide
caccagucaggcuggugg

SEQ ID NO: 23044 - RNA, 18 nt, Artificial Sequence
  Description of Artificial Sequence: Synthetic oligonucleotide
uaagacaccagucaggcu

SEQ ID NO: 23045 - RNA, 18 nt, Artificial Sequence
  Description of Artificial Sequence: Synthetic oligonucleotide
cauacuaagacaccaguc

SEQ ID NO: 23046 - RNA, 18 nt, Artificial Sequence
  Description of Artificial Sequence: Synthetic oligonucleotide
caacucauacuaagacac

SEQ ID NO: 23047 - RNA, 18 nt, Artificial Sequence
  Description of Artificial Sequence: Synthetic oligonucleotide
uucuccaacucauacuaa

SEQ ID NO: 23048 - RNA, 18 nt, Artificial Sequence
  Description of Artificial Sequence: Synthetic oligonucleotide
gcaccuucuccaacucau

SEQ ID NO: 23049 - RNA, 18 nt, Artificial Sequence
  Description of Artificial Sequence: Synthetic oligonucleotide
gggcaccuucuccaacuc

SEQ ID NO: 23050 - RNA, 18 nt, Artificial Sequence
  Description of Artificial Sequence: Synthetic oligonucleotide
agggacccaggagcaggg

SEQ ID NO: 23051 - RNA, 18 nt, Artificial Sequence
  Description of Artificial Sequence: Synthetic oligonucleotide
gcccaagggacccaggag

SEQ ID NO: 23052 - RNA, 18 nt, Artificial Sequence
  Description of Artificial Sequence: Synthetic oligonucleotide
gccuggcccaagggaccc

SEQ ID NO: 23053 - RNA, 18 nt, Artificial Sequence
  Description of Artificial Sequence: Synthetic oligonucleotide
uaggcgccuggcccaagg

SEQ ID NO: 23054 - RNA, 18 nt, Artificial Sequence
  Description of Artificial Sequence: Synthetic oligonucleotide
ggacguaggcgccuggcc

SEQ ID NO: 23055 - RNA, 18 nt, Artificial Sequence
  Description of Artificial Sequence: Synthetic oligonucleotide
ggccuggacguaggcgcc

SEQ ID NO: 23056 - RNA, 18 nt, Artificial Sequence
  Description of Artificial Sequence: Synthetic oligonucleotide
ggcugggccuggacguag

SEQ ID NO: 23057 - RNA, 18 nt, Artificial Sequence
  Description of Artificial Sequence: Synthetic oligonucleotide
augugggcugggccugga

SEQ ID NO: 23058 - RNA, 18 nt, Artificial Sequence
  Description of Artificial Sequence: Synthetic oligonucleotide
caggcaugugggcugggc

SEQ ID NO: 23059 - RNA, 18 nt, Artificial Sequence
  Description of Artificial Sequence: Synthetic oligonucleotide
ccgcacaggcaugugggc

SEQ ID NO: 23060 - RNA, 18 nt, Artificial Sequence
  Description of Artificial Sequence: Synthetic oligonucleotide
gccacccgcacaggcaug

SEQ ID NO: 23061 - RNA, 18 nt, Artificial Sequence
  Description of Artificial Sequence: Synthetic oligonucleotide
cgagggccacccgcacag

SEQ ID NO: 23062 - RNA, 18 nt, Artificial Sequence
  Description of Artificial Sequence: Synthetic oligonucleotide
cauaacgagggccacccg

SEQ ID NO: 23063 - RNA, 18 nt, Artificial Sequence
  Description of Artificial Sequence: Synthetic oligonucleotide
cucuccauaacgagggcc

SEQ ID NO: 23064 - RNA, 18 nt, Artificial Sequence
  Description of Artificial Sequence: Synthetic oligonucleotide
gggcccucuccauaacga

SEQ ID NO: 23065 - RNA, 18 nt, Artificial Sequence
  Description of Artificial Sequence: Synthetic oligonucleotide
cucgugggcccucuccau

SEQ ID NO: 23066 - RNA, 18 nt, Artificial Sequence
  Description of Artificial Sequence: Synthetic oligonucleotide
augugggcugggccugga

SEQ ID NO: 23067 - RNA, 18 nt, Artificial Sequence
  Description of Artificial Sequence: Synthetic oligonucleotide
caggcaugugggcugggc

SEQ ID NO: 23068 - RNA, 18 nt, Artificial Sequence
  Description of Artificial Sequence: Synthetic oligonucleotide
ccgcacaggcaugugggc

SEQ ID NO: 23069 - RNA, 18 nt, Artificial Sequence
  Description of Artificial Sequence: Synthetic oligonucleotide
gccacccgcacaggcaug

SEQ ID NO: 23070 - RNA, 18 nt, Artificial Sequence
  Description of Artificial Sequence: Synthetic oligonucleotide
cgagggccacccgcacag

SEQ ID NO: 23071 - RNA, 18 nt, Artificial Sequence
  Description of Artificial Sequence: Synthetic oligonucleotide
cauaacgagggccacccg

SEQ ID NO: 23072 - RNA, 18 nt, Artificial Sequence
  Description of Artificial Sequence: Synthetic oligonucleotide
cucuccauaacgagggcc

SEQ ID NO: 23073 - RNA, 18 nt, Artificial Sequence
  Description of Artificial Sequence: Synthetic oligonucleotide
gggcccucuccauaacga

SEQ ID NO: 23074 - RNA, 18 nt, Artificial Sequence
  Description of Artificial Sequence: Synthetic oligonucleotide
cucgugggcccucuccau

SEQ ID NO: 23075 - RNA, 18 nt, Artificial Sequence
  Description of Artificial Sequence: Synthetic oligonucleotide
gcugacucgugggcccuc

SEQ ID NO: 23076 - RNA, 18 nt, Artificial Sequence
  Description of Artificial Sequence: Synthetic oligonucleotide
gaucagcugacucguggg

SEQ ID NO: 23077 - RNA, 18 nt, Artificial Sequence
  Description of Artificial Sequence: Synthetic oligonucleotide
agcuugaucagcugacuc

SEQ ID NO: 23078 - RNA, 18 nt, Artificial Sequence
  Description of Artificial Sequence: Synthetic oligonucleotide
ucaugagcuugaucagcu

SEQ ID NO: 23079 - RNA, 18 nt, Artificial Sequence
  Description of Artificial Sequence: Synthetic oligonucleotide
acaagucaugagcuugau

SEQ ID NO: 23080 - RNA, 18 nt, Artificial Sequence
  Description of Artificial Sequence: Synthetic oligonucleotide
aauuuacaagucaugagc

SEQ ID NO: 23081 - RNA, 18 nt, Artificial Sequence
  Description of Artificial Sequence: Synthetic oligonucleotide
ccaacaauuuacaaguca

SEQ ID NO: 23082 - RNA, 18 nt, Artificial Sequence
  Description of Artificial Sequence: Synthetic oligonucleotide
aagccccaacaauuuaca

SEQ ID NO: 23083 - RNA, 18 nt, Artificial Sequence
  Description of Artificial Sequence: Synthetic oligonucleotide
aggccaagccccaacaau

SEQ ID NO: 23084 - RNA, 18 nt, Artificial Sequence
  Description of Artificial Sequence: Synthetic oligonucleotide
cggaaaggccaagcccca

SEQ ID NO: 23085 - RNA, 18 nt, Artificial Sequence
  Description of Artificial Sequence: Synthetic oligonucleotide
caacacggaaaggccaag

SEQ ID NO: 23086 - RNA, 18 nt, Artificial Sequence
  Description of Artificial Sequence: Synthetic oligonucleotide
gguaacaacacggaaagg

SEQ ID NO: 23087 - RNA, 18 nt, Artificial Sequence
  Description of Artificial Sequence: Synthetic oligonucleotide
uuuaagguaacaacacgg

SEQ ID NO: 23088 - RNA, 18 nt, Artificial Sequence
  Description of Artificial Sequence: Synthetic oligonucleotide
aucguuuuaagguaacaa

SEQ ID NO: 23089 - RNA, 18 nt, Artificial Sequence
  Description of Artificial Sequence: Synthetic oligonucleotide
gauguaucguuuuaaggu

SEQ ID NO: 23090 - RNA, 18 nt, Artificial Sequence
  Description of Artificial Sequence: Synthetic oligonucleotide
acguggauguaucguuuu

SEQ ID NO: 23091 - RNA, 18 nt, Artificial Sequence
  Description of Artificial Sequence: Synthetic oligonucleotide
ggagaacguggauguauc

SEQ ID NO: 23092 - RNA, 18 nt, Artificial Sequence
  Description of Artificial Sequence: Synthetic oligonucleotide
gccugggagaacguggau

SEQ ID NO: 23093 - RNA, 18 nt, Artificial Sequence
  Description of Artificial Sequence: Synthetic oligonucleotide
uccaugccugggagaacg

SEQ ID NO: 23094 - RNA, 18 nt, Artificial Sequence
  Description of Artificial Sequence: Synthetic oligonucleotide
ccucauccaugccuggga

SEQ ID NO: 23095 - RNA, 18 nt, Artificial Sequence
  Description of Artificial Sequence: Synthetic oligonucleotide
ggcuaccucauccaugcc

SEQ ID NO: 23096 - RNA, 18 nt, Artificial Sequence
  Description of Artificial Sequence: Synthetic oligonucleotide
aauugggcuaccucaucc

SEQ ID NO: 23097 - RNA, 18 nt, Artificial Sequence
  Description of Artificial Sequence: Synthetic oligonucleotide
uguccaauugggcuaccu

SEQ ID NO: 23098 - RNA, 18 nt, Artificial Sequence
  Description of Artificial Sequence: Synthetic oligonucleotide
ucugcuguccaauugggc

SEQ ID NO: 23099 - RNA, 18 nt, Artificial Sequence
  Description of Artificial Sequence: Synthetic oligonucleotide
cagaaucugcuguccaau

SEQ ID NO: 23100 - RNA, 18 nt, Artificial Sequence
  Description of Artificial Sequence: Synthetic oligonucleotide
cuaugcagaaucugcugu

SEQ ID NO: 23101 - RNA, 18 nt, Artificial Sequence
  Description of Artificial Sequence: Synthetic oligonucleotide
aagugcuaugcagaaucu

SEQ ID NO: 23102 - RNA, 18 nt, Artificial Sequence
  Description of Artificial Sequence: Synthetic oligonucleotide
ggaaaaagugcuaugcag

SEQ ID NO: 23103 - RNA, 18 nt, Artificial Sequence
  Description of Artificial Sequence: Synthetic oligonucleotide
gaacaggaaaaagugcua

SEQ ID NO: 23104 - RNA, 18 nt, Artificial Sequence
  Description of Artificial Sequence: Synthetic oligonucleotide
uucuagaacaggaaaaag

SEQ ID NO: 23105 - RNA, 18 nt, Artificial Sequence
  Description of Artificial Sequence: Synthetic oligonucleotide
guaccuucuagaacagga

SEQ ID NO: 23106 - RNA, 18 nt, Artificial Sequence
  Description of Artificial Sequence: Synthetic oligonucleotide
ugagaguaccuucuagaa

SEQ ID NO: 23107 - RNA, 18 nt, Artificial Sequence
  Description of Artificial Sequence: Synthetic oligonucleotide
gcacuugagaguaccuuc

SEQ ID NO: 23108 - RNA, 18 nt, Artificial Sequence
  Description of Artificial Sequence: Synthetic oligonucleotide
uacaagcacuugagagua

SEQ ID NO: 23109 - RNA, 18 nt, Artificial Sequence
  Description of Artificial Sequence: Synthetic oligonucleotide
ccuauuacaagcacuuga

SEQ ID NO: 23110 - RNA, 18 nt, Artificial Sequence
  Description of Artificial Sequence: Synthetic oligonucleotide
aaaugccuauuacaagca

SEQ ID NO: 23111 - RNA, 18 nt, Artificial Sequence
  Description of Artificial Sequence: Synthetic oligonucleotide
cacugaaaugccuauuac

SEQ ID NO: 23112 - RNA, 18 nt, Artificial Sequence
  Description of Artificial Sequence: Synthetic oligonucleotide
gcugacacugaaaugccu

SEQ ID NO: 23113 - RNA, 18 nt, Artificial Sequence
  Description of Artificial Sequence: Synthetic oligonucleotide
aucuggcugacacugaaa

SEQ ID NO: 23114 - RNA, 18 nt, Artificial Sequence
  Description of Artificial Sequence: Synthetic oligonucleotide
auuugaucuggcugacac

SEQ ID NO: 23115 - RNA, 18 nt, Artificial Sequence
  Description of Artificial Sequence: Synthetic oligonucleotide
cuaacauuugaucuggcu

SEQ ID NO: 23116 - RNA, 18 nt, Artificial Sequence
  Description of Artificial Sequence: Synthetic oligonucleotide
uaauacuaacauuugauc

SEQ ID NO: 23117 - RNA, 18 nt, Artificial Sequence
  Description of Artificial Sequence: Synthetic oligonucleotide
uuuauuaauacuaacauu

SEQ ID NO: 23118 - RNA, 18 nt, Artificial Sequence
  Description of Artificial Sequence: Synthetic oligonucleotide
uccauuuuauuaauacua

SEQ ID NO: 23119 - RNA, 18 nt, Artificial Sequence
  Description of Artificial Sequence: Synthetic oligonucleotide
aacaauccauuuuauuaa

SEQ ID NO: 23120 - RNA, 18 nt, Artificial Sequence
  Description of Artificial Sequence: Synthetic oligonucleotide
cuuaaaacaauccauuuu

SEQ ID NO: 23121 - RNA, 18 nt, Artificial Sequence
  Description of Artificial Sequence: Synthetic oligonucleotide
agaaacuuaaaacaaucc

SEQ ID NO: 23122 - RNA, 18 nt, Artificial Sequence
  Description of Artificial Sequence: Synthetic oligonucleotide
acaauagaaacuuaaaac

SEQ ID NO: 23123 - RNA, 18 nt, Artificial Sequence
  Description of Artificial Sequence: Synthetic oligonucleotide
uugcuacaauagaaacuu

SEQ ID NO: 23124 - RNA, 18 nt, Artificial Sequence
  Description of Artificial Sequence: Synthetic oligonucleotide
ugacuuugcuacaauaga

SEQ ID NO: 23125 - RNA, 18 nt, Artificial Sequence
  Description of Artificial Sequence: Synthetic oligonucleotide
uaguuugacuuugcuaca

SEQ ID NO: 23126 - RNA, 18 nt, Artificial Sequence
  Description of Artificial Sequence: Synthetic oligonucleotide
aagaguaguuugacuuug

SEQ ID NO: 23127 - RNA, 18 nt, Artificial Sequence
  Description of Artificial Sequence: Synthetic oligonucleotide
ccaauaagaguaguuuga

SEQ ID NO: 23128 - RNA, 18 nt, Artificial Sequence
  Description of Artificial Sequence: Synthetic oligonucleotide
agccaccaauaagaguag

SEQ ID NO: 23129 - RNA, 18 nt, Artificial Sequence
  Description of Artificial Sequence: Synthetic oligonucleotide
caauuagccaccaauaag

SEQ ID NO: 23130 - RNA, 18 nt, Artificial Sequence
  Description of Artificial Sequence: Synthetic oligonucleotide
augaccaauuagccacca

SEQ ID NO: 23131 - RNA, 18 nt, Artificial Sequence
  Description of Artificial Sequence: Synthetic oligonucleotide
gggccaugaccaauuagc

SEQ ID NO: 23132 - RNA, 18 nt, Artificial Sequence
  Description of Artificial Sequence: Synthetic oligonucleotide
aauuucucccucaguggg

SEQ ID NO: 23133 - RNA, 18 nt, Artificial Sequence
  Description of Artificial Sequence: Synthetic oligonucleotide
uaauuucucccucagugg

SEQ ID NO: 23134 - RNA, 18 nt, Artificial Sequence
  Description of Artificial Sequence: Synthetic oligonucleotide
ucacuuaauuucucccuc

SEQ ID NO: 23135 - RNA, 18 nt, Artificial Sequence
  Description of Artificial Sequence: Synthetic oligonucleotide
gauagucacuuaauuucu

SEQ ID NO: 23136 - RNA, 18 nt, Artificial Sequence
  Description of Artificial Sequence: Synthetic oligonucleotide
aauuugauagucacuuaa

SEQ ID NO: 23137 - RNA, 18 nt, Artificial Sequence
  Description of Artificial Sequence: Synthetic oligonucleotide
aaggcaauuugauaguca

SEQ ID NO: 23138 - RNA, 18 nt, Artificial Sequence
  Description of Artificial Sequence: Synthetic oligonucleotide
guaagaaggcaauuugau

SEQ ID NO: 23139 - RNA, 18 nt, Artificial Sequence
  Description of Artificial Sequence: Synthetic oligonucleotide
gacuaguaagaaggcaau

SEQ ID NO: 23140 - RNA, 18 nt, Artificial Sequence
  Description of Artificial Sequence: Synthetic oligonucleotide
acgcagacuaguaagaag

SEQ ID NO: 23141 - RNA, 18 nt, Artificial Sequence
  Description of Artificial Sequence: Synthetic oligonucleotide
cucuaacgcagacuagua

SEQ ID NO: 23142 - RNA, 18 nt, Artificial Sequence
  Description of Artificial Sequence: Synthetic oligonucleotide
ccccucucuaacgcagac

SEQ ID NO: 23143 - RNA, 18 nt, Artificial Sequence
  Description of Artificial Sequence: Synthetic oligonucleotide
acuguccccucucuaacg

SEQ ID NO: 23144 - RNA, 18 nt, Artificial Sequence
  Description of Artificial Sequence: Synthetic oligonucleotide
aacgcacuguccccucuc

SEQ ID NO: 23145 - RNA, 18 nt, Artificial Sequence
  Description of Artificial Sequence: Synthetic oligonucleotide
agagaaacgcacuguccc

SEQ ID NO: 23146 - RNA, 18 nt, Artificial Sequence
  Description of Artificial Sequence: Synthetic oligonucleotide
uugggagagaaacgcacu

SEQ ID NO: 23147 - RNA, 18 nt, Artificial Sequence
  Description of Artificial Sequence: Synthetic oligonucleotide
aucguuugggagagaaac

SEQ ID NO: 23148 - RNA, 18 nt, Artificial Sequence
  Description of Artificial Sequence: Synthetic oligonucleotide
cugcaaucguuugggaga

SEQ ID NO: 23149 - RNA, 18 nt, Artificial Sequence
  Description of Artificial Sequence: Synthetic oligonucleotide
ugcucuuugcauuauagg

SEQ ID NO: 23150 - RNA, 18 nt, Artificial Sequence
  Description of Artificial Sequence: Synthetic oligonucleotide
gcuuuugcucuuugcauu

SEQ ID NO: 23151 - RNA, 18 nt, Artificial Sequence
  Description of Artificial Sequence: Synthetic oligonucleotide
ucaaagcuuuugcucuuu

SEQ ID NO: 23152 - RNA, 18 nt, Artificial Sequence
  Description of Artificial Sequence: Synthetic oligonucleotide
gaucuucaaagcuuuugc

SEQ ID NO: 23153 - RNA, 18 nt, Artificial Sequence
  Description of Artificial Sequence: Synthetic oligonucleotide
gggaggaucuucaaagcu

SEQ ID NO: 23154 - RNA, 18 nt, Artificial Sequence
  Description of Artificial Sequence: Synthetic oligonucleotide
ugguugggaggaucuuca

SEQ ID NO: 23155 - RNA, 18 nt, Artificial Sequence
  Description of Artificial Sequence: Synthetic oligonucleotide
gggcaugguugggaggau

SEQ ID NO: 23156 - RNA, 18 nt, Artificial Sequence
  Description of Artificial Sequence: Synthetic oligonucleotide
gcuacgggcaugguuggg

SEQ ID NO: 23157 - RNA, 18 nt, Artificial Sequence
  Description of Artificial Sequence: Synthetic oligonucleotide
ccagggcuacgggcaugg

SEQ ID NO: 23158 - RNA, 18 nt, Artificial Sequence
  Description of Artificial Sequence: Synthetic oligonucleotide
uguuuccagggcuacggg

SEQ ID NO: 23159 - RNA, 18 nt, Artificial Sequence
  Description of Artificial Sequence: Synthetic oligonucleotide
cccuuuguuuccagggcu

SEQ ID NO: 23160 - RNA, 18 nt, Artificial Sequence
  Description of Artificial Sequence: Synthetic oligonucleotide
cccuucccuuuguuucca

SEQ ID NO: 23161 - RNA, 18 nt, Artificial Sequence
  Description of Artificial Sequence: Synthetic oligonucleotide
ccuugcccuucccuuugu

SEQ ID NO: 23162 - RNA, 18 nt, Artificial Sequence
  Description of Artificial Sequence: Synthetic oligonucleotide
uuuucccuugcccuuccc

SEQ ID NO: 23163 - RNA, 18 nt, Artificial Sequence
  Description of Artificial Sequence: Synthetic oligonucleotide
gccauuuuuuucuccguu

SEQ ID NO: 23164 - RNA, 18 nt, Artificial Sequence
  Description of Artificial Sequence: Synthetic oligonucleotide
cgcgagccauuuuuuucu

SEQ ID NO: 23165 - RNA, 18 nt, Artificial Sequence
  Description of Artificial Sequence: Synthetic oligonucleotide
uuuggcgcgagccauuuu

SEQ ID NO: 23166 - RNA, 18 nt, Artificial Sequence
  Description of Artificial Sequence: Synthetic oligonucleotide
acuguuuuggcgcgagcc

SEQ ID NO: 23167 - RNA, 18 nt, Artificial Sequence
  Description of Artificial Sequence: Synthetic oligonucleotide
ucaugacuguuuuggcgc

SEQ ID NO: 23168 - RNA, 18 nt, Artificial Sequence
  Description of Artificial Sequence: Synthetic oligonucleotide
ggaguucaugacuguuuu

SEQ ID NO: 23169 - RNA, 18 nt, Artificial Sequence
  Description of Artificial Sequence: Synthetic oligonucleotide
cuuuauucccggcagaug

SEQ ID NO: 23170 - RNA, 18 nt, Artificial Sequence
  Description of Artificial Sequence: Synthetic oligonucleotide
accggcuuuauucccggc

SEQ ID NO: 23171 - RNA, 18 nt, Artificial Sequence
  Description of Artificial Sequence: Synthetic oligonucleotide
ccgccaccggcuuuauuc

SEQ ID NO: 23172 - RNA, 18 nt, Artificial Sequence
  Description of Artificial Sequence: Synthetic oligonucleotide
gagcgccgccaccggcuu

SEQ ID NO: 23173 - RNA, 18 nt, Artificial Sequence
  Description of Artificial Sequence: Synthetic oligonucleotide
cucgugagcgccgccacc

SEQ ID NO: 23174 - RNA, 18 nt, Artificial Sequence
  Description of Artificial Sequence: Synthetic oligonucleotide
gccgccucgugagcgccg

SEQ ID NO: 23175 - RNA, 18 nt, Artificial Sequence
  Description of Artificial Sequence: Synthetic oligonucleotide
ucccagccgccucgugag

SEQ ID NO: 23176 - RNA, 18 nt, Artificial Sequence
  Description of Artificial Sequence: Synthetic oligonucleotide
gcagcucccagccgccuc

SEQ ID NO: 23177 - RNA, 18 nt, Artificial Sequence
  Description of Artificial Sequence: Synthetic oligonucleotide
agagagcagcucccagcc

SEQ ID NO: 23178 - RNA, 18 nt, Artificial Sequence
  Description of Artificial Sequence: Synthetic oligonucleotide
cacucagagagcagcucc

SEQ ID NO: 23179 - RNA, 18 nt, Artificial Sequence
  Description of Artificial Sequence: Synthetic oligonucleotide
gauggcacucagagagca

SEQ ID NO: 23180 - RNA, 18 nt, Artificial Sequence
  Description of Artificial Sequence: Synthetic oligonucleotide
cagaugauggcacucaga

SEQ ID NO: 23181 - RNA, 18 nt, Artificial Sequence
  Description of Artificial Sequence: Synthetic oligonucleotide
cgccgccaccggcuuuau

SEQ ID NO: 23182 - RNA, 18 nt, Artificial Sequence
  Description of Artificial Sequence: Synthetic oligonucleotide
gugagcgccgccaccggc

SEQ ID NO: 23183 - RNA, 18 nt, Artificial Sequence
  Description of Artificial Sequence: Synthetic oligonucleotide
gccucgugagcgccgcca

SEQ ID NO: 23184 - RNA, 18 nt, Artificial Sequence
  Description of Artificial Sequence: Synthetic oligonucleotide
cagccgccucgugagcgc

SEQ ID NO: 23185 - RNA, 18 nt, Artificial Sequence
  Description of Artificial Sequence: Synthetic oligonucleotide
gcucccagccgccucgug

SEQ ID NO: 23186 - RNA, 18 nt, Artificial Sequence
  Description of Artificial Sequence: Synthetic oligonucleotide
gagcagcucccagccgcc

SEQ ID NO: 23187 - RNA, 18 nt, Artificial Sequence
  Description of Artificial Sequence: Synthetic oligonucleotide
ucagagagcagcucccag

SEQ ID NO: 23188 - RNA, 18 nt, Artificial Sequence
  Description of Artificial Sequence: Synthetic oligonucleotide
ggcacucagagagcagcu

SEQ ID NO: 23189 - RNA, 18 nt, Artificial Sequence
  Description of Artificial Sequence: Synthetic oligonucleotide
augauggcacucagagag

SEQ ID NO: 23190 - RNA, 18 nt, Artificial Sequence
  Description of Artificial Sequence: Synthetic oligonucleotide
cacagaugauggcacuca

SEQ ID NO: 23191 - RNA, 18 nt, Artificial Sequence
  Description of Artificial Sequence: Synthetic oligonucleotide
ugcacuugggaggguggg

SEQ ID NO: 23192 - RNA, 18 nt, Artificial Sequence
  Description of Artificial Sequence: Synthetic oligonucleotide
cugaaugcacuugggagg

SEQ ID NO: 23193 - RNA, 18 nt, Artificial Sequence
  Description of Artificial Sequence: Synthetic oligonucleotide
ccgcacugaaugcacuug

SEQ ID NO: 23194 - RNA, 18 nt, Artificial Sequence
  Description of Artificial Sequence: Synthetic oligonucleotide
acugcccgcacugaaugc

SEQ ID NO: 23195 - RNA, 18 nt, Artificial Sequence
  Description of Artificial Sequence: Synthetic oligonucleotide
cagguacugcccgcacug

SEQ ID NO: 23196 - RNA, 18 nt, Artificial Sequence
  Description of Artificial Sequence: Synthetic oligonucleotide
ucguccagguacugcccg

SEQ ID NO: 23197 - RNA, 18 nt, Artificial Sequence
  Description of Artificial Sequence: Synthetic oligonucleotide
cagggucguccagguacu

SEQ ID NO: 23198 - RNA, 18 nt, Artificial Sequence
  Description of Artificial Sequence: Synthetic oligonucleotide
gaggucagggucguccag

SEQ ID NO: 23199 - RNA, 18 nt, Artificial Sequence
  Description of Artificial Sequence: Synthetic oligonucleotide
uauuugaggucagggucg

SEQ ID NO: 23200 - RNA, 18 nt, Artificial Sequence
  Description of Artificial Sequence: Synthetic oligonucleotide
gcccauauuugaggucag

SEQ ID NO: 23201 - RNA, 18 nt, Artificial Sequence
  Description of Artificial Sequence: Synthetic oligonucleotide
gugcugcccauauuugag

SEQ ID NO: 23202 - RNA, 18 nt, Artificial Sequence
  Description of Artificial Sequence: Synthetic oligonucleotide
ggugggugcugcccauau

SEQ ID NO: 23203 - RNA, 18 nt, Artificial Sequence
  Description of Artificial Sequence: Synthetic oligonucleotide
cgucuggugggugcugcc

SEQ ID NO: 23204 - RNA, 18 nt, Artificial Sequence
  Description of Artificial Sequence: Synthetic oligonucleotide
gucuucugccuugggcuu

SEQ ID NO: 23205 - RNA, 18 nt, Artificial Sequence
  Description of Artificial Sequence: Synthetic oligonucleotide
gauaggucuucugccuug

SEQ ID NO: 23206 - RNA, 18 nt, Artificial Sequence
  Description of Artificial Sequence: Synthetic oligonucleotide
augcagauaggucuucug

SEQ ID NO: 23207 - RNA, 18 nt, Artificial Sequence
  Description of Artificial Sequence: Synthetic oligonucleotide
cucaaaugcagauagguc

SEQ ID NO: 23208 - RNA, 18 nt, Artificial Sequence
  Description of Artificial Sequence: Synthetic oligonucleotide
gagggcucaaaugcagau

SEQ ID NO: 23209 - RNA, 18 nt, Artificial Sequence
  Description of Artificial Sequence: Synthetic oligonucleotide
gagaguaccugggaacaa

SEQ ID NO: 23210 - RNA, 18 nt, Artificial Sequence
  Description of Artificial Sequence: Synthetic oligonucleotide
acauagagaguaccuggg

SEQ ID NO: 23211 - RNA, 18 nt, Artificial Sequence
  Description of Artificial Sequence: Synthetic oligonucleotide
ucaccacauagagaguac

SEQ ID NO: 23212 - RNA, 18 nt, Artificial Sequence
  Description of Artificial Sequence: Synthetic oligonucleotide
caccaucaccacauagag

SEQ ID NO: 23213 - RNA, 18 nt, Artificial Sequence
  Description of Artificial Sequence: Synthetic oligonucleotide
ggcagcaccaucaccaca

SEQ ID NO: 23214 - RNA, 18 nt, Artificial Sequence
  Description of Artificial Sequence: Synthetic oligonucleotide
cagagggcagcaccauca

SEQ ID NO: 23215 - RNA, 18 nt, Artificial Sequence
  Description of Artificial Sequence: Synthetic oligonucleotide
uaucacagagggcagcac

SEQ ID NO: 23216 - RNA, 18 nt, Artificial Sequence
  Description of Artificial Sequence: Synthetic oligonucleotide
guuaguaucacagagggc

SEQ ID NO: 23217 - RNA, 18 nt, Artificial Sequence
  Description of Artificial Sequence: Synthetic oligonucleotide
cacggguuaguaucacag

SEQ ID NO: 23218 - RNA, 18 nt, Artificial Sequence
  Description of Artificial Sequence: Synthetic oligonucleotide
ucaugcacggguuaguau

SEQ ID NO: 23219 - RNA, 18 nt, Artificial Sequence
  Description of Artificial Sequence: Synthetic oligonucleotide
caagcucaugcacggguu

SEQ ID NO: 23220 - RNA, 18 nt, Artificial Sequence
  Description of Artificial Sequence: Synthetic oligonucleotide
acaggcaagcucaugcac

SEQ ID NO: 23221 - RNA, 18 nt, Artificial Sequence
  Description of Artificial Sequence: Synthetic oligonucleotide
cagagacaggcaagcuca

SEQ ID NO: 23222 - RNA, 18 nt, Artificial Sequence
  Description of Artificial Sequence: Synthetic oligonucleotide
gaggacagagacaggcaa

SEQ ID NO: 23223 - RNA, 18 nt, Artificial Sequence
  Description of Artificial Sequence: Synthetic oligonucleotide
ggcccgaggacagagaca

SEQ ID NO: 23224 - RNA, 18 nt, Artificial Sequence
  Description of Artificial Sequence: Synthetic oligonucleotide
aguguggcccgaggacag

SEQ ID NO: 23225 - RNA, 18 nt, Artificial Sequence
  Description of Artificial Sequence: Synthetic oligonucleotide
ggcucaguguggcccgag

SEQ ID NO: 23226 - RNA, 18 nt, Artificial Sequence
  Description of Artificial Sequence: Synthetic oligonucleotide
guaagggcucaguguggc

SEQ ID NO: 23227 - RNA, 18 nt, Artificial Sequence
  Description of Artificial Sequence: Synthetic oligonucleotide
cccucguaagggcucagu

SEQ ID NO: 23228 - RNA, 18 nt, Artificial Sequence
  Description of Artificial Sequence: Synthetic oligonucleotide
accugcccucguaagggc

SEQ ID NO: 23229 - RNA, 18 nt, Artificial Sequence
  Description of Artificial Sequence: Synthetic oligonucleotide
gcaccaccugcccucgua

SEQ ID NO: 23230 - RNA, 18 nt, Artificial Sequence
  Description of Artificial Sequence: Synthetic oligonucleotide
cccaggcaccaccugccc

SEQ ID NO: 23231 - RNA, 18 nt, Artificial Sequence
  Description of Artificial Sequence: Synthetic oligonucleotide
caguacccaggcaccacc

SEQ ID NO: 23232 - RNA, 18 nt, Artificial Sequence
  Description of Artificial Sequence: Synthetic oligonucleotide
gcggccaguacccaggca

SEQ ID NO: 23233 - RNA, 18 nt, Artificial Sequence
  Description of Artificial Sequence: Synthetic oligonucleotide
augcugcggccaguaccc

SEQ ID NO: 23234 - RNA, 18 nt, Artificial Sequence
  Description of Artificial Sequence: Synthetic oligonucleotide
aaagcaugcugcggccag

SEQ ID NO: 23235 - RNA, 18 nt, Artificial Sequence
  Description of Artificial Sequence: Synthetic oligonucleotide
gacucaaagcaugcugcg

SEQ ID NO: 23236 - RNA, 18 nt, Artificial Sequence
  Description of Artificial Sequence: Synthetic oligonucleotide
uuuuagacucaaagcaug

SEQ ID NO: 23237 - RNA, 18 nt, Artificial Sequence
  Description of Artificial Sequence: Synthetic oligonucleotide
ccuacuuuuagacucaaa

SEQ ID NO: 23238 - RNA, 18 nt, Artificial Sequence
  Description of Artificial Sequence: Synthetic oligonucleotide
gggugccuacuuuuagac

SEQ ID NO: 23239 - RNA, 18 nt, Artificial Sequence
  Description of Artificial Sequence: Synthetic oligonucleotide
agggugggugccuacuuu

SEQ ID NO: 23240 - RNA, 18 nt, Artificial Sequence
  Description of Artificial Sequence: Synthetic oligonucleotide
uucacagggugggugccu

SEQ ID NO: 23241 - RNA, 18 nt, Artificial Sequence
  Description of Artificial Sequence: Synthetic oligonucleotide
cuggcuucacaggguggg

SEQ ID NO: 23242 - RNA, 18 nt, Artificial Sequence
  Description of Artificial Sequence: Synthetic oligonucleotide
cuggucuggcuucacagg

SEQ ID NO: 23243 - RNA, 18 nt, Artificial Sequence
  Description of Artificial Sequence: Synthetic oligonucleotide
ggaggcuggucuggcuuc

SEQ ID NO: 23244 - RNA, 18 nt, Artificial Sequence
  Description of Artificial Sequence: Synthetic oligonucleotide
gcccuggaggcuggucug

SEQ ID NO: 23245 - RNA, 18 nt, Artificial Sequence
  Description of Artificial Sequence: Synthetic oligonucleotide
gggcccuggaggcugguc

SEQ ID NO: 23246 - RNA, 18 nt, Artificial Sequence
  Description of Artificial Sequence: Synthetic oligonucleotide
acgaggcagucuucuggg

SEQ ID NO: 23247 - RNA, 18 nt, Artificial Sequence
  Description of Artificial Sequence: Synthetic oligonucleotide
ucggaacgaggcagucuu

SEQ ID NO: 23248 - RNA, 18 nt, Artificial Sequence
  Description of Artificial Sequence: Synthetic oligonucleotide
gcucuucggaacgaggca

SEQ ID NO: 23249 - RNA, 18 nt, Artificial Sequence
  Description of Artificial Sequence: Synthetic oligonucleotide
gacaugcucuucggaacg

SEQ ID NO: 23250 - RNA, 18 nt, Artificial Sequence
  Description of Artificial Sequence: Synthetic oligonucleotide
cccaugacaugcucuucg

SEQ ID NO: 23251 - RNA, 18 nt, Artificial Sequence
  Description of Artificial Sequence: Synthetic oligonucleotide
acagccccaugacaugcu

SEQ ID NO: 23252 - RNA, 18 nt, Artificial Sequence
  Description of Artificial Sequence: Synthetic oligonucleotide
guccuacagccccaugac

SEQ ID NO: 23253 - RNA, 18 nt, Artificial Sequence
  Description of Artificial Sequence: Synthetic oligonucleotide
ggcugguccuacagcccc

SEQ ID NO: 23254 - RNA, 18 nt, Artificial Sequence
  Description of Artificial Sequence: Synthetic oligonucleotide
agaauggcugguccuaca

SEQ ID NO: 23255 - RNA, 18 nt, Artificial Sequence
  Description of Artificial Sequence: Synthetic oligonucleotide
ugggaagaauggcugguc

SEQ ID NO: 23256 - RNA, 18 nt, Artificial Sequence
  Description of Artificial Sequence: Synthetic oligonucleotide
cgagaugggaagaauggc

SEQ ID NO: 23257 - RNA, 18 nt, Artificial Sequence
  Description of Artificial Sequence: Synthetic oligonucleotide
ugacccgagaugggaaga

SEQ ID NO: 23258 - RNA, 18 nt, Artificial Sequence
  Description of Artificial Sequence: Synthetic oligonucleotide
aacaaugacccgagaugg

SEQ ID NO: 23259 - RNA, 18 nt, Artificial Sequence
  Description of Artificial Sequence: Synthetic oligonucleotide
agcccaacaaugacccga

SEQ ID NO: 23260 - RNA, 18 nt, Artificial Sequence
  Description of Artificial Sequence: Synthetic oligonucleotide
uccccagcccaacaauga

SEQ ID NO: 23261 - RNA, 18 nt, Artificial Sequence
  Description of Artificial Sequence: Synthetic oligonucleotide
aaccuuccccagcccaac

SEQ ID NO: 23262 - RNA, 18 nt, Artificial Sequence
  Description of Artificial Sequence: Synthetic oligonucleotide
gccauaaccuuccccagc

SEQ ID NO: 23263 - RNA, 18 nt, Artificial Sequence
  Description of Artificial Sequence: Synthetic oligonucleotide
aagaagccauaaccuucc

SEQ ID NO: 23264 - RNA, 18 nt, Artificial Sequence
  Description of Artificial Sequence: Synthetic oligonucleotide
uggacaagaagccauaac

SEQ ID NO: 23265 - RNA, 18 nt, Artificial Sequence
  Description of Artificial Sequence: Synthetic oligonucleotide
cugacuggacaagaagcc

SEQ ID NO: 23266 - RNA, 18 nt, Artificial Sequence
  Description of Artificial Sequence: Synthetic oligonucleotide
cacaccugacuggacaag

SEQ ID NO: 23267 - RNA, 18 nt, Artificial Sequence
  Description of Artificial Sequence: Synthetic oligonucleotide
uuagacacaccugacugg

SEQ ID NO: 23268 - RNA, 18 nt, Artificial Sequence
  Description of Artificial Sequence: Synthetic oligonucleotide
gacuuuuagacacaccug

SEQ ID NO: 23269 - RNA, 18 nt, Artificial Sequence
  Description of Artificial Sequence: Synthetic oligonucleotide
caaaggacuuuuagacac

SEQ ID NO: 23270 - RNA, 18 nt, Artificial Sequence
  Description of Artificial Sequence: Synthetic oligonucleotide
caagacaaaggacuuuua

SEQ ID NO: 23271 - RNA, 18 nt, Artificial Sequence
  Description of Artificial Sequence: Synthetic oligonucleotide
gccaccaagacaaaggac

SEQ ID NO: 23272 - RNA, 18 nt, Artificial Sequence
  Description of Artificial Sequence: Synthetic oligonucleotide
aguaugccaccaagacaa

SEQ ID NO: 23273 - RNA, 18 nt, Artificial Sequence
  Description of Artificial Sequence: Synthetic oligonucleotide
cuaggaguaugccaccaa

SEQ ID NO: 23274 - RNA, 18 nt, Artificial Sequence
  Description of Artificial Sequence: Synthetic oligonucleotide
ccaugcuaggaguaugcc

SEQ ID NO: 23275 - RNA, 18 nt, Artificial Sequence
  Description of Artificial Sequence: Synthetic oligonucleotide
cauuuccaugcuaggagu

SEQ ID NO: 23276 - RNA, 18 nt, Artificial Sequence
  Description of Artificial Sequence: Synthetic oligonucleotide
gaccccauuuccaugcua

SEQ ID NO: 23277 - RNA, 18 nt, Artificial Sequence
  Description of Artificial Sequence: Synthetic oligonucleotide
agauugaccccauuucca

SEQ ID NO: 23278 - RNA, 18 nt, Artificial Sequence
  Description of Artificial Sequence: Synthetic oligonucleotide
ugcccagauugaccccau

SEQ ID NO: 23279 - RNA, 18 nt, Artificial Sequence
  Description of Artificial Sequence: Synthetic oligonucleotide
caaagugcccagauugac

SEQ ID NO: 23280 - RNA, 18 nt, Artificial Sequence
  Description of Artificial Sequence: Synthetic oligonucleotide
gucuccaaagugcccaga

SEQ ID NO: 23281 - RNA, 18 nt, Artificial Sequence
  Description of Artificial Sequence: Synthetic oligonucleotide
caccagucuccaaagugc

SEQ ID NO: 23282 - RNA, 18 nt, Artificial Sequence
  Description of Artificial Sequence: Synthetic oligonucleotide
aaacacaccagucuccaa

SEQ ID NO: 23283 - RNA, 18 nt, Artificial Sequence
  Description of Artificial Sequence: Synthetic oligonucleotide
gaguuaaacacaccaguc

SEQ ID NO: 23284 - RNA, 18 nt, Artificial Sequence
  Description of Artificial Sequence: Synthetic oligonucleotide
aucuugaguuaaacacac

SEQ ID NO: 23285 - RNA, 18 nt, Artificial Sequence
  Description of Artificial Sequence: Synthetic oligonucleotide
ucuugaucuugaguuaaa

SEQ ID NO: 23286 - RNA, 18 nt, Artificial Sequence
  Description of Artificial Sequence: Synthetic oligonucleotide
aaaggucuugaucuugag

SEQ ID NO: 23287 - RNA, 18 nt, Artificial Sequence
  Description of Artificial Sequence: Synthetic oligonucleotide
gcauaaaaggucuugauc

SEQ ID NO: 23288 - RNA, 18 nt, Artificial Sequence
  Description of Artificial Sequence: Synthetic oligonucleotide
ucaacgcauaaaaggucu

SEQ ID NO: 23289 - RNA, 18 nt, Artificial Sequence
  Description of Artificial Sequence: Synthetic oligonucleotide
ggcugucaacgcauaaaa

SEQ ID NO: 23290 - RNA, 18 nt, Artificial Sequence
  Description of Artificial Sequence: Synthetic oligonucleotide
ugagaggcugucaacgca

SEQ ID NO: 23291 - RNA, 18 nt, Artificial Sequence
  Description of Artificial Sequence: Synthetic oligonucleotide
ggucuugagaggcuguca

SEQ ID NO: 23292 - RNA, 18 nt, Artificial Sequence
  Description of Artificial Sequence: Synthetic oligonucleotide
ccaugggucuugagaggc

SEQ ID NO: 23293 - RNA, 18 nt, Artificial Sequence
  Description of Artificial Sequence: Synthetic oligonucleotide
ugugaccaugggucuuga

SEQ ID NO: 23294 - RNA, 18 nt, Artificial Sequence
  Description of Artificial Sequence: Synthetic oligonucleotide
ccaggugugaccaugggu

SEQ ID NO: 23295 - RNA, 18 nt, Artificial Sequence
  Description of Artificial Sequence: Synthetic oligonucleotide
agcugccaggugugacca

SEQ ID NO: 23296 - RNA, 18 nt, Artificial Sequence
  Description of Artificial Sequence: Synthetic oligonucleotide
ccagaagcugccaggugu

SEQ ID NO: 23297 - RNA, 18 nt, Artificial Sequence
  Description of Artificial Sequence: Synthetic oligonucleotide
cacuaccagaagcugcca

SEQ ID NO: 23298 - RNA, 18 nt, Artificial Sequence
  Description of Artificial Sequence: Synthetic oligonucleotide
ugccccacuaccagaagc

SEQ ID NO: 23299 - RNA, 18 nt, Artificial Sequence
  Description of Artificial Sequence: Synthetic oligonucleotide
ccuuuugccccacuacca

SEQ ID NO: 23300 - RNA, 18 nt, Artificial Sequence
  Description of Artificial Sequence: Synthetic oligonucleotide
gcaacccuuuugccccac

SEQ ID NO: 23301 - RNA, 18 nt, Artificial Sequence
  Description of Artificial Sequence: Synthetic oligonucleotide
cacaagcaacccuuuugc

SEQ ID NO: 23302 - RNA, 18 nt, Artificial Sequence
  Description of Artificial Sequence: Synthetic oligonucleotide
gccagcacaagcaacccu

SEQ ID NO: 23303 - RNA, 18 nt, Artificial Sequence
  Description of Artificial Sequence: Synthetic oligonucleotide
aaugagccagcacaagca

SEQ ID NO: 23304 - RNA, 18 nt, Artificial Sequence
  Description of Artificial Sequence: Synthetic oligonucleotide
aggaaaaugagccagcac

SEQ ID NO: 23305 - RNA, 18 nt, Artificial Sequence
  Description of Artificial Sequence: Synthetic oligonucleotide
ucuaaaggaaaaugagcc

SEQ ID NO: 23306 - RNA, 18 nt, Artificial Sequence
  Description of Artificial Sequence: Synthetic oligonucleotide
aaagcucuaaaggaaaau

SEQ ID NO: 23307 - RNA, 18 nt, Artificial Sequence
  Description of Artificial Sequence: Synthetic oligonucleotide
uuaccccuucuacuccug

SEQ ID NO: 23308 - RNA, 18 nt, Artificial Sequence
  Description of Artificial Sequence: Synthetic oligonucleotide
agaguuuaccccuucuac

SEQ ID NO: 23309 - RNA, 18 nt, Artificial Sequence
  Description of Artificial Sequence: Synthetic oligonucleotide
gaggaagaguuuaccccu

SEQ ID NO: 23310 - RNA, 18 nt, Artificial Sequence
  Description of Artificial Sequence: Synthetic oligonucleotide
cagaugaggaagaguuua

SEQ ID NO: 23311 - RNA, 18 nt, Artificial Sequence
  Description of Artificial Sequence: Synthetic oligonucleotide
uguggcagaugaggaaga

SEQ ID NO: 23312 - RNA, 18 nt, Artificial Sequence
  Description of Artificial Sequence: Synthetic oligonucleotide
aggccuguggcagaugag

SEQ ID NO: 23313 - RNA, 18 nt, Artificial Sequence
  Description of Artificial Sequence: Synthetic oligonucleotide
aaggcaggccuguggcag

SEQ ID NO: 23314 - RNA, 18 nt, Artificial Sequence
  Description of Artificial Sequence: Synthetic oligonucleotide
gaggcaaggcaggccugu

SEQ ID NO: 23315 - RNA, 18 nt, Artificial Sequence
  Description of Artificial Sequence: Synthetic oligonucleotide
ggccugaggcaaggcagg

SEQ ID NO: 23316 - RNA, 18 nt, Artificial Sequence
  Description of Artificial Sequence: Synthetic oligonucleotide
gacguggccugaggcaag

SEQ ID NO: 23317 - RNA, 18 nt, Artificial Sequence
  Description of Artificial Sequence: Synthetic oligonucleotide
aaggugacguggccugag

SEQ ID NO: 23318 - RNA, 18 nt, Artificial Sequence
  Description of Artificial Sequence: Synthetic oligonucleotide
ccuggcaacauggcuggg

SEQ ID NO: 23319 - RNA, 18 nt, Artificial Sequence
  Description of Artificial Sequence: Synthetic oligonucleotide
caugcccuggcaacaugg

SEQ ID NO: 23320 - RNA, 18 nt, Artificial Sequence
  Description of Artificial Sequence: Synthetic oligonucleotide
guccucaugcccuggcaa

SEQ ID NO: 23321 - RNA, 18 nt, Artificial Sequence
  Description of Artificial Sequence: Synthetic oligonucleotide
ucuuaguccucaugcccu

SEQ ID NO: 23322 - RNA, 18 nt, Artificial Sequence
  Description of Artificial Sequence: Synthetic oligonucleotide
aagcaucuuaguccucau

SEQ ID NO: 23323 - RNA, 18 nt, Artificial Sequence
  Description of Artificial Sequence: Synthetic oligonucleotide
agggcaagcaucuuaguc

SEQ ID NO: 23324 - RNA, 18 nt, Artificial Sequence
  Description of Artificial Sequence: Synthetic oligonucleotide
uuggcagggcaagcaucu

SEQ ID NO: 23325 - RNA, 18 nt, Artificial Sequence
  Description of Artificial Sequence: Synthetic oligonucleotide
cgggcuuggcagggcaag

SEQ ID NO: 23326 - RNA, 18 nt, Artificial Sequence
  Description of Artificial Sequence: Synthetic oligonucleotide
cccuccgggcuuggcagg

SEQ ID NO: 23327 - RNA, 18 nt, Artificial Sequence
  Description of Artificial Sequence: Synthetic oligonucleotide
ucauccccuccgggcuug

SEQ ID NO: 23328 - RNA, 18 nt, Artificial Sequence
  Description of Artificial Sequence: Synthetic oligonucleotide
gcugcucauccccuccgg

SEQ ID NO: 23329 - RNA, 18 nt, Artificial Sequence
  Description of Artificial Sequence: Synthetic oligonucleotide
cugaggcugcucaucccc

SEQ ID NO: 23330 - RNA, 18 nt, Artificial Sequence
  Description of Artificial Sequence: Synthetic oligonucleotide
accagcugaggcugcuca

SEQ ID NO: 23331 - RNA, 18 nt, Artificial Sequence
  Description of Artificial Sequence: Synthetic oligonucleotide
gcggcaccagcugaggcu

SEQ ID NO: 23332 - RNA, 18 nt, Artificial Sequence
  Description of Artificial Sequence: Synthetic oligonucleotide
cuguggcggcaccagcug

SEQ ID NO: 23333 - RNA, 18 nt, Artificial Sequence
  Description of Artificial Sequence: Synthetic oligonucleotide
gcugucuguggcggcacc

SEQ ID NO: 23334 - RNA, 18 nt, Artificial Sequence
  Description of Artificial Sequence: Synthetic oligonucleotide
ggugugcugucuguggcg

SEQ ID NO: 23335 - RNA, 18 nt, Artificial Sequence
  Description of Artificial Sequence: Synthetic oligonucleotide
ucuguggugugcugucug

SEQ ID NO: 23336 - RNA, 18 nt, Artificial Sequence
  Description of Artificial Sequence: Synthetic oligonucleotide
ccaccucuguggugugcu

SEQ ID NO: 23337 - RNA, 18 nt, Artificial Sequence
  Description of Artificial Sequence: Synthetic oligonucleotide
cugagccaccucuguggu

SEQ ID NO: 23338 - RNA, 18 nt, Artificial Sequence
  Description of Artificial Sequence: Synthetic oligonucleotide
ggucccugagccaccucu

SEQ ID NO: 23339 - RNA, 18 nt, Artificial Sequence
  Description of Artificial Sequence: Synthetic oligonucleotide
accaaggucccugagcca

SEQ ID NO: 23340 - RNA, 18 nt, Artificial Sequence
  Description of Artificial Sequence: Synthetic oligonucleotide
caucuaccaaggucccug

SEQ ID NO: 23341 - RNA, 18 nt, Artificial Sequence
  Description of Artificial Sequence: Synthetic oligonucleotide
auucccaucuaccaaggu

SEQ ID NO: 23342 - RNA, 18 nt, Artificial Sequence
  Description of Artificial Sequence: Synthetic oligonucleotide
cucacauucccaucuacc

SEQ ID NO: 23343 - RNA, 18 nt, Artificial Sequence
  Description of Artificial Sequence: Synthetic oligonucleotide
agauucucacauucccau

SEQ ID NO: 23344 - RNA, 18 nt, Artificial Sequence
  Description of Artificial Sequence: Synthetic oligonucleotide
uuaauagauucucacauu

SEQ ID NO: 23345 - RNA, 18 nt, Artificial Sequence
  Description of Artificial Sequence: Synthetic oligonucleotide
cuauuuuaauagauucuc

SEQ ID NO: 23346 - RNA, 18 nt, Artificial Sequence
  Description of Artificial Sequence: Synthetic oligonucleotide
ccugccuauuuuaauaga

SEQ ID NO: 23347 - RNA, 18 nt, Artificial Sequence
  Description of Artificial Sequence: Synthetic oligonucleotide
agaucccugccuauuuua

SEQ ID NO: 23348 - RNA, 18 nt, Artificial Sequence
  Description of Artificial Sequence: Synthetic oligonucleotide
accggagaucccugccua

SEQ ID NO: 23349 - RNA, 18 nt, Artificial Sequence
  Description of Artificial Sequence: Synthetic oligonucleotide
agaggaccggagaucccu

SEQ ID NO: 23350 - RNA, 18 nt, Artificial Sequence
  Description of Artificial Sequence: Synthetic oligonucleotide
uugacagaggaccggaga

SEQ ID NO: 23351 - RNA, 18 nt, Artificial Sequence
  Description of Artificial Sequence: Synthetic oligonucleotide
gccucuugacagaggacc

SEQ ID NO: 23352 - RNA, 18 nt, Artificial Sequence
  Description of Artificial Sequence: Synthetic oligonucleotide
gcauugccucuugacaga

SEQ ID NO: 23353 - RNA, 18 nt, Artificial Sequence
  Description of Artificial Sequence: Synthetic oligonucleotide
cgucagcauugccucuug

SEQ ID NO: 23354 - RNA, 18 nt, Artificial Sequence
  Description of Artificial Sequence: Synthetic oligonucleotide
aaagccgucagcauugcc

SEQ ID NO: 23355 - RNA, 18 nt, Artificial Sequence
  Description of Artificial Sequence: Synthetic oligonucleotide
aggaaaaagccgucagca

SEQ ID NO: 23356 - RNA, 18 nt, Artificial Sequence
  Description of Artificial Sequence: Synthetic oligonucleotide
ccagcaggaaaaagccgu

SEQ ID NO: 23357 - RNA, 18 nt, Artificial Sequence
  Description of Artificial Sequence: Synthetic oligonucleotide
gcacgccagcaggaaaaa

SEQ ID NO: 23358 - RNA, 18 nt, Artificial Sequence
  Description of Artificial Sequence: Synthetic oligonucleotide
cagaggcacgccagcagg

SEQ ID NO: 23359 - RNA, 18 nt, Artificial Sequence
  Description of Artificial Sequence: Synthetic oligonucleotide
gugggcagaggcacgcca

SEQ ID NO: 23360 - RNA, 18 nt, Artificial Sequence
  Description of Artificial Sequence: Synthetic oligonucleotide
ggcuggugggcagaggca

SEQ ID NO: 23361 - RNA, 18 nt, Artificial Sequence
  Description of Artificial Sequence: Synthetic oligonucleotide
gggaaggcuggugggcag

SEQ ID NO: 23362 - RNA, 18 nt, Artificial Sequence
  Description of Artificial Sequence: Synthetic oligonucleotide
aaugaggaugugcaaggg

SEQ ID NO: 23363 - RNA, 18 nt, Artificial Sequence
  Description of Artificial Sequence: Synthetic oligonucleotide
acaaaugaggaugugcaa

SEQ ID NO: 23364 - RNA, 18 nt, Artificial Sequence
  Description of Artificial Sequence: Synthetic oligonucleotide
aggugacaaaugaggaug

SEQ ID NO: 23365 - RNA, 18 nt, Artificial Sequence
  Description of Artificial Sequence: Synthetic oligonucleotide
uuaggaggugacaaauga

SEQ ID NO: 23366 - RNA, 18 nt, Artificial Sequence
  Description of Artificial Sequence: Synthetic oligonucleotide
ucaaauuaggaggugaca

SEQ ID NO: 23367 - RNA, 18 nt, Artificial Sequence
  Description of Artificial Sequence: Synthetic oligonucleotide
auaauucaaauuaggagg

SEQ ID NO: 23368 - RNA, 18 nt, Artificial Sequence
  Description of Artificial Sequence: Synthetic oligonucleotide
gcccaauaauucaaauua

SEQ ID NO: 23369 - RNA, 18 nt, Artificial Sequence
  Description of Artificial Sequence: Synthetic oligonucleotide
gauuugcccaauaauuca

SEQ ID NO: 23370 - RNA, 18 nt, Artificial Sequence
  Description of Artificial Sequence: Synthetic oligonucleotide
ggccagauuugcccaaua

SEQ ID NO: 23371 - RNA, 18 nt, Artificial Sequence
  Description of Artificial Sequence: Synthetic oligonucleotide
uaagcggccagauuugcc

SEQ ID NO: 23372 - RNA, 18 nt, Artificial Sequence
  Description of Artificial Sequence: Synthetic oligonucleotide
ccaaauaagcggccagau

SEQ ID NO: 23373 - RNA, 18 nt, Artificial Sequence
  Description of Artificial Sequence: Synthetic oligonucleotide
cagucccaaauaagcggc

SEQ ID NO: 23374 - RNA, 18 nt, Artificial Sequence
  Description of Artificial Sequence: Synthetic oligonucleotide
gcugucagucccaaauaa

SEQ ID NO: 23375 - RNA, 18 nt, Artificial Sequence
  Description of Artificial Sequence: Synthetic oligonucleotide
aguuggcugucaguccca

SEQ ID NO: 23376 - RNA, 18 nt, Artificial Sequence
  Description of Artificial Sequence: Synthetic oligonucleotide
caagaaguuggcugucag

SEQ ID NO: 23377 - RNA, 18 nt, Artificial Sequence
  Description of Artificial Sequence: Synthetic oligonucleotide
augcucaagaaguuggcu

SEQ ID NO: 23378 - RNA, 18 nt, Artificial Sequence
  Description of Artificial Sequence: Synthetic oligonucleotide
aauagaugcucaagaagu

SEQ ID NO: 23379 - RNA, 18 nt, Artificial Sequence
  Description of Artificial Sequence: Synthetic oligonucleotide
guucaaauagaugcucaa

SEQ ID NO: 23380 - RNA, 18 nt, Artificial Sequence
  Description of Artificial Sequence: Synthetic oligonucleotide
aggcuguucaaauagaug

SEQ ID NO: 23381 - RNA, 18 nt, Artificial Sequence
  Description of Artificial Sequence: Synthetic oligonucleotide
agggaaggcuguucaaau

SEQ ID NO: 23382 - RNA, 18 nt, Artificial Sequence
  Description of Artificial Sequence: Synthetic oligonucleotide
gcgaaagggaaggcuguu

SEQ ID NO: 23383 - RNA, 18 nt, Artificial Sequence
  Description of Artificial Sequence: Synthetic oligonucleotide
ugggagcgaaagggaagg

SEQ ID NO: 23384 - RNA, 18 nt, Artificial Sequence
  Description of Artificial Sequence: Synthetic oligonucleotide
guggcugggagcgaaagg

SEQ ID NO: 23385 - RNA, 18 nt, Artificial Sequence
  Description of Artificial Sequence: Synthetic oligonucleotide
caaagguggcugggagcg

SEQ ID NO: 23386 - RNA, 18 nt, Artificial Sequence
  Description of Artificial Sequence: Synthetic oligonucleotide
caccucaaagguggcugg

SEQ ID NO: 23387 - RNA, 18 nt, Artificial Sequence
  Description of Artificial Sequence: Synthetic oligonucleotide
ggacucaccucaaaggug

SEQ ID NO: 23388 - RNA, 18 nt, Artificial Sequence
  Description of Artificial Sequence: Synthetic oligonucleotide
cacuuggacucaccucaa

SEQ ID NO: 23389 - RNA, 18 nt, Artificial Sequence
  Description of Artificial Sequence: Synthetic oligonucleotide
ccugccacuuggacucac

SEQ ID NO: 23390 - RNA, 18 nt, Artificial Sequence
  Description of Artificial Sequence: Synthetic oligonucleotide
ccuguccugccacuugga

SEQ ID NO: 23391 - RNA, 18 nt, Artificial Sequence
  Description of Artificial Sequence: Synthetic oligonucleotide
aggguccuguccugccac

SEQ ID NO: 23392 - RNA, 18 nt, Artificial Sequence
  Description of Artificial Sequence: Synthetic oligonucleotide
cacacaggguccuguccu

SEQ ID NO: 23393 - RNA, 18 nt, Artificial Sequence
  Description of Artificial Sequence: Synthetic oligonucleotide
ucugucacacaggguccu

SEQ ID NO: 23394 - RNA, 18 nt, Artificial Sequence
  Description of Artificial Sequence: Synthetic oligonucleotide
uccgcucugucacacagg

SEQ ID NO: 23395 - RNA, 18 nt, Artificial Sequence
  Description of Artificial Sequence: Synthetic oligonucleotide
agaccuccgcucugucac

SEQ ID NO: 23396 - RNA, 18 nt, Artificial Sequence
  Description of Artificial Sequence: Synthetic oligonucleotide
gcacaagaccuccgcucu

SEQ ID NO: 23397 - RNA, 18 nt, Artificial Sequence
  Description of Artificial Sequence: Synthetic oligonucleotide
agagggcacaagaccucc

SEQ ID NO: 23398 - RNA, 18 nt, Artificial Sequence
  Description of Artificial Sequence: Synthetic oligonucleotide
agcugagagggcacaaga

SEQ ID NO: 23399 - RNA, 18 nt, Artificial Sequence
  Description of Artificial Sequence: Synthetic oligonucleotide
gaagaagcugagagggca

SEQ ID NO: 23400 - RNA, 18 nt, Artificial Sequence
  Description of Artificial Sequence: Synthetic oligonucleotide
uggcgcucugcaagguga

SEQ ID NO: 23401 - RNA, 18 nt, Artificial Sequence
  Description of Artificial Sequence: Synthetic oligonucleotide
ggacuuggcgcucugcaa

SEQ ID NO: 23402 - RNA, 18 nt, Artificial Sequence
  Description of Artificial Sequence: Synthetic oligonucleotide
acucgggacuuggcgcuc

SEQ ID NO: 23403 - RNA, 18 nt, Artificial Sequence
  Description of Artificial Sequence: Synthetic oligonucleotide
aggccacucgggacuugg

SEQ ID NO: 23404 - RNA, 18 nt, Artificial Sequence
  Description of Artificial Sequence: Synthetic oligonucleotide
aaagaaggccacucggga

SEQ ID NO: 23405 - RNA, 18 nt, Artificial Sequence
  Description of Artificial Sequence: Synthetic oligonucleotide
ucuucaaagaaggccacu

SEQ ID NO: 23406 - RNA, 18 nt, Artificial Sequence
  Description of Artificial Sequence: Synthetic oligonucleotide
agagcucuucaaagaagg

SEQ ID NO: 23407 - RNA, 18 nt, Artificial Sequence
  Description of Artificial Sequence: Synthetic oligonucleotide
cugcuagagcucuucaaa

SEQ ID NO: 23408 - RNA, 18 nt, Artificial Sequence
  Description of Artificial Sequence: Synthetic oligonucleotide
gucaccugcuagagcucu

SEQ ID NO: 23409 - RNA, 18 nt, Artificial Sequence
  Description of Artificial Sequence: Synthetic oligonucleotide
gcugggucaccugcuaga

SEQ ID NO: 23410 - RNA, 18 nt, Artificial Sequence
  Description of Artificial Sequence: Synthetic oligonucleotide
ggguggcugggucaccug

SEQ ID NO: 23411 - RNA, 18 nt, Artificial Sequence
  Description of Artificial Sequence: Synthetic oligonucleotide
aggagaaguggcaggucc

SEQ ID NO: 23412 - RNA, 18 nt, Artificial Sequence
  Description of Artificial Sequence: Synthetic oligonucleotide
guagcaggagaaguggca

SEQ ID NO: 23413 - RNA, 18 nt, Artificial Sequence
  Description of Artificial Sequence: Synthetic oligonucleotide
ucccgguagcaggagaag

SEQ ID NO: 23414 - RNA, 18 nt, Artificial Sequence
  Description of Artificial Sequence: Synthetic oligonucleotide
cgcggucccgguagcagg

SEQ ID NO: 23415 - RNA, 18 nt, Artificial Sequence
  Description of Artificial Sequence: Synthetic oligonucleotide
caucccgcggucccggua

SEQ ID NO: 23416 - RNA, 18 nt, Artificial Sequence
  Description of Artificial Sequence: Synthetic oligonucleotide
ugguccaucccgcggucc

SEQ ID NO: 23417 - RNA, 18 nt, Artificial Sequence
  Description of Artificial Sequence: Synthetic oligonucleotide
auaucugguccaucccgc

SEQ ID NO: 23418 - RNA, 18 nt, Artificial Sequence
  Description of Artificial Sequence: Synthetic oligonucleotide
ucuugauaucugguccau

SEQ ID NO: 23419 - RNA, 18 nt, Artificial Sequence
  Description of Artificial Sequence: Synthetic oligonucleotide
ggcucucuugauaucugg

SEQ ID NO: 23420 - RNA, 18 nt, Artificial Sequence
  Description of Artificial Sequence: Synthetic oligonucleotide
uggauggcucucuugaua

SEQ ID NO: 23421 - RNA, 18 nt, Artificial Sequence
  Description of Artificial Sequence: Synthetic oligonucleotide
cccuauggauggcucucu

SEQ ID NO: 23422 - RNA, 18 nt, Artificial Sequence
  Description of Artificial Sequence: Synthetic oligonucleotide
cagcucccuauggauggc

SEQ ID NO: 23423 - RNA, 18 nt, Artificial Sequence
  Description of Artificial Sequence: Synthetic oligonucleotide
ccagccagcucccuaugg

SEQ ID NO: 23424 - RNA, 18 nt, Artificial Sequence
  Description of Artificial Sequence: Synthetic oligonucleotide
aacccccagccagcuccc

SEQ ID NO: 23425 - RNA, 18 nt, Artificial Sequence
  Description of Artificial Sequence: Synthetic oligonucleotide
acggaaacccccagccag

SEQ ID NO: 23426 - RNA, 18 nt, Artificial Sequence
  Description of Artificial Sequence: Synthetic oligonucleotide
cucccacggaaaccccca

SEQ ID NO: 23427 - RNA, 18 nt, Artificial Sequence
  Description of Artificial Sequence: Synthetic oligonucleotide
uggagcucccacggaaac

SEQ ID NO: 23428 - RNA, 18 nt, Artificial Sequence
  Description of Artificial Sequence: Synthetic oligonucleotide
aguucuggagcucccacg

SEQ ID NO: 23429 - RNA, 18 nt, Artificial Sequence
  Description of Artificial Sequence: Synthetic oligonucleotide
gggaaaguucuggagcuc

SEQ ID NO: 23430 - RNA, 18 nt, Artificial Sequence
  Description of Artificial Sequence: Synthetic oligonucleotide
cugggcucuucacucagc

SEQ ID NO: 23431 - RNA, 18 nt, Artificial Sequence
  Description of Artificial Sequence: Synthetic oligonucleotide
gggcugggcucuucacuc

SEQ ID NO: 23432 - RNA, 18 nt, Artificial Sequence
  Description of Artificial Sequence: Synthetic oligonucleotide
caauugcacauaagaggg

SEQ ID NO: 23433 - RNA, 18 nt, Artificial Sequence
  Description of Artificial Sequence: Synthetic oligonucleotide
caaggcaauugcacauaa

SEQ ID NO: 23434 - RNA, 18 nt, Artificial Sequence
  Description of Artificial Sequence: Synthetic oligonucleotide
uaguucaaggcaauugca

SEQ ID NO: 23435 - RNA, 18 nt, Artificial Sequence
  Description of Artificial Sequence: Synthetic oligonucleotide
ggucguaguucaaggcaa

SEQ ID NO: 23436 - RNA, 18 nt, Artificial Sequence
  Description of Artificial Sequence: Synthetic oligonucleotide
uacagggucguaguucaa

SEQ ID NO: 23437 - RNA, 18 nt, Artificial Sequence
  Description of Artificial Sequence: Synthetic oligonucleotide
aucucuacagggucguag

SEQ ID NO: 23438 - RNA, 18 nt, Artificial Sequence
  Description of Artificial Sequence: Synthetic oligonucleotide
gagaaaucucuacagggu

SEQ ID NO: 23439 - RNA, 18 nt, Artificial Sequence
  Description of Artificial Sequence: Synthetic oligonucleotide
caugagagaaaucucuac

SEQ ID NO: 23440 - RNA, 18 nt, Artificial Sequence
  Description of Artificial Sequence: Synthetic oligonucleotide
aacgccaugagagaaauc

SEQ ID NO: 23441 - RNA, 18 nt, Artificial Sequence
  Description of Artificial Sequence: Synthetic oligonucleotide
acuagaacgccaugagag

SEQ ID NO: 23442 - RNA, 18 nt, Artificial Sequence
  Description of Artificial Sequence: Synthetic oligonucleotide
agagaacuagaacgccau

SEQ ID NO: 23443 - RNA, 18 nt, Artificial Sequence
  Description of Artificial Sequence: Synthetic oligonucleotide
aggucagagaacuagaac

SEQ ID NO: 23444 - RNA, 18 nt, Artificial Sequence
  Description of Artificial Sequence: Synthetic oligonucleotide
gacucaggucagagaacu

SEQ ID NO: 23445 - RNA, 18 nt, Artificial Sequence
  Description of Artificial Sequence: Synthetic oligonucleotide
acaaagacucaggucaga

SEQ ID NO: 23446 - RNA, 18 nt, Artificial Sequence
  Description of Artificial Sequence: Synthetic oligonucleotide
uuaaaacaaagacucagg

SEQ ID NO: 23447 - RNA, 18 nt, Artificial Sequence
  Description of Artificial Sequence: Synthetic oligonucleotide
acuucuuaaaacaaagac

SEQ ID NO: 23448 - RNA, 18 nt, Artificial Sequence
  Description of Artificial Sequence: Synthetic oligonucleotide
caaauacuucuuaaaaca

SEQ ID NO: 23449 - RNA, 18 nt, Artificial Sequence
  Description of Artificial Sequence: Synthetic oligonucleotide
gaagacaaauacuucuua

SEQ ID NO: 23450 - RNA, 18 nt, Artificial Sequence
  Description of Artificial Sequence: Synthetic oligonucleotide
caaaggaagacaaauacu

SEQ ID NO: 23451 - RNA, 18 nt, Artificial Sequence
  Description of Artificial Sequence: Synthetic oligonucleotide
uuagacaaaggaagacaa

SEQ ID NO: 23452 - RNA, 18 nt, Artificial Sequence
  Description of Artificial Sequence: Synthetic oligonucleotide
ccacauuagacaaaggaa

SEQ ID NO: 23453 - RNA, 18 nt, Artificial Sequence
  Description of Artificial Sequence: Synthetic oligonucleotide
gaaucccacauuagacaa

SEQ ID NO: 23454 - RNA, 18 nt, Artificial Sequence
  Description of Artificial Sequence: Synthetic oligonucleotide
gucaggaaucccacauua

SEQ ID NO: 23455 - RNA, 18 nt, Artificial Sequence
  Description of Artificial Sequence: Synthetic oligonucleotide
agggagucaggaauccca

SEQ ID NO: 23456 - RNA, 18 nt, Artificial Sequence
  Description of Artificial Sequence: Synthetic oligonucleotide
gacgaagggagucaggaa

SEQ ID NO: 23457 - RNA, 18 nt, Artificial Sequence
  Description of Artificial Sequence: Synthetic oligonucleotide
ccuuggacgaagggaguc

SEQ ID NO: 23458 - RNA, 18 nt, Artificial Sequence
  Description of Artificial Sequence: Synthetic oligonucleotide
cggugccuuggacgaagg

SEQ ID NO: 23459 - RNA, 18 nt, Artificial Sequence
  Description of Artificial Sequence: Synthetic oligonucleotide
cacaccggugccuuggac

SEQ ID NO: 23460 - RNA, 18 nt, Artificial Sequence
  Description of Artificial Sequence: Synthetic oligonucleotide
acacacacaccggugccu

SEQ ID NO: 23461 - RNA, 18 nt, Artificial Sequence
  Description of Artificial Sequence: Synthetic oligonucleotide
aagacacacacacaccgg

SEQ ID NO: 23462 - RNA, 18 nt, Artificial Sequence
  Description of Artificial Sequence: Synthetic oligonucleotide
agugcaagacacacacac

SEQ ID NO: 23463 - RNA, 18 nt, Artificial Sequence
  Description of Artificial Sequence: Synthetic oligonucleotide
ucuggagugcaagacaca

SEQ ID NO: 23464 - RNA, 18 nt, Artificial Sequence
  Description of Artificial Sequence: Synthetic oligonucleotide
ucagcucuggagugcaag

SEQ ID NO: 23465 - RNA, 18 nt, Artificial Sequence
  Description of Artificial Sequence: Synthetic oligonucleotide
ggaggucagcucuggagu

SEQ ID NO: 23466 - RNA, 18 nt, Artificial Sequence
  Description of Artificial Sequence: Synthetic oligonucleotide
gcgguggaggucagcucu

SEQ ID NO: 23467 - RNA, 18 nt, Artificial Sequence
  Description of Artificial Sequence: Synthetic oligonucleotide
gcugggcgguggagguca

SEQ ID NO: 23468 - RNA, 18 nt, Artificial Sequence
  Description of Artificial Sequence: Synthetic oligonucleotide
cccaggcugggcggugga

SEQ ID NO: 23469 - RNA, 18 nt, Artificial Sequence
  Description of Artificial Sequence: Synthetic oligonucleotide
gacuucccaggcugggcg

SEQ ID NO: 23470 - RNA, 18 nt, Artificial Sequence
  Description of Artificial Sequence: Synthetic oligonucleotide
acaaugacuucccaggcu

SEQ ID NO: 23471 - RNA, 18 nt, Artificial Sequence
  Description of Artificial Sequence: Synthetic oligonucleotide
ucccuacaaugacuuccc

SEQ ID NO: 23472 - RNA, 18 nt, Artificial Sequence
  Description of Artificial Sequence: Synthetic oligonucleotide
cucacucccuacaaugac

SEQ ID NO: 23473 - RNA, 18 nt, Artificial Sequence
  Description of Artificial Sequence: Synthetic oligonucleotide
agugucucacucccuaca

SEQ ID NO: 23474 - RNA, 18 nt, Artificial Sequence
  Description of Artificial Sequence: Synthetic oligonucleotide
gcuucagugucucacucc

SEQ ID NO: 23475 - RNA, 18 nt, Artificial Sequence
  Description of Artificial Sequence: Synthetic oligonucleotide
ucagggcuucagugucuc

SEQ ID NO: 23476 - RNA, 18 nt, Artificial Sequence
  Description of Artificial Sequence: Synthetic oligonucleotide
gcuucucagggcuucagu

SEQ ID NO: 23477 - RNA, 18 nt, Artificial Sequence
  Description of Artificial Sequence: Synthetic oligonucleotide
cacuggcuucucagggcu

SEQ ID NO: 23478 - RNA, 18 nt, Artificial Sequence
  Description of Artificial Sequence: Synthetic oligonucleotide
gauggcacuggcuucuca

SEQ ID NO: 23479 - RNA, 18 nt, Artificial Sequence
  Description of Artificial Sequence: Synthetic oligonucleotide
gggaugauggcacuggcu

SEQ ID NO: 23480 - RNA, 18 nt, Artificial Sequence
  Description of Artificial Sequence: Synthetic oligonucleotide
auguuccggaacccuggg

SEQ ID NO: 23481 - RNA, 18 nt, Artificial Sequence
  Description of Artificial Sequence: Synthetic oligonucleotide
aaugaauguuccggaacc

SEQ ID NO: 23482 - RNA, 18 nt, Artificial Sequence
  Description of Artificial Sequence: Synthetic oligonucleotide
gggaaugaauguuccgga

SEQ ID NO: 23483 - RNA, 18 nt, Artificial Sequence
  Description of Artificial Sequence: Synthetic oligonucleotide
cagguccucaccgguggg

SEQ ID NO: 23484 - RNA, 18 nt, Artificial Sequence
  Description of Artificial Sequence: Synthetic oligonucleotide
caugccagguccucaccg

SEQ ID NO: 23485 - RNA, 18 nt, Artificial Sequence
  Description of Artificial Sequence: Synthetic oligonucleotide
cgcugcaugccagguccu

SEQ ID NO: 23486 - RNA, 18 nt, Artificial Sequence
  Description of Artificial Sequence: Synthetic oligonucleotide
ugcuucgcugcaugccag

SEQ ID NO: 23487 - RNA, 18 nt, Artificial Sequence
  Description of Artificial Sequence: Synthetic oligonucleotide
ugggcugcuucgcugcau

SEQ ID NO: 23488 - RNA, 18 nt, Artificial Sequence
  Description of Artificial Sequence: Synthetic oligonucleotide
cgggcugggcugcuucgc

SEQ ID NO: 23489 - RNA, 18 nt, Artificial Sequence
  Description of Artificial Sequence: Synthetic oligonucleotide
uccgccgggcugggcugc

SEQ ID NO: 23490 - RNA, 18 nt, Artificial Sequence
  Description of Artificial Sequence: Synthetic oligonucleotide
ugggauccgccgggcugg

SEQ ID NO: 23491 - RNA, 18 nt, Artificial Sequence
  Description of Artificial Sequence: Synthetic oligonucleotide
uggccugggauccgccgg

SEQ ID NO: 23492 - RNA, 18 nt, Artificial Sequence
  Description of Artificial Sequence: Synthetic oligonucleotide
cgugcuggccugggaucc

SEQ ID NO: 23493 - RNA, 18 nt, Artificial Sequence
  Description of Artificial Sequence: Synthetic oligonucleotide
gcaggcgugcuggccugg

SEQ ID NO: 23494 - RNA, 18 nt, Artificial Sequence
  Description of Artificial Sequence: Synthetic oligonucleotide
agccggcaggcgugcugg

SEQ ID NO: 23495 - RNA, 18 nt, Artificial Sequence
  Description of Artificial Sequence: Synthetic oligonucleotide
ugagaagccggcaggcgu

SEQ ID NO: 23496 - RNA, 18 nt, Artificial Sequence
  Description of Artificial Sequence: Synthetic oligonucleotide
gacgaugagaagccggca

SEQ ID NO: 23497 - RNA, 18 nt, Artificial Sequence
  Description of Artificial Sequence: Synthetic oligonucleotide
ucccugacgaugagaagc

SEQ ID NO: 23498 - RNA, 18 nt, Artificial Sequence
  Description of Artificial Sequence: Synthetic oligonucleotide
cgggcucccugacgauga

SEQ ID NO: 23499 - RNA, 18 nt, Artificial Sequence
  Description of Artificial Sequence: Synthetic oligonucleotide
cugggcgggcucccugac

SEQ ID NO: 23500 - RNA, 18 nt, Artificial Sequence
  Description of Artificial Sequence: Synthetic oligonucleotide
gagcucugggcgggcucc

SEQ ID NO: 23501 - RNA, 18 nt, Artificial Sequence
  Description of Artificial Sequence: Synthetic oligonucleotide
gucacgagcucugggcgg

SEQ ID NO: 23502 - RNA, 18 nt, Artificial Sequence
  Description of Artificial Sequence: Synthetic oligonucleotide
ugcucgucacgagcucug

SEQ ID NO: 23503 - RNA, 18 nt, Artificial Sequence
  Description of Artificial Sequence: Synthetic oligonucleotide
gcacuugcucgucacgag

SEQ ID NO: 23504 - RNA, 18 nt, Artificial Sequence
  Description of Artificial Sequence: Synthetic oligonucleotide
acccagcacuugcucguc

SEQ ID NO: 23505 - RNA, 18 nt, Artificial Sequence
  Description of Artificial Sequence: Synthetic oligonucleotide
gggacccagcacuugcuc

SEQ ID NO: 23506 - RNA, 18 nt, Artificial Sequence
  Description of Artificial Sequence: Synthetic oligonucleotide
ccagagcgccgccucggg

SEQ ID NO: 23507 - RNA, 18 nt, Artificial Sequence
  Description of Artificial Sequence: Synthetic oligonucleotide
gccagccagagcgccgcc

SEQ ID NO: 23508 - RNA, 18 nt, Artificial Sequence
  Description of Artificial Sequence: Synthetic oligonucleotide
cagcugccagccagagcg

SEQ ID NO: 23509 - RNA, 18 nt, Artificial Sequence
  Description of Artificial Sequence: Synthetic oligonucleotide
cccaccagcugccagcca

SEQ ID NO: 23510 - RNA, 18 nt, Artificial Sequence
  Description of Artificial Sequence: Synthetic oligonucleotide
uauuccccaccagcugcc

SEQ ID NO: 23511 - RNA, 18 nt, Artificial Sequence
  Description of Artificial Sequence: Synthetic oligonucleotide
cugccuauuccccaccag

SEQ ID NO: 23512 - RNA, 18 nt, Artificial Sequence
  Description of Artificial Sequence: Synthetic oligonucleotide
cugcccugccuauucccc

SEQ ID NO: 23513 - RNA, 18 nt, Artificial Sequence
  Description of Artificial Sequence: Synthetic oligonucleotide
cacagcugcccugccuau

SEQ ID NO: 23514 - RNA, 18 nt, Artificial Sequence
  Description of Artificial Sequence: Synthetic oligonucleotide
ccagccacagcugcccug

SEQ ID NO: 23515 - RNA, 18 nt, Artificial Sequence
  Description of Artificial Sequence: Synthetic oligonucleotide
ucuccccagccacagcug

SEQ ID NO: 23516 - RNA, 18 nt, Artificial Sequence
  Description of Artificial Sequence: Synthetic oligonucleotide
aagucucuccccagccac

SEQ ID NO: 23517 - RNA, 18 nt, Artificial Sequence
  Description of Artificial Sequence: Synthetic oligonucleotide
gccuaaagucucucccca

SEQ ID NO: 23518 - RNA, 18 nt, Artificial Sequence
  Description of Artificial Sequence: Synthetic oligonucleotide
cuucugccuaaagucucu

SEQ ID NO: 23519 - RNA, 18 nt, Artificial Sequence
  Description of Artificial Sequence: Synthetic oligonucleotide
cacagcuucugccuaaag

SEQ ID NO: 23520 - RNA, 18 nt, Artificial Sequence
  Description of Artificial Sequence: Synthetic oligonucleotide
ugcaucacagcuucugcc

SEQ ID NO: 23521 - RNA, 18 nt, Artificial Sequence
  Description of Artificial Sequence: Synthetic oligonucleotide
cagccugcaucacagcuu

SEQ ID NO: 23522 - RNA, 18 nt, Artificial Sequence
  Description of Artificial Sequence: Synthetic oligonucleotide
gcagucagccugcaucac

SEQ ID NO: 23523 - RNA, 18 nt, Artificial Sequence
  Description of Artificial Sequence: Synthetic oligonucleotide
ggcuggcagucagccugc

SEQ ID NO: 23524 - RNA, 18 nt, Artificial Sequence
  Description of Artificial Sequence: Synthetic oligonucleotide
cccucggcuggcagucag

SEQ ID NO: 23525 - RNA, 18 nt, Artificial Sequence
  Description of Artificial Sequence: Synthetic oligonucleotide
ccagccccucggcuggca

SEQ ID NO: 23526 - RNA, 18 nt, Artificial Sequence
  Description of Artificial Sequence: Synthetic oligonucleotide
acuacccagccccucggc

SEQ ID NO: 23527 - RNA, 18 nt, Artificial Sequence
  Description of Artificial Sequence: Synthetic oligonucleotide
acggcacuacccagcccc

SEQ ID NO: 23528 - RNA, 18 nt, Artificial Sequence
  Description of Artificial Sequence: Synthetic oligonucleotide
cccgcacggcacuaccca

SEQ ID NO: 23529 - RNA, 18 nt, Artificial Sequence
  Description of Artificial Sequence: Synthetic oligonucleotide
cagcucccgcacggcacu

SEQ ID NO: 23530 - RNA, 18 nt, Artificial Sequence
  Description of Artificial Sequence: Synthetic oligonucleotide
accaucagcucccgcacg

SEQ ID NO: 23531 - RNA, 18 nt, Artificial Sequence
  Description of Artificial Sequence: Synthetic oligonucleotide
ccuguaccaucagcuccc

SEQ ID NO: 23532 - RNA, 18 nt, Artificial Sequence
  Description of Artificial Sequence: Synthetic oligonucleotide
agugcccuguaccaucag

SEQ ID NO: 23533 - RNA, 18 nt, Artificial Sequence
  Description of Artificial Sequence: Synthetic oligonucleotide
cagcgagugcccuguacc

SEQ ID NO: 23534 - RNA, 18 nt, Artificial Sequence
  Description of Artificial Sequence: Synthetic oligonucleotide
gggacagcgagugcccug

SEQ ID NO: 23535 - RNA, 18 nt, Artificial Sequence
  Description of Artificial Sequence: Synthetic oligonucleotide
ucuaggguggccggaggg

SEQ ID NO: 23536 - RNA, 18 nt, Artificial Sequence
  Description of Artificial Sequence: Synthetic oligonucleotide
ccuggucuaggguggccg

SEQ ID NO: 23537 - RNA, 18 nt, Artificial Sequence
  Description of Artificial Sequence: Synthetic oligonucleotide
cggacccuggucuagggu

SEQ ID NO: 23538 - RNA, 18 nt, Artificial Sequence
  Description of Artificial Sequence: Synthetic oligonucleotide
ccucucggacccuggucu

SEQ ID NO: 23539 - RNA, 18 nt, Artificial Sequence
  Description of Artificial Sequence: Synthetic oligonucleotide
gccugccucucggacccu

SEQ ID NO: 23540 - RNA, 18 nt, Artificial Sequence
  Description of Artificial Sequence: Synthetic oligonucleotide
cuccugccugccucucgg

SEQ ID NO: 23541 - RNA, 18 nt, Artificial Sequence
  Description of Artificial Sequence: Synthetic oligonucleotide
aguggcuccugccugccu

SEQ ID NO: 23542 - RNA, 18 nt, Artificial Sequence
  Description of Artificial Sequence: Synthetic oligonucleotide
acaugaguggcuccugcc

SEQ ID NO: 23543 - RNA, 18 nt, Artificial Sequence
  Description of Artificial Sequence: Synthetic oligonucleotide
ggaagacaugaguggcuc

SEQ ID NO: 23544 - RNA, 18 nt, Artificial Sequence
  Description of Artificial Sequence: Synthetic oligonucleotide
gggaagacaugaguggcu

SEQ ID NO: 23545 - RNA, 18 nt, Artificial Sequence
  Description of Artificial Sequence: Synthetic oligonucleotide
ugggcgucgggcaauggg

SEQ ID NO: 23546 - RNA, 18 nt, Artificial Sequence
  Description of Artificial Sequence: Synthetic oligonucleotide
gucuaugggcgucgggca

SEQ ID NO: 23547 - RNA, 18 nt, Artificial Sequence
  Description of Artificial Sequence: Synthetic oligonucleotide
ggagcgucuaugggcguc

SEQ ID NO: 23548 - RNA, 18 nt, Artificial Sequence
  Description of Artificial Sequence: Synthetic oligonucleotide
aggaaggagcgucuaugg

SEQ ID NO: 23549 - RNA, 18 nt, Artificial Sequence
  Description of Artificial Sequence: Synthetic oligonucleotide
cacacaggaaggagcguc

SEQ ID NO: 23550 - RNA, 18 nt, Artificial Sequence
  Description of Artificial Sequence: Synthetic oligonucleotide
agccccacacaggaagga

SEQ ID NO: 23551 - RNA, 18 nt, Artificial Sequence
  Description of Artificial Sequence: Synthetic oligonucleotide
accccagccccacacagg

SEQ ID NO: 23552 - RNA, 18 nt, Artificial Sequence
  Description of Artificial Sequence: Synthetic oligonucleotide
ggaguaccccagccccac

SEQ ID NO: 23553 - RNA, 18 nt, Artificial Sequence
  Description of Artificial Sequence: Synthetic oligonucleotide
accagggaguaccccagc

SEQ ID NO: 23554 - RNA, 18 nt, Artificial Sequence
  Description of Artificial Sequence: Synthetic oligonucleotide
guacgaccagggaguacc

SEQ ID NO: 23555 - RNA, 18 nt, Artificial Sequence
  Description of Artificial Sequence: Synthetic oligonucleotide
cugcaguacgaccaggga

SEQ ID NO: 23556 - RNA, 18 nt, Artificial Sequence
  Description of Artificial Sequence: Synthetic oligonucleotide
gcugacugcaguacgacc

SEQ ID NO: 23557 - RNA, 18 nt, Artificial Sequence
  Description of Artificial Sequence: Synthetic oligonucleotide
cgggugcugacugcagua

SEQ ID NO: 23558 - RNA, 18 nt, Artificial Sequence
  Description of Artificial Sequence: Synthetic oligonucleotide
gguuacgggugcugacug

SEQ ID NO: 23559 - RNA, 18 nt, Artificial Sequence
  Description of Artificial Sequence: Synthetic oligonucleotide
agccggguuacgggugcu

SEQ ID NO: 23560 - RNA, 18 nt, Artificial Sequence
  Description of Artificial Sequence: Synthetic oligonucleotide
gucauagccggguuacgg

SEQ ID NO: 23561 - RNA, 18 nt, Artificial Sequence
  Description of Artificial Sequence: Synthetic oligonucleotide
cccuggucauagccgggu

SEQ ID NO: 23562 - RNA, 18 nt, Artificial Sequence
  Description of Artificial Sequence: Synthetic oligonucleotide
cagaucccuggucauagc

SEQ ID NO: 23563 - RNA, 18 nt, Artificial Sequence
  Description of Artificial Sequence: Synthetic oligonucleotide
gcuuacagaucccugguc

SEQ ID NO: 23564 - RNA, 18 nt, Artificial Sequence
  Description of Artificial Sequence: Synthetic oligonucleotide
acagggcuuacagauccc

SEQ ID NO: 23565 - RNA, 18 nt, Artificial Sequence
  Description of Artificial Sequence: Synthetic oligonucleotide
gagccacagggcuuacag

SEQ ID NO: 23566 - RNA, 18 nt, Artificial Sequence
  Description of Artificial Sequence: Synthetic oligonucleotide
cuguggagccacagggcu

SEQ ID NO: 23567 - RNA, 18 nt, Artificial Sequence
  Description of Artificial Sequence: Synthetic oligonucleotide
agcaccuguggagccaca

SEQ ID NO: 23568 - RNA, 18 nt, Artificial Sequence
  Description of Artificial Sequence: Synthetic oligonucleotide
gaagcagcaccuguggag

SEQ ID NO: 23569 - RNA, 18 nt, Artificial Sequence
  Description of Artificial Sequence: Synthetic oligonucleotide
agugagaagcagcaccug

SEQ ID NO: 23570 - RNA, 18 nt, Artificial Sequence
  Description of Artificial Sequence: Synthetic oligonucleotide
gggccagugagaagcagc

SEQ ID NO: 23571 - RNA, 18 nt, Artificial Sequence
  Description of Artificial Sequence: Synthetic oligonucleotide
agucugggccagugagaa

SEQ ID NO: 23572 - RNA, 18 nt, Artificial Sequence
  Description of Artificial Sequence: Synthetic oligonucleotide
cucagagucugggccagu

SEQ ID NO: 23573 - RNA, 18 nt, Artificial Sequence
  Description of Artificial Sequence: Synthetic oligonucleotide
uggagcucagagucuggg

SEQ ID NO: 23574 - RNA, 18 nt, Artificial Sequence
  Description of Artificial Sequence: Synthetic oligonucleotide
gccgguggagcucagagu

SEQ ID NO: 23575 - RNA, 18 nt, Artificial Sequence
  Description of Artificial Sequence: Synthetic oligonucleotide
acugggccgguggagcuc

SEQ ID NO: 23576 - RNA, 18 nt, Artificial Sequence
  Description of Artificial Sequence: Synthetic oligonucleotide
ugcagacugggccggugg

SEQ ID NO: 23577 - RNA, 18 nt, Artificial Sequence
  Description of Artificial Sequence: Synthetic oligonucleotide
ggccgugcagacugggcc

SEQ ID NO: 23578 - RNA, 18 nt, Artificial Sequence
  Description of Artificial Sequence: Synthetic oligonucleotide
agaugggccgugcagacu

SEQ ID NO: 23579 - RNA, 18 nt, Artificial Sequence
  Description of Artificial Sequence: Synthetic oligonucleotide
gaagcagaugggccgugc

SEQ ID NO: 23580 - RNA, 18 nt, Artificial Sequence
  Description of Artificial Sequence: Synthetic oligonucleotide
aaggugaagcagaugggc

SEQ ID NO: 23581 - RNA, 18 nt, Artificial Sequence
  Description of Artificial Sequence: Synthetic oligonucleotide
gagggaaggugaagcaga

SEQ ID NO: 23582 - RNA, 18 nt, Artificial Sequence
  Description of Artificial Sequence: Synthetic oligonucleotide
gcugggagggaaggugaa

SEQ ID NO: 23583 - RNA, 18 nt, Artificial Sequence
  Description of Artificial Sequence: Synthetic oligonucleotide
acguggcugggagggaag

SEQ ID NO: 23584 - RNA, 18 nt, Artificial Sequence
  Description of Artificial Sequence: Synthetic oligonucleotide
cuggcacguggcugggag

SEQ ID NO: 23585 - RNA, 18 nt, Artificial Sequence
  Description of Artificial Sequence: Synthetic oligonucleotide
ggccacuggcacguggcu

SEQ ID NO: 23586 - RNA, 18 nt, Artificial Sequence
  Description of Artificial Sequence: Synthetic oligonucleotide
gcuguggccacuggcacg

SEQ ID NO: 23587 - RNA, 18 nt, Artificial Sequence
  Description of Artificial Sequence: Synthetic oligonucleotide
agugggcuguggccacug

SEQ ID NO: 23588 - RNA, 18 nt, Artificial Sequence
  Description of Artificial Sequence: Synthetic oligonucleotide
ugggaagugggcuguggc

SEQ ID NO: 23589 - RNA, 18 nt, Artificial Sequence
  Description of Artificial Sequence: Synthetic oligonucleotide
uggguugggaagugggcu

SEQ ID NO: 23590 - RNA, 18 nt, Artificial Sequence
  Description of Artificial Sequence: Synthetic oligonucleotide
aacaguggguugggaagu

SEQ ID NO: 23591 - RNA, 18 nt, Artificial Sequence
  Description of Artificial Sequence: Synthetic oligonucleotide
gguacaacaguggguugg

SEQ ID NO: 23592 - RNA, 18 nt, Artificial Sequence
  Description of Artificial Sequence: Synthetic oligonucleotide
gccuggguacaacagugg

SEQ ID NO: 23593 - RNA, 18 nt, Artificial Sequence
  Description of Artificial Sequence: Synthetic oligonucleotide
gugaggccuggguacaac

SEQ ID NO: 23594 - RNA, 18 nt, Artificial Sequence
  Description of Artificial Sequence: Synthetic oligonucleotide
gcaaagugaggccugggu

SEQ ID NO: 23595 - RNA, 18 nt, Artificial Sequence
  Description of Artificial Sequence: Synthetic oligonucleotide
caacagcaaagugaggcc

SEQ ID NO: 23596 - RNA, 18 nt, Artificial Sequence
  Description of Artificial Sequence: Synthetic oligonucleotide
aagggcaacagcaaagug

SEQ ID NO: 23597 - RNA, 18 nt, Artificial Sequence
  Description of Artificial Sequence: Synthetic oligonucleotide
gggacaagggcaacagca

SEQ ID NO: 23598 - RNA, 18 nt, Artificial Sequence
  Description of Artificial Sequence: Synthetic oligonucleotide
gaagagggacaagggcaa

SEQ ID NO: 23599 - RNA, 18 nt, Artificial Sequence
  Description of Artificial Sequence: Synthetic oligonucleotide
ggcccgaagagggacaag

SEQ ID NO: 23600 - RNA, 18 nt, Artificial Sequence
  Description of Artificial Sequence: Synthetic oligonucleotide
uucagggcccgaagaggg

SEQ ID NO: 23601 - RNA, 18 nt, Artificial Sequence
  Description of Artificial Sequence: Synthetic oligonucleotide
gaaaauucagggcccgaa

SEQ ID NO: 23602 - RNA, 18 nt, Artificial Sequence
  Description of Artificial Sequence: Synthetic oligonucleotide
gaacagaaaauucagggc

SEQ ID NO: 23603 - RNA, 18 nt, Artificial Sequence
  Description of Artificial Sequence: Synthetic oligonucleotide
ccagggaacagaaaauuc

SEQ ID NO: 23604 - RNA, 18 nt, Artificial Sequence
  Description of Artificial Sequence: Synthetic oligonucleotide
ggcccccagggaacagaa

SEQ ID NO: 23605 - RNA, 18 nt, Artificial Sequence
  Description of Artificial Sequence: Synthetic oligonucleotide
uggcuggcccccagggaa

SEQ ID NO: 23606 - RNA, 18 nt, Artificial Sequence
  Description of Artificial Sequence: Synthetic oligonucleotide
ggcccuggcuggccccca

SEQ ID NO: 23607 - RNA, 18 nt, Artificial Sequence
  Description of Artificial Sequence: Synthetic oligonucleotide
caaagggcccuggcuggc

SEQ ID NO: 23608 - RNA, 18 nt, Artificial Sequence
  Description of Artificial Sequence: Synthetic oligonucleotide
gggcacaaagggcccugg

SEQ ID NO: 23609 - RNA, 18 nt, Artificial Sequence
  Description of Artificial Sequence: Synthetic oligonucleotide
caucaggccugugcuggg

SEQ ID NO: 23610 - RNA, 18 nt, Artificial Sequence
  Description of Artificial Sequence: Synthetic oligonucleotide
accugcaucaggccugug

SEQ ID NO: 23611 - RNA, 18 nt, Artificial Sequence
  Description of Artificial Sequence: Synthetic oligonucleotide
uggacaccugcaucaggc

SEQ ID NO: 23612 - RNA, 18 nt, Artificial Sequence
  Description of Artificial Sequence: Synthetic oligonucleotide
gugaguggacaccugcau

SEQ ID NO: 23613 - RNA, 18 nt, Artificial Sequence
  Description of Artificial Sequence: Synthetic oligonucleotide
caccugugaguggacacc

SEQ ID NO: 23614 - RNA, 18 nt, Artificial Sequence
  Description of Artificial Sequence: Synthetic oligonucleotide
agcgccaccugugagugg

SEQ ID NO: 23615 - RNA, 18 nt, Artificial Sequence
  Description of Artificial Sequence: Synthetic oligonucleotide
aggugagcgccaccugug

SEQ ID NO: 23616 - RNA, 18 nt, Artificial Sequence
  Description of Artificial Sequence: Synthetic oligonucleotide
agccuaggugagcgccac

SEQ ID NO: 23617 - RNA, 18 nt, Artificial Sequence
  Description of Artificial Sequence: Synthetic oligonucleotide
gugacagccuaggugagc

SEQ ID NO: 23618 - RNA, 18 nt, Artificial Sequence
  Description of Artificial Sequence: Synthetic oligonucleotide
guccugugacagccuagg

SEQ ID NO: 23619 - RNA, 18 nt, Artificial Sequence
  Description of Artificial Sequence: Synthetic oligonucleotide
gguggguccugugacagc

SEQ ID NO: 23620 - RNA, 18 nt, Artificial Sequence
  Description of Artificial Sequence: Synthetic oligonucleotide
auggagguggguccugug

SEQ ID NO: 23621 - RNA, 18 nt, Artificial Sequence
  Description of Artificial Sequence: Synthetic oligonucleotide
cuggcauggagguggguc

SEQ ID NO: 23622 - RNA, 18 nt, Artificial Sequence
  Description of Artificial Sequence: Synthetic oligonucleotide
guugccuggcauggaggu

SEQ ID NO: 23623 - RNA, 18 nt, Artificial Sequence
  Description of Artificial Sequence: Synthetic oligonucleotide
ccucuguugccuggcaug

SEQ ID NO: 23624 - RNA, 18 nt, Artificial Sequence
  Description of Artificial Sequence: Synthetic oligonucleotide
guggcccucuguugccug

SEQ ID NO: 23625 - RNA, 18 nt, Artificial Sequence
  Description of Artificial Sequence: Synthetic oligonucleotide
guucuguggcccucuguu

SEQ ID NO: 23626 - RNA, 18 nt, Artificial Sequence
  Description of Artificial Sequence: Synthetic oligonucleotide
gggugguucuguggcccu

SEQ ID NO: 23627 - RNA, 18 nt, Artificial Sequence
  Description of Artificial Sequence: Synthetic oligonucleotide
gaccaaggagugagccgu

SEQ ID NO: 23628 - RNA, 18 nt, Artificial Sequence
  Description of Artificial Sequence: Synthetic oligonucleotide
ccccagaccaaggaguga

SEQ ID NO: 23629 - RNA, 18 nt, Artificial Sequence
  Description of Artificial Sequence: Synthetic oligonucleotide
gguggccccagaccaagg

SEQ ID NO: 23630 - RNA, 18 nt, Artificial Sequence
  Description of Artificial Sequence: Synthetic oligonucleotide
aagaagguggccccagac

SEQ ID NO: 23631 - RNA, 18 nt, Artificial Sequence
  Description of Artificial Sequence: Synthetic oligonucleotide
agggcaagaagguggccc

SEQ ID NO: 23632 - RNA, 18 nt, Artificial Sequence
  Description of Artificial Sequence: Synthetic oligonucleotide
aagaaagggcaagaaggu

SEQ ID NO: 23633 - RNA, 18 nt, Artificial Sequence
  Description of Artificial Sequence: Synthetic oligonucleotide
aaaaaaagaaagggcaag

SEQ ID NO: 23634 - RNA, 18 nt, Artificial Sequence
  Description of Artificial Sequence: Synthetic oligonucleotide
aaaaaaaaaaaagaaagg

SEQ ID NO: 23635 - RNA, 18 nt, Artificial Sequence
  Description of Artificial Sequence: Synthetic oligonucleotide
aaaaaaaaaaaaaaaaag

SEQ ID NO: 23636 - RNA, 18 nt, Artificial Sequence
  Description of Artificial Sequence: Synthetic oligonucleotide
aaaaaaaaaaaaaaaaaa

SEQ ID NO: 23637 - RNA, 18 nt, Artificial Sequence
  Description of Artificial Sequence: Synthetic oligonucleotide
ucggaaaaaaaaaaaaaa

SEQ ID NO: 23638 - RNA, 18 nt, Artificial Sequence
  Description of Artificial Sequence: Synthetic oligonucleotide
ccaucucggaaaaaaaaa

SEQ ID NO: 23639 - RNA, 18 nt, Artificial Sequence
  Description of Artificial Sequence: Synthetic oligonucleotide
agacuccaucucggaaaa

SEQ ID NO: 23640 - RNA, 18 nt, Artificial Sequence
  Description of Artificial Sequence: Synthetic oligonucleotide
gagagagacuccaucucg

SEQ ID NO: 23641 - RNA, 18 nt, Artificial Sequence
  Description of Artificial Sequence: Synthetic oligonucleotide
ugacagagagagacucca

SEQ ID NO: 23642 - RNA, 18 nt, Artificial Sequence
  Description of Artificial Sequence: Synthetic oligonucleotide
cugggugacagagagaga

SEQ ID NO: 23643 - RNA, 18 nt, Artificial Sequence
  Description of Artificial Sequence: Synthetic oligonucleotide
cccaccugggugacagag

SEQ ID NO: 23644 - RNA, 18 nt, Artificial Sequence
  Description of Artificial Sequence: Synthetic oligonucleotide
acacucccaccuggguga

SEQ ID NO: 23645 - RNA, 18 nt, Artificial Sequence
  Description of Artificial Sequence: Synthetic oligonucleotide
ccaccacacucccaccug

SEQ ID NO: 23646 - RNA, 18 nt, Artificial Sequence
  Description of Artificial Sequence: Synthetic oligonucleotide
uugugccaccacacuccc

SEQ ID NO: 23647 - RNA, 18 nt, Artificial Sequence
  Description of Artificial Sequence: Synthetic oligonucleotide
cgagauugugccaccaca

SEQ ID NO: 23648 - RNA, 18 nt, Artificial Sequence
  Description of Artificial Sequence: Synthetic oligonucleotide
ugagccgagauugugcca

SEQ ID NO: 23649 - RNA, 18 nt, Artificial Sequence
  Description of Artificial Sequence: Synthetic oligonucleotide
ugcagugagccgagauug

SEQ ID NO: 23650 - RNA, 18 nt, Artificial Sequence
  Description of Artificial Sequence: Synthetic oligonucleotide
gagguugcagugagccga

SEQ ID NO: 23651 - RNA, 18 nt, Artificial Sequence
  Description of Artificial Sequence: Synthetic oligonucleotide
agguggagguugcaguga

SEQ ID NO: 23652 - RNA, 18 nt, Artificial Sequence
  Description of Artificial Sequence: Synthetic oligonucleotide
ucaggagguggagguugc

SEQ ID NO: 23653 - RNA, 18 nt, Artificial Sequence
  Description of Artificial Sequence: Synthetic oligonucleotide
ugaacucaggagguggag

SEQ ID NO: 23654 - RNA, 18 nt, Artificial Sequence
  Description of Artificial Sequence: Synthetic oligonucleotide
uugcuugaacucaggagg

SEQ ID NO: 23655 - RNA, 18 nt, Artificial Sequence
  Description of Artificial Sequence: Synthetic oligonucleotide
gagaauugcuugaacuca

SEQ ID NO: 23656 - RNA, 18 nt, Artificial Sequence
  Description of Artificial Sequence: Synthetic oligonucleotide
ggcaggagaauugcuuga

SEQ ID NO: 23657 - RNA, 18 nt, Artificial Sequence
  Description of Artificial Sequence: Synthetic oligonucleotide
gcugaggcaggagaauug

SEQ ID NO: 23658 - RNA, 18 nt, Artificial Sequence
  Description of Artificial Sequence: Synthetic oligonucleotide
gggaggcugaggcaggag

SEQ ID NO: 23659 - RNA, 18 nt, Artificial Sequence
  Description of Artificial Sequence: Synthetic oligonucleotide
uacuugggaggcugaggc

SEQ ID NO: 23660 - RNA, 18 nt, Artificial Sequence
  Description of Artificial Sequence: Synthetic oligonucleotide
ccagcuacuugggaggcu

SEQ ID NO: 23661 - RNA, 18 nt, Artificial Sequence
  Description of Artificial Sequence: Synthetic oligonucleotide
uagucccagcuacuuggg

SEQ ID NO: 23662 - RNA, 18 nt, Artificial Sequence
  Description of Artificial Sequence: Synthetic oligonucleotide
gccuguagucccagcuac

SEQ ID NO: 23663 - RNA, 18 nt, Artificial Sequence
  Description of Artificial Sequence: Synthetic oligonucleotide
ugcaugccuguaguccca

SEQ ID NO: 23664 - RNA, 18 nt, Artificial Sequence
  Description of Artificial Sequence: Synthetic oligonucleotide
gguggugcaugccuguag

SEQ ID NO: 23665 - RNA, 18 nt, Artificial Sequence
  Description of Artificial Sequence: Synthetic oligonucleotide
agugugguggugcaugcc

SEQ ID NO: 23666 - RNA, 18 nt, Artificial Sequence
  Description of Artificial Sequence: Synthetic oligonucleotide
ggccaagugugguggugc

SEQ ID NO: 23667 - RNA, 18 nt, Artificial Sequence
  Description of Artificial Sequence: Synthetic oligonucleotide
acauuggccaaguguggu

SEQ ID NO: 23668 - RNA, 18 nt, Artificial Sequence
  Description of Artificial Sequence: Synthetic oligonucleotide
acagaacauuggccaagu

SEQ ID NO: 23669 - RNA, 18 nt, Artificial Sequence
  Description of Artificial Sequence: Synthetic oligonucleotide
aaaauacagaacauuggc

SEQ ID NO: 23670 - RNA, 18 nt, Artificial Sequence
  Description of Artificial Sequence: Synthetic oligonucleotide
uauuaaaaauacagaaca

SEQ ID NO: 23671 - RNA, 18 nt, Artificial Sequence
  Description of Artificial Sequence: Synthetic oligonucleotide
gucccuauuaaaaauaca

SEQ ID NO: 23672 - RNA, 18 nt, Artificial Sequence
  Description of Artificial Sequence: Synthetic oligonucleotide
accccgucccuauuaaaa

SEQ ID NO: 23673 - RNA, 18 nt, Artificial Sequence
  Description of Artificial Sequence: Synthetic oligonucleotide
gcaaaaccccgucccuau

SEQ ID NO: 23674 - RNA, 18 nt, Artificial Sequence
  Description of Artificial Sequence: Synthetic oligonucleotide
acauggcaaaaccccguc

SEQ ID NO: 23675 - RNA, 18 nt, Artificial Sequence
  Description of Artificial Sequence: Synthetic oligonucleotide
agcuaacauggcaaaacc

SEQ ID NO: 23676 - RNA, 18 nt, Artificial Sequence
  Description of Artificial Sequence: Synthetic oligonucleotide
agccuagcuaacauggca

SEQ ID NO: 23677 - RNA, 18 nt, Artificial Sequence
  Description of Artificial Sequence: Synthetic oligonucleotide
agaccagccuagcuaaca

SEQ ID NO: 23678 - RNA, 18 nt, Artificial Sequence
  Description of Artificial Sequence: Synthetic oligonucleotide
guuugagaccagccuagc

SEQ ID NO: 23679 - RNA, 18 nt, Artificial Sequence
  Description of Artificial Sequence: Synthetic oligonucleotide
ugugaguuugagaccagc

SEQ ID NO: 23680 - RNA, 18 nt, Artificial Sequence
  Description of Artificial Sequence: Synthetic oligonucleotide
ccaggugugaguuugaga

SEQ ID NO: 23681 - RNA, 18 nt, Artificial Sequence
  Description of Artificial Sequence: Synthetic oligonucleotide
uaaucccaggugugaguu

SEQ ID NO: 23682 - RNA, 18 nt, Artificial Sequence
  Description of Artificial Sequence: Synthetic oligonucleotide
gccuguaaucccaggugu

SEQ ID NO: 23683 - RNA, 18 nt, Artificial Sequence
  Description of Artificial Sequence: Synthetic oligonucleotide
cucaugccuguaauccca

SEQ ID NO: 23684 - RNA, 18 nt, Artificial Sequence
  Description of Artificial Sequence: Synthetic oligonucleotide
aguggcucaugccuguaa

SEQ ID NO: 23685 - RNA, 18 nt, Artificial Sequence
  Description of Artificial Sequence: Synthetic oligonucleotide
ggugcaguggcucaugcc

SEQ ID NO: 23686 - RNA, 18 nt, Artificial Sequence
  Description of Artificial Sequence: Synthetic oligonucleotide
ggcugggugcaguggcuc

SEQ ID NO: 23687 - RNA, 18 nt, Artificial Sequence
  Description of Artificial Sequence: Synthetic oligonucleotide
gggcugggugcaguggcu

SEQ ID NO: 23688 - RNA, 18 nt, Artificial Sequence
  Description of Artificial Sequence: Synthetic oligonucleotide
aagaaagggcaagaaggg

SEQ ID NO: 23689 - RNA, 18 nt, Artificial Sequence
  Description of Artificial Sequence: Synthetic oligonucleotide
gagaaaagaaagggcaag

SEQ ID NO: 23690 - RNA, 18 nt, Artificial Sequence
  Description of Artificial Sequence: Synthetic oligonucleotide
ccauggagaaaagaaagg

SEQ ID NO: 23691 - RNA, 18 nt, Artificial Sequence
  Description of Artificial Sequence: Synthetic oligonucleotide
aucagccauggagaaaag

SEQ ID NO: 23692 - RNA, 18 nt, Artificial Sequence
  Description of Artificial Sequence: Synthetic oligonucleotide
gcagcaucagccauggag

SEQ ID NO: 23693 - RNA, 18 nt, Artificial Sequence
  Description of Artificial Sequence: Synthetic oligonucleotide
ccacagcagcaucagcca

SEQ ID NO: 23694 - RNA, 18 nt, Artificial Sequence
  Description of Artificial Sequence: Synthetic oligonucleotide
gcuggccacagcagcauc

SEQ ID NO: 23695 - RNA, 18 nt, Artificial Sequence
  Description of Artificial Sequence: Synthetic oligonucleotide
cccuggcuggccacagca

SEQ ID NO: 23696 - RNA, 18 nt, Artificial Sequence
  Description of Artificial Sequence: Synthetic oligonucleotide
aagggcccuggcuggcca

SEQ ID NO: 23697 - RNA, 18 nt, Artificial Sequence
  Description of Artificial Sequence: Synthetic oligonucleotide
aucucaagggcccuggcu

SEQ ID NO: 23698 - RNA, 18 nt, Artificial Sequence
  Description of Artificial Sequence: Synthetic oligonucleotide
gaaggaucucaagggccc

SEQ ID NO: 23699 - RNA, 18 nt, Artificial Sequence
  Description of Artificial Sequence: Synthetic oligonucleotide
aacuggaaggaucucaag

SEQ ID NO: 23700 - RNA, 18 nt, Artificial Sequence
  Description of Artificial Sequence: Synthetic oligonucleotide
agccaaacuggaaggauc

SEQ ID NO: 23701 - RNA, 18 nt, Artificial Sequence
  Description of Artificial Sequence: Synthetic oligonucleotide
auaacagccaaacuggaa

SEQ ID NO: 23702 - RNA, 18 nt, Artificial Sequence
  Description of Artificial Sequence: Synthetic oligonucleotide
uuugcauaacagccaaac

SEQ ID NO: 23703 - RNA, 18 nt, Artificial Sequence
  Description of Artificial Sequence: Synthetic oligonucleotide
ccugcuuugcauaacagc

SEQ ID NO: 23704 - RNA, 18 nt, Artificial Sequence
  Description of Artificial Sequence: Synthetic oligonucleotide
aaucaccugcuuugcaua

SEQ ID NO: 23705 - RNA, 18 nt, Artificial Sequence
  Description of Artificial Sequence: Synthetic oligonucleotide
agacaaaucaccugcuuu

SEQ ID NO: 23706 - RNA, 18 nt, Artificial Sequence
  Description of Artificial Sequence: Synthetic oligonucleotide
gauuaagacaaaucaccu

SEQ ID NO: 23707 - RNA, 18 nt, Artificial Sequence
  Description of Artificial Sequence: Synthetic oligonucleotide
uaucugauuaagacaaau

SEQ ID NO: 23708 - RNA, 18 nt, Artificial Sequence
  Description of Artificial Sequence: Synthetic oligonucleotide
ucuuuuaucugauuaaga

SEQ ID NO: 23709 - RNA, 18 nt, Artificial Sequence
  Description of Artificial Sequence: Synthetic oligonucleotide
cucuaucuuuuaucugau

SEQ ID NO: 23710 - RNA, 18 nt, Artificial Sequence
  Description of Artificial Sequence: Synthetic oligonucleotide
auagccucuaucuuuuau

SEQ ID NO: 23711 - RNA, 18 nt, Artificial Sequence
  Description of Artificial Sequence: Synthetic oligonucleotide
cccccauagccucuaucu

SEQ ID NO: 23712 - RNA, 18 nt, Artificial Sequence
  Description of Artificial Sequence: Synthetic oligonucleotide
ugaggcccccauagccuc

SEQ ID NO: 23713 - RNA, 18 nt, Artificial Sequence
  Description of Artificial Sequence: Synthetic oligonucleotide
aaucuugaggcccccaua

SEQ ID NO: 23714 - RNA, 18 nt, Artificial Sequence
  Description of Artificial Sequence: Synthetic oligonucleotide
ccaaaaaucuugaggccc

SEQ ID NO: 23715 - RNA, 18 nt, Artificial Sequence
  Description of Artificial Sequence: Synthetic oligonucleotide
gcucuccaaaaaucuuga

SEQ ID NO: 23716 - RNA, 18 nt, Artificial Sequence
  Description of Artificial Sequence: Synthetic oligonucleotide
ccucugcucuccaaaaau

SEQ ID NO: 23717 - RNA, 18 nt, Artificial Sequence
  Description of Artificial Sequence: Synthetic oligonucleotide
gaccaccucugcucucca

SEQ ID NO: 23718 - RNA, 18 nt, Artificial Sequence
  Description of Artificial Sequence: Synthetic oligonucleotide
ccagagaccaccucugcu

SEQ ID NO: 23719 - RNA, 18 nt, Artificial Sequence
  Description of Artificial Sequence: Synthetic oligonucleotide
aauugccagagaccaccu

SEQ ID NO: 23720 - RNA, 18 nt, Artificial Sequence
  Description of Artificial Sequence: Synthetic oligonucleotide
gauggaauugccagagac

SEQ ID NO: 23721 - RNA, 18 nt, Artificial Sequence
  Description of Artificial Sequence: Synthetic oligonucleotide
aaccagauggaauugcca

SEQ ID NO: 23722 - RNA, 18 nt, Artificial Sequence
  Description of Artificial Sequence: Synthetic oligonucleotide
cucaaaaccagauggaau

SEQ ID NO: 23723 - RNA, 18 nt, Artificial Sequence
  Description of Artificial Sequence: Synthetic oligonucleotide
aguuucucaaaaccagau

SEQ ID NO: 23724 - RNA, 18 nt, Artificial Sequence
  Description of Artificial Sequence: Synthetic oligonucleotide
ugcuaaguuucucaaaac

SEQ ID NO: 23725 - RNA, 18 nt, Artificial Sequence
  Description of Artificial Sequence: Synthetic oligonucleotide
ugagcugcuaaguuucuc

SEQ ID NO: 23726 - RNA, 18 nt, Artificial Sequence
  Description of Artificial Sequence: Synthetic oligonucleotide
cucugugagcugcuaagu

SEQ ID NO: 23727 - RNA, 18 nt, Artificial Sequence
  Description of Artificial Sequence: Synthetic oligonucleotide
cugugcucugugagcugc

SEQ ID NO: 23728 - RNA, 18 nt, Artificial Sequence
  Description of Artificial Sequence: Synthetic oligonucleotide
gaucucugugcucuguga

SEQ ID NO: 23729 - RNA, 18 nt, Artificial Sequence
  Description of Artificial Sequence: Synthetic oligonucleotide
ggcaggaucucugugcuc

SEQ ID NO: 23730 - RNA, 18 nt, Artificial Sequence
  Description of Artificial Sequence: Synthetic oligonucleotide
aagaaggcaggaucucug

SEQ ID NO: 23731 - RNA, 18 nt, Artificial Sequence
  Description of Artificial Sequence: Synthetic oligonucleotide
guaggaagaaggcaggau

SEQ ID NO: 23732 - RNA, 18 nt, Artificial Sequence
  Description of Artificial Sequence: Synthetic oligonucleotide
ugauaguaggaagaaggc

SEQ ID NO: 23733 - RNA, 18 nt, Artificial Sequence
  Description of Artificial Sequence: Synthetic oligonucleotide
cagccugauaguaggaag

SEQ ID NO: 23734 - RNA, 18 nt, Artificial Sequence
  Description of Artificial Sequence: Synthetic oligonucleotide
uaggucagccugauagua

SEQ ID NO: 23735 - RNA, 18 nt, Artificial Sequence
  Description of Artificial Sequence: Synthetic oligonucleotide
cccauuaggucagccuga

SEQ ID NO: 23736 - RNA, 18 nt, Artificial Sequence
  Description of Artificial Sequence: Synthetic oligonucleotide
ccaaccccauuaggucag

SEQ ID NO: 23737 - RNA, 18 nt, Artificial Sequence
  Description of Artificial Sequence: Synthetic oligonucleotide
gcagcccaaccccauuag

SEQ ID NO: 23738 - RNA, 18 nt, Artificial Sequence
  Description of Artificial Sequence: Synthetic oligonucleotide
gccgagcagcccaacccc

SEQ ID NO: 23739 - RNA, 18 nt, Artificial Sequence
  Description of Artificial Sequence: Synthetic oligonucleotide
caguugccgagcagccca

SEQ ID NO: 23740 - RNA, 18 nt, Artificial Sequence
  Description of Artificial Sequence: Synthetic oligonucleotide
ccaagcaguugccgagca

SEQ ID NO: 23741 - RNA, 18 nt, Artificial Sequence
  Description of Artificial Sequence: Synthetic oligonucleotide
gugacccaagcaguugcc

SEQ ID NO: 23742 - RNA, 18 nt, Artificial Sequence
  Description of Artificial Sequence: Synthetic oligonucleotide
gcaaggugacccaagcag

SEQ ID NO: 23743 - RNA, 18 nt, Artificial Sequence
  Description of Artificial Sequence: Synthetic oligonucleotide
gggcaaggugacccaagc

SEQ ID NO: 23744 - RNA, 18 nt, Artificial Sequence
  Description of Artificial Sequence: Synthetic oligonucleotide
agggcugguuuccuuggg

SEQ ID NO: 23745 - RNA, 18 nt, Artificial Sequence
  Description of Artificial Sequence: Synthetic oligonucleotide
cacccagggcugguuucc

SEQ ID NO: 23746 - RNA, 18 nt, Artificial Sequence
  Description of Artificial Sequence: Synthetic oligonucleotide
gguggcacccagggcugg

SEQ ID NO: 23747 - RNA, 18 nt, Artificial Sequence
  Description of Artificial Sequence: Synthetic oligonucleotide
ggcuggguggcacccagg

SEQ ID NO: 23748 - RNA, 18 nt, Artificial Sequence
  Description of Artificial Sequence: Synthetic oligonucleotide
uaaguggcuggguggcac

SEQ ID NO: 23749 - RNA, 18 nt, Artificial Sequence
  Description of Artificial Sequence: Synthetic oligonucleotide
gacccuaaguggcugggu

SEQ ID NO: 23750 - RNA, 18 nt, Artificial Sequence
  Description of Artificial Sequence: Synthetic oligonucleotide
cuguagacccuaaguggc

SEQ ID NO: 23751 - RNA, 18 nt, Artificial Sequence
  Description of Artificial Sequence: Synthetic oligonucleotide
ccacccuguagacccuaa

SEQ ID NO: 23752 - RNA, 18 nt, Artificial Sequence
  Description of Artificial Sequence: Synthetic oligonucleotide
gagucccacccuguagac

SEQ ID NO: 23753 - RNA, 18 nt, Artificial Sequence
  Description of Artificial Sequence: Synthetic oligonucleotide
gucuggagucccacccug

SEQ ID NO: 23754 - RNA, 18 nt, Artificial Sequence
  Description of Artificial Sequence: Synthetic oligonucleotide
ucuaggucuggaguccca

SEQ ID NO: 23755 - RNA, 18 nt, Artificial Sequence
  Description of Artificial Sequence: Synthetic oligonucleotide
uacgcucuaggucuggag

SEQ ID NO: 23756 - RNA, 18 nt, Artificial Sequence
  Description of Artificial Sequence: Synthetic oligonucleotide
auacuuacgcucuagguc

SEQ ID NO: 23757 - RNA, 18 nt, Artificial Sequence
  Description of Artificial Sequence: Synthetic oligonucleotide
cauccauacuuacgcucu

SEQ ID NO: 23758 - RNA, 18 nt, Artificial Sequence
  Description of Artificial Sequence: Synthetic oligonucleotide
cacaacauccauacuuac

SEQ ID NO: 23759 - RNA, 18 nt, Artificial Sequence
  Description of Artificial Sequence: Synthetic oligonucleotide
agggccacaacauccaua

SEQ ID NO: 23760 - RNA, 18 nt, Artificial Sequence
  Description of Artificial Sequence: Synthetic oligonucleotide
gacacagggccacaacau

SEQ ID NO: 23761 - RNA, 18 nt, Artificial Sequence
  Description of Artificial Sequence: Synthetic oligonucleotide
aggaagacacagggccac

SEQ ID NO: 23762 - RNA, 18 nt, Artificial Sequence
  Description of Artificial Sequence: Synthetic oligonucleotide
acacuaggaagacacagg

SEQ ID NO: 23763 - RNA, 18 nt, Artificial Sequence
  Description of Artificial Sequence: Synthetic oligonucleotide
gggucacacuaggaagac

SEQ ID NO: 23764 - RNA, 18 nt, Artificial Sequence
  Description of Artificial Sequence: Synthetic oligonucleotide
uggcugggucacacuagg

SEQ ID NO: 23765 - RNA, 18 nt, Artificial Sequence
  Description of Artificial Sequence: Synthetic oligonucleotide
gcuccuggcugggucaca

SEQ ID NO: 23766 - RNA, 18 nt, Artificial Sequence
  Description of Artificial Sequence: Synthetic oligonucleotide
cuuccgcuccuggcuggg

SEQ ID NO: 23767 - RNA, 18 nt, Artificial Sequence
  Description of Artificial Sequence: Synthetic oligonucleotide
ugaagcuuccgcuccugg

SEQ ID NO: 23768 - RNA, 18 nt, Artificial Sequence
  Description of Artificial Sequence: Synthetic oligonucleotide
acgccugaagcuuccgcu

SEQ ID NO: 23769 - RNA, 18 nt, Artificial Sequence
  Description of Artificial Sequence: Synthetic oligonucleotide
uacaaacgccugaagcuu

SEQ ID NO: 23770 - RNA, 18 nt, Artificial Sequence
  Description of Artificial Sequence: Synthetic oligonucleotide
cacuuuacaaacgccuga

SEQ ID NO: 23771 - RNA, 18 nt, Artificial Sequence
  Description of Artificial Sequence: Synthetic oligonucleotide
gaccucacuuuacaaacg

SEQ ID NO: 23772 - RNA, 18 nt, Artificial Sequence
  Description of Artificial Sequence: Synthetic oligonucleotide
agccagaccucacuuuac

SEQ ID NO: 23773 - RNA, 18 nt, Artificial Sequence
  Description of Artificial Sequence: Synthetic oligonucleotide
ggcagagccagaccucac

SEQ ID NO: 23774 - RNA, 18 nt, Artificial Sequence
  Description of Artificial Sequence: Synthetic oligonucleotide
gaggaggcagagccagac

SEQ ID NO: 23775 - RNA, 18 nt, Artificial Sequence
  Description of Artificial Sequence: Synthetic oligonucleotide
aaacggaggaggcagagc

SEQ ID NO: 23776 - RNA, 18 nt, Artificial Sequence
  Description of Artificial Sequence: Synthetic oligonucleotide
aaaaaaaacggaggaggc

SEQ ID NO: 23777 - RNA, 18 nt, Artificial Sequence
  Description of Artificial Sequence: Synthetic oligonucleotide
aaaaaaaaaaaaacggag

SEQ ID NO: 23778 - RNA, 18 nt, Artificial Sequence
  Description of Artificial Sequence: Synthetic oligonucleotide
acagaaaaaaaaaaaaaa

SEQ ID NO: 23779 - RNA, 18 nt, Artificial Sequence
  Description of Artificial Sequence: Synthetic oligonucleotide
cagaaacagaaaaaaaaa

SEQ ID NO: 23780 - RNA, 18 nt, Artificial Sequence
  Description of Artificial Sequence: Synthetic oligonucleotide
agaaacagaaacagaaaa

SEQ ID NO: 23781 - RNA, 18 nt, Artificial Sequence
  Description of Artificial Sequence: Synthetic oligonucleotide
aaaacagaaacagaaaca

SEQ ID NO: 23782 - RNA, 18 nt, Artificial Sequence
  Description of Artificial Sequence: Synthetic oligonucleotide
aaaaaaaaacagaaacag

SEQ ID NO: 23783 - RNA, 18 nt, Artificial Sequence
  Description of Artificial Sequence: Synthetic oligonucleotide
ucucaaaaaaaaaacaga

SEQ ID NO: 23784 - RNA, 18 nt, Artificial Sequence
  Description of Artificial Sequence: Synthetic oligonucleotide
cuccaucucaaaaaaaaa

SEQ ID NO: 23785 - RNA, 18 nt, Artificial Sequence
  Description of Artificial Sequence: Synthetic oligonucleotide
cgagacuccaucucaaaa

SEQ ID NO: 23786 - RNA, 18 nt, Artificial Sequence
  Description of Artificial Sequence: Synthetic oligonucleotide
cagagcgagacuccaucu

SEQ ID NO: 23787 - RNA, 18 nt, Artificial Sequence
  Description of Artificial Sequence: Synthetic oligonucleotide
ggcgacagagcgagacuc

SEQ ID NO: 23788 - RNA, 18 nt, Artificial Sequence
  Description of Artificial Sequence: Synthetic oligonucleotide
gccugggcgacagagcga

SEQ ID NO: 23789 - RNA, 18 nt, Artificial Sequence
  Description of Artificial Sequence: Synthetic oligonucleotide
cuccagccugggcgacag

SEQ ID NO: 23790 - RNA, 18 nt, Artificial Sequence
  Description of Artificial Sequence: Synthetic oligonucleotide
cugcacuccagccugggc

SEQ ID NO: 23791 - RNA, 18 nt, Artificial Sequence
  Description of Artificial Sequence: Synthetic oligonucleotide
ugacacugcacuccagcc

SEQ ID NO: 23792 - RNA, 18 nt, Artificial Sequence
  Description of Artificial Sequence: Synthetic oligonucleotide
gaucgugacacugcacuc

SEQ ID NO: 23793 - RNA, 18 nt, Artificial Sequence
  Description of Artificial Sequence: Synthetic oligonucleotide
gcugagaucgugacacug

SEQ ID NO: 23794 - RNA, 18 nt, Artificial Sequence
  Description of Artificial Sequence: Synthetic oligonucleotide
agugagcugagaucguga

SEQ ID NO: 23795 - RNA, 18 nt, Artificial Sequence
  Description of Artificial Sequence: Synthetic oligonucleotide
guugcagugagcugagau

SEQ ID NO: 23796 - RNA, 18 nt, Artificial Sequence
  Description of Artificial Sequence: Synthetic oligonucleotide
cggagguugcagugagcu

SEQ ID NO: 23797 - RNA, 18 nt, Artificial Sequence
  Description of Artificial Sequence: Synthetic oligonucleotide
ggaggcggagguugcagu

SEQ ID NO: 23798 - RNA, 18 nt, Artificial Sequence
  Description of Artificial Sequence: Synthetic oligonucleotide
accugggaggcggagguu

SEQ ID NO: 23799 - RNA, 18 nt, Artificial Sequence
  Description of Artificial Sequence: Synthetic oligonucleotide
cuuguaccugggaggcgg

SEQ ID NO: 23800 - RNA, 18 nt, Artificial Sequence
  Description of Artificial Sequence: Synthetic oligonucleotide
aaucucuuguaccuggga

SEQ ID NO: 23801 - RNA, 18 nt, Artificial Sequence
  Description of Artificial Sequence: Synthetic oligonucleotide
aggagaaucucuuguacc

SEQ ID NO: 23802 - RNA, 18 nt, Artificial Sequence
  Description of Artificial Sequence: Synthetic oligonucleotide
gaggcaggagaaucucuu

SEQ ID NO: 23803 - RNA, 18 nt, Artificial Sequence
  Description of Artificial Sequence: Synthetic oligonucleotide
aggcugaggcaggagaau

SEQ ID NO: 23804 - RNA, 18 nt, Artificial Sequence
  Description of Artificial Sequence: Synthetic oligonucleotide
ucgggaggcugaggcagg

SEQ ID NO: 23805 - RNA, 18 nt, Artificial Sequence
  Description of Artificial Sequence: Synthetic oligonucleotide
gcuacucgggaggcugag

SEQ ID NO: 23806 - RNA, 18 nt, Artificial Sequence
  Description of Artificial Sequence: Synthetic oligonucleotide
ucccagcuacucgggagg

SEQ ID NO: 23807 - RNA, 18 nt, Artificial Sequence
  Description of Artificial Sequence: Synthetic oligonucleotide
uguagucccagcuacucg

SEQ ID NO: 23808 - RNA, 18 nt, Artificial Sequence
  Description of Artificial Sequence: Synthetic oligonucleotide
acgccuguagucccagcu

SEQ ID NO: 23809 - RNA, 18 nt, Artificial Sequence
  Description of Artificial Sequence: Synthetic oligonucleotide
ggcacacgccuguagucc

SEQ ID NO: 23810 - RNA, 18 nt, Artificial Sequence
  Description of Artificial Sequence: Synthetic oligonucleotide
augguggcacacgccugu

SEQ ID NO: 23811 - RNA, 18 nt, Artificial Sequence
  Description of Artificial Sequence: Synthetic oligonucleotide
caggcaugguggcacacg

SEQ ID NO: 23812 - RNA, 18 nt, Artificial Sequence
  Description of Artificial Sequence: Synthetic oligonucleotide
uuagccaggcaugguggc

SEQ ID NO: 23813 - RNA, 18 nt, Artificial Sequence
  Description of Artificial Sequence: Synthetic oligonucleotide
aaaaauuagccaggcaug

SEQ ID NO: 23814 - RNA, 18 nt, Artificial Sequence
  Description of Artificial Sequence: Synthetic oligonucleotide
aauacaaaaauuagccag

SEQ ID NO: 23815 - RNA, 18 nt, Artificial Sequence
  Description of Artificial Sequence: Synthetic oligonucleotide
cuaaaaauacaaaaauua

SEQ ID NO: 23816 - RNA, 18 nt, Artificial Sequence
  Description of Artificial Sequence: Synthetic oligonucleotide
cucuacuaaaaauacaaa

SEQ ID NO: 23817 - RNA, 18 nt, Artificial Sequence
  Description of Artificial Sequence: Synthetic oligonucleotide
cccaucucuacuaaaaau

SEQ ID NO: 23818 - RNA, 18 nt, Artificial Sequence
  Description of Artificial Sequence: Synthetic oligonucleotide
gaaaccccaucucuacua

SEQ ID NO: 23819 - RNA, 18 nt, Artificial Sequence
  Description of Artificial Sequence: Synthetic oligonucleotide
auggcgaaaccccaucuc

SEQ ID NO: 23820 - RNA, 18 nt, Artificial Sequence
  Description of Artificial Sequence: Synthetic oligonucleotide
cuaacauggcgaaacccc

SEQ ID NO: 23821 - RNA, 18 nt, Artificial Sequence
  Description of Artificial Sequence: Synthetic oligonucleotide
ucuggcuaacauggcgaa

SEQ ID NO: 23822 - RNA, 18 nt, Artificial Sequence
  Description of Artificial Sequence: Synthetic oligonucleotide
accagucuggcuaacaug

SEQ ID NO: 23823 - RNA, 18 nt, Artificial Sequence
  Description of Artificial Sequence: Synthetic oligonucleotide
ucgagaccagucuggcua

SEQ ID NO: 23824 - RNA, 18 nt, Artificial Sequence
  Description of Artificial Sequence: Synthetic oligonucleotide
ggaguucgagaccagucu

SEQ ID NO: 23825 - RNA, 18 nt, Artificial Sequence
  Description of Artificial Sequence: Synthetic oligonucleotide
ggucaggaguucgagacc

SEQ ID NO: 23826 - RNA, 18 nt, Artificial Sequence
  Description of Artificial Sequence: Synthetic oligonucleotide
ccugaggucaggaguucg

SEQ ID NO: 23827 - RNA, 18 nt, Artificial Sequence
  Description of Artificial Sequence: Synthetic oligonucleotide
gaucaccugaggucagga

SEQ ID NO: 23828 - RNA, 18 nt, Artificial Sequence
  Description of Artificial Sequence: Synthetic oligonucleotide
gggaggaucaccugaggu

SEQ ID NO: 23829 - RNA, 18 nt, Artificial Sequence
  Description of Artificial Sequence: Synthetic oligonucleotide
gggugggaggaucaccug

SEQ ID NO: 23830 - RNA, 18 nt, Artificial Sequence
  Description of Artificial Sequence: Synthetic oligonucleotide
gaacuuugggaagccggg

SEQ ID NO: 23831 - RNA, 18 nt, Artificial Sequence
  Description of Artificial Sequence: Synthetic oligonucleotide
ucccagaacuuugggaag

SEQ ID NO: 23832 - RNA, 18 nt, Artificial Sequence
  Description of Artificial Sequence: Synthetic oligonucleotide
uauaaucccagaacuuug

SEQ ID NO: 23833 - RNA, 18 nt, Artificial Sequence
  Description of Artificial Sequence: Synthetic oligonucleotide
acgccuauaaucccagaa

SEQ ID NO: 23834 - RNA, 18 nt, Artificial Sequence
  Description of Artificial Sequence: Synthetic oligonucleotide
ggcucacgccuauaaucc

SEQ ID NO: 23835 - RNA, 18 nt, Artificial Sequence
  Description of Artificial Sequence: Synthetic oligonucleotide
augguggcucacgccuau

SEQ ID NO: 23836 - RNA, 18 nt, Artificial Sequence
  Description of Artificial Sequence: Synthetic oligonucleotide
cgggcaugguggcucacg

SEQ ID NO: 23837 - RNA, 18 nt, Artificial Sequence
  Description of Artificial Sequence: Synthetic oligonucleotide
gagaccgggcaugguggc

SEQ ID NO: 23838 - RNA, 18 nt, Artificial Sequence
  Description of Artificial Sequence: Synthetic oligonucleotide
gagaagagaccgggcaug

SEQ ID NO: 23839 - RNA, 18 nt, Artificial Sequence
  Description of Artificial Sequence: Synthetic oligonucleotide
agacugagaagagaccgg

SEQ ID NO: 23840 - RNA, 18 nt, Artificial Sequence
  Description of Artificial Sequence: Synthetic oligonucleotide
cuucaagacugagaagag

SEQ ID NO: 23841 - RNA, 18 nt, Artificial Sequence
  Description of Artificial Sequence: Synthetic oligonucleotide
augggcuucaagacugag

SEQ ID NO: 23842 - RNA, 18 nt, Artificial Sequence
  Description of Artificial Sequence: Synthetic oligonucleotide
cagggaugggcuucaaga

SEQ ID NO: 23843 - RNA, 18 nt, Artificial Sequence
  Description of Artificial Sequence: Synthetic oligonucleotide
aaauccagggaugggcuu

SEQ ID NO: 23844 - RNA, 18 nt, Artificial Sequence
  Description of Artificial Sequence: Synthetic oligonucleotide
gguggaaauccagggaug

SEQ ID NO: 23845 - RNA, 18 nt, Artificial Sequence
  Description of Artificial Sequence: Synthetic oligonucleotide
cuccugguggaaauccag

SEQ ID NO: 23846 - RNA, 18 nt, Artificial Sequence
  Description of Artificial Sequence: Synthetic oligonucleotide
aguaacuccugguggaaa

SEQ ID NO: 23847 - RNA, 18 nt, Artificial Sequence
  Description of Artificial Sequence: Synthetic oligonucleotide
aggaaaguaacuccuggu

SEQ ID NO: 23848 - RNA, 18 nt, Artificial Sequence
  Description of Artificial Sequence: Synthetic oligonucleotide
ucaggaggaaaguaacuc

SEQ ID NO: 23849 - RNA, 18 nt, Artificial Sequence
  Description of Artificial Sequence: Synthetic oligonucleotide
acaggucaggaggaaagu

SEQ ID NO: 23850 - RNA, 18 nt, Artificial Sequence
  Description of Artificial Sequence: Synthetic oligonucleotide
aauuuacaggucaggagg

SEQ ID NO: 23851 - RNA, 18 nt, Artificial Sequence
  Description of Artificial Sequence: Synthetic oligonucleotide
gaacaaauuuacagguca

SEQ ID NO: 23852 - RNA, 18 nt, Artificial Sequence
  Description of Artificial Sequence: Synthetic oligonucleotide
uuaaagaacaaauuuaca

SEQ ID NO: 23853 - RNA, 18 nt, Artificial Sequence
  Description of Artificial Sequence: Synthetic oligonucleotide
cauuguuaaagaacaaau

SEQ ID NO: 23854 - RNA, 18 nt, Artificial Sequence
  Description of Artificial Sequence: Synthetic oligonucleotide
gcagccauuguuaaagaa

SEQ ID NO: 23855 - RNA, 18 nt, Artificial Sequence
  Description of Artificial Sequence: Synthetic oligonucleotide
caccugcagccauuguua

SEQ ID NO: 23856 - RNA, 18 nt, Artificial Sequence
  Description of Artificial Sequence: Synthetic oligonucleotide
gcucccaccugcagccau

SEQ ID NO: 23857 - RNA, 18 nt, Artificial Sequence
  Description of Artificial Sequence: Synthetic oligonucleotide
cauaugcucccaccugca

SEQ ID NO: 23858 - RNA, 18 nt, Artificial Sequence
  Description of Artificial Sequence: Synthetic oligonucleotide
accaccauaugcucccac

SEQ ID NO: 23859 - RNA, 18 nt, Artificial Sequence
  Description of Artificial Sequence: Synthetic oligonucleotide
uauaaaccaccauaugcu

SEQ ID NO: 23860 - RNA, 18 nt, Artificial Sequence
  Description of Artificial Sequence: Synthetic oligonucleotide
guuuuuauaaaccaccau

SEQ ID NO: 23861 - RNA, 18 nt, Artificial Sequence
  Description of Artificial Sequence: Synthetic oligonucleotide
acagcguuuuuauaaacc

SEQ ID NO: 23862 - RNA, 18 nt, Artificial Sequence
  Description of Artificial Sequence: Synthetic oligonucleotide
gcccgacagcguuuuuau

SEQ ID NO: 23863 - RNA, 18 nt, Artificial Sequence
  Description of Artificial Sequence: Synthetic oligonucleotide
acaaagcccgacagcguu

SEQ ID NO: 23864 - RNA, 18 nt, Artificial Sequence
  Description of Artificial Sequence: Synthetic oligonucleotide
aggaaacaaagcccgaca

SEQ ID NO: 23865 - RNA, 18 nt, Artificial Sequence
  Description of Artificial Sequence: Synthetic oligonucleotide
aaagaaggaaacaaagcc

SEQ ID NO: 23866 - RNA, 18 nt, Artificial Sequence
  Description of Artificial Sequence: Synthetic oligonucleotide
cagcuaaagaaggaaaca

SEQ ID NO: 23867 - RNA, 18 nt, Artificial Sequence
  Description of Artificial Sequence: Synthetic oligonucleotide
cacggcagcuaaagaagg

SEQ ID NO: 23868 - RNA, 18 nt, Artificial Sequence
  Description of Artificial Sequence: Synthetic oligonucleotide
guagacacggcagcuaaa

SEQ ID NO: 23869 - RNA, 18 nt, Artificial Sequence
  Description of Artificial Sequence: Synthetic oligonucleotide
cagaaguagacacggcag

SEQ ID NO: 23870 - RNA, 18 nt, Artificial Sequence
  Description of Artificial Sequence: Synthetic oligonucleotide
gacuucagaaguagacac

SEQ ID NO: 23871 - RNA, 18 nt, Artificial Sequence
  Description of Artificial Sequence: Synthetic oligonucleotide
ucccagacuucagaagua

SEQ ID NO: 23872 - RNA, 18 nt, Artificial Sequence
  Description of Artificial Sequence: Synthetic oligonucleotide
gcacuucccagacuucag

SEQ ID NO: 23873 - RNA, 18 nt, Artificial Sequence
  Description of Artificial Sequence: Synthetic oligonucleotide
gcuuggcacuucccagac

SEQ ID NO: 23874 - RNA, 18 nt, Artificial Sequence
  Description of Artificial Sequence: Synthetic oligonucleotide
gcguggcuuggcacuucc

SEQ ID NO: 23875 - RNA, 18 nt, Artificial Sequence
  Description of Artificial Sequence: Synthetic oligonucleotide
aggccgcguggcuuggca

SEQ ID NO: 23876 - RNA, 18 nt, Artificial Sequence
  Description of Artificial Sequence: Synthetic oligonucleotide
ccuugaggccgcguggcu

SEQ ID NO: 23877 - RNA, 18 nt, Artificial Sequence
  Description of Artificial Sequence: Synthetic oligonucleotide
agcucccuugaggccgcg

SEQ ID NO: 23878 - RNA, 18 nt, Artificial Sequence
  Description of Artificial Sequence: Synthetic oligonucleotide
cagccagcucccuugagg

SEQ ID NO: 23879 - RNA, 18 nt, Artificial Sequence
  Description of Artificial Sequence: Synthetic oligonucleotide
aacaccagccagcucccu

SEQ ID NO: 23880 - RNA, 18 nt, Artificial Sequence
  Description of Artificial Sequence: Synthetic oligonucleotide
gcucaaacaccagccagc

SEQ ID NO: 23881 - RNA, 18 nt, Artificial Sequence
  Description of Artificial Sequence: Synthetic oligonucleotide
ccacagcucaaacaccag

SEQ ID NO: 23882 - RNA, 18 nt, Artificial Sequence
  Description of Artificial Sequence: Synthetic oligonucleotide
uucugccacagcucaaac

SEQ ID NO: 23883 - RNA, 18 nt, Artificial Sequence
  Description of Artificial Sequence: Synthetic oligonucleotide
ggugcuucugccacagcu

SEQ ID NO: 23884 - RNA, 18 nt, Artificial Sequence
  Description of Artificial Sequence: Synthetic oligonucleotide
ccccaggugcuucugcca

SEQ ID NO: 23885 - RNA, 18 nt, Artificial Sequence
  Description of Artificial Sequence: Synthetic oligonucleotide
uggagccccaggugcuuc

SEQ ID NO: 23886 - RNA, 18 nt, Artificial Sequence
  Description of Artificial Sequence: Synthetic oligonucleotide
cucccuggagccccaggu

SEQ ID NO: 23887 - RNA, 18 nt, Artificial Sequence
  Description of Artificial Sequence: Synthetic oligonucleotide
gccugcucccuggagccc

SEQ ID NO: 23888 - RNA, 18 nt, Artificial Sequence
  Description of Artificial Sequence: Synthetic oligonucleotide
ucccagccugcucccugg

SEQ ID NO: 23889 - RNA, 18 nt, Artificial Sequence
  Description of Artificial Sequence: Synthetic oligonucleotide
gcaguucccagccugcuc

SEQ ID NO: 23890 - RNA, 18 nt, Artificial Sequence
  Description of Artificial Sequence: Synthetic oligonucleotide
guccugcaguucccagcc

SEQ ID NO: 23891 - RNA, 18 nt, Artificial Sequence
  Description of Artificial Sequence: Synthetic oligonucleotide
gcaagguccugcaguucc

SEQ ID NO: 23892 - RNA, 18 nt, Artificial Sequence
  Description of Artificial Sequence: Synthetic oligonucleotide
gcugagcaagguccugca

SEQ ID NO: 23893 - RNA, 18 nt, Artificial Sequence
  Description of Artificial Sequence: Synthetic oligonucleotide
uccuggcugagcaagguc

SEQ ID NO: 23894 - RNA, 18 nt, Artificial Sequence
  Description of Artificial Sequence: Synthetic oligonucleotide
agugcuccuggcugagca

SEQ ID NO: 23895 - RNA, 18 nt, Artificial Sequence
  Description of Artificial Sequence: Synthetic oligonucleotide
gggaagugcuccuggcug

SEQ ID NO: 23896 - RNA, 18 nt, Artificial Sequence
  Description of Artificial Sequence: Synthetic oligonucleotide
uuccugccucaaggaggg

SEQ ID NO: 23897 - RNA, 18 nt, Artificial Sequence
  Description of Artificial Sequence: Synthetic oligonucleotide
caguauuccugccucaag

SEQ ID NO: 23898 - RNA, 18 nt, Artificial Sequence
  Description of Artificial Sequence: Synthetic oligonucleotide
caccucaguauuccugcc

SEQ ID NO: 23899 - RNA, 18 nt, Artificial Sequence
  Description of Artificial Sequence: Synthetic oligonucleotide
ggaggcaccucaguauuc

SEQ ID NO: 23900 - RNA, 18 nt, Artificial Sequence
  Description of Artificial Sequence: Synthetic oligonucleotide
gggaggcaccucaguauu

SEQ ID NO: 23901 - RNA, 18 nt, Artificial Sequence
  Description of Artificial Sequence: Synthetic oligonucleotide
accuucuccaucuguggg

SEQ ID NO: 23902 - RNA, 18 nt, Artificial Sequence
  Description of Artificial Sequence: Synthetic oligonucleotide
ucuccaccuucuccaucu

SEQ ID NO: 23903 - RNA, 18 nt, Artificial Sequence
  Description of Artificial Sequence: Synthetic oligonucleotide
ccuccucuccaccuucuc

SEQ ID NO: 23904 - RNA, 18 nt, Artificial Sequence
  Description of Artificial Sequence: Synthetic oligonucleotide
cccauccuccucuccacc

SEQ ID NO: 23905 - RNA, 18 nt, Artificial Sequence
  Description of Artificial Sequence: Synthetic oligonucleotide
ugaggcccauccuccucu

SEQ ID NO: 23906 - RNA, 18 nt, Artificial Sequence
  Description of Artificial Sequence: Synthetic oligonucleotide
gcuccugaggcccauccu

SEQ ID NO: 23907 - RNA, 18 nt, Artificial Sequence
  Description of Artificial Sequence: Synthetic oligonucleotide
gagaugcuccugaggccc

SEQ ID NO: 23908 - RNA, 18 nt, Artificial Sequence
  Description of Artificial Sequence: Synthetic oligonucleotide
ggcuugagaugcuccuga

SEQ ID NO: 23909 - RNA, 18 nt, Artificial Sequence
  Description of Artificial Sequence: Synthetic oligonucleotide
gggcuugagaugcuccug

SEQ ID NO: 23910 - RNA, 18 nt, Artificial Sequence
  Description of Artificial Sequence: Synthetic oligonucleotide
cuuucuccugcuacuggg

SEQ ID NO: 23911 - RNA, 18 nt, Artificial Sequence
  Description of Artificial Sequence: Synthetic oligonucleotide
ucuuucuuucuccugcua

SEQ ID NO: 23912 - RNA, 18 nt, Artificial Sequence
  Description of Artificial Sequence: Synthetic oligonucleotide
cucuuucuuucuuucucc

SEQ ID NO: 23913 - RNA, 18 nt, Artificial Sequence
  Description of Artificial Sequence: Synthetic oligonucleotide
ggcaucucuuucuuucuu

SEQ ID NO: 23914 - RNA, 18 nt, Artificial Sequence
  Description of Artificial Sequence: Synthetic oligonucleotide
aaccaggcaucucuuucu

SEQ ID NO: 23915 - RNA, 18 nt, Artificial Sequence
  Description of Artificial Sequence: Synthetic oligonucleotide
gugaaaaccaggcaucuc

SEQ ID NO: 23916 - RNA, 18 nt, Artificial Sequence
  Description of Artificial Sequence: Synthetic oligonucleotide
agucugugaaaaccaggc

SEQ ID NO: 23917 - RNA, 18 nt, Artificial Sequence
  Description of Artificial Sequence: Synthetic oligonucleotide
gaaccagucugugaaaac

SEQ ID NO: 23918 - RNA, 18 nt, Artificial Sequence
  Description of Artificial Sequence: Synthetic oligonucleotide
cacaggaaccagucugug

SEQ ID NO: 23919 - RNA, 18 nt, Artificial Sequence
  Description of Artificial Sequence: Synthetic oligonucleotide
ccagccacaggaaccagu

SEQ ID NO: 23920 - RNA, 18 nt, Artificial Sequence
  Description of Artificial Sequence: Synthetic oligonucleotide
ucaucccagccacaggaa

SEQ ID NO: 23921 - RNA, 18 nt, Artificial Sequence
  Description of Artificial Sequence: Synthetic oligonucleotide
ugcagucaucccagccac

SEQ ID NO: 23922 - RNA, 18 nt, Artificial Sequence
  Description of Artificial Sequence: Synthetic oligonucleotide
aaggaugcagucauccca

SEQ ID NO: 23923 - RNA, 18 nt, Artificial Sequence
  Description of Artificial Sequence: Synthetic oligonucleotide
aaaaaaaggaugcaguca

SEQ ID NO: 23924 - RNA, 18 nt, Artificial Sequence
  Description of Artificial Sequence: Synthetic oligonucleotide
aaaaaaaaaaaaggaugc

SEQ ID NO: 23925 - RNA, 18 nt, Artificial Sequence
  Description of Artificial Sequence: Synthetic oligonucleotide
caaaaaaaaaaaaaaaag

SEQ ID NO: 23926 - RNA, 18 nt, Artificial Sequence
  Description of Artificial Sequence: Synthetic oligonucleotide
cgucucaaaaaaaaaaaa

SEQ ID NO: 23927 - RNA, 18 nt, Artificial Sequence
  Description of Artificial Sequence: Synthetic oligonucleotide
aacuccgucucaaaaaaa

SEQ ID NO: 23928 - RNA, 18 nt, Artificial Sequence
  Description of Artificial Sequence: Synthetic oligonucleotide
gcaaaaacuccgucucaa

SEQ ID NO: 23929 - RNA, 18 nt, Artificial Sequence
  Description of Artificial Sequence: Synthetic oligonucleotide
caaaggcaaaaacuccgu

SEQ ID NO: 23930 - RNA, 18 nt, Artificial Sequence
  Description of Artificial Sequence: Synthetic oligonucleotide
ggcgacaaaggcaaaaac

SEQ ID NO: 23931 - RNA, 18 nt, Artificial Sequence
  Description of Artificial Sequence: Synthetic oligonucleotide
gccugggcgacaaaggca

SEQ ID NO: 23932 - RNA, 18 nt, Artificial Sequence
  Description of Artificial Sequence: Synthetic oligonucleotide
cuccagccugggcgacaa

SEQ ID NO: 23933 - RNA, 18 nt, Artificial Sequence
  Description of Artificial Sequence: Synthetic oligonucleotide
uugcacuccagccugggc

SEQ ID NO: 23934 - RNA, 18 nt, Artificial Sequence
  Description of Artificial Sequence: Synthetic oligonucleotide
cgccauugcacuccagcc

SEQ ID NO: 23935 - RNA, 18 nt, Artificial Sequence
  Description of Artificial Sequence: Synthetic oligonucleotide
gaucacgccauugcacuc

SEQ ID NO: 23936 - RNA, 18 nt, Artificial Sequence
  Description of Artificial Sequence: Synthetic oligonucleotide
gccgagaucacgccauug

SEQ ID NO: 23937 - RNA, 18 nt, Artificial Sequence
  Description of Artificial Sequence: Synthetic oligonucleotide
ggugagccgagaucacgc

SEQ ID NO: 23938 - RNA, 18 nt, Artificial Sequence
  Description of Artificial Sequence: Synthetic oligonucleotide
guugcggugagccgagau

SEQ ID NO: 23939 - RNA, 18 nt, Artificial Sequence
  Description of Artificial Sequence: Synthetic oligonucleotide
cggagguugcggugagcc

SEQ ID NO: 23940 - RNA, 18 nt, Artificial Sequence
  Description of Artificial Sequence: Synthetic oligonucleotide
ggaggcggagguugcggu

SEQ ID NO: 23941 - RNA, 18 nt, Artificial Sequence
  Description of Artificial Sequence: Synthetic oligonucleotide
auccgggaggcggagguu

SEQ ID NO: 23942 - RNA, 18 nt, Artificial Sequence
  Description of Artificial Sequence: Synthetic oligonucleotide
cuugaauccgggaggcgg

SEQ ID NO: 23943 - RNA, 18 nt, Artificial Sequence
  Description of Artificial Sequence: Synthetic oligonucleotide
aauugcuugaauccggga

SEQ ID NO: 23944 - RNA, 18 nt, Artificial Sequence
  Description of Artificial Sequence: Synthetic oligonucleotide
aggagaauugcuugaauc

SEQ ID NO: 23945 - RNA, 18 nt, Artificial Sequence
  Description of Artificial Sequence: Synthetic oligonucleotide
gaggcaggagaauugcuu

SEQ ID NO: 23946 - RNA, 18 nt, Artificial Sequence
  Description of Artificial Sequence: Synthetic oligonucleotide
aggcugaggcaggagaau

SEQ ID NO: 23947 - RNA, 18 nt, Artificial Sequence
  Description of Artificial Sequence: Synthetic oligonucleotide
ucgggaggcugaggcagg

SEQ ID NO: 23948 - RNA, 18 nt, Artificial Sequence
  Description of Artificial Sequence: Synthetic oligonucleotide
gcuacucgggaggcugag

SEQ ID NO: 23949 - RNA, 18 nt, Artificial Sequence
  Description of Artificial Sequence: Synthetic oligonucleotide
ucccagcuacucgggagg

SEQ ID NO: 23950 - RNA, 18 nt, Artificial Sequence
  Description of Artificial Sequence: Synthetic oligonucleotide
uguaaucccagcuacucg

SEQ ID NO: 23951 - RNA, 18 nt, Artificial Sequence
  Description of Artificial Sequence: Synthetic oligonucleotide
gugccuguaaucccagcu

SEQ ID NO: 23952 - RNA, 18 nt, Artificial Sequence
  Description of Artificial Sequence: Synthetic oligonucleotide
ggugcgugccuguaaucc

SEQ ID NO: 23953 - RNA, 18 nt, Artificial Sequence
  Description of Artificial Sequence: Synthetic oligonucleotide
guggaggugcgugccugu

SEQ ID NO: 23954 - RNA, 18 nt, Artificial Sequence
  Description of Artificial Sequence: Synthetic oligonucleotide
cggacguggaggugcgug

SEQ ID NO: 23955 - RNA, 18 nt, Artificial Sequence
  Description of Artificial Sequence: Synthetic oligonucleotide
uuagccggacguggaggu

SEQ ID NO: 23956 - RNA, 18 nt, Artificial Sequence
  Description of Artificial Sequence: Synthetic oligonucleotide
caaaauuagccggacgug

SEQ ID NO: 23957 - RNA, 18 nt, Artificial Sequence
  Description of Artificial Sequence: Synthetic oligonucleotide
aaauacaaaauuagccgg

SEQ ID NO: 23958 - RNA, 18 nt, Artificial Sequence
  Description of Artificial Sequence: Synthetic oligonucleotide
acuaaaaauacaaaauua

SEQ ID NO: 23959 - RNA, 18 nt, Artificial Sequence
  Description of Artificial Sequence: Synthetic oligonucleotide
ucuccacuaaaaauacaa

SEQ ID NO: 23960 - RNA, 18 nt, Artificial Sequence
  Description of Artificial Sequence: Synthetic oligonucleotide
ccccgucuccacuaaaaa

SEQ ID NO: 23961 - RNA, 18 nt, Artificial Sequence
  Description of Artificial Sequence: Synthetic oligonucleotide
agaaaccccgucuccacu

SEQ ID NO: 23962 - RNA, 18 nt, Artificial Sequence
  Description of Artificial Sequence: Synthetic oligonucleotide
cauggagaaaccccgucu

SEQ ID NO: 23963 - RNA, 18 nt, Artificial Sequence
  Description of Artificial Sequence: Synthetic oligonucleotide
accgacauggagaaaccc

SEQ ID NO: 23964 - RNA, 18 nt, Artificial Sequence
  Description of Artificial Sequence: Synthetic oligonucleotide
gccugaccgacauggaga

SEQ ID NO: 23965 - RNA, 18 nt, Artificial Sequence
  Description of Artificial Sequence: Synthetic oligonucleotide
gaccagccugaccgacau

SEQ ID NO: 23966 - RNA, 18 nt, Artificial Sequence
  Description of Artificial Sequence: Synthetic oligonucleotide
uucgagaccagccugacc

SEQ ID NO: 23967 - RNA, 18 nt, Artificial Sequence
  Description of Artificial Sequence: Synthetic oligonucleotide
gggaguucgagaccagcc

SEQ ID NO: 23968 - RNA, 18 nt, Artificial Sequence
  Description of Artificial Sequence: Synthetic oligonucleotide
aggucgggaguucgagac

SEQ ID NO: 23969 - RNA, 18 nt, Artificial Sequence
  Description of Artificial Sequence: Synthetic oligonucleotide
accugaggucgggaguuc

SEQ ID NO: 23970 - RNA, 18 nt, Artificial Sequence
  Description of Artificial Sequence: Synthetic oligonucleotide
agaucaccugaggucggg

SEQ ID NO: 23971 - RNA, 18 nt, Artificial Sequence
  Description of Artificial Sequence: Synthetic oligonucleotide
ugggcagaucaccugagg

SEQ ID NO: 23972 - RNA, 18 nt, Artificial Sequence
  Description of Artificial Sequence: Synthetic oligonucleotide
cgaggugggcagaucacc

SEQ ID NO: 23973 - RNA, 18 nt, Artificial Sequence
  Description of Artificial Sequence: Synthetic oligonucleotide
gaggccgaggugggcaga

SEQ ID NO: 23974 - RNA, 18 nt, Artificial Sequence
  Description of Artificial Sequence: Synthetic oligonucleotide
uuugggaggccgaggugg

SEQ ID NO: 23975 - RNA, 18 nt, Artificial Sequence
  Description of Artificial Sequence: Synthetic oligonucleotide
agcacuuugggaggccga

SEQ ID NO: 23976 - RNA, 18 nt, Artificial Sequence
  Description of Artificial Sequence: Synthetic oligonucleotide
aucccagcacuuugggag

SEQ ID NO: 23977 - RNA, 18 nt, Artificial Sequence
  Description of Artificial Sequence: Synthetic oligonucleotide
cuguaaucccagcacuuu

SEQ ID NO: 23978 - RNA, 18 nt, Artificial Sequence
  Description of Artificial Sequence: Synthetic oligonucleotide
caugccuguaaucccagc

SEQ ID NO: 23979 - RNA, 18 nt, Artificial Sequence
  Description of Artificial Sequence: Synthetic oligonucleotide
uggcucaugccuguaauc

SEQ ID NO: 23980 - RNA, 18 nt, Artificial Sequence
  Description of Artificial Sequence: Synthetic oligonucleotide
cgcgguggcucaugccug

SEQ ID NO: 23981 - RNA, 18 nt, Artificial Sequence
  Description of Artificial Sequence: Synthetic oligonucleotide
ccaagcgcgguggcucau

SEQ ID NO: 23982 - RNA, 18 nt, Artificial Sequence
  Description of Artificial Sequence: Synthetic oligonucleotide
ucuggccaagcgcggugg

SEQ ID NO: 23983 - RNA, 18 nt, Artificial Sequence
  Description of Artificial Sequence: Synthetic oligonucleotide
cgcagucuggccaagcgc

SEQ ID NO: 23984 - RNA, 18 nt, Artificial Sequence
  Description of Artificial Sequence: Synthetic oligonucleotide
aaggacgcagucuggcca

SEQ ID NO: 23985 - RNA, 18 nt, Artificial Sequence
  Description of Artificial Sequence: Synthetic oligonucleotide
uuaaaaaggacgcagucu

SEQ ID NO: 23986 - RNA, 18 nt, Artificial Sequence
  Description of Artificial Sequence: Synthetic oligonucleotide
uucgcuuaaaaaggacgc

SEQ ID NO: 23987 - RNA, 18 nt, Artificial Sequence
  Description of Artificial Sequence: Synthetic oligonucleotide
aaauguucgcuuaaaaag

SEQ ID NO: 23988 - RNA, 18 nt, Artificial Sequence
  Description of Artificial Sequence: Synthetic oligonucleotide
cccuaaaauguucgcuua

SEQ ID NO: 23989 - RNA, 18 nt, Artificial Sequence
  Description of Artificial Sequence: Synthetic oligonucleotide
ccaggcccuaaaauguuc

SEQ ID NO: 23990 - RNA, 18 nt, Artificial Sequence
  Description of Artificial Sequence: Synthetic oligonucleotide
aacucccaggcccuaaaa

SEQ ID NO: 23991 - RNA, 18 nt, Artificial Sequence
  Description of Artificial Sequence: Synthetic oligonucleotide
ugacaaacucccaggccc

SEQ ID NO: 23992 - RNA, 18 nt, Artificial Sequence
  Description of Artificial Sequence: Synthetic oligonucleotide
uuacuugacaaacuccca

SEQ ID NO: 23993 - RNA, 18 nt, Artificial Sequence
  Description of Artificial Sequence: Synthetic oligonucleotide
cuuccuuacuugacaaac

SEQ ID NO: 23994 - RNA, 18 nt, Artificial Sequence
  Description of Artificial Sequence: Synthetic oligonucleotide
ugagacuuccuuacuuga

SEQ ID NO: 23995 - RNA, 18 nt, Artificial Sequence
  Description of Artificial Sequence: Synthetic oligonucleotide
gggcuugagacuuccuua

SEQ ID NO: 23996 - RNA, 18 nt, Artificial Sequence
  Description of Artificial Sequence: Synthetic oligonucleotide
ucuuugggcuugagacuu

SEQ ID NO: 23997 - RNA, 18 nt, Artificial Sequence
  Description of Artificial Sequence: Synthetic oligonucleotide
gcugcucuuugggcuuga

SEQ ID NO: 23998 - RNA, 18 nt, Artificial Sequence
  Description of Artificial Sequence: Synthetic oligonucleotide
aggacgcugcucuuuggg

SEQ ID NO: 23999 - RNA, 18 nt, Artificial Sequence
  Description of Artificial Sequence: Synthetic oligonucleotide
uggucaggacgcugcucu

SEQ ID NO: 24000 - RNA, 18 nt, Artificial Sequence
  Description of Artificial Sequence: Synthetic oligonucleotide
caccauggucaggacgcu

SEQ ID NO: 24001 - RNA, 18 nt, Artificial Sequence
  Description of Artificial Sequence: Synthetic oligonucleotide
gaaaccaccauggucagg

SEQ ID NO: 24002 - RNA, 18 nt, Artificial Sequence
  Description of Artificial Sequence: Synthetic oligonucleotide
guaaugaaaccaccaugg

SEQ ID NO: 24003 - RNA, 18 nt, Artificial Sequence
  Description of Artificial Sequence: Synthetic oligonucleotide
ggcucguaaugaaaccac

SEQ ID NO: 24004 - RNA, 18 nt, Artificial Sequence
  Description of Artificial Sequence: Synthetic oligonucleotide
agaagggcucguaaugaa

SEQ ID NO: 24005 - RNA, 18 nt, Artificial Sequence
  Description of Artificial Sequence: Synthetic oligonucleotide
ccagcagaagggcucgua

SEQ ID NO: 24006 - RNA, 18 nt, Artificial Sequence
  Description of Artificial Sequence: Synthetic oligonucleotide
gagagccagcagaagggc

SEQ ID NO: 24007 - RNA, 18 nt, Artificial Sequence
  Description of Artificial Sequence: Synthetic oligonucleotide
ugccugagagccagcaga

SEQ ID NO: 24008 - RNA, 18 nt, Artificial Sequence
  Description of Artificial Sequence: Synthetic oligonucleotide
gcuucugccugagagcca

SEQ ID NO: 24009 - RNA, 18 nt, Artificial Sequence
  Description of Artificial Sequence: Synthetic oligonucleotide
gggcuucugccugagagc

SEQ ID NO: 24010 - RNA, 18 nt, Artificial Sequence
  Description of Artificial Sequence: Synthetic oligonucleotide
uggucccggugcuguggg

SEQ ID NO: 24011 - RNA, 18 nt, Artificial Sequence
  Description of Artificial Sequence: Synthetic oligonucleotide
augaauggucccggugcu

SEQ ID NO: 24012 - RNA, 18 nt, Artificial Sequence
  Description of Artificial Sequence: Synthetic oligonucleotide
accucaugaauggucccg

SEQ ID NO: 24013 - RNA, 18 nt, Artificial Sequence
  Description of Artificial Sequence: Synthetic oligonucleotide
cagugaccucaugaaugg

SEQ ID NO: 24014 - RNA, 18 nt, Artificial Sequence
  Description of Artificial Sequence: Synthetic oligonucleotide
cugggcagugaccucaug

SEQ ID NO: 24015 - RNA, 18 nt, Artificial Sequence
  Description of Artificial Sequence: Synthetic oligonucleotide
augagcugggcagugacc

SEQ ID NO: 24016 - RNA, 18 nt, Artificial Sequence
  Description of Artificial Sequence: Synthetic oligonucleotide
acaucaugagcugggcag

SEQ ID NO: 24017 - RNA, 18 nt, Artificial Sequence
  Description of Artificial Sequence: Synthetic oligonucleotide
cacggacaucaugagcug

SEQ ID NO: 24018 - RNA, 18 nt, Artificial Sequence
  Description of Artificial Sequence: Synthetic oligonucleotide
agccucacggacaucaug

SEQ ID NO: 24019 - RNA, 18 nt, Artificial Sequence
  Description of Artificial Sequence: Synthetic oligonucleotide
aggacagccucacggaca

SEQ ID NO: 24020 - RNA, 18 nt, Artificial Sequence
  Description of Artificial Sequence: Synthetic oligonucleotide
ccaaaaggacagccucac

SEQ ID NO: 24021 - RNA, 18 nt, Artificial Sequence
  Description of Artificial Sequence: Synthetic oligonucleotide
acuggccaaaaggacagc

SEQ ID NO: 24022 - RNA, 18 nt, Artificial Sequence
  Description of Artificial Sequence: Synthetic oligonucleotide
cggcuacuggccaaaagg

SEQ ID NO: 24023 - RNA, 18 nt, Artificial Sequence
  Description of Artificial Sequence: Synthetic oligonucleotide
gcacacggcuacuggcca

SEQ ID NO: 24024 - RNA, 18 nt, Artificial Sequence
  Description of Artificial Sequence: Synthetic oligonucleotide
cagcugcacacggcuacu

SEQ ID NO: 24025 - RNA, 18 nt, Artificial Sequence
  Description of Artificial Sequence: Synthetic oligonucleotide
ccacacagcugcacacgg

SEQ ID NO: 24026 - RNA, 18 nt, Artificial Sequence
  Description of Artificial Sequence: Synthetic oligonucleotide
cugugccacacagcugca

SEQ ID NO: 24027 - RNA, 18 nt, Artificial Sequence
  Description of Artificial Sequence: Synthetic oligonucleotide
gccaucugugccacacag

SEQ ID NO: 24028 - RNA, 18 nt, Artificial Sequence
  Description of Artificial Sequence: Synthetic oligonucleotide
acgaagccaucugugcca

SEQ ID NO: 24029 - RNA, 18 nt, Artificial Sequence
  Description of Artificial Sequence: Synthetic oligonucleotide
gaugaacgaagccaucug

SEQ ID NO: 24030 - RNA, 18 nt, Artificial Sequence
  Description of Artificial Sequence: Synthetic oligonucleotide
aucaggaugaacgaagcc

SEQ ID NO: 24031 - RNA, 18 nt, Artificial Sequence
  Description of Artificial Sequence: Synthetic oligonucleotide
ccuugaucaggaugaacg

SEQ ID NO: 24032 - RNA, 18 nt, Artificial Sequence
  Description of Artificial Sequence: Synthetic oligonucleotide
gggccuugaucaggauga

SEQ ID NO: 24033 - RNA, 18 nt, Artificial Sequence
  Description of Artificial Sequence: Synthetic oligonucleotide
ugcuguggcugagguggg

SEQ ID NO: 24034 - RNA, 18 nt, Artificial Sequence
  Description of Artificial Sequence: Synthetic oligonucleotide
gggacugcuguggcugag

SEQ ID NO: 24035 - RNA, 18 nt, Artificial Sequence
  Description of Artificial Sequence: Synthetic oligonucleotide
gguggacaacacagguug

SEQ ID NO: 24036 - RNA, 18 nt, Artificial Sequence
  Description of Artificial Sequence: Synthetic oligonucleotide
aauaggguggacaacaca

SEQ ID NO: 24037 - RNA, 18 nt, Artificial Sequence
  Description of Artificial Sequence: Synthetic oligonucleotide
ugaauaauaggguggaca

SEQ ID NO: 24038 - RNA, 18 nt, Artificial Sequence
  Description of Artificial Sequence: Synthetic oligonucleotide
guacaugaauaauagggu

SEQ ID NO: 24039 - RNA, 18 nt, Artificial Sequence
  Description of Artificial Sequence: Synthetic oligonucleotide
ggcagguacaugaauaau

SEQ ID NO: 24040 - RNA, 18 nt, Artificial Sequence
  Description of Artificial Sequence: Synthetic oligonucleotide
ggccuggcagguacauga

SEQ ID NO: 24041 - RNA, 18 nt, Artificial Sequence
  Description of Artificial Sequence: Synthetic oligonucleotide
agcagggccuggcaggua

SEQ ID NO: 24042 - RNA, 18 nt, Artificial Sequence
  Description of Artificial Sequence: Synthetic oligonucleotide
uaucuagcagggccuggc

SEQ ID NO: 24043 - RNA, 18 nt, Artificial Sequence
  Description of Artificial Sequence: Synthetic oligonucleotide
ggugcuaucuagcagggc

SEQ ID NO: 24044 - RNA, 18 nt, Artificial Sequence
  Description of Artificial Sequence: Synthetic oligonucleotide
gggugcuaucuagcaggg

SEQ ID NO: 24045 - RNA, 18 nt, Artificial Sequence
  Description of Artificial Sequence: Synthetic oligonucleotide
guuauguaaugccacggg

SEQ ID NO: 24046 - RNA, 18 nt, Artificial Sequence
  Description of Artificial Sequence: Synthetic oligonucleotide
gaaguguuauguaaugcc

SEQ ID NO: 24047 - RNA, 18 nt, Artificial Sequence
  Description of Artificial Sequence: Synthetic oligonucleotide
cucaugaaguguuaugua

SEQ ID NO: 24048 - RNA, 18 nt, Artificial Sequence
  Description of Artificial Sequence: Synthetic oligonucleotide
agccacucaugaaguguu

SEQ ID NO: 24049 - RNA, 18 nt, Artificial Sequence
  Description of Artificial Sequence: Synthetic oligonucleotide
gacacagccacucaugaa

SEQ ID NO: 24050 - RNA, 18 nt, Artificial Sequence
  Description of Artificial Sequence: Synthetic oligonucleotide
uacaagacacagccacuc

SEQ ID NO: 24051 - RNA, 18 nt, Artificial Sequence
  Description of Artificial Sequence: Synthetic oligonucleotide
aaaauuacaagacacagc

SEQ ID NO: 24052 - RNA, 18 nt, Artificial Sequence
  Description of Artificial Sequence: Synthetic oligonucleotide
uccccaaaauuacaagac

SEQ ID NO: 24053 - RNA, 18 nt, Artificial Sequence
  Description of Artificial Sequence: Synthetic oligonucleotide
accuguccccaaaauuac

SEQ ID NO: 24054 - RNA, 18 nt, Artificial Sequence
  Description of Artificial Sequence: Synthetic oligonucleotide
gagaaaccuguccccaaa

SEQ ID NO: 24055 - RNA, 18 nt, Artificial Sequence
  Description of Artificial Sequence: Synthetic oligonucleotide
aaagagagaaaccugucc

SEQ ID NO: 24056 - RNA, 18 nt, Artificial Sequence
  Description of Artificial Sequence: Synthetic oligonucleotide
gagggaaagagagaaacc

SEQ ID NO: 24057 - RNA, 18 nt, Artificial Sequence
  Description of Artificial Sequence: Synthetic oligonucleotide
aaagagagggaaagagag

SEQ ID NO: 24058 - RNA, 18 nt, Artificial Sequence
  Description of Artificial Sequence: Synthetic oligonucleotide
aaaaaaaagagagggaaa

SEQ ID NO: 24059 - RNA, 18 nt, Artificial Sequence
  Description of Artificial Sequence: Synthetic oligonucleotide
uugacaaaaaaaagagag

SEQ ID NO: 24060 - RNA, 18 nt, Artificial Sequence
  Description of Artificial Sequence: Synthetic oligonucleotide
ggcuuuugacaaaaaaaa

SEQ ID NO: 24061 - RNA, 18 nt, Artificial Sequence
  Description of Artificial Sequence: Synthetic oligonucleotide
cucugggcuuuugacaaa

SEQ ID NO: 24062 - RNA, 18 nt, Artificial Sequence
  Description of Artificial Sequence: Synthetic oligonucleotide
ucagucucugggcuuuug

SEQ ID NO: 24063 - RNA, 18 nt, Artificial Sequence
  Description of Artificial Sequence: Synthetic oligonucleotide
gguugucagucucugggc

SEQ ID NO: 24064 - RNA, 18 nt, Artificial Sequence
  Description of Artificial Sequence: Synthetic oligonucleotide
cagcugguugucagucuc

SEQ ID NO: 24065 - RNA, 18 nt, Artificial Sequence
  Description of Artificial Sequence: Synthetic oligonucleotide
cacugcagcugguuguca

SEQ ID NO: 24066 - RNA, 18 nt, Artificial Sequence
  Description of Artificial Sequence: Synthetic oligonucleotide
uuagacacugcagcuggu

SEQ ID NO: 24067 - RNA, 18 nt, Artificial Sequence
  Description of Artificial Sequence: Synthetic oligonucleotide
aacacuuagacacugcag

SEQ ID NO: 24068 - RNA, 18 nt, Artificial Sequence
  Description of Artificial Sequence: Synthetic oligonucleotide
ugaggaacacuuagacac

SEQ ID NO: 24069 - RNA, 18 nt, Artificial Sequence
  Description of Artificial Sequence: Synthetic oligonucleotide
gucagugaggaacacuua

SEQ ID NO: 24070 - RNA, 18 nt, Artificial Sequence
  Description of Artificial Sequence: Synthetic oligonucleotide
acccugucagugaggaac

SEQ ID NO: 24071 - RNA, 18 nt, Artificial Sequence
  Description of Artificial Sequence: Synthetic oligonucleotide
gccccacccugucaguga

SEQ ID NO: 24072 - RNA, 18 nt, Artificial Sequence
  Description of Artificial Sequence: Synthetic oligonucleotide
gugaggccccacccuguc

SEQ ID NO: 24073 - RNA, 18 nt, Artificial Sequence
  Description of Artificial Sequence: Synthetic oligonucleotide
ggguggugaggccccacc

SEQ ID NO: 24074 - RNA, 18 nt, Artificial Sequence
  Description of Artificial Sequence: Synthetic oligonucleotide
gccaacgcugcucccucc

SEQ ID NO: 24075 - RNA, 18 nt, Artificial Sequence
  Description of Artificial Sequence: Synthetic oligonucleotide
ucccugccaacgcugcuc

SEQ ID NO: 24076 - RNA, 18 nt, Artificial Sequence
  Description of Artificial Sequence: Synthetic oligonucleotide
cugucucccugccaacgc

SEQ ID NO: 24077 - RNA, 18 nt, Artificial Sequence
  Description of Artificial Sequence: Synthetic oligonucleotide
ccaggcugucucccugcc

SEQ ID NO: 24078 - RNA, 18 nt, Artificial Sequence
  Description of Artificial Sequence: Synthetic oligonucleotide
cugggccaggcugucucc

SEQ ID NO: 24079 - RNA, 18 nt, Artificial Sequence
  Description of Artificial Sequence: Synthetic oligonucleotide
ggucacugggccaggcug

SEQ ID NO: 24080 - RNA, 18 nt, Artificial Sequence
  Description of Artificial Sequence: Synthetic oligonucleotide
cccagggucacugggcca

SEQ ID NO: 24081 - RNA, 18 nt, Artificial Sequence
  Description of Artificial Sequence: Synthetic oligonucleotide
uugggcccagggucacug

SEQ ID NO: 24082 - RNA, 18 nt, Artificial Sequence
  Description of Artificial Sequence: Synthetic oligonucleotide
cuggcuugggcccagggu

SEQ ID NO: 24083 - RNA, 18 nt, Artificial Sequence
  Description of Artificial Sequence: Synthetic oligonucleotide
gggcuggcuugggcccag

SEQ ID NO: 24084 - RNA, 18 nt, Artificial Sequence
  Description of Artificial Sequence: Synthetic oligonucleotide
ccugaaagcccuggaggg

SEQ ID NO: 24085 - RNA, 18 nt, Artificial Sequence
  Description of Artificial Sequence: Synthetic oligonucleotide
gcuucccugaaagcccug

SEQ ID NO: 24086 - RNA, 18 nt, Artificial Sequence
  Description of Artificial Sequence: Synthetic oligonucleotide
auggcgcuucccugaaag

SEQ ID NO: 24087 - RNA, 18 nt, Artificial Sequence
  Description of Artificial Sequence: Synthetic oligonucleotide
aauggauggcgcuucccu

SEQ ID NO: 24088 - RNA, 18 nt, Artificial Sequence
  Description of Artificial Sequence: Synthetic oligonucleotide
uugaaaauggauggcgcu

SEQ ID NO: 24089 - RNA, 18 nt, Artificial Sequence
  Description of Artificial Sequence: Synthetic oligonucleotide
caucuuugaaaauggaug

SEQ ID NO: 24090 - RNA, 18 nt, Artificial Sequence
  Description of Artificial Sequence: Synthetic oligonucleotide
uuugacaucuuugaaaau

SEQ ID NO: 24091 - RNA, 18 nt, Artificial Sequence
  Description of Artificial Sequence: Synthetic oligonucleotide
ugacguuugacaucuuug

SEQ ID NO: 24092 - RNA, 18 nt, Artificial Sequence
  Description of Artificial Sequence: Synthetic oligonucleotide
agaagugacguuugacau

SEQ ID NO: 24093 - RNA, 18 nt, Artificial Sequence
  Description of Artificial Sequence: Synthetic oligonucleotide
caggaagaagugacguuu

SEQ ID NO: 24094 - RNA, 18 nt, Artificial Sequence
  Description of Artificial Sequence: Synthetic oligonucleotide
cccuacaggaagaaguga

SEQ ID NO: 24095 - RNA, 18 nt, Artificial Sequence
  Description of Artificial Sequence: Synthetic oligonucleotide
ucgggcccuacaggaaga

SEQ ID NO: 24096 - RNA, 18 nt, Artificial Sequence
  Description of Artificial Sequence: Synthetic oligonucleotide
aggacucgggcccuacag

SEQ ID NO: 24097 - RNA, 18 nt, Artificial Sequence
  Description of Artificial Sequence: Synthetic oligonucleotide
gaggcaggacucgggccc

SEQ ID NO: 24098 - RNA, 18 nt, Artificial Sequence
  Description of Artificial Sequence: Synthetic oligonucleotide
gauaggaggcaggacucg

SEQ ID NO: 24099 - RNA, 18 nt, Artificial Sequence
  Description of Artificial Sequence: Synthetic oligonucleotide
gcccugauaggaggcagg

SEQ ID NO: 24100 - RNA, 18 nt, Artificial Sequence
  Description of Artificial Sequence: Synthetic oligonucleotide
aucuggcccugauaggag

SEQ ID NO: 24101 - RNA, 18 nt, Artificial Sequence
  Description of Artificial Sequence: Synthetic oligonucleotide
cuaugaucuggcccugau

SEQ ID NO: 24102 - RNA, 18 nt, Artificial Sequence
  Description of Artificial Sequence: Synthetic oligonucleotide
gccuucuaugaucuggcc

SEQ ID NO: 24103 - RNA, 18 nt, Artificial Sequence
  Description of Artificial Sequence: Synthetic oligonucleotide
aaauagccuucuaugauc

SEQ ID NO: 24104 - RNA, 18 nt, Artificial Sequence
  Description of Artificial Sequence: Synthetic oligonucleotide
auagaaaauagccuucua

SEQ ID NO: 24105 - RNA, 18 nt, Artificial Sequence
  Description of Artificial Sequence: Synthetic oligonucleotide
ccagaauagaaaauagcc

SEQ ID NO: 24106 - RNA, 18 nt, Artificial Sequence
  Description of Artificial Sequence: Synthetic oligonucleotide
guuccccagaauagaaaa

SEQ ID NO: 24107 - RNA, 18 nt, Artificial Sequence
  Description of Artificial Sequence: Synthetic oligonucleotide
uaaucguuccccagaaua

SEQ ID NO: 24108 - RNA, 18 nt, Artificial Sequence
  Description of Artificial Sequence: Synthetic oligonucleotide
aguuauaaucguucccca

SEQ ID NO: 24109 - RNA, 18 nt, Artificial Sequence
  Description of Artificial Sequence: Synthetic oligonucleotide
auuuaaguuauaaucguu

SEQ ID NO: 24110 - RNA, 18 nt, Artificial Sequence
  Description of Artificial Sequence: Synthetic oligonucleotide
caaucauuuaaguuauaa

SEQ ID NO: 24111 - RNA, 18 nt, Artificial Sequence
  Description of Artificial Sequence: Synthetic oligonucleotide
uaaaacaaucauuuaagu

SEQ ID NO: 24112 - RNA, 18 nt, Artificial Sequence
  Description of Artificial Sequence: Synthetic oligonucleotide
uuuauuaaaacaaucauu

SEQ ID NO: 24113 - RNA, 18 nt, Artificial Sequence
  Description of Artificial Sequence: Synthetic oligonucleotide
gaauuuuuauuaaaacaa

SEQ ID NO: 24114 - RNA, 18 nt, Artificial Sequence
  Description of Artificial Sequence: Synthetic oligonucleotide
gcuuagaauuuuuauuaa

SEQ ID NO: 24115 - RNA, 18 nt, Artificial Sequence
  Description of Artificial Sequence: Synthetic oligonucleotide
uuccagcuuagaauuuuu

SEQ ID NO: 24116 - RNA, 18 nt, Artificial Sequence
  Description of Artificial Sequence: Synthetic oligonucleotide
gucuucugccuugggcuu

SEQ ID NO: 24117 - RNA, 18 nt, Artificial Sequence
  Description of Artificial Sequence: Synthetic oligonucleotide
gauaggucuucugccuug

SEQ ID NO: 24118 - RNA, 18 nt, Artificial Sequence
  Description of Artificial Sequence: Synthetic oligonucleotide
augcagauaggucuucug

SEQ ID NO: 24119 - RNA, 18 nt, Artificial Sequence
  Description of Artificial Sequence: Synthetic oligonucleotide
cucaaaugcagauagguc

SEQ ID NO: 24120 - RNA, 18 nt, Artificial Sequence
  Description of Artificial Sequence: Synthetic oligonucleotide
gagggcucaaaugcagau

SEQ ID NO: 24121 - RNA, 18 nt, Artificial Sequence
  Description of Artificial Sequence: Synthetic oligonucleotide
gagaguaccugggaacaa

SEQ ID NO: 24122 - RNA, 18 nt, Artificial Sequence
  Description of Artificial Sequence: Synthetic oligonucleotide
acauagagaguaccuggg

SEQ ID NO: 24123 - RNA, 18 nt, Artificial Sequence
  Description of Artificial Sequence: Synthetic oligonucleotide
ucaccacauagagaguac

SEQ ID NO: 24124 - RNA, 18 nt, Artificial Sequence
  Description of Artificial Sequence: Synthetic oligonucleotide
caccaucaccacauagag

SEQ ID NO: 24125 - RNA, 18 nt, Artificial Sequence
  Description of Artificial Sequence: Synthetic oligonucleotide
ggcagcaccaucaccaca

SEQ ID NO: 24126 - RNA, 18 nt, Artificial Sequence
  Description of Artificial Sequence: Synthetic oligonucleotide
cagagggcagcaccauca

SEQ ID NO: 24127 - RNA, 18 nt, Artificial Sequence
  Description of Artificial Sequence: Synthetic oligonucleotide
uaucacagagggcagcac

SEQ ID NO: 24128 - RNA, 18 nt, Artificial Sequence
  Description of Artificial Sequence: Synthetic oligonucleotide
guuaguaucacagagggc

SEQ ID NO: 24129 - RNA, 18 nt, Artificial Sequence
  Description of Artificial Sequence: Synthetic oligonucleotide
cacggguuaguaucacag

SEQ ID NO: 24130 - RNA, 18 nt, Artificial Sequence
  Description of Artificial Sequence: Synthetic oligonucleotide
ucaugcacggguuaguau

SEQ ID NO: 24131 - RNA, 18 nt, Artificial Sequence
  Description of Artificial Sequence: Synthetic oligonucleotide
caagcucaugcacggguu

SEQ ID NO: 24132 - RNA, 18 nt, Artificial Sequence
  Description of Artificial Sequence: Synthetic oligonucleotide
acaggcaagcucaugcac

SEQ ID NO: 24133 - RNA, 18 nt, Artificial Sequence
  Description of Artificial Sequence: Synthetic oligonucleotide
cagagacaggcaagcuca

SEQ ID NO: 24134 - RNA, 18 nt, Artificial Sequence
  Description of Artificial Sequence: Synthetic oligonucleotide
gaggacagagacaggcaa

SEQ ID NO: 24135 - RNA, 18 nt, Artificial Sequence
  Description of Artificial Sequence: Synthetic oligonucleotide
ggcccgaggacagagaca

SEQ ID NO: 24136 - RNA, 18 nt, Artificial Sequence
  Description of Artificial Sequence: Synthetic oligonucleotide
aguguggcccgaggacag

SEQ ID NO: 24137 - RNA, 18 nt, Artificial Sequence
  Description of Artificial Sequence: Synthetic oligonucleotide
ggcucaguguggcccgag

SEQ ID NO: 24138 - RNA, 18 nt, Artificial Sequence
  Description of Artificial Sequence: Synthetic oligonucleotide
guaagggcucaguguggc

SEQ ID NO: 24139 - RNA, 18 nt, Artificial Sequence
  Description of Artificial Sequence: Synthetic oligonucleotide
cccucguaagggcucagu

SEQ ID NO: 24140 - RNA, 18 nt, Artificial Sequence
  Description of Artificial Sequence: Synthetic oligonucleotide
accugcccucguaagggc

SEQ ID NO: 24141 - RNA, 18 nt, Artificial Sequence
  Description of Artificial Sequence: Synthetic oligonucleotide
gcaccaccugcccucgua

SEQ ID NO: 24142 - RNA, 18 nt, Artificial Sequence
  Description of Artificial Sequence: Synthetic oligonucleotide
cccaggcaccaccugccc

SEQ ID NO: 24143 - RNA, 18 nt, Artificial Sequence
  Description of Artificial Sequence: Synthetic oligonucleotide
caguacccaggcaccacc

SEQ ID NO: 24144 - RNA, 18 nt, Artificial Sequence
  Description of Artificial Sequence: Synthetic oligonucleotide
gcggccaguacccaggca

SEQ ID NO: 24145 - RNA, 18 nt, Artificial Sequence
  Description of Artificial Sequence: Synthetic oligonucleotide
augcugcggccaguaccc

SEQ ID NO: 24146 - RNA, 18 nt, Artificial Sequence
  Description of Artificial Sequence: Synthetic oligonucleotide
aaagcaugcugcggccag

SEQ ID NO: 24147 - RNA, 18 nt, Artificial Sequence
  Description of Artificial Sequence: Synthetic oligonucleotide
gacucaaagcaugcugcg

SEQ ID NO: 24148 - RNA, 18 nt, Artificial Sequence
  Description of Artificial Sequence: Synthetic oligonucleotide
uuuuagacucaaagcaug

SEQ ID NO: 24149 - RNA, 18 nt, Artificial Sequence
  Description of Artificial Sequence: Synthetic oligonucleotide
ccuacuuuuagacucaaa

SEQ ID NO: 24150 - RNA, 18 nt, Artificial Sequence
  Description of Artificial Sequence: Synthetic oligonucleotide
gggugccuacuuuuagac

SEQ ID NO: 24151 - RNA, 18 nt, Artificial Sequence
  Description of Artificial Sequence: Synthetic oligonucleotide
agggugggugccuacuuu

SEQ ID NO: 24152 - RNA, 18 nt, Artificial Sequence
  Description of Artificial Sequence: Synthetic oligonucleotide
uucacagggugggugccu

SEQ ID NO: 24153 - RNA, 18 nt, Artificial Sequence
  Description of Artificial Sequence: Synthetic oligonucleotide
cuggcuucacaggguggg

SEQ ID NO: 24154 - RNA, 18 nt, Artificial Sequence
  Description of Artificial Sequence: Synthetic oligonucleotide
cuggucuggcuucacagg

SEQ ID NO: 24155 - RNA, 18 nt, Artificial Sequence
  Description of Artificial Sequence: Synthetic oligonucleotide
ggaggcuggucuggcuuc

SEQ ID NO: 24156 - RNA, 18 nt, Artificial Sequence
  Description of Artificial Sequence: Synthetic oligonucleotide
gcccuggaggcuggucug

SEQ ID NO: 24157 - RNA, 18 nt, Artificial Sequence
  Description of Artificial Sequence: Synthetic oligonucleotide
gggcccuggaggcugguc

SEQ ID NO: 24158 - RNA, 18 nt, Artificial Sequence
  Description of Artificial Sequence: Synthetic oligonucleotide
acgaggcagucuucuggg

SEQ ID NO: 24159 - RNA, 18 nt, Artificial Sequence
  Description of Artificial Sequence: Synthetic oligonucleotide
ucggaacgaggcagucuu

SEQ ID NO: 24160 - RNA, 18 nt, Artificial Sequence
  Description of Artificial Sequence: Synthetic oligonucleotide
gcucuucggaacgaggca

SEQ ID NO: 24161 - RNA, 18 nt, Artificial Sequence
  Description of Artificial Sequence: Synthetic oligonucleotide
gacaugcucuucggaacg

SEQ ID NO: 24162 - RNA, 18 nt, Artificial Sequence
  Description of Artificial Sequence: Synthetic oligonucleotide
cccaugacaugcucuucg

SEQ ID NO: 24163 - RNA, 18 nt, Artificial Sequence
  Description of Artificial Sequence: Synthetic oligonucleotide
acagccccaugacaugcu

SEQ ID NO: 24164 - RNA, 18 nt, Artificial Sequence
  Description of Artificial Sequence: Synthetic oligonucleotide
guccuacagccccaugac

SEQ ID NO: 24165 - RNA, 18 nt, Artificial Sequence
  Description of Artificial Sequence: Synthetic oligonucleotide
ggcugguccuacagcccc

SEQ ID NO: 24166 - RNA, 18 nt, Artificial Sequence
  Description of Artificial Sequence: Synthetic oligonucleotide
agaauggcugguccuaca

SEQ ID NO: 24167 - RNA, 18 nt, Artificial Sequence
  Description of Artificial Sequence: Synthetic oligonucleotide
ugggaagaauggcugguc

SEQ ID NO: 24168 - RNA, 18 nt, Artificial Sequence
  Description of Artificial Sequence: Synthetic oligonucleotide
cgagaugggaagaauggc

SEQ ID NO: 24169 - RNA, 18 nt, Artificial Sequence
  Description of Artificial Sequence: Synthetic oligonucleotide
ugacccgagaugggaaga

SEQ ID NO: 24170 - RNA, 18 nt, Artificial Sequence
  Description of Artificial Sequence: Synthetic oligonucleotide
aacaaugacccgagaugg

SEQ ID NO: 24171 - RNA, 18 nt, Artificial Sequence
  Description of Artificial Sequence: Synthetic oligonucleotide
agcccaacaaugacccga

SEQ ID NO: 24172 - RNA, 18 nt, Artificial Sequence
  Description of Artificial Sequence: Synthetic oligonucleotide
uccccagcccaacaauga

SEQ ID NO: 24173 - RNA, 18 nt, Artificial Sequence
  Description of Artificial Sequence: Synthetic oligonucleotide
aaccuuccccagcccaac

SEQ ID NO: 24174 - RNA, 18 nt, Artificial Sequence
  Description of Artificial Sequence: Synthetic oligonucleotide
gccauaaccuuccccagc

SEQ ID NO: 24175 - RNA, 18 nt, Artificial Sequence
  Description of Artificial Sequence: Synthetic oligonucleotide
aagaagccauaaccuucc

SEQ ID NO: 24176 - RNA, 18 nt, Artificial Sequence
  Description of Artificial Sequence: Synthetic oligonucleotide
uggacaagaagccauaac

SEQ ID NO: 24177 - RNA, 18 nt, Artificial Sequence
  Description of Artificial Sequence: Synthetic oligonucleotide
cugacuggacaagaagcc

SEQ ID NO: 24178 - RNA, 18 nt, Artificial Sequence
  Description of Artificial Sequence: Synthetic oligonucleotide
cacaccugacuggacaag

SEQ ID NO: 24179 - RNA, 18 nt, Artificial Sequence
  Description of Artificial Sequence: Synthetic oligonucleotide
uuagacacaccugacugg

SEQ ID NO: 24180 - RNA, 18 nt, Artificial Sequence
  Description of Artificial Sequence: Synthetic oligonucleotide
gacuuuuagacacaccug

SEQ ID NO: 24181 - RNA, 18 nt, Artificial Sequence
  Description of Artificial Sequence: Synthetic oligonucleotide
caaaggacuuuuagacac

SEQ ID NO: 24182 - RNA, 18 nt, Artificial Sequence
  Description of Artificial Sequence: Synthetic oligonucleotide
caagacaaaggacuuuua

SEQ ID NO: 24183 - RNA, 18 nt, Artificial Sequence
  Description of Artificial Sequence: Synthetic oligonucleotide
gccaccaagacaaaggac

SEQ ID NO: 24184 - RNA, 18 nt, Artificial Sequence
  Description of Artificial Sequence: Synthetic oligonucleotide
aguaugccaccaagacaa

SEQ ID NO: 24185 - RNA, 18 nt, Artificial Sequence
  Description of Artificial Sequence: Synthetic oligonucleotide
cuaggaguaugccaccaa

SEQ ID NO: 24186 - RNA, 18 nt, Artificial Sequence
  Description of Artificial Sequence: Synthetic oligonucleotide
ccaugcuaggaguaugcc

SEQ ID NO: 24187 - RNA, 18 nt, Artificial Sequence
  Description of Artificial Sequence: Synthetic oligonucleotide
cauuuccaugcuaggagu

SEQ ID NO: 24188 - RNA, 18 nt, Artificial Sequence
  Description of Artificial Sequence: Synthetic oligonucleotide
gaccccauuuccaugcua

SEQ ID NO: 24189 - RNA, 18 nt, Artificial Sequence
  Description of Artificial Sequence: Synthetic oligonucleotide
agauugaccccauuucca

SEQ ID NO: 24190 - RNA, 18 nt, Artificial Sequence
  Description of Artificial Sequence: Synthetic oligonucleotide
ugcccagauugaccccau

SEQ ID NO: 24191 - RNA, 18 nt, Artificial Sequence
  Description of Artificial Sequence: Synthetic oligonucleotide
caaagugcccagauugac

SEQ ID NO: 24192 - RNA, 18 nt, Artificial Sequence
  Description of Artificial Sequence: Synthetic oligonucleotide
gucuccaaagugcccaga

SEQ ID NO: 24193 - RNA, 18 nt, Artificial Sequence
  Description of Artificial Sequence: Synthetic oligonucleotide
caccagucuccaaagugc

SEQ ID NO: 24194 - RNA, 18 nt, Artificial Sequence
  Description of Artificial Sequence: Synthetic oligonucleotide
aaacacaccagucuccaa

SEQ ID NO: 24195 - RNA, 18 nt, Artificial Sequence
  Description of Artificial Sequence: Synthetic oligonucleotide
gaguuaaacacaccaguc

SEQ ID NO: 24196 - RNA, 18 nt, Artificial Sequence
  Description of Artificial Sequence: Synthetic oligonucleotide
aucuugaguuaaacacac

SEQ ID NO: 24197 - RNA, 18 nt, Artificial Sequence
  Description of Artificial Sequence: Synthetic oligonucleotide
ucuugaucuugaguuaaa

SEQ ID NO: 24198 - RNA, 18 nt, Artificial Sequence
  Description of Artificial Sequence: Synthetic oligonucleotide
aaaggucuugaucuugag

SEQ ID NO: 24199 - RNA, 18 nt, Artificial Sequence
  Description of Artificial Sequence: Synthetic oligonucleotide
gcauaaaaggucuugauc

SEQ ID NO: 24200 - RNA, 18 nt, Artificial Sequence
  Description of Artificial Sequence: Synthetic oligonucleotide
ucaacgcauaaaaggucu

SEQ ID NO: 24201 - RNA, 18 nt, Artificial Sequence
  Description of Artificial Sequence: Synthetic oligonucleotide
ggcugucaacgcauaaaa

SEQ ID NO: 24202 - RNA, 18 nt, Artificial Sequence
  Description of Artificial Sequence: Synthetic oligonucleotide
ugagaggcugucaacgca

SEQ ID NO: 24203 - RNA, 18 nt, Artificial Sequence
  Description of Artificial Sequence: Synthetic oligonucleotide
ggucuugagaggcuguca

SEQ ID NO: 24204 - RNA, 18 nt, Artificial Sequence
  Description of Artificial Sequence: Synthetic oligonucleotide
ccaugggucuugagaggc

SEQ ID NO: 24205 - RNA, 18 nt, Artificial Sequence
  Description of Artificial Sequence: Synthetic oligonucleotide
ugugaccaugggucuuga

SEQ ID NO: 24206 - RNA, 18 nt, Artificial Sequence
  Description of Artificial Sequence: Synthetic oligonucleotide
ccaggugugaccaugggu

SEQ ID NO: 24207 - RNA, 18 nt, Artificial Sequence
  Description of Artificial Sequence: Synthetic oligonucleotide
agcugccaggugugacca

SEQ ID NO: 24208 - RNA, 18 nt, Artificial Sequence
  Description of Artificial Sequence: Synthetic oligonucleotide
ccagaagcugccaggugu

SEQ ID NO: 24209 - RNA, 18 nt, Artificial Sequence
  Description of Artificial Sequence: Synthetic oligonucleotide
cacuaccagaagcugcca

SEQ ID NO: 24210 - RNA, 18 nt, Artificial Sequence
  Description of Artificial Sequence: Synthetic oligonucleotide
ugccccacuaccagaagc

SEQ ID NO: 24211 - RNA, 18 nt, Artificial Sequence
  Description of Artificial Sequence: Synthetic oligonucleotide
ccuuuugccccacuacca

SEQ ID NO: 24212 - RNA, 18 nt, Artificial Sequence
  Description of Artificial Sequence: Synthetic oligonucleotide
gcaacccuuuugccccac

SEQ ID NO: 24213 - RNA, 18 nt, Artificial Sequence
  Description of Artificial Sequence: Synthetic oligonucleotide
cacaagcaacccuuuugc

SEQ ID NO: 24214 - RNA, 18 nt, Artificial Sequence
  Description of Artificial Sequence: Synthetic oligonucleotide
gccagcacaagcaacccu

SEQ ID NO: 24215 - RNA, 18 nt, Artificial Sequence
  Description of Artificial Sequence: Synthetic oligonucleotide
aaugagccagcacaagca

SEQ ID NO: 24216 - RNA, 18 nt, Artificial Sequence
  Description of Artificial Sequence: Synthetic oligonucleotide
aggaaaaugagccagcac

SEQ ID NO: 24217 - RNA, 18 nt, Artificial Sequence
  Description of Artificial Sequence: Synthetic oligonucleotide
ucuaaaggaaaaugagcc

SEQ ID NO: 24218 - RNA, 18 nt, Artificial Sequence
  Description of Artificial Sequence: Synthetic oligonucleotide
aaagcucuaaaggaaaau

SEQ ID NO: 24219 - RNA, 18 nt, Artificial Sequence
  Description of Artificial Sequence: Synthetic oligonucleotide
uuaccccuucuacuccug

SEQ ID NO: 24220 - RNA, 18 nt, Artificial Sequence
  Description of Artificial Sequence: Synthetic oligonucleotide
agaguuuaccccuucuac

SEQ ID NO: 24221 - RNA, 18 nt, Artificial Sequence
  Description of Artificial Sequence: Synthetic oligonucleotide
gaggaagaguuuaccccu

SEQ ID NO: 24222 - RNA, 18 nt, Artificial Sequence
  Description of Artificial Sequence: Synthetic oligonucleotide
cagaugaggaagaguuua

SEQ ID NO: 24223 - RNA, 18 nt, Artificial Sequence
  Description of Artificial Sequence: Synthetic oligonucleotide
uguggcagaugaggaaga

SEQ ID NO: 24224 - RNA, 18 nt, Artificial Sequence
  Description of Artificial Sequence: Synthetic oligonucleotide
aggccuguggcagaugag

SEQ ID NO: 24225 - RNA, 18 nt, Artificial Sequence
  Description of Artificial Sequence: Synthetic oligonucleotide
aaggcaggccuguggcag

SEQ ID NO: 24226 - RNA, 18 nt, Artificial Sequence
  Description of Artificial Sequence: Synthetic oligonucleotide
gaggcaaggcaggccugu

SEQ ID NO: 24227 - RNA, 18 nt, Artificial Sequence
  Description of Artificial Sequence: Synthetic oligonucleotide
ggccugaggcaaggcagg

SEQ ID NO: 24228 - RNA, 18 nt, Artificial Sequence
  Description of Artificial Sequence: Synthetic oligonucleotide
gacguggccugaggcaag

SEQ ID NO: 24229 - RNA, 18 nt, Artificial Sequence
  Description of Artificial Sequence: Synthetic oligonucleotide
aaggugacguggccugag

SEQ ID NO: 24230 - RNA, 18 nt, Artificial Sequence
  Description of Artificial Sequence: Synthetic oligonucleotide
ccuggcaacauggcuggg

SEQ ID NO: 24231 - RNA, 18 nt, Artificial Sequence
  Description of Artificial Sequence: Synthetic oligonucleotide
caugcccuggcaacaugg

SEQ ID NO: 24232 - RNA, 18 nt, Artificial Sequence
  Description of Artificial Sequence: Synthetic oligonucleotide
guccucaugcccuggcaa

SEQ ID NO: 24233 - RNA, 18 nt, Artificial Sequence
  Description of Artificial Sequence: Synthetic oligonucleotide
ucuuaguccucaugcccu

SEQ ID NO: 24234 - RNA, 18 nt, Artificial Sequence
  Description of Artificial Sequence: Synthetic oligonucleotide
aagcaucuuaguccucau

SEQ ID NO: 24235 - RNA, 18 nt, Artificial Sequence
  Description of Artificial Sequence: Synthetic oligonucleotide
agggcaagcaucuuaguc

SEQ ID NO: 24236 - RNA, 18 nt, Artificial Sequence
  Description of Artificial Sequence: Synthetic oligonucleotide
uuggcagggcaagcaucu

SEQ ID NO: 24237 - RNA, 18 nt, Artificial Sequence
  Description of Artificial Sequence: Synthetic oligonucleotide
cgggcuuggcagggcaag

SEQ ID NO: 24238 - RNA, 18 nt, Artificial Sequence
  Description of Artificial Sequence: Synthetic oligonucleotide
cccuccgggcuuggcagg

SEQ ID NO: 24239 - RNA, 18 nt, Artificial Sequence
  Description of Artificial Sequence: Synthetic oligonucleotide
ucauccccuccgggcuug

SEQ ID NO: 24240 - RNA, 18 nt, Artificial Sequence
  Description of Artificial Sequence: Synthetic oligonucleotide
gcugcucauccccuccgg

SEQ ID NO: 24241 - RNA, 18 nt, Artificial Sequence
  Description of Artificial Sequence: Synthetic oligonucleotide
cugaggcugcucaucccc

SEQ ID NO: 24242 - RNA, 18 nt, Artificial Sequence
  Description of Artificial Sequence: Synthetic oligonucleotide
accagcugaggcugcuca

SEQ ID NO: 24243 - RNA, 18 nt, Artificial Sequence
  Description of Artificial Sequence: Synthetic oligonucleotide
gcggcaccagcugaggcu

SEQ ID NO: 24244 - RNA, 18 nt, Artificial Sequence
  Description of Artificial Sequence: Synthetic oligonucleotide
cuguggcggcaccagcug

SEQ ID NO: 24245 - RNA, 18 nt, Artificial Sequence
  Description of Artificial Sequence: Synthetic oligonucleotide
gcugucuguggcggcacc

SEQ ID NO: 24246 - RNA, 18 nt, Artificial Sequence
  Description of Artificial Sequence: Synthetic oligonucleotide
ggugugcugucuguggcg

SEQ ID NO: 24247 - RNA, 18 nt, Artificial Sequence
  Description of Artificial Sequence: Synthetic oligonucleotide
ucuguggugugcugucug

SEQ ID NO: 24248 - RNA, 18 nt, Artificial Sequence
  Description of Artificial Sequence: Synthetic oligonucleotide
ccaccucuguggugugcu

SEQ ID NO: 24249 - RNA, 18 nt, Artificial Sequence
  Description of Artificial Sequence: Synthetic oligonucleotide
cugagccaccucuguggu

SEQ ID NO: 24250 - RNA, 18 nt, Artificial Sequence
  Description of Artificial Sequence: Synthetic oligonucleotide
ggucccugagccaccucu

SEQ ID NO: 24251 - RNA, 18 nt, Artificial Sequence
  Description of Artificial Sequence: Synthetic oligonucleotide
accaaggucccugagcca

SEQ ID NO: 24252 - RNA, 18 nt, Artificial Sequence
  Description of Artificial Sequence: Synthetic oligonucleotide
caucuaccaaggucccug

SEQ ID NO: 24253 - RNA, 18 nt, Artificial Sequence
  Description of Artificial Sequence: Synthetic oligonucleotide
auucccaucuaccaaggu

SEQ ID NO: 24254 - RNA, 18 nt, Artificial Sequence
  Description of Artificial Sequence: Synthetic oligonucleotide
cucacauucccaucuacc

SEQ ID NO: 24255 - RNA, 18 nt, Artificial Sequence
  Description of Artificial Sequence: Synthetic oligonucleotide
agauucucacauucccau

SEQ ID NO: 24256 - RNA, 18 nt, Artificial Sequence
  Description of Artificial Sequence: Synthetic oligonucleotide
uuaauagauucucacauu

SEQ ID NO: 24257 - RNA, 18 nt, Artificial Sequence
  Description of Artificial Sequence: Synthetic oligonucleotide
cuauuuuaauagauucuc

SEQ ID NO: 24258 - RNA, 18 nt, Artificial Sequence
  Description of Artificial Sequence: Synthetic oligonucleotide
ccugccuauuuuaauaga

SEQ ID NO: 24259 - RNA, 18 nt, Artificial Sequence
  Description of Artificial Sequence: Synthetic oligonucleotide
agaucccugccuauuuua

SEQ ID NO: 24260 - RNA, 18 nt, Artificial Sequence
  Description of Artificial Sequence: Synthetic oligonucleotide
accggagaucccugccua

SEQ ID NO: 24261 - RNA, 18 nt, Artificial Sequence
  Description of Artificial Sequence: Synthetic oligonucleotide
agaggaccggagaucccu

SEQ ID NO: 24262 - RNA, 18 nt, Artificial Sequence
  Description of Artificial Sequence: Synthetic oligonucleotide
uugacagaggaccggaga

SEQ ID NO: 24263 - RNA, 18 nt, Artificial Sequence
  Description of Artificial Sequence: Synthetic oligonucleotide
gccucuugacagaggacc

SEQ ID NO: 24264 - RNA, 18 nt, Artificial Sequence
  Description of Artificial Sequence: Synthetic oligonucleotide
gcauugccucuugacaga

SEQ ID NO: 24265 - RNA, 18 nt, Artificial Sequence
  Description of Artificial Sequence: Synthetic oligonucleotide
cgucagcauugccucuug

SEQ ID NO: 24266 - RNA, 18 nt, Artificial Sequence
  Description of Artificial Sequence: Synthetic oligonucleotide
aaagccgucagcauugcc

SEQ ID NO: 24267 - RNA, 18 nt, Artificial Sequence
  Description of Artificial Sequence: Synthetic oligonucleotide
aggaaaaagccgucagca

SEQ ID NO: 24268 - RNA, 18 nt, Artificial Sequence
  Description of Artificial Sequence: Synthetic oligonucleotide
ccagcaggaaaaagccgu

SEQ ID NO: 24269 - RNA, 18 nt, Artificial Sequence
  Description of Artificial Sequence: Synthetic oligonucleotide
gcacgccagcaggaaaaa

SEQ ID NO: 24270 - RNA, 18 nt, Artificial Sequence
  Description of Artificial Sequence: Synthetic oligonucleotide
cagaggcacgccagcagg

SEQ ID NO: 24271 - RNA, 18 nt, Artificial Sequence
  Description of Artificial Sequence: Synthetic oligonucleotide
gugggcagaggcacgcca

SEQ ID NO: 24272 - RNA, 18 nt, Artificial Sequence
  Description of Artificial Sequence: Synthetic oligonucleotide
ggcuggugggcagaggca

SEQ ID NO: 24273 - RNA, 18 nt, Artificial Sequence
  Description of Artificial Sequence: Synthetic oligonucleotide
gggaaggcuggugggcag

SEQ ID NO: 24274 - RNA, 18 nt, Artificial Sequence
  Description of Artificial Sequence: Synthetic oligonucleotide
aaugaggaugugcaaggg

SEQ ID NO: 24275 - RNA, 18 nt, Artificial Sequence
  Description of Artificial Sequence: Synthetic oligonucleotide
acaaaugaggaugugcaa

SEQ ID NO: 24276 - RNA, 18 nt, Artificial Sequence
  Description of Artificial Sequence: Synthetic oligonucleotide
aggugacaaaugaggaug

SEQ ID NO: 24277 - RNA, 18 nt, Artificial Sequence
  Description of Artificial Sequence: Synthetic oligonucleotide
uuaggaggugacaaauga

SEQ ID NO: 24278 - RNA, 18 nt, Artificial Sequence
  Description of Artificial Sequence: Synthetic oligonucleotide
ucaaauuaggaggugaca

SEQ ID NO: 24279 - RNA, 18 nt, Artificial Sequence
  Description of Artificial Sequence: Synthetic oligonucleotide
auaauucaaauuaggagg

SEQ ID NO: 24280 - RNA, 18 nt, Artificial Sequence
  Description of Artificial Sequence: Synthetic oligonucleotide
gcccaauaauucaaauua

SEQ ID NO: 24281 - RNA, 18 nt, Artificial Sequence
  Description of Artificial Sequence: Synthetic oligonucleotide
gauuugcccaauaauuca

SEQ ID NO: 24282 - RNA, 18 nt, Artificial Sequence
  Description of Artificial Sequence: Synthetic oligonucleotide
ggccagauuugcccaaua

SEQ ID NO: 24283 - RNA, 18 nt, Artificial Sequence
  Description of Artificial Sequence: Synthetic oligonucleotide
uaagcggccagauuugcc

SEQ ID NO: 24284 - RNA, 18 nt, Artificial Sequence
  Description of Artificial Sequence: Synthetic oligonucleotide
ccaaauaagcggccagau

SEQ ID NO: 24285 - RNA, 18 nt, Artificial Sequence
  Description of Artificial Sequence: Synthetic oligonucleotide
cagucccaaauaagcggc

SEQ ID NO: 24286 - RNA, 18 nt, Artificial Sequence
  Description of Artificial Sequence: Synthetic oligonucleotide
gcugucagucccaaauaa

SEQ ID NO: 24287 - RNA, 18 nt, Artificial Sequence
  Description of Artificial Sequence: Synthetic oligonucleotide
aguuggcugucaguccca

SEQ ID NO: 24288 - RNA, 18 nt, Artificial Sequence
  Description of Artificial Sequence: Synthetic oligonucleotide
caagaaguuggcugucag

SEQ ID NO: 24289 - RNA, 18 nt, Artificial Sequence
  Description of Artificial Sequence: Synthetic oligonucleotide
augcucaagaaguuggcu

SEQ ID NO: 24290 - RNA, 18 nt, Artificial Sequence
  Description of Artificial Sequence: Synthetic oligonucleotide
aauagaugcucaagaagu

SEQ ID NO: 24291 - RNA, 18 nt, Artificial Sequence
  Description of Artificial Sequence: Synthetic oligonucleotide
guucaaauagaugcucaa

SEQ ID NO: 24292 - RNA, 18 nt, Artificial Sequence
  Description of Artificial Sequence: Synthetic oligonucleotide
aggcuguucaaauagaug

SEQ ID NO: 24293 - RNA, 18 nt, Artificial Sequence
  Description of Artificial Sequence: Synthetic oligonucleotide
agggaaggcuguucaaau

SEQ ID NO: 24294 - RNA, 18 nt, Artificial Sequence
  Description of Artificial Sequence: Synthetic oligonucleotide
gcgaaagggaaggcuguu

SEQ ID NO: 24295 - RNA, 18 nt, Artificial Sequence
  Description of Artificial Sequence: Synthetic oligonucleotide
ugggagcgaaagggaagg

SEQ ID NO: 24296 - RNA, 18 nt, Artificial Sequence
  Description of Artificial Sequence: Synthetic oligonucleotide
guggcugggagcgaaagg

SEQ ID NO: 24297 - RNA, 18 nt, Artificial Sequence
  Description of Artificial Sequence: Synthetic oligonucleotide
caaagguggcugggagcg

SEQ ID NO: 24298 - RNA, 18 nt, Artificial Sequence
  Description of Artificial Sequence: Synthetic oligonucleotide
caccucaaagguggcugg

SEQ ID NO: 24299 - RNA, 18 nt, Artificial Sequence
  Description of Artificial Sequence: Synthetic oligonucleotide
ggacucaccucaaaggug

SEQ ID NO: 24300 - RNA, 18 nt, Artificial Sequence
  Description of Artificial Sequence: Synthetic oligonucleotide
cacuuggacucaccucaa

SEQ ID NO: 24301 - RNA, 18 nt, Artificial Sequence
  Description of Artificial Sequence: Synthetic oligonucleotide
ccugccacuuggacucac

SEQ ID NO: 24302 - RNA, 18 nt, Artificial Sequence
  Description of Artificial Sequence: Synthetic oligonucleotide
ccuguccugccacuugga

SEQ ID NO: 24303 - RNA, 18 nt, Artificial Sequence
  Description of Artificial Sequence: Synthetic oligonucleotide
aggguccuguccugccac

SEQ ID NO: 24304 - RNA, 18 nt, Artificial Sequence
  Description of Artificial Sequence: Synthetic oligonucleotide
cacacaggguccuguccu

SEQ ID NO: 24305 - RNA, 18 nt, Artificial Sequence
  Description of Artificial Sequence: Synthetic oligonucleotide
ucugucacacaggguccu

SEQ ID NO: 24306 - RNA, 18 nt, Artificial Sequence
  Description of Artificial Sequence: Synthetic oligonucleotide
uccgcucugucacacagg

SEQ ID NO: 24307 - RNA, 18 nt, Artificial Sequence
  Description of Artificial Sequence: Synthetic oligonucleotide
agaccuccgcucugucac

SEQ ID NO: 24308 - RNA, 18 nt, Artificial Sequence
  Description of Artificial Sequence: Synthetic oligonucleotide
gcacaagaccuccgcucu

SEQ ID NO: 24309 - RNA, 18 nt, Artificial Sequence
  Description of Artificial Sequence: Synthetic oligonucleotide
agagggcacaagaccucc

SEQ ID NO: 24310 - RNA, 18 nt, Artificial Sequence
  Description of Artificial Sequence: Synthetic oligonucleotide
agcugagagggcacaaga

SEQ ID NO: 24311 - RNA, 18 nt, Artificial Sequence
  Description of Artificial Sequence: Synthetic oligonucleotide
gaagaagcugagagggca

SEQ ID NO: 24312 - RNA, 18 nt, Artificial Sequence
  Description of Artificial Sequence: Synthetic oligonucleotide
uggcgcucugcaagguga

SEQ ID NO: 24313 - RNA, 18 nt, Artificial Sequence
  Description of Artificial Sequence: Synthetic oligonucleotide
ggacuuggcgcucugcaa

SEQ ID NO: 24314 - RNA, 18 nt, Artificial Sequence
  Description of Artificial Sequence: Synthetic oligonucleotide
acucgggacuuggcgcuc

SEQ ID NO: 24315 - RNA, 18 nt, Artificial Sequence
  Description of Artificial Sequence: Synthetic oligonucleotide
aggccacucgggacuugg

SEQ ID NO: 24316 - RNA, 18 nt, Artificial Sequence
  Description of Artificial Sequence: Synthetic oligonucleotide
aaagaaggccacucggga

SEQ ID NO: 24317 - RNA, 18 nt, Artificial Sequence
  Description of Artificial Sequence: Synthetic oligonucleotide
ucuucaaagaaggccacu

SEQ ID NO: 24318 - RNA, 18 nt, Artificial Sequence
  Description of Artificial Sequence: Synthetic oligonucleotide
agagcucuucaaagaagg

SEQ ID NO: 24319 - RNA, 18 nt, Artificial Sequence
  Description of Artificial Sequence: Synthetic oligonucleotide
cugcuagagcucuucaaa

SEQ ID NO: 24320 - RNA, 18 nt, Artificial Sequence
  Description of Artificial Sequence: Synthetic oligonucleotide
gucaccugcuagagcucu

SEQ ID NO: 24321 - RNA, 18 nt, Artificial Sequence
  Description of Artificial Sequence: Synthetic oligonucleotide
gcugggucaccugcuaga

SEQ ID NO: 24322 - RNA, 18 nt, Artificial Sequence
  Description of Artificial Sequence: Synthetic oligonucleotide
ggguggcugggucaccug

SEQ ID NO: 24323 - RNA, 18 nt, Artificial Sequence
  Description of Artificial Sequence: Synthetic oligonucleotide
aggagaaguggcaggucc

SEQ ID NO: 24324 - RNA, 18 nt, Artificial Sequence
  Description of Artificial Sequence: Synthetic oligonucleotide
guagcaggagaaguggca

SEQ ID NO: 24325 - RNA, 18 nt, Artificial Sequence
  Description of Artificial Sequence: Synthetic oligonucleotide
ucccgguagcaggagaag

SEQ ID NO: 24326 - RNA, 18 nt, Artificial Sequence
  Description of Artificial Sequence: Synthetic oligonucleotide
cgcggucccgguagcagg

SEQ ID NO: 24327 - RNA, 18 nt, Artificial Sequence
  Description of Artificial Sequence: Synthetic oligonucleotide
caucccgcggucccggua

SEQ ID NO: 24328 - RNA, 18 nt, Artificial Sequence
  Description of Artificial Sequence: Synthetic oligonucleotide
ugguccaucccgcggucc

SEQ ID NO: 24329 - RNA, 18 nt, Artificial Sequence
  Description of Artificial Sequence: Synthetic oligonucleotide
auaucugguccaucccgc

SEQ ID NO: 24330 - RNA, 18 nt, Artificial Sequence
  Description of Artificial Sequence: Synthetic oligonucleotide
ucuugauaucugguccau

SEQ ID NO: 24331 - RNA, 18 nt, Artificial Sequence
  Description of Artificial Sequence: Synthetic oligonucleotide
ggcucucuugauaucugg

SEQ ID NO: 24332 - RNA, 18 nt, Artificial Sequence
  Description of Artificial Sequence: Synthetic oligonucleotide
uggauggcucucuugaua

SEQ ID NO: 24333 - RNA, 18 nt, Artificial Sequence
  Description of Artificial Sequence: Synthetic oligonucleotide
cccuauggauggcucucu

SEQ ID NO: 24334 - RNA, 18 nt, Artificial Sequence
  Description of Artificial Sequence: Synthetic oligonucleotide
cagcucccuauggauggc

SEQ ID NO: 24335 - RNA, 18 nt, Artificial Sequence
  Description of Artificial Sequence: Synthetic oligonucleotide
ccagccagcucccuaugg

SEQ ID NO: 24336 - RNA, 18 nt, Artificial Sequence
  Description of Artificial Sequence: Synthetic oligonucleotide
aacccccagccagcuccc

SEQ ID NO: 24337 - RNA, 18 nt, Artificial Sequence
  Description of Artificial Sequence: Synthetic oligonucleotide
acggaaacccccagccag

SEQ ID NO: 24338 - RNA, 18 nt, Artificial Sequence
  Description of Artificial Sequence: Synthetic oligonucleotide
cucccacggaaaccccca

SEQ ID NO: 24339 - RNA, 18 nt, Artificial Sequence
  Description of Artificial Sequence: Synthetic oligonucleotide
uggagcucccacggaaac

SEQ ID NO: 24340 - RNA, 18 nt, Artificial Sequence
  Description of Artificial Sequence: Synthetic oligonucleotide
aguucuggagcucccacg

SEQ ID NO: 24341 - RNA, 18 nt, Artificial Sequence
  Description of Artificial Sequence: Synthetic oligonucleotide
gggaaaguucuggagcuc

SEQ ID NO: 24342 - RNA, 18 nt, Artificial Sequence
  Description of Artificial Sequence: Synthetic oligonucleotide
cugggcucuucacucagc

SEQ ID NO: 24343 - RNA, 18 nt, Artificial Sequence
  Description of Artificial Sequence: Synthetic oligonucleotide
gggcugggcucuucacuc

SEQ ID NO: 24344 - RNA, 18 nt, Artificial Sequence
  Description of Artificial Sequence: Synthetic oligonucleotide
caauugcacauaagaggg

SEQ ID NO: 24345 - RNA, 18 nt, Artificial Sequence
  Description of Artificial Sequence: Synthetic oligonucleotide
caaggcaauugcacauaa

SEQ ID NO: 24346 - RNA, 18 nt, Artificial Sequence
  Description of Artificial Sequence: Synthetic oligonucleotide
uaguucaaggcaauugca

SEQ ID NO: 24347 - RNA, 18 nt, Artificial Sequence
  Description of Artificial Sequence: Synthetic oligonucleotide
ggucguaguucaaggcaa

SEQ ID NO: 24348 - RNA, 18 nt, Artificial Sequence
  Description of Artificial Sequence: Synthetic oligonucleotide
uacagggucguaguucaa

SEQ ID NO: 24349 - RNA, 18 nt, Artificial Sequence
  Description of Artificial Sequence: Synthetic oligonucleotide
aucucuacagggucguag

SEQ ID NO: 24350 - RNA, 18 nt, Artificial Sequence
  Description of Artificial Sequence: Synthetic oligonucleotide
gagaaaucucuacagggu

SEQ ID NO: 24351 - RNA, 18 nt, Artificial Sequence
  Description of Artificial Sequence: Synthetic oligonucleotide
caugagagaaaucucuac

SEQ ID NO: 24352 - RNA, 18 nt, Artificial Sequence
  Description of Artificial Sequence: Synthetic oligonucleotide
aacgccaugagagaaauc

SEQ ID NO: 24353 - RNA, 18 nt, Artificial Sequence
  Description of Artificial Sequence: Synthetic oligonucleotide
acuagaacgccaugagag

SEQ ID NO: 24354 - RNA, 18 nt, Artificial Sequence
  Description of Artificial Sequence: Synthetic oligonucleotide
agagaacuagaacgccau

SEQ ID NO: 24355 - RNA, 18 nt, Artificial Sequence
  Description of Artificial Sequence: Synthetic oligonucleotide
aggucagagaacuagaac

SEQ ID NO: 24356 - RNA, 18 nt, Artificial Sequence
  Description of Artificial Sequence: Synthetic oligonucleotide
gacucaggucagagaacu

SEQ ID NO: 24357 - RNA, 18 nt, Artificial Sequence
  Description of Artificial Sequence: Synthetic oligonucleotide
acaaagacucaggucaga

SEQ ID NO: 24358 - RNA, 18 nt, Artificial Sequence
  Description of Artificial Sequence: Synthetic oligonucleotide
uuaaaacaaagacucagg

SEQ ID NO: 24359 - RNA, 18 nt, Artificial Sequence
  Description of Artificial Sequence: Synthetic oligonucleotide
acuucuuaaaacaaagac

SEQ ID NO: 24360 - RNA, 18 nt, Artificial Sequence
  Description of Artificial Sequence: Synthetic oligonucleotide
caaauacuucuuaaaaca

SEQ ID NO: 24361 - RNA, 18 nt, Artificial Sequence
  Description of Artificial Sequence: Synthetic oligonucleotide
gaagacaaauacuucuua

SEQ ID NO: 24362 - RNA, 18 nt, Artificial Sequence
  Description of Artificial Sequence: Synthetic oligonucleotide
caaaggaagacaaauacu

SEQ ID NO: 24363 - RNA, 18 nt, Artificial Sequence
  Description of Artificial Sequence: Synthetic oligonucleotide
uuagacaaaggaagacaa

SEQ ID NO: 24364 - RNA, 18 nt, Artificial Sequence
  Description of Artificial Sequence: Synthetic oligonucleotide
ccacauuagacaaaggaa

SEQ ID NO: 24365 - RNA, 18 nt, Artificial Sequence
  Description of Artificial Sequence: Synthetic oligonucleotide
gaaucccacauuagacaa

SEQ ID NO: 24366 - RNA, 18 nt, Artificial Sequence
  Description of Artificial Sequence: Synthetic oligonucleotide
gucaggaaucccacauua

SEQ ID NO: 24367 - RNA, 18 nt, Artificial Sequence
  Description of Artificial Sequence: Synthetic oligonucleotide
agggagucaggaauccca

SEQ ID NO: 24368 - RNA, 18 nt, Artificial Sequence
  Description of Artificial Sequence: Synthetic oligonucleotide
gacgaagggagucaggaa

SEQ ID NO: 24369 - RNA, 18 nt, Artificial Sequence
  Description of Artificial Sequence: Synthetic oligonucleotide
ccuuggacgaagggaguc

SEQ ID NO: 24370 - RNA, 18 nt, Artificial Sequence
  Description of Artificial Sequence: Synthetic oligonucleotide
cggugccuuggacgaagg

SEQ ID NO: 24371 - RNA, 18 nt, Artificial Sequence
  Description of Artificial Sequence: Synthetic oligonucleotide
cacaccggugccuuggac

SEQ ID NO: 24372 - RNA, 18 nt, Artificial Sequence
  Description of Artificial Sequence: Synthetic oligonucleotide
acacacacaccggugccu

SEQ ID NO: 24373 - RNA, 18 nt, Artificial Sequence
  Description of Artificial Sequence: Synthetic oligonucleotide
aagacacacacacaccgg

SEQ ID NO: 24374 - RNA, 18 nt, Artificial Sequence
  Description of Artificial Sequence: Synthetic oligonucleotide
agugcaagacacacacac

SEQ ID NO: 24375 - RNA, 18 nt, Artificial Sequence
  Description of Artificial Sequence: Synthetic oligonucleotide
ucuggagugcaagacaca

SEQ ID NO: 24376 - RNA, 18 nt, Artificial Sequence
  Description of Artificial Sequence: Synthetic oligonucleotide
ucagcucuggagugcaag

SEQ ID NO: 24377 - RNA, 18 nt, Artificial Sequence
  Description of Artificial Sequence: Synthetic oligonucleotide
ggaggucagcucuggagu

SEQ ID NO: 24378 - RNA, 18 nt, Artificial Sequence
  Description of Artificial Sequence: Synthetic oligonucleotide
gcgguggaggucagcucu

SEQ ID NO: 24379 - RNA, 18 nt, Artificial Sequence
  Description of Artificial Sequence: Synthetic oligonucleotide
gcugggcgguggagguca

SEQ ID NO: 24380 - RNA, 18 nt, Artificial Sequence
  Description of Artificial Sequence: Synthetic oligonucleotide
cccaggcugggcggugga

SEQ ID NO: 24381 - RNA, 18 nt, Artificial Sequence
  Description of Artificial Sequence: Synthetic oligonucleotide
gacuucccaggcugggcg

SEQ ID NO: 24382 - RNA, 18 nt, Artificial Sequence
  Description of Artificial Sequence: Synthetic oligonucleotide
acaaugacuucccaggcu

SEQ ID NO: 24383 - RNA, 18 nt, Artificial Sequence
  Description of Artificial Sequence: Synthetic oligonucleotide
ucccuacaaugacuuccc

SEQ ID NO: 24384 - RNA, 18 nt, Artificial Sequence
  Description of Artificial Sequence: Synthetic oligonucleotide
cucacucccuacaaugac

SEQ ID NO: 24385 - RNA, 18 nt, Artificial Sequence
  Description of Artificial Sequence: Synthetic oligonucleotide
agugucucacucccuaca

SEQ ID NO: 24386 - RNA, 18 nt, Artificial Sequence
  Description of Artificial Sequence: Synthetic oligonucleotide
gcuucagugucucacucc

SEQ ID NO: 24387 - RNA, 18 nt, Artificial Sequence
  Description of Artificial Sequence: Synthetic oligonucleotide
ucagggcuucagugucuc

SEQ ID NO: 24388 - RNA, 18 nt, Artificial Sequence
  Description of Artificial Sequence: Synthetic oligonucleotide
gcuucucagggcuucagu

SEQ ID NO: 24389 - RNA, 18 nt, Artificial Sequence
  Description of Artificial Sequence: Synthetic oligonucleotide
cacuggcuucucagggcu

SEQ ID NO: 24390 - RNA, 18 nt, Artificial Sequence
  Description of Artificial Sequence: Synthetic oligonucleotide
gauggcacuggcuucuca

SEQ ID NO: 24391 - RNA, 18 nt, Artificial Sequence
  Description of Artificial Sequence: Synthetic oligonucleotide
gggaugauggcacuggcu

SEQ ID NO: 24392 - RNA, 18 nt, Artificial Sequence
  Description of Artificial Sequence: Synthetic oligonucleotide
auguuccggaacccuggg

SEQ ID NO: 24393 - RNA, 18 nt, Artificial Sequence
  Description of Artificial Sequence: Synthetic oligonucleotide
aaugaauguuccggaacc

SEQ ID NO: 24394 - RNA, 18 nt, Artificial Sequence
  Description of Artificial Sequence: Synthetic oligonucleotide
gggaaugaauguuccgga

SEQ ID NO: 24395 - RNA, 18 nt, Artificial Sequence
  Description of Artificial Sequence: Synthetic oligonucleotide
cagguccucaccgguggg

SEQ ID NO: 24396 - RNA, 18 nt, Artificial Sequence
  Description of Artificial Sequence: Synthetic oligonucleotide
caugccagguccucaccg

SEQ ID NO: 24397 - RNA, 18 nt, Artificial Sequence
  Description of Artificial Sequence: Synthetic oligonucleotide
cgcugcaugccagguccu

SEQ ID NO: 24398 - RNA, 18 nt, Artificial Sequence
  Description of Artificial Sequence: Synthetic oligonucleotide
ugcuucgcugcaugccag

SEQ ID NO: 24399 - RNA, 18 nt, Artificial Sequence
  Description of Artificial Sequence: Synthetic oligonucleotide
ugggcugcuucgcugcau

SEQ ID NO: 24400 - RNA, 18 nt, Artificial Sequence
  Description of Artificial Sequence: Synthetic oligonucleotide
cgggcugggcugcuucgc

SEQ ID NO: 24401 - RNA, 18 nt, Artificial Sequence
  Description of Artificial Sequence: Synthetic oligonucleotide
uccgccgggcugggcugc

SEQ ID NO: 24402 - RNA, 18 nt, Artificial Sequence
  Description of Artificial Sequence: Synthetic oligonucleotide
ugggauccgccgggcugg

SEQ ID NO: 24403 - RNA, 18 nt, Artificial Sequence
  Description of Artificial Sequence: Synthetic oligonucleotide
uggccugggauccgccgg

SEQ ID NO: 24404 - RNA, 18 nt, Artificial Sequence
  Description of Artificial Sequence: Synthetic oligonucleotide
cgugcuggccugggaucc

SEQ ID NO: 24405 - RNA, 18 nt, Artificial Sequence
  Description of Artificial Sequence: Synthetic oligonucleotide
gcaggcgugcuggccugg

SEQ ID NO: 24406 - RNA, 18 nt, Artificial Sequence
  Description of Artificial Sequence: Synthetic oligonucleotide
agccggcaggcgugcugg

SEQ ID NO: 24407 - RNA, 18 nt, Artificial Sequence
  Description of Artificial Sequence: Synthetic oligonucleotide
ugagaagccggcaggcgu

SEQ ID NO: 24408 - RNA, 18 nt, Artificial Sequence
  Description of Artificial Sequence: Synthetic oligonucleotide
gacgaugagaagccggca

SEQ ID NO: 24409 - RNA, 18 nt, Artificial Sequence
  Description of Artificial Sequence: Synthetic oligonucleotide
ucccugacgaugagaagc

SEQ ID NO: 24410 - RNA, 18 nt, Artificial Sequence
  Description of Artificial Sequence: Synthetic oligonucleotide
cgggcucccugacgauga

SEQ ID NO: 24411 - RNA, 18 nt, Artificial Sequence
  Description of Artificial Sequence: Synthetic oligonucleotide
cugggcgggcucccugac

SEQ ID NO: 24412 - RNA, 18 nt, Artificial Sequence
  Description of Artificial Sequence: Synthetic oligonucleotide
gagcucugggcgggcucc

SEQ ID NO: 24413 - RNA, 18 nt, Artificial Sequence
  Description of Artificial Sequence: Synthetic oligonucleotide
gucacgagcucugggcgg

SEQ ID NO: 24414 - RNA, 18 nt, Artificial Sequence
  Description of Artificial Sequence: Synthetic oligonucleotide
ugcucgucacgagcucug

SEQ ID NO: 24415 - RNA, 18 nt, Artificial Sequence
  Description of Artificial Sequence: Synthetic oligonucleotide
gcacuugcucgucacgag

SEQ ID NO: 24416 - RNA, 18 nt, Artificial Sequence
  Description of Artificial Sequence: Synthetic oligonucleotide
acccagcacuugcucguc

SEQ ID NO: 24417 - RNA, 18 nt, Artificial Sequence
  Description of Artificial Sequence: Synthetic oligonucleotide
gggacccagcacuugcuc

SEQ ID NO: 24418 - RNA, 18 nt, Artificial Sequence
  Description of Artificial Sequence: Synthetic oligonucleotide
ccagagcgccgccucggg

SEQ ID NO: 24419 - RNA, 18 nt, Artificial Sequence
  Description of Artificial Sequence: Synthetic oligonucleotide
gccagccagagcgccgcc

SEQ ID NO: 24420 - RNA, 18 nt, Artificial Sequence
  Description of Artificial Sequence: Synthetic oligonucleotide
cagcugccagccagagcg

SEQ ID NO: 24421 - RNA, 18 nt, Artificial Sequence
  Description of Artificial Sequence: Synthetic oligonucleotide
cccaccagcugccagcca

SEQ ID NO: 24422 - RNA, 18 nt, Artificial Sequence
  Description of Artificial Sequence: Synthetic oligonucleotide
uauuccccaccagcugcc

SEQ ID NO: 24423 - RNA, 18 nt, Artificial Sequence
  Description of Artificial Sequence: Synthetic oligonucleotide
cugccuauuccccaccag

SEQ ID NO: 24424 - RNA, 18 nt, Artificial Sequence
  Description of Artificial Sequence: Synthetic oligonucleotide
cugcccugccuauucccc

SEQ ID NO: 24425 - RNA, 18 nt, Artificial Sequence
  Description of Artificial Sequence: Synthetic oligonucleotide
cacagcugcccugccuau

SEQ ID NO: 24426 - RNA, 18 nt, Artificial Sequence
  Description of Artificial Sequence: Synthetic oligonucleotide
ccagccacagcugcccug

SEQ ID NO: 24427 - RNA, 18 nt, Artificial Sequence
  Description of Artificial Sequence: Synthetic oligonucleotide
ucuccccagccacagcug

SEQ ID NO: 24428 - RNA, 18 nt, Artificial Sequence
  Description of Artificial Sequence: Synthetic oligonucleotide
aagucucuccccagccac

SEQ ID NO: 24429 - RNA, 18 nt, Artificial Sequence
  Description of Artificial Sequence: Synthetic oligonucleotide
gccuaaagucucucccca

SEQ ID NO: 24430 - RNA, 18 nt, Artificial Sequence
  Description of Artificial Sequence: Synthetic oligonucleotide
cuucugccuaaagucucu

SEQ ID NO: 24431 - RNA, 18 nt, Artificial Sequence
  Description of Artificial Sequence: Synthetic oligonucleotide
cacagcuucugccuaaag

SEQ ID NO: 24432 - RNA, 18 nt, Artificial Sequence
  Description of Artificial Sequence: Synthetic oligonucleotide
ugcaucacagcuucugcc

SEQ ID NO: 24433 - RNA, 18 nt, Artificial Sequence
  Description of Artificial Sequence: Synthetic oligonucleotide
cagccugcaucacagcuu

SEQ ID NO: 24434 - RNA, 18 nt, Artificial Sequence
  Description of Artificial Sequence: Synthetic oligonucleotide
gcagucagccugcaucac

SEQ ID NO: 24435 - RNA, 18 nt, Artificial Sequence
  Description of Artificial Sequence: Synthetic oligonucleotide
ggcuggcagucagccugc

SEQ ID NO: 24436 - RNA, 18 nt, Artificial Sequence
  Description of Artificial Sequence: Synthetic oligonucleotide
cccucggcuggcagucag

SEQ ID NO: 24437 - RNA, 18 nt, Artificial Sequence
  Description of Artificial Sequence: Synthetic oligonucleotide
ccagccccucggcuggca

SEQ ID NO: 24438 - RNA, 18 nt, Artificial Sequence
  Description of Artificial Sequence: Synthetic oligonucleotide
acuacccagccccucggc

SEQ ID NO: 24439 - RNA, 18 nt, Artificial Sequence
  Description of Artificial Sequence: Synthetic oligonucleotide
acggcacuacccagcccc

SEQ ID NO: 24440 - RNA, 18 nt, Artificial Sequence
  Description of Artificial Sequence: Synthetic oligonucleotide
cccgcacggcacuaccca

SEQ ID NO: 24441 - RNA, 18 nt, Artificial Sequence
  Description of Artificial Sequence: Synthetic oligonucleotide
cagcucccgcacggcacu

SEQ ID NO: 24442 - RNA, 18 nt, Artificial Sequence
  Description of Artificial Sequence: Synthetic oligonucleotide
accaucagcucccgcacg

SEQ ID NO: 24443 - RNA, 18 nt, Artificial Sequence
  Description of Artificial Sequence: Synthetic oligonucleotide
ccuguaccaucagcuccc

SEQ ID NO: 24444 - RNA, 18 nt, Artificial Sequence
  Description of Artificial Sequence: Synthetic oligonucleotide
agugcccuguaccaucag

SEQ ID NO: 24445 - RNA, 18 nt, Artificial Sequence
  Description of Artificial Sequence: Synthetic oligonucleotide
cagcgagugcccuguacc

SEQ ID NO: 24446 - RNA, 18 nt, Artificial Sequence
  Description of Artificial Sequence: Synthetic oligonucleotide
gggacagcgagugcccug

SEQ ID NO: 24447 - RNA, 18 nt, Artificial Sequence
  Description of Artificial Sequence: Synthetic oligonucleotide
ucuaggguggccggaggg

SEQ ID NO: 24448 - RNA, 18 nt, Artificial Sequence
  Description of Artificial Sequence: Synthetic oligonucleotide
ccuggucuaggguggccg

SEQ ID NO: 24449 - RNA, 18 nt, Artificial Sequence
  Description of Artificial Sequence: Synthetic oligonucleotide
cggacccuggucuagggu

SEQ ID NO: 24450 - RNA, 18 nt, Artificial Sequence
  Description of Artificial Sequence: Synthetic oligonucleotide
ccucucggacccuggucu

SEQ ID NO: 24451 - RNA, 18 nt, Artificial Sequence
  Description of Artificial Sequence: Synthetic oligonucleotide
gccugccucucggacccu

SEQ ID NO: 24452 - RNA, 18 nt, Artificial Sequence
  Description of Artificial Sequence: Synthetic oligonucleotide
cuccugccugccucucgg

SEQ ID NO: 24453 - RNA, 18 nt, Artificial Sequence
  Description of Artificial Sequence: Synthetic oligonucleotide
aguggcuccugccugccu

SEQ ID NO: 24454 - RNA, 18 nt, Artificial Sequence
  Description of Artificial Sequence: Synthetic oligonucleotide
acaugaguggcuccugcc

SEQ ID NO: 24455 - RNA, 18 nt, Artificial Sequence
  Description of Artificial Sequence: Synthetic oligonucleotide
ggaagacaugaguggcuc

SEQ ID NO: 24456 - RNA, 18 nt, Artificial Sequence
  Description of Artificial Sequence: Synthetic oligonucleotide
gggaagacaugaguggcu

SEQ ID NO: 24457 - RNA, 18 nt, Artificial Sequence
  Description of Artificial Sequence: Synthetic oligonucleotide
ugggcgucgggcaauggg

SEQ ID NO: 24458 - RNA, 18 nt, Artificial Sequence
  Description of Artificial Sequence: Synthetic oligonucleotide
gucuaugggcgucgggca

SEQ ID NO: 24459 - RNA, 18 nt, Artificial Sequence
  Description of Artificial Sequence: Synthetic oligonucleotide
ggagcgucuaugggcguc

SEQ ID NO: 24460 - RNA, 18 nt, Artificial Sequence
  Description of Artificial Sequence: Synthetic oligonucleotide
aggaaggagcgucuaugg

SEQ ID NO: 24461 - RNA, 18 nt, Artificial Sequence
  Description of Artificial Sequence: Synthetic oligonucleotide
cacacaggaaggagcguc

SEQ ID NO: 24462 - RNA, 18 nt, Artificial Sequence
  Description of Artificial Sequence: Synthetic oligonucleotide
agccccacacaggaagga

SEQ ID NO: 24463 - RNA, 18 nt, Artificial Sequence
  Description of Artificial Sequence: Synthetic oligonucleotide
accccagccccacacagg

SEQ ID NO: 24464 - RNA, 18 nt, Artificial Sequence
  Description of Artificial Sequence: Synthetic oligonucleotide
ggaguaccccagccccac

SEQ ID NO: 24465 - RNA, 18 nt, Artificial Sequence
  Description of Artificial Sequence: Synthetic oligonucleotide
accagggaguaccccagc

SEQ ID NO: 24466 - RNA, 18 nt, Artificial Sequence
  Description of Artificial Sequence: Synthetic oligonucleotide
guacgaccagggaguacc

SEQ ID NO: 24467 - RNA, 18 nt, Artificial Sequence
  Description of Artificial Sequence: Synthetic oligonucleotide
cugcaguacgaccaggga

SEQ ID NO: 24468 - RNA, 18 nt, Artificial Sequence
  Description of Artificial Sequence: Synthetic oligonucleotide
gcugacugcaguacgacc

SEQ ID NO: 24469 - RNA, 18 nt, Artificial Sequence
  Description of Artificial Sequence: Synthetic oligonucleotide
cgggugcugacugcagua

SEQ ID NO: 24470 - RNA, 18 nt, Artificial Sequence
  Description of Artificial Sequence: Synthetic oligonucleotide
gguuacgggugcugacug

SEQ ID NO: 24471 - RNA, 18 nt, Artificial Sequence
  Description of Artificial Sequence: Synthetic oligonucleotide
agccggguuacgggugcu

SEQ ID NO: 24472 - RNA, 18 nt, Artificial Sequence
  Description of Artificial Sequence: Synthetic oligonucleotide
gucauagccggguuacgg

SEQ ID NO: 24473 - RNA, 18 nt, Artificial Sequence
  Description of Artificial Sequence: Synthetic oligonucleotide
cccuggucauagccgggu

SEQ ID NO: 24474 - RNA, 18 nt, Artificial Sequence
  Description of Artificial Sequence: Synthetic oligonucleotide
cagaucccuggucauagc

SEQ ID NO: 24475 - RNA, 18 nt, Artificial Sequence
  Description of Artificial Sequence: Synthetic oligonucleotide
gcuuacagaucccugguc

SEQ ID NO: 24476 - RNA, 18 nt, Artificial Sequence
  Description of Artificial Sequence: Synthetic oligonucleotide
acagggcuuacagauccc

SEQ ID NO: 24477 - RNA, 18 nt, Artificial Sequence
  Description of Artificial Sequence: Synthetic oligonucleotide
gagccacagggcuuacag

SEQ ID NO: 24478 - RNA, 18 nt, Artificial Sequence
  Description of Artificial Sequence: Synthetic oligonucleotide
cuguggagccacagggcu

SEQ ID NO: 24479 - RNA, 18 nt, Artificial Sequence
  Description of Artificial Sequence: Synthetic oligonucleotide
agcaccuguggagccaca

SEQ ID NO: 24480 - RNA, 18 nt, Artificial Sequence
  Description of Artificial Sequence: Synthetic oligonucleotide
gaagcagcaccuguggag

SEQ ID NO: 24481 - RNA, 18 nt, Artificial Sequence
  Description of Artificial Sequence: Synthetic oligonucleotide
agugagaagcagcaccug

SEQ ID NO: 24482 - RNA, 18 nt, Artificial Sequence
  Description of Artificial Sequence: Synthetic oligonucleotide
gggccagugagaagcagc

SEQ ID NO: 24483 - RNA, 18 nt, Artificial Sequence
  Description of Artificial Sequence: Synthetic oligonucleotide
agucugggccagugagaa

SEQ ID NO: 24484 - RNA, 18 nt, Artificial Sequence
  Description of Artificial Sequence: Synthetic oligonucleotide
cucagagucugggccagu

SEQ ID NO: 24485 - RNA, 18 nt, Artificial Sequence
  Description of Artificial Sequence: Synthetic oligonucleotide
uggagcucagagucuggg

SEQ ID NO: 24486 - RNA, 18 nt, Artificial Sequence
  Description of Artificial Sequence: Synthetic oligonucleotide
gccgguggagcucagagu

SEQ ID NO: 24487 - RNA, 18 nt, Artificial Sequence
  Description of Artificial Sequence: Synthetic oligonucleotide
acugggccgguggagcuc

SEQ ID NO: 24488 - RNA, 18 nt, Artificial Sequence
  Description of Artificial Sequence: Synthetic oligonucleotide
ugcagacugggccggugg

SEQ ID NO: 24489 - RNA, 18 nt, Artificial Sequence
  Description of Artificial Sequence: Synthetic oligonucleotide
ggccgugcagacugggcc

SEQ ID NO: 24490 - RNA, 18 nt, Artificial Sequence
  Description of Artificial Sequence: Synthetic oligonucleotide
agaugggccgugcagacu

SEQ ID NO: 24491 - RNA, 18 nt, Artificial Sequence
  Description of Artificial Sequence: Synthetic oligonucleotide
gaagcagaugggccgugc

SEQ ID NO: 24492 - RNA, 18 nt, Artificial Sequence
  Description of Artificial Sequence: Synthetic oligonucleotide
aaggugaagcagaugggc

SEQ ID NO: 24493 - RNA, 18 nt, Artificial Sequence
  Description of Artificial Sequence: Synthetic oligonucleotide
gagggaaggugaagcaga

SEQ ID NO: 24494 - RNA, 18 nt, Artificial Sequence
  Description of Artificial Sequence: Synthetic oligonucleotide
gcugggagggaaggugaa

SEQ ID NO: 24495 - RNA, 18 nt, Artificial Sequence
  Description of Artificial Sequence: Synthetic oligonucleotide
acguggcugggagggaag

SEQ ID NO: 24496 - RNA, 18 nt, Artificial Sequence
  Description of Artificial Sequence: Synthetic oligonucleotide
cuggcacguggcugggag

SEQ ID NO: 24497 - RNA, 18 nt, Artificial Sequence
  Description of Artificial Sequence: Synthetic oligonucleotide
ggccacuggcacguggcu

SEQ ID NO: 24498 - RNA, 18 nt, Artificial Sequence
  Description of Artificial Sequence: Synthetic oligonucleotide
gcuguggccacuggcacg

SEQ ID NO: 24499 - RNA, 18 nt, Artificial Sequence
  Description of Artificial Sequence: Synthetic oligonucleotide
agugggcuguggccacug

SEQ ID NO: 24500 - RNA, 18 nt, Artificial Sequence
  Description of Artificial Sequence: Synthetic oligonucleotide
ugggaagugggcuguggc

SEQ ID NO: 24501 - RNA, 18 nt, Artificial Sequence
  Description of Artificial Sequence: Synthetic oligonucleotide
uggguugggaagugggcu

SEQ ID NO: 24502 - RNA, 18 nt, Artificial Sequence
  Description of Artificial Sequence: Synthetic oligonucleotide
aacaguggguugggaagu

SEQ ID NO: 24503 - RNA, 18 nt, Artificial Sequence
  Description of Artificial Sequence: Synthetic oligonucleotide
gguacaacaguggguugg

SEQ ID NO: 24504 - RNA, 18 nt, Artificial Sequence
  Description of Artificial Sequence: Synthetic oligonucleotide
gccuggguacaacagugg

SEQ ID NO: 24505 - RNA, 18 nt, Artificial Sequence
  Description of Artificial Sequence: Synthetic oligonucleotide
gugaggccuggguacaac

SEQ ID NO: 24506 - RNA, 18 nt, Artificial Sequence
  Description of Artificial Sequence: Synthetic oligonucleotide
gcaaagugaggccugggu

SEQ ID NO: 24507 - RNA, 18 nt, Artificial Sequence
  Description of Artificial Sequence: Synthetic oligonucleotide
caacagcaaagugaggcc

SEQ ID NO: 24508 - RNA, 18 nt, Artificial Sequence
  Description of Artificial Sequence: Synthetic oligonucleotide
aagggcaacagcaaagug

SEQ ID NO: 24509 - RNA, 18 nt, Artificial Sequence
  Description of Artificial Sequence: Synthetic oligonucleotide
gggacaagggcaacagca

SEQ ID NO: 24510 - RNA, 18 nt, Artificial Sequence
  Description of Artificial Sequence: Synthetic oligonucleotide
gaagagggacaagggcaa

SEQ ID NO: 24511 - RNA, 18 nt, Artificial Sequence
  Description of Artificial Sequence: Synthetic oligonucleotide
ggcccgaagagggacaag

SEQ ID NO: 24512 - RNA, 18 nt, Artificial Sequence
  Description of Artificial Sequence: Synthetic oligonucleotide
uucagggcccgaagaggg

SEQ ID NO: 24513 - RNA, 18 nt, Artificial Sequence
  Description of Artificial Sequence: Synthetic oligonucleotide
gaaaauucagggcccgaa

SEQ ID NO: 24514 - RNA, 18 nt, Artificial Sequence
  Description of Artificial Sequence: Synthetic oligonucleotide
gaacagaaaauucagggc

SEQ ID NO: 24515 - RNA, 18 nt, Artificial Sequence
  Description of Artificial Sequence: Synthetic oligonucleotide
ccagggaacagaaaauuc

SEQ ID NO: 24516 - RNA, 18 nt, Artificial Sequence
  Description of Artificial Sequence: Synthetic oligonucleotide
ggcccccagggaacagaa

SEQ ID NO: 24517 - RNA, 18 nt, Artificial Sequence
  Description of Artificial Sequence: Synthetic oligonucleotide
uggcuggcccccagggaa

SEQ ID NO: 24518 - RNA, 18 nt, Artificial Sequence
  Description of Artificial Sequence: Synthetic oligonucleotide
ggcccuggcuggccccca

SEQ ID NO: 24519 - RNA, 18 nt, Artificial Sequence
  Description of Artificial Sequence: Synthetic oligonucleotide
caaagggcccuggcuggc

SEQ ID NO: 24520 - RNA, 18 nt, Artificial Sequence
  Description of Artificial Sequence: Synthetic oligonucleotide
gggcacaaagggcccugg

SEQ ID NO: 24521 - RNA, 18 nt, Artificial Sequence
  Description of Artificial Sequence: Synthetic oligonucleotide
caucaggccugugcuggg

SEQ ID NO: 24522 - RNA, 18 nt, Artificial Sequence
  Description of Artificial Sequence: Synthetic oligonucleotide
accugcaucaggccugug

SEQ ID NO: 24523 - RNA, 18 nt, Artificial Sequence
  Description of Artificial Sequence: Synthetic oligonucleotide
uggacaccugcaucaggc

SEQ ID NO: 24524 - RNA, 18 nt, Artificial Sequence
  Description of Artificial Sequence: Synthetic oligonucleotide
gugaguggacaccugcau

SEQ ID NO: 24525 - RNA, 18 nt, Artificial Sequence
  Description of Artificial Sequence: Synthetic oligonucleotide
caccugugaguggacacc

SEQ ID NO: 24526 - RNA, 18 nt, Artificial Sequence
  Description of Artificial Sequence: Synthetic oligonucleotide
agcgccaccugugagugg

SEQ ID NO: 24527 - RNA, 18 nt, Artificial Sequence
  Description of Artificial Sequence: Synthetic oligonucleotide
aggugagcgccaccugug

SEQ ID NO: 24528 - RNA, 18 nt, Artificial Sequence
  Description of Artificial Sequence: Synthetic oligonucleotide
agccuaggugagcgccac

SEQ ID NO: 24529 - RNA, 18 nt, Artificial Sequence
  Description of Artificial Sequence: Synthetic oligonucleotide
gugacagccuaggugagc

SEQ ID NO: 24530 - RNA, 18 nt, Artificial Sequence
  Description of Artificial Sequence: Synthetic oligonucleotide
guccugugacagccuagg

SEQ ID NO: 24531 - RNA, 18 nt, Artificial Sequence
  Description of Artificial Sequence: Synthetic oligonucleotide
gguggguccugugacagc

SEQ ID NO: 24532 - RNA, 18 nt, Artificial Sequence
  Description of Artificial Sequence: Synthetic oligonucleotide
auggagguggguccugug

SEQ ID NO: 24533 - RNA, 18 nt, Artificial Sequence
  Description of Artificial Sequence: Synthetic oligonucleotide
cuggcauggagguggguc

SEQ ID NO: 24534 - RNA, 18 nt, Artificial Sequence
  Description of Artificial Sequence: Synthetic oligonucleotide
guugccuggcauggaggu

SEQ ID NO: 24535 - RNA, 18 nt, Artificial Sequence
  Description of Artificial Sequence: Synthetic oligonucleotide
ccucuguugccuggcaug

SEQ ID NO: 24536 - RNA, 18 nt, Artificial Sequence
  Description of Artificial Sequence: Synthetic oligonucleotide
guggcccucuguugccug

SEQ ID NO: 24537 - RNA, 18 nt, Artificial Sequence
  Description of Artificial Sequence: Synthetic oligonucleotide
guucuguggcccucuguu

SEQ ID NO: 24538 - RNA, 18 nt, Artificial Sequence
  Description of Artificial Sequence: Synthetic oligonucleotide
gggugguucuguggcccu

SEQ ID NO: 24539 - RNA, 18 nt, Artificial Sequence
  Description of Artificial Sequence: Synthetic oligonucleotide
gaccaaggagugagccgu

SEQ ID NO: 24540 - RNA, 18 nt, Artificial Sequence
  Description of Artificial Sequence: Synthetic oligonucleotide
ccccagaccaaggaguga

SEQ ID NO: 24541 - RNA, 18 nt, Artificial Sequence
  Description of Artificial Sequence: Synthetic oligonucleotide
gguggccccagaccaagg

SEQ ID NO: 24542 - RNA, 18 nt, Artificial Sequence
  Description of Artificial Sequence: Synthetic oligonucleotide
aagaagguggccccagac

SEQ ID NO: 24543 - RNA, 18 nt, Artificial Sequence
  Description of Artificial Sequence: Synthetic oligonucleotide
agggcaagaagguggccc

SEQ ID NO: 24544 - RNA, 18 nt, Artificial Sequence
  Description of Artificial Sequence: Synthetic oligonucleotide
aagaaagggcaagaaggu

SEQ ID NO: 24545 - RNA, 18 nt, Artificial Sequence
  Description of Artificial Sequence: Synthetic oligonucleotide
aaaaaaagaaagggcaag

SEQ ID NO: 24546 - RNA, 18 nt, Artificial Sequence
  Description of Artificial Sequence: Synthetic oligonucleotide
aaaaaaaaaaaagaaagg

SEQ ID NO: 24547 - RNA, 18 nt, Artificial Sequence
  Description of Artificial Sequence: Synthetic oligonucleotide
aaaaaaaaaaaaaaaaag

SEQ ID NO: 24548 - RNA, 18 nt, Artificial Sequence
  Description of Artificial Sequence: Synthetic oligonucleotide
aaaaaaaaaaaaaaaaaa

SEQ ID NO: 24549 - RNA, 18 nt, Artificial Sequence
  Description of Artificial Sequence: Synthetic oligonucleotide
ucggaaaaaaaaaaaaaa

SEQ ID NO: 24550 - RNA, 18 nt, Artificial Sequence
  Description of Artificial Sequence: Synthetic oligonucleotide
ccaucucggaaaaaaaaa

SEQ ID NO: 24551 - RNA, 18 nt, Artificial Sequence
  Description of Artificial Sequence: Synthetic oligonucleotide
agacuccaucucggaaaa

SEQ ID NO: 24552 - RNA, 18 nt, Artificial Sequence
  Description of Artificial Sequence: Synthetic oligonucleotide
gagagagacuccaucucg

SEQ ID NO: 24553 - RNA, 18 nt, Artificial Sequence
  Description of Artificial Sequence: Synthetic oligonucleotide
ugacagagagagacucca

SEQ ID NO: 24554 - RNA, 18 nt, Artificial Sequence
  Description of Artificial Sequence: Synthetic oligonucleotide
cugggugacagagagaga

SEQ ID NO: 24555 - RNA, 18 nt, Artificial Sequence
  Description of Artificial Sequence: Synthetic oligonucleotide
cccaccugggugacagag

SEQ ID NO: 24556 - RNA, 18 nt, Artificial Sequence
  Description of Artificial Sequence: Synthetic oligonucleotide
acacucccaccuggguga

SEQ ID NO: 24557 - RNA, 18 nt, Artificial Sequence
  Description of Artificial Sequence: Synthetic oligonucleotide
ccaccacacucccaccug

SEQ ID NO: 24558 - RNA, 18 nt, Artificial Sequence
  Description of Artificial Sequence: Synthetic oligonucleotide
uugugccaccacacuccc

SEQ ID NO: 24559 - RNA, 18 nt, Artificial Sequence
  Description of Artificial Sequence: Synthetic oligonucleotide
cgagauugugccaccaca

SEQ ID NO: 24560 - RNA, 18 nt, Artificial Sequence
  Description of Artificial Sequence: Synthetic oligonucleotide
ugagccgagauugugcca

SEQ ID NO: 24561 - RNA, 18 nt, Artificial Sequence
  Description of Artificial Sequence: Synthetic oligonucleotide
ugcagugagccgagauug

SEQ ID NO: 24562 - RNA, 18 nt, Artificial Sequence
  Description of Artificial Sequence: Synthetic oligonucleotide
gagguugcagugagccga

SEQ ID NO: 24563 - RNA, 18 nt, Artificial Sequence
  Description of Artificial Sequence: Synthetic oligonucleotide
agguggagguugcaguga

SEQ ID NO: 24564 - RNA, 18 nt, Artificial Sequence
  Description of Artificial Sequence: Synthetic oligonucleotide
ucaggagguggagguugc

SEQ ID NO: 24565 - RNA, 18 nt, Artificial Sequence
  Description of Artificial Sequence: Synthetic oligonucleotide
ugaacucaggagguggag

SEQ ID NO: 24566 - RNA, 18 nt, Artificial Sequence
  Description of Artificial Sequence: Synthetic oligonucleotide
uugcuugaacucaggagg

SEQ ID NO: 24567 - RNA, 18 nt, Artificial Sequence
  Description of Artificial Sequence: Synthetic oligonucleotide
gagaauugcuugaacuca

SEQ ID NO: 24568 - RNA, 18 nt, Artificial Sequence
  Description of Artificial Sequence: Synthetic oligonucleotide
ggcaggagaauugcuuga

SEQ ID NO: 24569 - RNA, 18 nt, Artificial Sequence
  Description of Artificial Sequence: Synthetic oligonucleotide
gcugaggcaggagaauug

SEQ ID NO: 24570 - RNA, 18 nt, Artificial Sequence
  Description of Artificial Sequence: Synthetic oligonucleotide
gggaggcugaggcaggag

SEQ ID NO: 24571 - RNA, 18 nt, Artificial Sequence
  Description of Artificial Sequence: Synthetic oligonucleotide
uacuugggaggcugaggc

SEQ ID NO: 24572 - RNA, 18 nt, Artificial Sequence
  Description of Artificial Sequence: Synthetic oligonucleotide
ccagcuacuugggaggcu

SEQ ID NO: 24573 - RNA, 18 nt, Artificial Sequence
  Description of Artificial Sequence: Synthetic oligonucleotide
uagucccagcuacuuggg

SEQ ID NO: 24574 - RNA, 18 nt, Artificial Sequence
  Description of Artificial Sequence: Synthetic oligonucleotide
gccuguagucccagcuac

SEQ ID NO: 24575 - RNA, 18 nt, Artificial Sequence
  Description of Artificial Sequence: Synthetic oligonucleotide
ugcaugccuguaguccca

SEQ ID NO: 24576 - RNA, 18 nt, Artificial Sequence
  Description of Artificial Sequence: Synthetic oligonucleotide
gguggugcaugccuguag

SEQ ID NO: 24577 - RNA, 18 nt, Artificial Sequence
  Description of Artificial Sequence: Synthetic oligonucleotide
agugugguggugcaugcc

SEQ ID NO: 24578 - RNA, 18 nt, Artificial Sequence
  Description of Artificial Sequence: Synthetic oligonucleotide
ggccaagugugguggugc

SEQ ID NO: 24579 - RNA, 18 nt, Artificial Sequence
  Description of Artificial Sequence: Synthetic oligonucleotide
acauuggccaaguguggu

SEQ ID NO: 24580 - RNA, 18 nt, Artificial Sequence
  Description of Artificial Sequence: Synthetic oligonucleotide
acagaacauuggccaagu

SEQ ID NO: 24581 - RNA, 18 nt, Artificial Sequence
  Description of Artificial Sequence: Synthetic oligonucleotide
aaaauacagaacauuggc

SEQ ID NO: 24582 - RNA, 18 nt, Artificial Sequence
  Description of Artificial Sequence: Synthetic oligonucleotide
uauuaaaaauacagaaca

SEQ ID NO: 24583 - RNA, 18 nt, Artificial Sequence
  Description of Artificial Sequence: Synthetic oligonucleotide
gucccuauuaaaaauaca

SEQ ID NO: 24584 - RNA, 18 nt, Artificial Sequence
  Description of Artificial Sequence: Synthetic oligonucleotide
accccgucccuauuaaaa

SEQ ID NO: 24585 - RNA, 18 nt, Artificial Sequence
  Description of Artificial Sequence: Synthetic oligonucleotide
gcaaaaccccgucccuau

SEQ ID NO: 24586 - RNA, 18 nt, Artificial Sequence
  Description of Artificial Sequence: Synthetic oligonucleotide
acauggcaaaaccccguc

SEQ ID NO: 24587 - RNA, 18 nt, Artificial Sequence
  Description of Artificial Sequence: Synthetic oligonucleotide
agcuaacauggcaaaacc

SEQ ID NO: 24588 - RNA, 18 nt, Artificial Sequence
  Description of Artificial Sequence: Synthetic oligonucleotide
agccuagcuaacauggca

SEQ ID NO: 24589 - RNA, 18 nt, Artificial Sequence
  Description of Artificial Sequence: Synthetic oligonucleotide
agaccagccuagcuaaca

SEQ ID NO: 24590 - RNA, 18 nt, Artificial Sequence
  Description of Artificial Sequence: Synthetic oligonucleotide
guuugagaccagccuagc

SEQ ID NO: 24591 - RNA, 18 nt, Artificial Sequence
  Description of Artificial Sequence: Synthetic oligonucleotide
ugugaguuugagaccagc

SEQ ID NO: 24592 - RNA, 18 nt, Artificial Sequence
  Description of Artificial Sequence: Synthetic oligonucleotide
ccaggugugaguuugaga

SEQ ID NO: 24593 - RNA, 18 nt, Artificial Sequence
  Description of Artificial Sequence: Synthetic oligonucleotide
uaaucccaggugugaguu

SEQ ID NO: 24594 - RNA, 18 nt, Artificial Sequence
  Description of Artificial Sequence: Synthetic oligonucleotide
gccuguaaucccaggugu

SEQ ID NO: 24595 - RNA, 18 nt, Artificial Sequence
  Description of Artificial Sequence: Synthetic oligonucleotide
cucaugccuguaauccca

SEQ ID NO: 24596 - RNA, 18 nt, Artificial Sequence
  Description of Artificial Sequence: Synthetic oligonucleotide
aguggcucaugccuguaa

SEQ ID NO: 24597 - RNA, 18 nt, Artificial Sequence
  Description of Artificial Sequence: Synthetic oligonucleotide
ggugcaguggcucaugcc

SEQ ID NO: 24598 - RNA, 18 nt, Artificial Sequence
  Description of Artificial Sequence: Synthetic oligonucleotide
ggcugggugcaguggcuc

SEQ ID NO: 24599 - RNA, 18 nt, Artificial Sequence
  Description of Artificial Sequence: Synthetic oligonucleotide
gggcugggugcaguggcu

SEQ ID NO: 24600 - RNA, 18 nt, Artificial Sequence
  Description of Artificial Sequence: Synthetic oligonucleotide
aagaaagggcaagaaggg

SEQ ID NO: 24601 - RNA, 18 nt, Artificial Sequence
  Description of Artificial Sequence: Synthetic oligonucleotide
gagaaaagaaagggcaag

SEQ ID NO: 24602 - RNA, 18 nt, Artificial Sequence
  Description of Artificial Sequence: Synthetic oligonucleotide
ccauggagaaaagaaagg

SEQ ID NO: 24603 - RNA, 18 nt, Artificial Sequence
  Description of Artificial Sequence: Synthetic oligonucleotide
aucagccauggagaaaag

SEQ ID NO: 24604 - RNA, 18 nt, Artificial Sequence
  Description of Artificial Sequence: Synthetic oligonucleotide
gcagcaucagccauggag

SEQ ID NO: 24605 - RNA, 18 nt, Artificial Sequence
  Description of Artificial Sequence: Synthetic oligonucleotide
ccacagcagcaucagcca

SEQ ID NO: 24606 - RNA, 18 nt, Artificial Sequence
  Description of Artificial Sequence: Synthetic oligonucleotide
gcuggccacagcagcauc

SEQ ID NO: 24607 - RNA, 18 nt, Artificial Sequence
  Description of Artificial Sequence: Synthetic oligonucleotide
cccuggcuggccacagca

SEQ ID NO: 24608 - RNA, 18 nt, Artificial Sequence
  Description of Artificial Sequence: Synthetic oligonucleotide
aagggcccuggcuggcca

SEQ ID NO: 24609 - RNA, 18 nt, Artificial Sequence
  Description of Artificial Sequence: Synthetic oligonucleotide
aucucaagggcccuggcu

SEQ ID NO: 24610 - RNA, 18 nt, Artificial Sequence
  Description of Artificial Sequence: Synthetic oligonucleotide
gaaggaucucaagggccc

SEQ ID NO: 24611 - RNA, 18 nt, Artificial Sequence
  Description of Artificial Sequence: Synthetic oligonucleotide
aacuggaaggaucucaag

SEQ ID NO: 24612 - RNA, 18 nt, Artificial Sequence
  Description of Artificial Sequence: Synthetic oligonucleotide
agccaaacuggaaggauc

SEQ ID NO: 24613 - RNA, 18 nt, Artificial Sequence
  Description of Artificial Sequence: Synthetic oligonucleotide
auaacagccaaacuggaa

SEQ ID NO: 24614 - RNA, 18 nt, Artificial Sequence
  Description of Artificial Sequence: Synthetic oligonucleotide
uuugcauaacagccaaac

SEQ ID NO: 24615 - RNA, 18 nt, Artificial Sequence
  Description of Artificial Sequence: Synthetic oligonucleotide
ccugcuuugcauaacagc

SEQ ID NO: 24616 - RNA, 18 nt, Artificial Sequence
  Description of Artificial Sequence: Synthetic oligonucleotide
aaucaccugcuuugcaua

SEQ ID NO: 24617 - RNA, 18 nt, Artificial Sequence
  Description of Artificial Sequence: Synthetic oligonucleotide
agacaaaucaccugcuuu

SEQ ID NO: 24618 - RNA, 18 nt, Artificial Sequence
  Description of Artificial Sequence: Synthetic oligonucleotide
gauuaagacaaaucaccu

SEQ ID NO: 24619 - RNA, 18 nt, Artificial Sequence
  Description of Artificial Sequence: Synthetic oligonucleotide
uaucugauuaagacaaau

SEQ ID NO: 24620 - RNA, 18 nt, Artificial Sequence
  Description of Artificial Sequence: Synthetic oligonucleotide
ucuuuuaucugauuaaga

SEQ ID NO: 24621 - RNA, 18 nt, Artificial Sequence
  Description of Artificial Sequence: Synthetic oligonucleotide
cucuaucuuuuaucugau

SEQ ID NO: 24622 - RNA, 18 nt, Artificial Sequence
  Description of Artificial Sequence: Synthetic oligonucleotide
auagccucuaucuuuuau

SEQ ID NO: 24623 - RNA, 18 nt, Artificial Sequence
  Description of Artificial Sequence: Synthetic oligonucleotide
cccccauagccucuaucu

SEQ ID NO: 24624 - RNA, 18 nt, Artificial Sequence
  Description of Artificial Sequence: Synthetic oligonucleotide
ugaggcccccauagccuc

SEQ ID NO: 24625 - RNA, 18 nt, Artificial Sequence
  Description of Artificial Sequence: Synthetic oligonucleotide
aaucuugaggcccccaua

SEQ ID NO: 24626 - RNA, 18 nt, Artificial Sequence
  Description of Artificial Sequence: Synthetic oligonucleotide
ccaaaaaucuugaggccc

SEQ ID NO: 24627 - RNA, 18 nt, Artificial Sequence
  Description of Artificial Sequence: Synthetic oligonucleotide
gcucuccaaaaaucuuga

SEQ ID NO: 24628 - RNA, 18 nt, Artificial Sequence
  Description of Artificial Sequence: Synthetic oligonucleotide
ccucugcucuccaaaaau

SEQ ID NO: 24629 - RNA, 18 nt, Artificial Sequence
  Description of Artificial Sequence: Synthetic oligonucleotide
gaccaccucugcucucca

SEQ ID NO: 24630 - RNA, 18 nt, Artificial Sequence
  Description of Artificial Sequence: Synthetic oligonucleotide
ccagagaccaccucugcu

SEQ ID NO: 24631 - RNA, 18 nt, Artificial Sequence
  Description of Artificial Sequence: Synthetic oligonucleotide
aauugccagagaccaccu

SEQ ID NO: 24632 - RNA, 18 nt, Artificial Sequence
  Description of Artificial Sequence: Synthetic oligonucleotide
gauggaauugccagagac

SEQ ID NO: 24633 - RNA, 18 nt, Artificial Sequence
  Description of Artificial Sequence: Synthetic oligonucleotide
aaccagauggaauugcca

SEQ ID NO: 24634 - RNA, 18 nt, Artificial Sequence
  Description of Artificial Sequence: Synthetic oligonucleotide
cucaaaaccagauggaau

SEQ ID NO: 24635 - RNA, 18 nt, Artificial Sequence
  Description of Artificial Sequence: Synthetic oligonucleotide
aguuucucaaaaccagau

SEQ ID NO: 24636 - RNA, 18 nt, Artificial Sequence
  Description of Artificial Sequence: Synthetic oligonucleotide
ugcuaaguuucucaaaac

SEQ ID NO: 24637 - RNA, 18 nt, Artificial Sequence
  Description of Artificial Sequence: Synthetic oligonucleotide
ugagcugcuaaguuucuc

SEQ ID NO: 24638 - RNA, 18 nt, Artificial Sequence
  Description of Artificial Sequence: Synthetic oligonucleotide
cucugugagcugcuaagu

SEQ ID NO: 24639 - RNA, 18 nt, Artificial Sequence
  Description of Artificial Sequence: Synthetic oligonucleotide
cugugcucugugagcugc

SEQ ID NO: 24640 - RNA, 18 nt, Artificial Sequence
  Description of Artificial Sequence: Synthetic oligonucleotide
gaucucugugcucuguga

SEQ ID NO: 24641 - RNA, 18 nt, Artificial Sequence
  Description of Artificial Sequence: Synthetic oligonucleotide
ggcaggaucucugugcuc

SEQ ID NO: 24642 - RNA, 18 nt, Artificial Sequence
  Description of Artificial Sequence: Synthetic oligonucleotide
aagaaggcaggaucucug

SEQ ID NO: 24643 - RNA, 18 nt, Artificial Sequence
  Description of Artificial Sequence: Synthetic oligonucleotide
guaggaagaaggcaggau

SEQ ID NO: 24644 - RNA, 18 nt, Artificial Sequence
  Description of Artificial Sequence: Synthetic oligonucleotide
ugauaguaggaagaaggc

SEQ ID NO: 24645 - RNA, 18 nt, Artificial Sequence
  Description of Artificial Sequence: Synthetic oligonucleotide
cagccugauaguaggaag

SEQ ID NO: 24646 - RNA, 18 nt, Artificial Sequence
  Description of Artificial Sequence: Synthetic oligonucleotide
uaggucagccugauagua

SEQ ID NO: 24647 - RNA, 18 nt, Artificial Sequence
  Description of Artificial Sequence: Synthetic oligonucleotide
cccauuaggucagccuga

SEQ ID NO: 24648 - RNA, 18 nt, Artificial Sequence
  Description of Artificial Sequence: Synthetic oligonucleotide
ccaaccccauuaggucag

SEQ ID NO: 24649 - RNA, 18 nt, Artificial Sequence
  Description of Artificial Sequence: Synthetic oligonucleotide
gcagcccaaccccauuag

SEQ ID NO: 24650 - RNA, 18 nt, Artificial Sequence
  Description of Artificial Sequence: Synthetic oligonucleotide
gccgagcagcccaacccc

SEQ ID NO: 24651 - RNA, 18 nt, Artificial Sequence
  Description of Artificial Sequence: Synthetic oligonucleotide
caguugccgagcagccca

SEQ ID NO: 24652 - RNA, 18 nt, Artificial Sequence
  Description of Artificial Sequence: Synthetic oligonucleotide
ccaagcaguugccgagca

SEQ ID NO: 24653 - RNA, 18 nt, Artificial Sequence
  Description of Artificial Sequence: Synthetic oligonucleotide
gugacccaagcaguugcc

SEQ ID NO: 24654 - RNA, 18 nt, Artificial Sequence
  Description of Artificial Sequence: Synthetic oligonucleotide
gcaaggugacccaagcag

SEQ ID NO: 24655 - RNA, 18 nt, Artificial Sequence
  Description of Artificial Sequence: Synthetic oligonucleotide
gggcaaggugacccaagc

SEQ ID NO: 24656 - RNA, 18 nt, Artificial Sequence
  Description of Artificial Sequence: Synthetic oligonucleotide
agggcugguuuccuuggg

SEQ ID NO: 24657 - RNA, 18 nt, Artificial Sequence
  Description of Artificial Sequence: Synthetic oligonucleotide
cacccagggcugguuucc

SEQ ID NO: 24658 - RNA, 18 nt, Artificial Sequence
  Description of Artificial Sequence: Synthetic oligonucleotide
gguggcacccagggcugg

SEQ ID NO: 24659 - RNA, 18 nt, Artificial Sequence
  Description of Artificial Sequence: Synthetic oligonucleotide
ggcuggguggcacccagg

SEQ ID NO: 24660 - RNA, 18 nt, Artificial Sequence
  Description of Artificial Sequence: Synthetic oligonucleotide
uaaguggcuggguggcac

SEQ ID NO: 24661 - RNA, 18 nt, Artificial Sequence
  Description of Artificial Sequence: Synthetic oligonucleotide
gacccuaaguggcugggu

SEQ ID NO: 24662 - RNA, 18 nt, Artificial Sequence
  Description of Artificial Sequence: Synthetic oligonucleotide
cuguagacccuaaguggc

SEQ ID NO: 24663 - RNA, 18 nt, Artificial Sequence
  Description of Artificial Sequence: Synthetic oligonucleotide
ccacccuguagacccuaa

SEQ ID NO: 24664 - RNA, 18 nt, Artificial Sequence
  Description of Artificial Sequence: Synthetic oligonucleotide
gagucccacccuguagac

SEQ ID NO: 24665 - RNA, 18 nt, Artificial Sequence
  Description of Artificial Sequence: Synthetic oligonucleotide
gucuggagucccacccug

SEQ ID NO: 24666 - RNA, 18 nt, Artificial Sequence
  Description of Artificial Sequence: Synthetic oligonucleotide
ucuaggucuggaguccca

SEQ ID NO: 24667 - RNA, 18 nt, Artificial Sequence
  Description of Artificial Sequence: Synthetic oligonucleotide
uacgcucuaggucuggag

SEQ ID NO: 24668 - RNA, 18 nt, Artificial Sequence
  Description of Artificial Sequence: Synthetic oligonucleotide
auacuuacgcucuagguc

SEQ ID NO: 24669 - RNA, 18 nt, Artificial Sequence
  Description of Artificial Sequence: Synthetic oligonucleotide
cauccauacuuacgcucu

SEQ ID NO: 24670 - RNA, 18 nt, Artificial Sequence
  Description of Artificial Sequence: Synthetic oligonucleotide
cacaacauccauacuuac

SEQ ID NO: 24671 - RNA, 18 nt, Artificial Sequence
  Description of Artificial Sequence: Synthetic oligonucleotide
agggccacaacauccaua

SEQ ID NO: 24672 - RNA, 18 nt, Artificial Sequence
  Description of Artificial Sequence: Synthetic oligonucleotide
gacacagggccacaacau

SEQ ID NO: 24673 - RNA, 18 nt, Artificial Sequence
  Description of Artificial Sequence: Synthetic oligonucleotide
aggaagacacagggccac

SEQ ID NO: 24674 - RNA, 18 nt, Artificial Sequence
  Description of Artificial Sequence: Synthetic oligonucleotide
acacuaggaagacacagg

SEQ ID NO: 24675 - RNA, 18 nt, Artificial Sequence
  Description of Artificial Sequence: Synthetic oligonucleotide
gggucacacuaggaagac

SEQ ID NO: 24676 - RNA, 18 nt, Artificial Sequence
  Description of Artificial Sequence: Synthetic oligonucleotide
uggcugggucacacuagg

SEQ ID NO: 24677 - RNA, 18 nt, Artificial Sequence
  Description of Artificial Sequence: Synthetic oligonucleotide
gcuccuggcugggucaca

SEQ ID NO: 24678 - RNA, 18 nt, Artificial Sequence
  Description of Artificial Sequence: Synthetic oligonucleotide
cuuccgcuccuggcuggg

SEQ ID NO: 24679 - RNA, 18 nt, Artificial Sequence
  Description of Artificial Sequence: Synthetic oligonucleotide
ugaagcuuccgcuccugg

SEQ ID NO: 24680 - RNA, 18 nt, Artificial Sequence
  Description of Artificial Sequence: Synthetic oligonucleotide
acgccugaagcuuccgcu

SEQ ID NO: 24681 - RNA, 18 nt, Artificial Sequence
  Description of Artificial Sequence: Synthetic oligonucleotide
uacaaacgccugaagcuu

SEQ ID NO: 24682 - RNA, 18 nt, Artificial Sequence
  Description of Artificial Sequence: Synthetic oligonucleotide
cacuuuacaaacgccuga

SEQ ID NO: 24683 - RNA, 18 nt, Artificial Sequence
  Description of Artificial Sequence: Synthetic oligonucleotide
gaccucacuuuacaaacg

SEQ ID NO: 24684 - RNA, 18 nt, Artificial Sequence
  Description of Artificial Sequence: Synthetic oligonucleotide
agccagaccucacuuuac

SEQ ID NO: 24685 - RNA, 18 nt, Artificial Sequence
  Description of Artificial Sequence: Synthetic oligonucleotide
ggcagagccagaccucac

SEQ ID NO: 24686 - RNA, 18 nt, Artificial Sequence
  Description of Artificial Sequence: Synthetic oligonucleotide
gaggaggcagagccagac

SEQ ID NO: 24687 - RNA, 18 nt, Artificial Sequence
  Description of Artificial Sequence: Synthetic oligonucleotide
aaacggaggaggcagagc

SEQ ID NO: 24688 - RNA, 18 nt, Artificial Sequence
  Description of Artificial Sequence: Synthetic oligonucleotide
aaaaaaaacggaggaggc

SEQ ID NO: 24689 - RNA, 18 nt, Artificial Sequence
  Description of Artificial Sequence: Synthetic oligonucleotide
aaaaaaaaaaaaacggag

SEQ ID NO: 24690 - RNA, 18 nt, Artificial Sequence
  Description of Artificial Sequence: Synthetic oligonucleotide
acagaaaaaaaaaaaaaa

SEQ ID NO: 24691 - RNA, 18 nt, Artificial Sequence
  Description of Artificial Sequence: Synthetic oligonucleotide
cagaaacagaaaaaaaaa

SEQ ID NO: 24692 - RNA, 18 nt, Artificial Sequence
  Description of Artificial Sequence: Synthetic oligonucleotide
agaaacagaaacagaaaa

SEQ ID NO: 24693 - RNA, 18 nt, Artificial Sequence
  Description of Artificial Sequence: Synthetic oligonucleotide
aaaacagaaacagaaaca

SEQ ID NO: 24694 - RNA, 18 nt, Artificial Sequence
  Description of Artificial Sequence: Synthetic oligonucleotide
aaaaaaaaacagaaacag

SEQ ID NO: 24695 - RNA, 18 nt, Artificial Sequence
  Description of Artificial Sequence: Synthetic oligonucleotide
ucucaaaaaaaaaacaga

SEQ ID NO: 24696 - RNA, 18 nt, Artificial Sequence
  Description of Artificial Sequence: Synthetic oligonucleotide
cuccaucucaaaaaaaaa

SEQ ID NO: 24697 - RNA, 18 nt, Artificial Sequence
  Description of Artificial Sequence: Synthetic oligonucleotide
cgagacuccaucucaaaa

SEQ ID NO: 24698 - RNA, 18 nt, Artificial Sequence
  Description of Artificial Sequence: Synthetic oligonucleotide
cagagcgagacuccaucu

SEQ ID NO: 24699 - RNA, 18 nt, Artificial Sequence
  Description of Artificial Sequence: Synthetic oligonucleotide
ggcgacagagcgagacuc

SEQ ID NO: 24700 - RNA, 18 nt, Artificial Sequence
  Description of Artificial Sequence: Synthetic oligonucleotide
gccugggcgacagagcga

SEQ ID NO: 24701 - RNA, 18 nt, Artificial Sequence
  Description of Artificial Sequence: Synthetic oligonucleotide
cuccagccugggcgacag

SEQ ID NO: 24702 - RNA, 18 nt, Artificial Sequence
  Description of Artificial Sequence: Synthetic oligonucleotide
cugcacuccagccugggc

SEQ ID NO: 24703 - RNA, 18 nt, Artificial Sequence
  Description of Artificial Sequence: Synthetic oligonucleotide
ugacacugcacuccagcc

SEQ ID NO: 24704 - RNA, 18 nt, Artificial Sequence
  Description of Artificial Sequence: Synthetic oligonucleotide
gaucgugacacugcacuc

SEQ ID NO: 24705 - RNA, 18 nt, Artificial Sequence
  Description of Artificial Sequence: Synthetic oligonucleotide
gcugagaucgugacacug

SEQ ID NO: 24706 - RNA, 18 nt, Artificial Sequence
  Description of Artificial Sequence: Synthetic oligonucleotide
agugagcugagaucguga

SEQ ID NO: 24707 - RNA, 18 nt, Artificial Sequence
  Description of Artificial Sequence: Synthetic oligonucleotide
guugcagugagcugagau

SEQ ID NO: 24708 - RNA, 18 nt, Artificial Sequence
  Description of Artificial Sequence: Synthetic oligonucleotide
cggagguugcagugagcu

SEQ ID NO: 24709 - RNA, 18 nt, Artificial Sequence
  Description of Artificial Sequence: Synthetic oligonucleotide
ggaggcggagguugcagu

SEQ ID NO: 24710 - RNA, 18 nt, Artificial Sequence
  Description of Artificial Sequence: Synthetic oligonucleotide
accugggaggcggagguu

SEQ ID NO: 24711 - RNA, 18 nt, Artificial Sequence
  Description of Artificial Sequence: Synthetic oligonucleotide
cuuguaccugggaggcgg

SEQ ID NO: 24712 - RNA, 18 nt, Artificial Sequence
  Description of Artificial Sequence: Synthetic oligonucleotide
aaucucuuguaccuggga

SEQ ID NO: 24713 - RNA, 18 nt, Artificial Sequence
  Description of Artificial Sequence: Synthetic oligonucleotide
aggagaaucucuuguacc

SEQ ID NO: 24714 - RNA, 18 nt, Artificial Sequence
  Description of Artificial Sequence: Synthetic oligonucleotide
gaggcaggagaaucucuu

SEQ ID NO: 24715 - RNA, 18 nt, Artificial Sequence
  Description of Artificial Sequence: Synthetic oligonucleotide
aggcugaggcaggagaau

SEQ ID NO: 24716 - RNA, 18 nt, Artificial Sequence
  Description of Artificial Sequence: Synthetic oligonucleotide
ucgggaggcugaggcagg

SEQ ID NO: 24717 - RNA, 18 nt, Artificial Sequence
  Description of Artificial Sequence: Synthetic oligonucleotide
gcuacucgggaggcugag

SEQ ID NO: 24718 - RNA, 18 nt, Artificial Sequence
  Description of Artificial Sequence: Synthetic oligonucleotide
ucccagcuacucgggagg

SEQ ID NO: 24719 - RNA, 18 nt, Artificial Sequence
  Description of Artificial Sequence: Synthetic oligonucleotide
uguagucccagcuacucg

SEQ ID NO: 24720 - RNA, 18 nt, Artificial Sequence
  Description of Artificial Sequence: Synthetic oligonucleotide
acgccuguagucccagcu

SEQ ID NO: 24721 - RNA, 18 nt, Artificial Sequence
  Description of Artificial Sequence: Synthetic oligonucleotide
ggcacacgccuguagucc

SEQ ID NO: 24722 - RNA, 18 nt, Artificial Sequence
  Description of Artificial Sequence: Synthetic oligonucleotide
augguggcacacgccugu

SEQ ID NO: 24723 - RNA, 18 nt, Artificial Sequence
  Description of Artificial Sequence: Synthetic oligonucleotide
caggcaugguggcacacg

SEQ ID NO: 24724 - RNA, 18 nt, Artificial Sequence
  Description of Artificial Sequence: Synthetic oligonucleotide
uuagccaggcaugguggc

SEQ ID NO: 24725 - RNA, 18 nt, Artificial Sequence
  Description of Artificial Sequence: Synthetic oligonucleotide
aaaaauuagccaggcaug

SEQ ID NO: 24726 - RNA, 18 nt, Artificial Sequence
  Description of Artificial Sequence: Synthetic oligonucleotide
aauacaaaaauuagccag

SEQ ID NO: 24727 - RNA, 18 nt, Artificial Sequence
  Description of Artificial Sequence: Synthetic oligonucleotide
cuaaaaauacaaaaauua

SEQ ID NO: 24728 - RNA, 18 nt, Artificial Sequence
  Description of Artificial Sequence: Synthetic oligonucleotide
cucuacuaaaaauacaaa

SEQ ID NO: 24729 - RNA, 18 nt, Artificial Sequence
  Description of Artificial Sequence: Synthetic oligonucleotide
cccaucucuacuaaaaau

SEQ ID NO: 24730 - RNA, 18 nt, Artificial Sequence
  Description of Artificial Sequence: Synthetic oligonucleotide
gaaaccccaucucuacua

SEQ ID NO: 24731 - RNA, 18 nt, Artificial Sequence
  Description of Artificial Sequence: Synthetic oligonucleotide
auggcgaaaccccaucuc

SEQ ID NO: 24732 - RNA, 18 nt, Artificial Sequence
  Description of Artificial Sequence: Synthetic oligonucleotide
cuaacauggcgaaacccc

SEQ ID NO: 24733 - RNA, 18 nt, Artificial Sequence
  Description of Artificial Sequence: Synthetic oligonucleotide
ucuggcuaacauggcgaa

SEQ ID NO: 24734 - RNA, 18 nt, Artificial Sequence
  Description of Artificial Sequence: Synthetic oligonucleotide
accagucuggcuaacaug

SEQ ID NO: 24735 - RNA, 18 nt, Artificial Sequence
  Description of Artificial Sequence: Synthetic oligonucleotide
ucgagaccagucuggcua

SEQ ID NO: 24736 - RNA, 18 nt, Artificial Sequence
  Description of Artificial Sequence: Synthetic oligonucleotide
ggaguucgagaccagucu

SEQ ID NO: 24737 - RNA, 18 nt, Artificial Sequence
  Description of Artificial Sequence: Synthetic oligonucleotide
ggucaggaguucgagacc

SEQ ID NO: 24738 - RNA, 18 nt, Artificial Sequence
  Description of Artificial Sequence: Synthetic oligonucleotide
ccugaggucaggaguucg

SEQ ID NO: 24739 - RNA, 18 nt, Artificial Sequence
  Description of Artificial Sequence: Synthetic oligonucleotide
gaucaccugaggucagga

SEQ ID NO: 24740 - RNA, 18 nt, Artificial Sequence
  Description of Artificial Sequence: Synthetic oligonucleotide
gggaggaucaccugaggu

SEQ ID NO: 24741 - RNA, 18 nt, Artificial Sequence
  Description of Artificial Sequence: Synthetic oligonucleotide
gggugggaggaucaccug

SEQ ID NO: 24742 - RNA, 18 nt, Artificial Sequence
  Description of Artificial Sequence: Synthetic oligonucleotide
gaacuuugggaagccggg

SEQ ID NO: 24743 - RNA, 18 nt, Artificial Sequence
  Description of Artificial Sequence: Synthetic oligonucleotide
ucccagaacuuugggaag

SEQ ID NO: 24744 - RNA, 18 nt, Artificial Sequence
  Description of Artificial Sequence: Synthetic oligonucleotide
uauaaucccagaacuuug

SEQ ID NO: 24745 - RNA, 18 nt, Artificial Sequence
  Description of Artificial Sequence: Synthetic oligonucleotide
acgccuauaaucccagaa

SEQ ID NO: 24746 - RNA, 18 nt, Artificial Sequence
  Description of Artificial Sequence: Synthetic oligonucleotide
ggcucacgccuauaaucc

SEQ ID NO: 24747 - RNA, 18 nt, Artificial Sequence
  Description of Artificial Sequence: Synthetic oligonucleotide
augguggcucacgccuau

SEQ ID NO: 24748 - RNA, 18 nt, Artificial Sequence
  Description of Artificial Sequence: Synthetic oligonucleotide
cgggcaugguggcucacg

SEQ ID NO: 24749 - RNA, 18 nt, Artificial Sequence
  Description of Artificial Sequence: Synthetic oligonucleotide
gagaccgggcaugguggc

SEQ ID NO: 24750 - RNA, 18 nt, Artificial Sequence
  Description of Artificial Sequence: Synthetic oligonucleotide
gagaagagaccgggcaug

SEQ ID NO: 24751 - RNA, 18 nt, Artificial Sequence
  Description of Artificial Sequence: Synthetic oligonucleotide
agacugagaagagaccgg

SEQ ID NO: 24752 - RNA, 18 nt, Artificial Sequence
  Description of Artificial Sequence: Synthetic oligonucleotide
cuucaagacugagaagag

SEQ ID NO: 24753 - RNA, 18 nt, Artificial Sequence
  Description of Artificial Sequence: Synthetic oligonucleotide
augggcuucaagacugag

SEQ ID NO: 24754 - RNA, 18 nt, Artificial Sequence
  Description of Artificial Sequence: Synthetic oligonucleotide
cagggaugggcuucaaga

SEQ ID NO: 24755 - RNA, 18 nt, Artificial Sequence
  Description of Artificial Sequence: Synthetic oligonucleotide
aaauccagggaugggcuu

SEQ ID NO: 24756 - RNA, 18 nt, Artificial Sequence
  Description of Artificial Sequence: Synthetic oligonucleotide
gguggaaauccagggaug

SEQ ID NO: 24757 - RNA, 18 nt, Artificial Sequence
  Description of Artificial Sequence: Synthetic oligonucleotide
cuccugguggaaauccag

SEQ ID NO: 24758 - RNA, 18 nt, Artificial Sequence
  Description of Artificial Sequence: Synthetic oligonucleotide
aguaacuccugguggaaa

SEQ ID NO: 24759 - RNA, 18 nt, Artificial Sequence
  Description of Artificial Sequence: Synthetic oligonucleotide
aggaaaguaacuccuggu

SEQ ID NO: 24760 - RNA, 18 nt, Artificial Sequence
  Description of Artificial Sequence: Synthetic oligonucleotide
ucaggaggaaaguaacuc

SEQ ID NO: 24761 - RNA, 18 nt, Artificial Sequence
  Description of Artificial Sequence: Synthetic oligonucleotide
acaggucaggaggaaagu

SEQ ID NO: 24762 - RNA, 18 nt, Artificial Sequence
  Description of Artificial Sequence: Synthetic oligonucleotide
aauuuacaggucaggagg

SEQ ID NO: 24763 - RNA, 18 nt, Artificial Sequence
  Description of Artificial Sequence: Synthetic oligonucleotide
gaacaaauuuacagguca

SEQ ID NO: 24764 - RNA, 18 nt, Artificial Sequence
  Description of Artificial Sequence: Synthetic oligonucleotide
uuaaagaacaaauuuaca

SEQ ID NO: 24765 - RNA, 18 nt, Artificial Sequence
  Description of Artificial Sequence: Synthetic oligonucleotide
cauuguuaaagaacaaau

SEQ ID NO: 24766 - RNA, 18 nt, Artificial Sequence
  Description of Artificial Sequence: Synthetic oligonucleotide
gcagccauuguuaaagaa

SEQ ID NO: 24767 - RNA, 18 nt, Artificial Sequence
  Description of Artificial Sequence: Synthetic oligonucleotide
caccugcagccauuguua

SEQ ID NO: 24768 - RNA, 18 nt, Artificial Sequence
  Description of Artificial Sequence: Synthetic oligonucleotide
gcucccaccugcagccau

SEQ ID NO: 24769 - RNA, 18 nt, Artificial Sequence
  Description of Artificial Sequence: Synthetic oligonucleotide
cauaugcucccaccugca

SEQ ID NO: 24770 - RNA, 18 nt, Artificial Sequence
  Description of Artificial Sequence: Synthetic oligonucleotide
accaccauaugcucccac

SEQ ID NO: 24771 - RNA, 18 nt, Artificial Sequence
  Description of Artificial Sequence: Synthetic oligonucleotide
uauaaaccaccauaugcu

SEQ ID NO: 24772 - RNA, 18 nt, Artificial Sequence
  Description of Artificial Sequence: Synthetic oligonucleotide
guuuuuauaaaccaccau

SEQ ID NO: 24773 - RNA, 18 nt, Artificial Sequence
  Description of Artificial Sequence: Synthetic oligonucleotide
acagcguuuuuauaaacc

SEQ ID NO: 24774 - RNA, 18 nt, Artificial Sequence
  Description of Artificial Sequence: Synthetic oligonucleotide
gcccgacagcguuuuuau

SEQ ID NO: 24775 - RNA, 18 nt, Artificial Sequence
  Description of Artificial Sequence: Synthetic oligonucleotide
acaaagcccgacagcguu

SEQ ID NO: 24776 - RNA, 18 nt, Artificial Sequence
  Description of Artificial Sequence: Synthetic oligonucleotide
aggaaacaaagcccgaca

SEQ ID NO: 24777 - RNA, 18 nt, Artificial Sequence
  Description of Artificial Sequence: Synthetic oligonucleotide
aaagaaggaaacaaagcc

SEQ ID NO: 24778 - RNA, 18 nt, Artificial Sequence
  Description of Artificial Sequence: Synthetic oligonucleotide
cagcuaaagaaggaaaca

SEQ ID NO: 24779 - RNA, 18 nt, Artificial Sequence
  Description of Artificial Sequence: Synthetic oligonucleotide
cacggcagcuaaagaagg

SEQ ID NO: 24780 - RNA, 18 nt, Artificial Sequence
  Description of Artificial Sequence: Synthetic oligonucleotide
guagacacggcagcuaaa

SEQ ID NO: 24781 - RNA, 18 nt, Artificial Sequence
  Description of Artificial Sequence: Synthetic oligonucleotide
cagaaguagacacggcag

SEQ ID NO: 24782 - RNA, 18 nt, Artificial Sequence
  Description of Artificial Sequence: Synthetic oligonucleotide
gacuucagaaguagacac

SEQ ID NO: 24783 - RNA, 18 nt, Artificial Sequence
  Description of Artificial Sequence: Synthetic oligonucleotide
ucccagacuucagaagua

SEQ ID NO: 24784 - RNA, 18 nt, Artificial Sequence
  Description of Artificial Sequence: Synthetic oligonucleotide
gcacuucccagacuucag

SEQ ID NO: 24785 - RNA, 18 nt, Artificial Sequence
  Description of Artificial Sequence: Synthetic oligonucleotide
gcuuggcacuucccagac

SEQ ID NO: 24786 - RNA, 18 nt, Artificial Sequence
  Description of Artificial Sequence: Synthetic oligonucleotide
gcguggcuuggcacuucc

SEQ ID NO: 24787 - RNA, 18 nt, Artificial Sequence
  Description of Artificial Sequence: Synthetic oligonucleotide
aggccgcguggcuuggca

SEQ ID NO: 24788 - RNA, 18 nt, Artificial Sequence
  Description of Artificial Sequence: Synthetic oligonucleotide
ccuugaggccgcguggcu

SEQ ID NO: 24789 - RNA, 18 nt, Artificial Sequence
  Description of Artificial Sequence: Synthetic oligonucleotide
agcucccuugaggccgcg

SEQ ID NO: 24790 - RNA, 18 nt, Artificial Sequence
  Description of Artificial Sequence: Synthetic oligonucleotide
cagccagcucccuugagg

SEQ ID NO: 24791 - RNA, 18 nt, Artificial Sequence
  Description of Artificial Sequence: Synthetic oligonucleotide
aacaccagccagcucccu

SEQ ID NO: 24792 - RNA, 18 nt, Artificial Sequence
  Description of Artificial Sequence: Synthetic oligonucleotide
gcucaaacaccagccagc

SEQ ID NO: 24793 - RNA, 18 nt, Artificial Sequence
  Description of Artificial Sequence: Synthetic oligonucleotide
ccacagcucaaacaccag

SEQ ID NO: 24794 - RNA, 18 nt, Artificial Sequence
  Description of Artificial Sequence: Synthetic oligonucleotide
uucugccacagcucaaac

SEQ ID NO: 24795 - RNA, 18 nt, Artificial Sequence
  Description of Artificial Sequence: Synthetic oligonucleotide
ggugcuucugccacagcu

SEQ ID NO: 24796 - RNA, 18 nt, Artificial Sequence
  Description of Artificial Sequence: Synthetic oligonucleotide
ccccaggugcuucugcca

SEQ ID NO: 24797 - RNA, 18 nt, Artificial Sequence
  Description of Artificial Sequence: Synthetic oligonucleotide
uggagccccaggugcuuc

SEQ ID NO: 24798 - RNA, 18 nt, Artificial Sequence
  Description of Artificial Sequence: Synthetic oligonucleotide
cucccuggagccccaggu

SEQ ID NO: 24799 - RNA, 18 nt, Artificial Sequence
  Description of Artificial Sequence: Synthetic oligonucleotide
gccugcucccuggagccc

SEQ ID NO: 24800 - RNA, 18 nt, Artificial Sequence
  Description of Artificial Sequence: Synthetic oligonucleotide
ucccagccugcucccugg

SEQ ID NO: 24801 - RNA, 18 nt, Artificial Sequence
  Description of Artificial Sequence: Synthetic oligonucleotide
gcaguucccagccugcuc

SEQ ID NO: 24802 - RNA, 18 nt, Artificial Sequence
  Description of Artificial Sequence: Synthetic oligonucleotide
guccugcaguucccagcc

SEQ ID NO: 24803 - RNA, 18 nt, Artificial Sequence
  Description of Artificial Sequence: Synthetic oligonucleotide
gcaagguccugcaguucc

SEQ ID NO: 24804 - RNA, 18 nt, Artificial Sequence
  Description of Artificial Sequence: Synthetic oligonucleotide
gcugagcaagguccugca

SEQ ID NO: 24805 - RNA, 18 nt, Artificial Sequence
  Description of Artificial Sequence: Synthetic oligonucleotide
uccuggcugagcaagguc

SEQ ID NO: 24806 - RNA, 18 nt, Artificial Sequence
  Description of Artificial Sequence: Synthetic oligonucleotide
agugcuccuggcugagca

SEQ ID NO: 24807 - RNA, 18 nt, Artificial Sequence
  Description of Artificial Sequence: Synthetic oligonucleotide
gggaagugcuccuggcug

SEQ ID NO: 24808 - RNA, 18 nt, Artificial Sequence
  Description of Artificial Sequence: Synthetic oligonucleotide
uuccugccucaaggaggg

SEQ ID NO: 24809 - RNA, 18 nt, Artificial Sequence
  Description of Artificial Sequence: Synthetic oligonucleotide
caguauuccugccucaag

SEQ ID NO: 24810 - RNA, 18 nt, Artificial Sequence
  Description of Artificial Sequence: Synthetic oligonucleotide
caccucaguauuccugcc

SEQ ID NO: 24811 - RNA, 18 nt, Artificial Sequence
  Description of Artificial Sequence: Synthetic oligonucleotide
ggaggcaccucaguauuc

SEQ ID NO: 24812 - RNA, 18 nt, Artificial Sequence
  Description of Artificial Sequence: Synthetic oligonucleotide
gggaggcaccucaguauu

SEQ ID NO: 24813 - RNA, 18 nt, Artificial Sequence
  Description of Artificial Sequence: Synthetic oligonucleotide
accuucuccaucuguggg

SEQ ID NO: 24814 - RNA, 18 nt, Artificial Sequence
  Description of Artificial Sequence: Synthetic oligonucleotide
ucuccaccuucuccaucu

SEQ ID NO: 24815 - RNA, 18 nt, Artificial Sequence
  Description of Artificial Sequence: Synthetic oligonucleotide
ccuccucuccaccuucuc

SEQ ID NO: 24816 - RNA, 18 nt, Artificial Sequence
  Description of Artificial Sequence: Synthetic oligonucleotide
cccauccuccucuccacc

SEQ ID NO: 24817 - RNA, 18 nt, Artificial Sequence
  Description of Artificial Sequence: Synthetic oligonucleotide
ugaggcccauccuccucu

SEQ ID NO: 24818 - RNA, 18 nt, Artificial Sequence
  Description of Artificial Sequence: Synthetic oligonucleotide
gcuccugaggcccauccu

SEQ ID NO: 24819 - RNA, 18 nt, Artificial Sequence
  Description of Artificial Sequence: Synthetic oligonucleotide
gagaugcuccugaggccc

SEQ ID NO: 24820 - RNA, 18 nt, Artificial Sequence
  Description of Artificial Sequence: Synthetic oligonucleotide
ggcuugagaugcuccuga

SEQ ID NO: 24821 - RNA, 18 nt, Artificial Sequence
  Description of Artificial Sequence: Synthetic oligonucleotide
gggcuugagaugcuccug

SEQ ID NO: 24822 - RNA, 18 nt, Artificial Sequence
  Description of Artificial Sequence: Synthetic oligonucleotide
cuuucuccugcuacuggg

SEQ ID NO: 24823 - RNA, 18 nt, Artificial Sequence
  Description of Artificial Sequence: Synthetic oligonucleotide
ucuuucuuucuccugcua

SEQ ID NO: 24824 - RNA, 18 nt, Artificial Sequence
  Description of Artificial Sequence: Synthetic oligonucleotide
cucuuucuuucuuucucc

SEQ ID NO: 24825 - RNA, 18 nt, Artificial Sequence
  Description of Artificial Sequence: Synthetic oligonucleotide
ggcaucucuuucuuucuu

SEQ ID NO: 24826 - RNA, 18 nt, Artificial Sequence
  Description of Artificial Sequence: Synthetic oligonucleotide
aaccaggcaucucuuucu

SEQ ID NO: 24827 - RNA, 18 nt, Artificial Sequence
  Description of Artificial Sequence: Synthetic oligonucleotide
gugaaaaccaggcaucuc

SEQ ID NO: 24828 - RNA, 18 nt, Artificial Sequence
  Description of Artificial Sequence: Synthetic oligonucleotide
agucugugaaaaccaggc

SEQ ID NO: 24829 - RNA, 18 nt, Artificial Sequence
  Description of Artificial Sequence: Synthetic oligonucleotide
gaaccagucugugaaaac

SEQ ID NO: 24830 - RNA, 18 nt, Artificial Sequence
  Description of Artificial Sequence: Synthetic oligonucleotide
cacaggaaccagucugug

SEQ ID NO: 24831 - RNA, 18 nt, Artificial Sequence
  Description of Artificial Sequence: Synthetic oligonucleotide
ccagccacaggaaccagu

SEQ ID NO: 24832 - RNA, 18 nt, Artificial Sequence
  Description of Artificial Sequence: Synthetic oligonucleotide
ucaucccagccacaggaa

SEQ ID NO: 24833 - RNA, 18 nt, Artificial Sequence
  Description of Artificial Sequence: Synthetic oligonucleotide
ugcagucaucccagccac

SEQ ID NO: 24834 - RNA, 18 nt, Artificial Sequence
  Description of Artificial Sequence: Synthetic oligonucleotide
aaggaugcagucauccca

SEQ ID NO: 24835 - RNA, 18 nt, Artificial Sequence
  Description of Artificial Sequence: Synthetic oligonucleotide
aaaaaaaggaugcaguca

SEQ ID NO: 24836 - RNA, 18 nt, Artificial Sequence
  Description of Artificial Sequence: Synthetic oligonucleotide
aaaaaaaaaaaaggaugc

SEQ ID NO: 24837 - RNA, 18 nt, Artificial Sequence
  Description of Artificial Sequence: Synthetic oligonucleotide
caaaaaaaaaaaaaaaag

SEQ ID NO: 24838 - RNA, 18 nt, Artificial Sequence
  Description of Artificial Sequence: Synthetic oligonucleotide
cgucucaaaaaaaaaaaa

SEQ ID NO: 24839 - RNA, 18 nt, Artificial Sequence
  Description of Artificial Sequence: Synthetic oligonucleotide
aacuccgucucaaaaaaa

SEQ ID NO: 24840 - RNA, 18 nt, Artificial Sequence
  Description of Artificial Sequence: Synthetic oligonucleotide
gcaaaaacuccgucucaa

SEQ ID NO: 24841 - RNA, 18 nt, Artificial Sequence
  Description of Artificial Sequence: Synthetic oligonucleotide
caaaggcaaaaacuccgu

SEQ ID NO: 24842 - RNA, 18 nt, Artificial Sequence
  Description of Artificial Sequence: Synthetic oligonucleotide
ggcgacaaaggcaaaaac

SEQ ID NO: 24843 - RNA, 18 nt, Artificial Sequence
  Description of Artificial Sequence: Synthetic oligonucleotide
gccugggcgacaaaggca

SEQ ID NO: 24844 - RNA, 18 nt, Artificial Sequence
  Description of Artificial Sequence: Synthetic oligonucleotide
cuccagccugggcgacaa

SEQ ID NO: 24845 - RNA, 18 nt, Artificial Sequence
  Description of Artificial Sequence: Synthetic oligonucleotide
uugcacuccagccugggc

SEQ ID NO: 24846 - RNA, 18 nt, Artificial Sequence
  Description of Artificial Sequence: Synthetic oligonucleotide
cgccauugcacuccagcc

SEQ ID NO: 24847 - RNA, 18 nt, Artificial Sequence
  Description of Artificial Sequence: Synthetic oligonucleotide
gaucacgccauugcacuc

SEQ ID NO: 24848 - RNA, 18 nt, Artificial Sequence
  Description of Artificial Sequence: Synthetic oligonucleotide
gccgagaucacgccauug

SEQ ID NO: 24849 - RNA, 18 nt, Artificial Sequence
  Description of Artificial Sequence: Synthetic oligonucleotide
ggugagccgagaucacgc

SEQ ID NO: 24850 - RNA, 18 nt, Artificial Sequence
  Description of Artificial Sequence: Synthetic oligonucleotide
guugcggugagccgagau

SEQ ID NO: 24851 - RNA, 18 nt, Artificial Sequence
  Description of Artificial Sequence: Synthetic oligonucleotide
cggagguugcggugagcc

SEQ ID NO: 24852 - RNA, 18 nt, Artificial Sequence
  Description of Artificial Sequence: Synthetic oligonucleotide
ggaggcggagguugcggu

SEQ ID NO: 24853 - RNA, 18 nt, Artificial Sequence
  Description of Artificial Sequence: Synthetic oligonucleotide
auccgggaggcggagguu

SEQ ID NO: 24854 - RNA, 18 nt, Artificial Sequence
  Description of Artificial Sequence: Synthetic oligonucleotide
cuugaauccgggaggcgg

SEQ ID NO: 24855 - RNA, 18 nt, Artificial Sequence
  Description of Artificial Sequence: Synthetic oligonucleotide
aauugcuugaauccggga

SEQ ID NO: 24856 - RNA, 18 nt, Artificial Sequence
  Description of Artificial Sequence: Synthetic oligonucleotide
aggagaauugcuugaauc

SEQ ID NO: 24857 - RNA, 18 nt, Artificial Sequence
  Description of Artificial Sequence: Synthetic oligonucleotide
gaggcaggagaauugcuu

SEQ ID NO: 24858 - RNA, 18 nt, Artificial Sequence
  Description of Artificial Sequence: Synthetic oligonucleotide
aggcugaggcaggagaau

SEQ ID NO: 24859 - RNA, 18 nt, Artificial Sequence
  Description of Artificial Sequence: Synthetic oligonucleotide
ucgggaggcugaggcagg

SEQ ID NO: 24860 - RNA, 18 nt, Artificial Sequence
  Description of Artificial Sequence: Synthetic oligonucleotide
gcuacucgggaggcugag

SEQ ID NO: 24861 - RNA, 18 nt, Artificial Sequence
  Description of Artificial Sequence: Synthetic oligonucleotide
ucccagcuacucgggagg

SEQ ID NO: 24862 - RNA, 18 nt, Artificial Sequence
  Description of Artificial Sequence: Synthetic oligonucleotide
uguaaucccagcuacucg

SEQ ID NO: 24863 - RNA, 18 nt, Artificial Sequence
  Description of Artificial Sequence: Synthetic oligonucleotide
gugccuguaaucccagcu

SEQ ID NO: 24864 - RNA, 18 nt, Artificial Sequence
  Description of Artificial Sequence: Synthetic oligonucleotide
ggugcgugccuguaaucc

SEQ ID NO: 24865 - RNA, 18 nt, Artificial Sequence
  Description of Artificial Sequence: Synthetic oligonucleotide
guggaggugcgugccugu

SEQ ID NO: 24866 - RNA, 18 nt, Artificial Sequence
  Description of Artificial Sequence: Synthetic oligonucleotide
cggacguggaggugcgug

SEQ ID NO: 24867 - RNA, 18 nt, Artificial Sequence
  Description of Artificial Sequence: Synthetic oligonucleotide
uuagccggacguggaggu

SEQ ID NO: 24868 - RNA, 18 nt, Artificial Sequence
  Description of Artificial Sequence: Synthetic oligonucleotide
caaaauuagccggacgug

SEQ ID NO: 24869 - RNA, 18 nt, Artificial Sequence
  Description of Artificial Sequence: Synthetic oligonucleotide
aaauacaaaauuagccgg

SEQ ID NO: 24870 - RNA, 18 nt, Artificial Sequence
  Description of Artificial Sequence: Synthetic oligonucleotide
acuaaaaauacaaaauua

SEQ ID NO: 24871 - RNA, 18 nt, Artificial Sequence
  Description of Artificial Sequence: Synthetic oligonucleotide
ucuccacuaaaaauacaa

SEQ ID NO: 24872 - RNA, 18 nt, Artificial Sequence
  Description of Artificial Sequence: Synthetic oligonucleotide
ccccgucuccacuaaaaa

SEQ ID NO: 24873 - RNA, 18 nt, Artificial Sequence
  Description of Artificial Sequence: Synthetic oligonucleotide
agaaaccccgucuccacu

SEQ ID NO: 24874 - RNA, 18 nt, Artificial Sequence
  Description of Artificial Sequence: Synthetic oligonucleotide
cauggagaaaccccgucu

SEQ ID NO: 24875 - RNA, 18 nt, Artificial Sequence
  Description of Artificial Sequence: Synthetic oligonucleotide
accgacauggagaaaccc

SEQ ID NO: 24876 - RNA, 18 nt, Artificial Sequence
  Description of Artificial Sequence: Synthetic oligonucleotide
gccugaccgacauggaga

SEQ ID NO: 24877 - RNA, 18 nt, Artificial Sequence
  Description of Artificial Sequence: Synthetic oligonucleotide
gaccagccugaccgacau

SEQ ID NO: 24878 - RNA, 18 nt, Artificial Sequence
  Description of Artificial Sequence: Synthetic oligonucleotide
uucgagaccagccugacc

SEQ ID NO: 24879 - RNA, 18 nt, Artificial Sequence
  Description of Artificial Sequence: Synthetic oligonucleotide
gggaguucgagaccagcc

SEQ ID NO: 24880 - RNA, 18 nt, Artificial Sequence
  Description of Artificial Sequence: Synthetic oligonucleotide
aggucgggaguucgagac

SEQ ID NO: 24881 - RNA, 18 nt, Artificial Sequence
  Description of Artificial Sequence: Synthetic oligonucleotide
accugaggucgggaguuc

SEQ ID NO: 24882 - RNA, 18 nt, Artificial Sequence
  Description of Artificial Sequence: Synthetic oligonucleotide
agaucaccugaggucggg

SEQ ID NO: 24883 - RNA, 18 nt, Artificial Sequence
  Description of Artificial Sequence: Synthetic oligonucleotide
ugggcagaucaccugagg

SEQ ID NO: 24884 - RNA, 18 nt, Artificial Sequence
  Description of Artificial Sequence: Synthetic oligonucleotide
cgaggugggcagaucacc

SEQ ID NO: 24885 - RNA, 18 nt, Artificial Sequence
  Description of Artificial Sequence: Synthetic oligonucleotide
gaggccgaggugggcaga

SEQ ID NO: 24886 - RNA, 18 nt, Artificial Sequence
  Description of Artificial Sequence: Synthetic oligonucleotide
uuugggaggccgaggugg

SEQ ID NO: 24887 - RNA, 18 nt, Artificial Sequence
  Description of Artificial Sequence: Synthetic oligonucleotide
agcacuuugggaggccga

SEQ ID NO: 24888 - RNA, 18 nt, Artificial Sequence
  Description of Artificial Sequence: Synthetic oligonucleotide
aucccagcacuuugggag

SEQ ID NO: 24889 - RNA, 18 nt, Artificial Sequence
  Description of Artificial Sequence: Synthetic oligonucleotide
cuguaaucccagcacuuu

SEQ ID NO: 24890 - RNA, 18 nt, Artificial Sequence
  Description of Artificial Sequence: Synthetic oligonucleotide
caugccuguaaucccagc

SEQ ID NO: 24891 - RNA, 18 nt, Artificial Sequence
  Description of Artificial Sequence: Synthetic oligonucleotide
uggcucaugccuguaauc

SEQ ID NO: 24892 - RNA, 18 nt, Artificial Sequence
  Description of Artificial Sequence: Synthetic oligonucleotide
cgcgguggcucaugccug

SEQ ID NO: 24893 - RNA, 18 nt, Artificial Sequence
  Description of Artificial Sequence: Synthetic oligonucleotide
ccaagcgcgguggcucau

SEQ ID NO: 24894 - RNA, 18 nt, Artificial Sequence
  Description of Artificial Sequence: Synthetic oligonucleotide
ucuggccaagcgcggugg

SEQ ID NO: 24895 - RNA, 18 nt, Artificial Sequence
  Description of Artificial Sequence: Synthetic oligonucleotide
cgcagucuggccaagcgc

SEQ ID NO: 24896 - RNA, 18 nt, Artificial Sequence
  Description of Artificial Sequence: Synthetic oligonucleotide
aaggacgcagucuggcca

SEQ ID NO: 24897 - RNA, 18 nt, Artificial Sequence
  Description of Artificial Sequence: Synthetic oligonucleotide
uuaaaaaggacgcagucu

SEQ ID NO: 24898 - RNA, 18 nt, Artificial Sequence
  Description of Artificial Sequence: Synthetic oligonucleotide
uucgcuuaaaaaggacgc

SEQ ID NO: 24899 - RNA, 18 nt, Artificial Sequence
  Description of Artificial Sequence: Synthetic oligonucleotide
aaauguucgcuuaaaaag

SEQ ID NO: 24900 - RNA, 18 nt, Artificial Sequence
  Description of Artificial Sequence: Synthetic oligonucleotide
cccuaaaauguucgcuua

SEQ ID NO: 24901 - RNA, 18 nt, Artificial Sequence
  Description of Artificial Sequence: Synthetic oligonucleotide
ccaggcccuaaaauguuc

SEQ ID NO: 24902 - RNA, 18 nt, Artificial Sequence
  Description of Artificial Sequence: Synthetic oligonucleotide
aacucccaggcccuaaaa

SEQ ID NO: 24903 - RNA, 18 nt, Artificial Sequence
  Description of Artificial Sequence: Synthetic oligonucleotide
ugacaaacucccaggccc

SEQ ID NO: 24904 - RNA, 18 nt, Artificial Sequence
  Description of Artificial Sequence: Synthetic oligonucleotide
uuacuugacaaacuccca

SEQ ID NO: 24905 - RNA, 18 nt, Artificial Sequence
  Description of Artificial Sequence: Synthetic oligonucleotide
cuuccuuacuugacaaac

SEQ ID NO: 24906 - RNA, 18 nt, Artificial Sequence
  Description of Artificial Sequence: Synthetic oligonucleotide
ugagacuuccuuacuuga

SEQ ID NO: 24907 - RNA, 18 nt, Artificial Sequence
  Description of Artificial Sequence: Synthetic oligonucleotide
gggcuugagacuuccuua

SEQ ID NO: 24908 - RNA, 18 nt, Artificial Sequence
  Description of Artificial Sequence: Synthetic oligonucleotide
ucuuugggcuugagacuu

SEQ ID NO: 24909 - RNA, 18 nt, Artificial Sequence
  Description of Artificial Sequence: Synthetic oligonucleotide
gcugcucuuugggcuuga

SEQ ID NO: 24910 - RNA, 18 nt, Artificial Sequence
  Description of Artificial Sequence: Synthetic oligonucleotide
aggacgcugcucuuuggg

SEQ ID NO: 24911 - RNA, 18 nt, Artificial Sequence
  Description of Artificial Sequence: Synthetic oligonucleotide
uggucaggacgcugcucu

SEQ ID NO: 24912 - RNA, 18 nt, Artificial Sequence
  Description of Artificial Sequence: Synthetic oligonucleotide
caccauggucaggacgcu

SEQ ID NO: 24913 - RNA, 18 nt, Artificial Sequence
  Description of Artificial Sequence: Synthetic oligonucleotide
gaaaccaccauggucagg

SEQ ID NO: 24914 - RNA, 18 nt, Artificial Sequence
  Description of Artificial Sequence: Synthetic oligonucleotide
guaaugaaaccaccaugg

SEQ ID NO: 24915 - RNA, 18 nt, Artificial Sequence
  Description of Artificial Sequence: Synthetic oligonucleotide
ggcucguaaugaaaccac

SEQ ID NO: 24916 - RNA, 18 nt, Artificial Sequence
  Description of Artificial Sequence: Synthetic oligonucleotide
agaagggcucguaaugaa

SEQ ID NO: 24917 - RNA, 18 nt, Artificial Sequence
  Description of Artificial Sequence: Synthetic oligonucleotide
ccagcagaagggcucgua

SEQ ID NO: 24918 - RNA, 18 nt, Artificial Sequence
  Description of Artificial Sequence: Synthetic oligonucleotide
gagagccagcagaagggc

SEQ ID NO: 24919 - RNA, 18 nt, Artificial Sequence
  Description of Artificial Sequence: Synthetic oligonucleotide
ugccugagagccagcaga

SEQ ID NO: 24920 - RNA, 18 nt, Artificial Sequence
  Description of Artificial Sequence: Synthetic oligonucleotide
gcuucugccugagagcca

SEQ ID NO: 24921 - RNA, 18 nt, Artificial Sequence
  Description of Artificial Sequence: Synthetic oligonucleotide
gggcuucugccugagagc

SEQ ID NO: 24922 - RNA, 18 nt, Artificial Sequence
  Description of Artificial Sequence: Synthetic oligonucleotide
uggucccggugcuguggg

SEQ ID NO: 24923 - RNA, 18 nt, Artificial Sequence
  Description of Artificial Sequence: Synthetic oligonucleotide
augaauggucccggugcu

SEQ ID NO: 24924 - RNA, 18 nt, Artificial Sequence
  Description of Artificial Sequence: Synthetic oligonucleotide
accucaugaauggucccg

SEQ ID NO: 24925 - RNA, 18 nt, Artificial Sequence
  Description of Artificial Sequence: Synthetic oligonucleotide
cagugaccucaugaaugg

SEQ ID NO: 24926 - RNA, 18 nt, Artificial Sequence
  Description of Artificial Sequence: Synthetic oligonucleotide
cugggcagugaccucaug

SEQ ID NO: 24927 - RNA, 18 nt, Artificial Sequence
  Description of Artificial Sequence: Synthetic oligonucleotide
augagcugggcagugacc

SEQ ID NO: 24928 - RNA, 18 nt, Artificial Sequence
  Description of Artificial Sequence: Synthetic oligonucleotide
acaucaugagcugggcag

SEQ ID NO: 24929 - RNA, 18 nt, Artificial Sequence
  Description of Artificial Sequence: Synthetic oligonucleotide
cacggacaucaugagcug

SEQ ID NO: 24930 - RNA, 18 nt, Artificial Sequence
  Description of Artificial Sequence: Synthetic oligonucleotide
agccucacggacaucaug

SEQ ID NO: 24931 - RNA, 18 nt, Artificial Sequence
  Description of Artificial Sequence: Synthetic oligonucleotide
aggacagccucacggaca

SEQ ID NO: 24932 - RNA, 18 nt, Artificial Sequence
  Description of Artificial Sequence: Synthetic oligonucleotide
ccaaaaggacagccucac

SEQ ID NO: 24933 - RNA, 18 nt, Artificial Sequence
  Description of Artificial Sequence: Synthetic oligonucleotide
acuggccaaaaggacagc

SEQ ID NO: 24934 - RNA, 18 nt, Artificial Sequence
  Description of Artificial Sequence: Synthetic oligonucleotide
cggcuacuggccaaaagg

SEQ ID NO: 24935 - RNA, 18 nt, Artificial Sequence
  Description of Artificial Sequence: Synthetic oligonucleotide
gcacacggcuacuggcca

SEQ ID NO: 24936 - RNA, 18 nt, Artificial Sequence
  Description of Artificial Sequence: Synthetic oligonucleotide
cagcugcacacggcuacu

SEQ ID NO: 24937 - RNA, 18 nt, Artificial Sequence
  Description of Artificial Sequence: Synthetic oligonucleotide
ccacacagcugcacacgg

SEQ ID NO: 24938 - RNA, 18 nt, Artificial Sequence
  Description of Artificial Sequence: Synthetic oligonucleotide
cugugccacacagcugca

SEQ ID NO: 24939 - RNA, 18 nt, Artificial Sequence
  Description of Artificial Sequence: Synthetic oligonucleotide
gccaucugugccacacag

SEQ ID NO: 24940 - RNA, 18 nt, Artificial Sequence
  Description of Artificial Sequence: Synthetic oligonucleotide
acgaagccaucugugcca

SEQ ID NO: 24941 - RNA, 18 nt, Artificial Sequence
  Description of Artificial Sequence: Synthetic oligonucleotide
gaugaacgaagccaucug

SEQ ID NO: 24942 - RNA, 18 nt, Artificial Sequence
  Description of Artificial Sequence: Synthetic oligonucleotide
aucaggaugaacgaagcc

SEQ ID NO: 24943 - RNA, 18 nt, Artificial Sequence
  Description of Artificial Sequence: Synthetic oligonucleotide
ccuugaucaggaugaacg

SEQ ID NO: 24944 - RNA, 18 nt, Artificial Sequence
  Description of Artificial Sequence: Synthetic oligonucleotide
gggccuugaucaggauga

SEQ ID NO: 24945 - RNA, 18 nt, Artificial Sequence
  Description of Artificial Sequence: Synthetic oligonucleotide
ugcuguggcugagguggg

SEQ ID NO: 24946 - RNA, 18 nt, Artificial Sequence
  Description of Artificial Sequence: Synthetic oligonucleotide
gggacugcuguggcugag

SEQ ID NO: 24947 - RNA, 18 nt, Artificial Sequence
  Description of Artificial Sequence: Synthetic oligonucleotide
gguggacaacacagguug

SEQ ID NO: 24948 - RNA, 18 nt, Artificial Sequence
  Description of Artificial Sequence: Synthetic oligonucleotide
aauaggguggacaacaca

SEQ ID NO: 24949 - RNA, 18 nt, Artificial Sequence
  Description of Artificial Sequence: Synthetic oligonucleotide
ugaauaauaggguggaca

SEQ ID NO: 24950 - RNA, 18 nt, Artificial Sequence
  Description of Artificial Sequence: Synthetic oligonucleotide
guacaugaauaauagggu

SEQ ID NO: 24951 - RNA, 18 nt, Artificial Sequence
  Description of Artificial Sequence: Synthetic oligonucleotide
ggcagguacaugaauaau

SEQ ID NO: 24952 - RNA, 18 nt, Artificial Sequence
  Description of Artificial Sequence: Synthetic oligonucleotide
ggccuggcagguacauga

SEQ ID NO: 24953 - RNA, 18 nt, Artificial Sequence
  Description of Artificial Sequence: Synthetic oligonucleotide
agcagggccuggcaggua

SEQ ID NO: 24954 - RNA, 18 nt, Artificial Sequence
  Description of Artificial Sequence: Synthetic oligonucleotide
uaucuagcagggccuggc

SEQ ID NO: 24955 - RNA, 18 nt, Artificial Sequence
  Description of Artificial Sequence: Synthetic oligonucleotide
ggugcuaucuagcagggc

SEQ ID NO: 24956 - RNA, 18 nt, Artificial Sequence
  Description of Artificial Sequence: Synthetic oligonucleotide
gggugcuaucuagcaggg

SEQ ID NO: 24957 - RNA, 18 nt, Artificial Sequence
  Description of Artificial Sequence: Synthetic oligonucleotide
guuauguaaugccacggg

SEQ ID NO: 24958 - RNA, 18 nt, Artificial Sequence
  Description of Artificial Sequence: Synthetic oligonucleotide
gaaguguuauguaaugcc

SEQ ID NO: 24959 - RNA, 18 nt, Artificial Sequence
  Description of Artificial Sequence: Synthetic oligonucleotide
cucaugaaguguuaugua

SEQ ID NO: 24960 - RNA, 18 nt, Artificial Sequence
  Description of Artificial Sequence: Synthetic oligonucleotide
agccacucaugaaguguu

SEQ ID NO: 24961 - RNA, 18 nt, Artificial Sequence
  Description of Artificial Sequence: Synthetic oligonucleotide
gacacagccacucaugaa

SEQ ID NO: 24962 - RNA, 18 nt, Artificial Sequence
  Description of Artificial Sequence: Synthetic oligonucleotide
uacaagacacagccacuc

SEQ ID NO: 24963 - RNA, 18 nt, Artificial Sequence
  Description of Artificial Sequence: Synthetic oligonucleotide
aaaauuacaagacacagc

SEQ ID NO: 24964 - RNA, 18 nt, Artificial Sequence
  Description of Artificial Sequence: Synthetic oligonucleotide
uccccaaaauuacaagac

SEQ ID NO: 24965 - RNA, 18 nt, Artificial Sequence
  Description of Artificial Sequence: Synthetic oligonucleotide
accuguccccaaaauuac

SEQ ID NO: 24966 - RNA, 18 nt, Artificial Sequence
  Description of Artificial Sequence: Synthetic oligonucleotide
gagaaaccuguccccaaa

SEQ ID NO: 24967 - RNA, 18 nt, Artificial Sequence
  Description of Artificial Sequence: Synthetic oligonucleotide
aaagagagaaaccugucc

SEQ ID NO: 24968 - RNA, 18 nt, Artificial Sequence
  Description of Artificial Sequence: Synthetic oligonucleotide
gagggaaagagagaaacc

SEQ ID NO: 24969 - RNA, 18 nt, Artificial Sequence
  Description of Artificial Sequence: Synthetic oligonucleotide
aaagagagggaaagagag

SEQ ID NO: 24970 - RNA, 18 nt, Artificial Sequence
  Description of Artificial Sequence: Synthetic oligonucleotide
aaaaaaaagagagggaaa

SEQ ID NO: 24971 - RNA, 18 nt, Artificial Sequence
  Description of Artificial Sequence: Synthetic oligonucleotide
uugacaaaaaaaagagag

SEQ ID NO: 24972 - RNA, 18 nt, Artificial Sequence
  Description of Artificial Sequence: Synthetic oligonucleotide
ggcuuuugacaaaaaaaa

SEQ ID NO: 24973 - RNA, 18 nt, Artificial Sequence
  Description of Artificial Sequence: Synthetic oligonucleotide
cucugggcuuuugacaaa

SEQ ID NO: 24974 - RNA, 18 nt, Artificial Sequence
  Description of Artificial Sequence: Synthetic oligonucleotide
ucagucucugggcuuuug

SEQ ID NO: 24975 - RNA, 18 nt, Artificial Sequence
  Description of Artificial Sequence: Synthetic oligonucleotide
gguugucagucucugggc

SEQ ID NO: 24976 - RNA, 18 nt, Artificial Sequence
  Description of Artificial Sequence: Synthetic oligonucleotide
cagcugguugucagucuc

SEQ ID NO: 24977 - RNA, 18 nt, Artificial Sequence
  Description of Artificial Sequence: Synthetic oligonucleotide
cacugcagcugguuguca

SEQ ID NO: 24978 - RNA, 18 nt, Artificial Sequence
  Description of Artificial Sequence: Synthetic oligonucleotide
uuagacacugcagcuggu

SEQ ID NO: 24979 - RNA, 18 nt, Artificial Sequence
  Description of Artificial Sequence: Synthetic oligonucleotide
aacacuuagacacugcag

SEQ ID NO: 24980 - RNA, 18 nt, Artificial Sequence
  Description of Artificial Sequence: Synthetic oligonucleotide
ugaggaacacuuagacac

SEQ ID NO: 24981 - RNA, 18 nt, Artificial Sequence
  Description of Artificial Sequence: Synthetic oligonucleotide
gucagugaggaacacuua

SEQ ID NO: 24982 - RNA, 18 nt, Artificial Sequence
  Description of Artificial Sequence: Synthetic oligonucleotide
acccugucagugaggaac

SEQ ID NO: 24983 - RNA, 18 nt, Artificial Sequence
  Description of Artificial Sequence: Synthetic oligonucleotide
gccccacccugucaguga

SEQ ID NO: 24984 - RNA, 18 nt, Artificial Sequence
  Description of Artificial Sequence: Synthetic oligonucleotide
gugaggccccacccuguc

SEQ ID NO: 24985 - RNA, 18 nt, Artificial Sequence
  Description of Artificial Sequence: Synthetic oligonucleotide
ggguggugaggccccacc

SEQ ID NO: 24986 - RNA, 18 nt, Artificial Sequence
  Description of Artificial Sequence: Synthetic oligonucleotide
gccaacgcugcucccucc

SEQ ID NO: 24987 - RNA, 18 nt, Artificial Sequence
  Description of Artificial Sequence: Synthetic oligonucleotide
ucccugccaacgcugcuc

SEQ ID NO: 24988 - RNA, 18 nt, Artificial Sequence
  Description of Artificial Sequence: Synthetic oligonucleotide
cugucucccugccaacgc

SEQ ID NO: 24989 - RNA, 18 nt, Artificial Sequence
  Description of Artificial Sequence: Synthetic oligonucleotide
ccaggcugucucccugcc

SEQ ID NO: 24990 - RNA, 18 nt, Artificial Sequence
  Description of Artificial Sequence: Synthetic oligonucleotide
cugggccaggcugucucc

SEQ ID NO: 24991 - RNA, 18 nt, Artificial Sequence
  Description of Artificial Sequence: Synthetic oligonucleotide
ggucacugggccaggcug

SEQ ID NO: 24992 - RNA, 18 nt, Artificial Sequence
  Description of Artificial Sequence: Synthetic oligonucleotide
cccagggucacugggcca

SEQ ID NO: 24993 - RNA, 18 nt, Artificial Sequence
  Description of Artificial Sequence: Synthetic oligonucleotide
uugggcccagggucacug

SEQ ID NO: 24994 - RNA, 18 nt, Artificial Sequence
  Description of Artificial Sequence: Synthetic oligonucleotide
cuggcuugggcccagggu

SEQ ID NO: 24995 - RNA, 18 nt, Artificial Sequence
  Description of Artificial Sequence: Synthetic oligonucleotide
gggcuggcuugggcccag

SEQ ID NO: 24996 - RNA, 18 nt, Artificial Sequence
  Description of Artificial Sequence: Synthetic oligonucleotide
ccugaaagcccuggaggg

SEQ ID NO: 24997 - RNA, 18 nt, Artificial Sequence
  Description of Artificial Sequence: Synthetic oligonucleotide
gcuucccugaaagcccug

SEQ ID NO: 24998 - RNA, 18 nt, Artificial Sequence
  Description of Artificial Sequence: Synthetic oligonucleotide
auggcgcuucccugaaag

SEQ ID NO: 24999 - RNA, 18 nt, Artificial Sequence
  Description of Artificial Sequence: Synthetic oligonucleotide
aauggauggcgcuucccu

SEQ ID NO: 25000 - RNA, 18 nt, Artificial Sequence
  Description of Artificial Sequence: Synthetic oligonucleotide
uugaaaauggauggcgcu

SEQ ID NO: 25001 - RNA, 18 nt, Artificial Sequence
  Description of Artificial Sequence: Synthetic oligonucleotide
caucuuugaaaauggaug

SEQ ID NO: 25002 - RNA, 18 nt, Artificial Sequence
  Description of Artificial Sequence: Synthetic oligonucleotide
uuugacaucuuugaaaau

SEQ ID NO: 25003 - RNA, 18 nt, Artificial Sequence
  Description of Artificial Sequence: Synthetic oligonucleotide
ugacguuugacaucuuug

SEQ ID NO: 25004 - RNA, 18 nt, Artificial Sequence
  Description of Artificial Sequence: Synthetic oligonucleotide
agaagugacguuugacau

SEQ ID NO: 25005 - RNA, 18 nt, Artificial Sequence
  Description of Artificial Sequence: Synthetic oligonucleotide
caggaagaagugacguuu

SEQ ID NO: 25006 - RNA, 18 nt, Artificial Sequence
  Description of Artificial Sequence: Synthetic oligonucleotide
cccuacaggaagaaguga

SEQ ID NO: 25007 - RNA, 18 nt, Artificial Sequence
  Description of Artificial Sequence: Synthetic oligonucleotide
ucgggcccuacaggaaga

SEQ ID NO: 25008 - RNA, 18 nt, Artificial Sequence
  Description of Artificial Sequence: Synthetic oligonucleotide
aggacucgggcccuacag

SEQ ID NO: 25009 - RNA, 18 nt, Artificial Sequence
  Description of Artificial Sequence: Synthetic oligonucleotide
gaggcaggacucgggccc

SEQ ID NO: 25010 - RNA, 18 nt, Artificial Sequence
  Description of Artificial Sequence: Synthetic oligonucleotide
gauaggaggcaggacucg

SEQ ID NO: 25011 - RNA, 18 nt, Artificial Sequence
  Description of Artificial Sequence: Synthetic oligonucleotide
gcccugauaggaggcagg

SEQ ID NO: 25012 - RNA, 18 nt, Artificial Sequence
  Description of Artificial Sequence: Synthetic oligonucleotide
aucuggcccugauaggag

SEQ ID NO: 25013 - RNA, 18 nt, Artificial Sequence
  Description of Artificial Sequence: Synthetic oligonucleotide
cuaugaucuggcccugau

SEQ ID NO: 25014 - RNA, 18 nt, Artificial Sequence
  Description of Artificial Sequence: Synthetic oligonucleotide
gccuucuaugaucuggcc

SEQ ID NO: 25015 - RNA, 18 nt, Artificial Sequence
  Description of Artificial Sequence: Synthetic oligonucleotide
aaauagccuucuaugauc

SEQ ID NO: 25016 - RNA, 18 nt, Artificial Sequence
  Description of Artificial Sequence: Synthetic oligonucleotide
auagaaaauagccuucua

SEQ ID NO: 25017 - RNA, 18 nt, Artificial Sequence
  Description of Artificial Sequence: Synthetic oligonucleotide
ccagaauagaaaauagcc

SEQ ID NO: 25018 - RNA, 18 nt, Artificial Sequence
  Description of Artificial Sequence: Synthetic oligonucleotide
guuccccagaauagaaaa

SEQ ID NO: 25019 - RNA, 18 nt, Artificial Sequence
  Description of Artificial Sequence: Synthetic oligonucleotide
uaaucguuccccagaaua

SEQ ID NO: 25020 - RNA, 18 nt, Artificial Sequence
  Description of Artificial Sequence: Synthetic oligonucleotide
aguuauaaucguucccca

SEQ ID NO: 25021 - RNA, 18 nt, Artificial Sequence
  Description of Artificial Sequence: Synthetic oligonucleotide
auuuaaguuauaaucguu

SEQ ID NO: 25022 - RNA, 18 nt, Artificial Sequence
  Description of Artificial Sequence: Synthetic oligonucleotide
caaucauuuaaguuauaa

SEQ ID NO: 25023 - RNA, 18 nt, Artificial Sequence
  Description of Artificial Sequence: Synthetic oligonucleotide
uaaaacaaucauuuaagu

SEQ ID NO: 25024 - RNA, 18 nt, Artificial Sequence
  Description of Artificial Sequence: Synthetic oligonucleotide
uuuauuaaaacaaucauu

SEQ ID NO: 25025 - RNA, 18 nt, Artificial Sequence
  Description of Artificial Sequence: Synthetic oligonucleotide
gaauuuuuauuaaaacaa

SEQ ID NO: 25026 - RNA, 18 nt, Artificial Sequence
  Description of Artificial Sequence: Synthetic oligonucleotide
gcuuagaauuuuuauuaa

SEQ ID NO: 25027 - RNA, 18 nt, Artificial Sequence
  Description of Artificial Sequence: Synthetic oligonucleotide
uuccagcuuagaauuuuu

SEQ ID NO: 25028 - RNA, 18 nt, Artificial Sequence
  Description of Artificial Sequence: Synthetic oligonucleotide
aucuaaaaucugcuucuu

SEQ ID NO: 25029 - RNA, 18 nt, Artificial Sequence
  Description of Artificial Sequence: Synthetic oligonucleotide
uuuucaucuaaaaucugc

SEQ ID NO: 25030 - RNA, 18 nt, Artificial Sequence
  Description of Artificial Sequence: Synthetic oligonucleotide
agaucuuuucaucuaaaa

SEQ ID NO: 25031 - RNA, 18 nt, Artificial Sequence
  Description of Artificial Sequence: Synthetic oligonucleotide
gcaguagaucuuuucauc

SEQ ID NO: 25032 - RNA, 18 nt, Artificial Sequence
  Description of Artificial Sequence: Synthetic oligonucleotide
ggagggcaguagaucuuu

SEQ ID NO: 25033 - RNA, 18 nt, Artificial Sequence
  Description of Artificial Sequence: Synthetic oligonucleotide
ccucaggagggcaguaga

SEQ ID NO: 25034 - RNA, 18 nt, Artificial Sequence
  Description of Artificial Sequence: Synthetic oligonucleotide
agaagccucaggagggca

SEQ ID NO: 25035 - RNA, 18 nt, Artificial Sequence
  Description of Artificial Sequence: Synthetic oligonucleotide
agcacagaagccucagga

SEQ ID NO: 25036 - RNA, 18 nt, Artificial Sequence
  Description of Artificial Sequence: Synthetic oligonucleotide
ccaggagcacagaagccu

SEQ ID NO: 25037 - RNA, 18 nt, Artificial Sequence
  Description of Artificial Sequence: Synthetic oligonucleotide
agaagccaggagcacaga

SEQ ID NO: 25038 - RNA, 18 nt, Artificial Sequence
  Description of Artificial Sequence: Synthetic oligonucleotide
gcguaagaagccaggagc

SEQ ID NO: 25039 - RNA, 18 nt, Artificial Sequence
  Description of Artificial Sequence: Synthetic oligonucleotide
ggacggcguaagaagcca

SEQ ID NO: 25040 - RNA, 18 nt, Artificial Sequence
  Description of Artificial Sequence: Synthetic oligonucleotide
ggccuggacggcguaaga

SEQ ID NO: 25041 - RNA, 18 nt, Artificial Sequence
  Description of Artificial Sequence: Synthetic oligonucleotide
acauuuuucuucuuugag

SEQ ID NO: 25042 - RNA, 18 nt, Artificial Sequence
  Description of Artificial Sequence: Synthetic oligonucleotide
aaaauacauuuuucuucu

SEQ ID NO: 25043 - RNA, 18 nt, Artificial Sequence
  Description of Artificial Sequence: Synthetic oligonucleotide
caggaaaaauacauuuuu

SEQ ID NO: 25044 - RNA, 18 nt, Artificial Sequence
  Description of Artificial Sequence: Synthetic oligonucleotide
acgcccaggaaaaauaca

SEQ ID NO: 25045 - RNA, 18 nt, Artificial Sequence
  Description of Artificial Sequence: Synthetic oligonucleotide
aauuaacgcccaggaaaa

SEQ ID NO: 25046 - RNA, 18 nt, Artificial Sequence
  Description of Artificial Sequence: Synthetic oligonucleotide
acccaaauuaacgcccag

SEQ ID NO: 25047 - RNA, 18 nt, Artificial Sequence
  Description of Artificial Sequence: Synthetic oligonucleotide
ccaugacccaaauuaacg

SEQ ID NO: 25048 - RNA, 18 nt, Artificial Sequence
  Description of Artificial Sequence: Synthetic oligonucleotide
ugaucccaugacccaaau

SEQ ID NO: 25049 - RNA, 18 nt, Artificial Sequence
  Description of Artificial Sequence: Synthetic oligonucleotide
aggagugaucccaugacc

SEQ ID NO: 25050 - RNA, 18 nt, Artificial Sequence
  Description of Artificial Sequence: Synthetic oligonucleotide
aagauaggagugauccca

SEQ ID NO: 25051 - RNA, 18 nt, Artificial Sequence
  Description of Artificial Sequence: Synthetic oligonucleotide
aagagaagauaggaguga

SEQ ID NO: 25052 - RNA, 18 nt, Artificial Sequence
  Description of Artificial Sequence: Synthetic oligonucleotide
aaagaaagagaagauagg

SEQ ID NO: 25053 - RNA, 18 nt, Artificial Sequence
  Description of Artificial Sequence: Synthetic oligonucleotide
aacccaaagaaagagaag

SEQ ID NO: 25054 - RNA, 18 nt, Artificial Sequence
  Description of Artificial Sequence: Synthetic oligonucleotide
cagaaaacccaaagaaag

SEQ ID NO: 25055 - RNA, 18 nt, Artificial Sequence
  Description of Artificial Sequence: Synthetic oligonucleotide
aaguacagaaaacccaaa

SEQ ID NO: 25056 - RNA, 18 nt, Artificial Sequence
  Description of Artificial Sequence: Synthetic oligonucleotide
cucugaaguacagaaaac

SEQ ID NO: 25057 - RNA, 18 nt, Artificial Sequence
  Description of Artificial Sequence: Synthetic oligonucleotide
agucucucugaaguacag

SEQ ID NO: 25058 - RNA, 18 nt, Artificial Sequence
  Description of Artificial Sequence: Synthetic oligonucleotide
gggcaagucucucugaag

SEQ ID NO: 25059 - RNA, 18 nt, Artificial Sequence
  Description of Artificial Sequence: Synthetic oligonucleotide
ccauaacaucucacuuuc

SEQ ID NO: 25060 - RNA, 18 nt, Artificial Sequence
  Description of Artificial Sequence: Synthetic oligonucleotide
aagucccauaacaucuca

SEQ ID NO: 25061 - RNA, 18 nt, Artificial Sequence
  Description of Artificial Sequence: Synthetic oligonucleotide
uccacaagucccauaaca

SEQ ID NO: 25062 - RNA, 18 nt, Artificial Sequence
  Description of Artificial Sequence: Synthetic oligonucleotide
ucaaguccacaaguccca

SEQ ID NO: 25063 - RNA, 18 nt, Artificial Sequence
  Description of Artificial Sequence: Synthetic oligonucleotide
guucuucaaguccacaag

SEQ ID NO: 25064 - RNA, 18 nt, Artificial Sequence
  Description of Artificial Sequence: Synthetic oligonucleotide
cagugguucuucaagucc

SEQ ID NO: 25065 - RNA, 18 nt, Artificial Sequence
  Description of Artificial Sequence: Synthetic oligonucleotide
agugacagugguucuuca

SEQ ID NO: 25066 - RNA, 18 nt, Artificial Sequence
  Description of Artificial Sequence: Synthetic oligonucleotide
ggaacagugacagugguu

SEQ ID NO: 25067 - RNA, 18 nt, Artificial Sequence
  Description of Artificial Sequence: Synthetic oligonucleotide
acacuggaacagugacag

SEQ ID NO: 25068 - RNA, 18 nt, Artificial Sequence
  Description of Artificial Sequence: Synthetic oligonucleotide
uacaaacacuggaacagu

SEQ ID NO: 25069 - RNA, 18 nt, Artificial Sequence
  Description of Artificial Sequence: Synthetic oligonucleotide
gauuauacaaacacugga

SEQ ID NO: 25070 - RNA, 18 nt, Artificial Sequence
  Description of Artificial Sequence: Synthetic oligonucleotide
cacaagauuauacaaaca

SEQ ID NO: 25071 - RNA, 18 nt, Artificial Sequence
  Description of Artificial Sequence: Synthetic oligonucleotide
acacacacaagauuauac

SEQ ID NO: 25072 - RNA, 18 nt, Artificial Sequence
  Description of Artificial Sequence: Synthetic oligonucleotide
cacauacacacacaagau

SEQ ID NO: 25073 - RNA, 18 nt, Artificial Sequence
  Description of Artificial Sequence: Synthetic oligonucleotide
acacacacauacacacac

SEQ ID NO: 25074 - RNA, 18 nt, Artificial Sequence
  Description of Artificial Sequence: Synthetic oligonucleotide
cacacacacacacauaca

SEQ ID NO: 25075 - RNA, 18 nt, Artificial Sequence
  Description of Artificial Sequence: Synthetic oligonucleotide
acauacacacacacacac

SEQ ID NO: 25076 - RNA, 18 nt, Artificial Sequence
  Description of Artificial Sequence: Synthetic oligonucleotide
cacacacauacacacaca

SEQ ID NO: 25077 - RNA, 18 nt, Artificial Sequence
  Description of Artificial Sequence: Synthetic oligonucleotide
ccacacacacacauacac

SEQ ID NO: 25078 - RNA, 18 nt, Artificial Sequence
  Description of Artificial Sequence: Synthetic oligonucleotide
gcacaccacacacacaca

SEQ ID NO: 25079 - RNA, 18 nt, Artificial Sequence
  Description of Artificial Sequence: Synthetic oligonucleotide
uuucugcacaccacacac

SEQ ID NO: 25080 - RNA, 18 nt, Artificial Sequence
  Description of Artificial Sequence: Synthetic oligonucleotide
uauaauuucugcacacca

SEQ ID NO: 25081 - RNA, 18 nt, Artificial Sequence
  Description of Artificial Sequence: Synthetic oligonucleotide
auacuuauaauuucugca

SEQ ID NO: 25082 - RNA, 18 nt, Artificial Sequence
  Description of Artificial Sequence: Synthetic oligonucleotide
gaacgauacuuauaauuu

SEQ ID NO: 25083 - RNA, 18 nt, Artificial Sequence
  Description of Artificial Sequence: Synthetic oligonucleotide
cauuagaacgauacuuau

SEQ ID NO: 25084 - RNA, 18 nt, Artificial Sequence
  Description of Artificial Sequence: Synthetic oligonucleotide
uaauucauuagaacgaua

SEQ ID NO: 25085 - RNA, 18 nt, Artificial Sequence
  Description of Artificial Sequence: Synthetic oligonucleotide
aauucuaauucauuagaa

SEQ ID NO: 25086 - RNA, 18 nt, Artificial Sequence
  Description of Artificial Sequence: Synthetic oligonucleotide
gaaugaauucuaauucau

SEQ ID NO: 25087 - RNA, 18 nt, Artificial Sequence
  Description of Artificial Sequence: Synthetic oligonucleotide
acuuagaaugaauucuaa

SEQ ID NO: 25088 - RNA, 18 nt, Artificial Sequence
  Description of Artificial Sequence: Synthetic oligonucleotide
aauucacuuagaaugaau

SEQ ID NO: 25089 - RNA, 18 nt, Artificial Sequence
  Description of Artificial Sequence: Synthetic oligonucleotide
gaaugaauucacuuagaa

SEQ ID NO: 25090 - RNA, 18 nt, Artificial Sequence
  Description of Artificial Sequence: Synthetic oligonucleotide
uuucugaaugaauucacu

SEQ ID NO: 25091 - RNA, 18 nt, Artificial Sequence
  Description of Artificial Sequence: Synthetic oligonucleotide
ucaucuuucugaaugaau

SEQ ID NO: 25092 - RNA, 18 nt, Artificial Sequence
  Description of Artificial Sequence: Synthetic oligonucleotide
gaaauucaucuuucugaa

SEQ ID NO: 25093 - RNA, 18 nt, Artificial Sequence
  Description of Artificial Sequence: Synthetic oligonucleotide
cacaggaaauucaucuuu

SEQ ID NO: 25094 - RNA, 18 nt, Artificial Sequence
  Description of Artificial Sequence: Synthetic oligonucleotide
gauuacacaggaaauuca

SEQ ID NO: 25095 - RNA, 18 nt, Artificial Sequence
  Description of Artificial Sequence: Synthetic oligonucleotide
aaugagauuacacaggaa

SEQ ID NO: 25096 - RNA, 18 nt, Artificial Sequence
  Description of Artificial Sequence: Synthetic oligonucleotide
uacauaaugagauuacac

SEQ ID NO: 25097 - RNA, 18 nt, Artificial Sequence
  Description of Artificial Sequence: Synthetic oligonucleotide
acauguacauaaugagau

SEQ ID NO: 25098 - RNA, 18 nt, Artificial Sequence
  Description of Artificial Sequence: Synthetic oligonucleotide
aaaccacauguacauaau

SEQ ID NO: 25099 - RNA, 18 nt, Artificial Sequence
  Description of Artificial Sequence: Synthetic oligonucleotide
gucauaaaccacauguac

SEQ ID NO: 25100 - RNA, 18 nt, Artificial Sequence
  Description of Artificial Sequence: Synthetic oligonucleotide
uaaaugucauaaaccaca

SEQ ID NO: 25101 - RNA, 18 nt, Artificial Sequence
  Description of Artificial Sequence: Synthetic oligonucleotide
uccaguaaaugucauaaa

SEQ ID NO: 25102 - RNA, 18 nt, Artificial Sequence
  Description of Artificial Sequence: Synthetic oligonucleotide
guuuuuccaguaaauguc

SEQ ID NO: 25103 - RNA, 18 nt, Artificial Sequence
  Description of Artificial Sequence: Synthetic oligonucleotide
aaaagguuuuuccaguaa

SEQ ID NO: 25104 - RNA, 18 nt, Artificial Sequence
  Description of Artificial Sequence: Synthetic oligonucleotide
aagaaaaaagguuuuucc

SEQ ID NO: 25105 - RNA, 18 nt, Artificial Sequence
  Description of Artificial Sequence: Synthetic oligonucleotide
aaaaaaagaaaaaagguu

SEQ ID NO: 25106 - RNA, 18 nt, Artificial Sequence
  Description of Artificial Sequence: Synthetic oligonucleotide
aaaaaaaaaaaagaaaaa

SEQ ID NO: 25107 - RNA, 18 nt, Artificial Sequence
  Description of Artificial Sequence: Synthetic oligonucleotide
gguuuaaaaaaaaaaaag

SEQ ID NO: 25108 - RNA, 18 nt, Artificial Sequence
  Description of Artificial Sequence: Synthetic oligonucleotide
uuuaugguuuaaaaaaaa

SEQ ID NO: 25109 - RNA, 18 nt, Artificial Sequence
  Description of Artificial Sequence: Synthetic oligonucleotide
uugaguuuaugguuuaaa

SEQ ID NO: 25110 - RNA, 18 nt, Artificial Sequence
  Description of Artificial Sequence: Synthetic oligonucleotide
caugguugaguuuauggu

SEQ ID NO: 25111 - RNA, 18 nt, Artificial Sequence
  Description of Artificial Sequence: Synthetic oligonucleotide
uaccacaugguugaguuu

SEQ ID NO: 25112 - RNA, 18 nt, Artificial Sequence
  Description of Artificial Sequence: Synthetic oligonucleotide
gguuguaccacaugguug

SEQ ID NO: 25113 - RNA, 18 nt, Artificial Sequence
  Description of Artificial Sequence: Synthetic oligonucleotide
agaaagguuguaccacau

SEQ ID NO: 25114 - RNA, 18 nt, Artificial Sequence
  Description of Artificial Sequence: Synthetic oligonucleotide
cuaauagaaagguuguac

SEQ ID NO: 25115 - RNA, 18 nt, Artificial Sequence
  Description of Artificial Sequence: Synthetic oligonucleotide
ccuggcuaauagaaaggu

SEQ ID NO: 25116 - RNA, 18 nt, Artificial Sequence
  Description of Artificial Sequence: Synthetic oligonucleotide
uuuuuccuggcuaauaga

SEQ ID NO: 25117 - RNA, 18 nt, Artificial Sequence
  Description of Artificial Sequence: Synthetic oligonucleotide
auucauuuuuccuggcua

SEQ ID NO: 25118 - RNA, 18 nt, Artificial Sequence
  Description of Artificial Sequence: Synthetic oligonucleotide
cauaaauucauuuuuccu

SEQ ID NO: 25119 - RNA, 18 nt, Artificial Sequence
  Description of Artificial Sequence: Synthetic oligonucleotide
gagaccauaaauucauuu

SEQ ID NO: 25120 - RNA, 18 nt, Artificial Sequence
  Description of Artificial Sequence: Synthetic oligonucleotide
aauuggagaccauaaauu

SEQ ID NO: 25121 - RNA, 18 nt, Artificial Sequence
  Description of Artificial Sequence: Synthetic oligonucleotide
gcuaaaauuggagaccau

SEQ ID NO: 25122 - RNA, 18 nt, Artificial Sequence
  Description of Artificial Sequence: Synthetic oligonucleotide
guuuggcuaaaauuggag

SEQ ID NO: 25123 - RNA, 18 nt, Artificial Sequence
  Description of Artificial Sequence: Synthetic oligonucleotide
gccauguuuggcuaaaau

SEQ ID NO: 25124 - RNA, 18 nt, Artificial Sequence
  Description of Artificial Sequence: Synthetic oligonucleotide
uaaaggccauguuuggcu

SEQ ID NO: 25125 - RNA, 18 nt, Artificial Sequence
  Description of Artificial Sequence: Synthetic oligonucleotide
ugaccuaaaggccauguu

SEQ ID NO: 25126 - RNA, 18 nt, Artificial Sequence
  Description of Artificial Sequence: Synthetic oligonucleotide
cuuucugaccuaaaggcc

SEQ ID NO: 25127 - RNA, 18 nt, Artificial Sequence
  Description of Artificial Sequence: Synthetic oligonucleotide
ugggccuuucugaccuaa

SEQ ID NO: 25128 - RNA, 18 nt, Artificial Sequence
  Description of Artificial Sequence: Synthetic oligonucleotide
ggaccugggccuuucuga

SEQ ID NO: 25129 - RNA, 18 nt, Artificial Sequence
  Description of Artificial Sequence: Synthetic oligonucleotide
agugaggaccugggccuu

SEQ ID NO: 25130 - RNA, 18 nt, Artificial Sequence
  Description of Artificial Sequence: Synthetic oligonucleotide
uuuggagugaggaccugg

SEQ ID NO: 25131 - RNA, 18 nt, Artificial Sequence
  Description of Artificial Sequence: Synthetic oligonucleotide
augaguuuggagugagga

SEQ ID NO: 25132 - RNA, 18 nt, Artificial Sequence
  Description of Artificial Sequence: Synthetic oligonucleotide
ugcaaaugaguuuggagu

SEQ ID NO: 25133 - RNA, 18 nt, Artificial Sequence
  Description of Artificial Sequence: Synthetic oligonucleotide
uuguuugcaaaugaguuu

SEQ ID NO: 25134 - RNA, 18 nt, Artificial Sequence
  Description of Artificial Sequence: Synthetic oligonucleotide
gcagcuuguuugcaaaug

SEQ ID NO: 25135 - RNA, 18 nt, Artificial Sequence
  Description of Artificial Sequence: Synthetic oligonucleotide
acaaggcagcuuguuugc

SEQ ID NO: 25136 - RNA, 18 nt, Artificial Sequence
  Description of Artificial Sequence: Synthetic oligonucleotide
cacacacaaggcagcuug

SEQ ID NO: 25137 - RNA, 18 nt, Artificial Sequence
  Description of Artificial Sequence: Synthetic oligonucleotide
uuaccccuucuacuccug

SEQ ID NO: 25138 - RNA, 18 nt, Artificial Sequence
  Description of Artificial Sequence: Synthetic oligonucleotide
agaguuuaccccuucuac

SEQ ID NO: 25139 - RNA, 18 nt, Artificial Sequence
  Description of Artificial Sequence: Synthetic oligonucleotide
gaggaagaguuuaccccu

SEQ ID NO: 25140 - RNA, 18 nt, Artificial Sequence
  Description of Artificial Sequence: Synthetic oligonucleotide
cagaugaggaagaguuua

SEQ ID NO: 25141 - RNA, 18 nt, Artificial Sequence
  Description of Artificial Sequence: Synthetic oligonucleotide
uguggcagaugaggaaga

SEQ ID NO: 25142 - RNA, 18 nt, Artificial Sequence
  Description of Artificial Sequence: Synthetic oligonucleotide
aggccuguggcagaugag

SEQ ID NO: 25143 - RNA, 18 nt, Artificial Sequence
  Description of Artificial Sequence: Synthetic oligonucleotide
aaggcaggccuguggcag

SEQ ID NO: 25144 - RNA, 18 nt, Artificial Sequence
  Description of Artificial Sequence: Synthetic oligonucleotide
gaggcaaggcaggccugu

SEQ ID NO: 25145 - RNA, 18 nt, Artificial Sequence
  Description of Artificial Sequence: Synthetic oligonucleotide
ggccugaggcaaggcagg

SEQ ID NO: 25146 - RNA, 18 nt, Artificial Sequence
  Description of Artificial Sequence: Synthetic oligonucleotide
gacguggccugaggcaag

SEQ ID NO: 25147 - RNA, 18 nt, Artificial Sequence
  Description of Artificial Sequence: Synthetic oligonucleotide
aaggugacguggccugag

SEQ ID NO: 25148 - RNA, 18 nt, Artificial Sequence
  Description of Artificial Sequence: Synthetic oligonucleotide
ccuggcaacauggcuggg

SEQ ID NO: 25149 - RNA, 18 nt, Artificial Sequence
  Description of Artificial Sequence: Synthetic oligonucleotide
caugcccuggcaacaugg

SEQ ID NO: 25150 - RNA, 18 nt, Artificial Sequence
  Description of Artificial Sequence: Synthetic oligonucleotide
guccucaugcccuggcaa

SEQ ID NO: 25151 - RNA, 18 nt, Artificial Sequence
  Description of Artificial Sequence: Synthetic oligonucleotide
ucuuaguccucaugcccu

SEQ ID NO: 25152 - RNA, 18 nt, Artificial Sequence
  Description of Artificial Sequence: Synthetic oligonucleotide
aagcaucuuaguccucau

SEQ ID NO: 25153 - RNA, 18 nt, Artificial Sequence
  Description of Artificial Sequence: Synthetic oligonucleotide
agggcaagcaucuuaguc

SEQ ID NO: 25154 - RNA, 18 nt, Artificial Sequence
  Description of Artificial Sequence: Synthetic oligonucleotide
uuggcagggcaagcaucu

SEQ ID NO: 25155 - RNA, 18 nt, Artificial Sequence
  Description of Artificial Sequence: Synthetic oligonucleotide
cgggcuuggcagggcaag

SEQ ID NO: 25156 - RNA, 18 nt, Artificial Sequence
  Description of Artificial Sequence: Synthetic oligonucleotide
cccuccgggcuuggcagg

SEQ ID NO: 25157 - RNA, 18 nt, Artificial Sequence
  Description of Artificial Sequence: Synthetic oligonucleotide
ucauccccuccgggcuug

SEQ ID NO: 25158 - RNA, 18 nt, Artificial Sequence
  Description of Artificial Sequence: Synthetic oligonucleotide
gcugcucauccccuccgg

SEQ ID NO: 25159 - RNA, 18 nt, Artificial Sequence
  Description of Artificial Sequence: Synthetic oligonucleotide
cugaggcugcucaucccc

SEQ ID NO: 25160 - RNA, 18 nt, Artificial Sequence
  Description of Artificial Sequence: Synthetic oligonucleotide
accagcugaggcugcuca

SEQ ID NO: 25161 - RNA, 18 nt, Artificial Sequence
  Description of Artificial Sequence: Synthetic oligonucleotide
gcggcaccagcugaggcu

SEQ ID NO: 25162 - RNA, 18 nt, Artificial Sequence
  Description of Artificial Sequence: Synthetic oligonucleotide
cuguggcggcaccagcug

SEQ ID NO: 25163 - RNA, 18 nt, Artificial Sequence
  Description of Artificial Sequence: Synthetic oligonucleotide
gcugucuguggcggcacc

SEQ ID NO: 25164 - RNA, 18 nt, Artificial Sequence
  Description of Artificial Sequence: Synthetic oligonucleotide
ggugugcugucuguggcg

SEQ ID NO: 25165 - RNA, 18 nt, Artificial Sequence
  Description of Artificial Sequence: Synthetic oligonucleotide
ucuguggugugcugucug

SEQ ID NO: 25166 - RNA, 18 nt, Artificial Sequence
  Description of Artificial Sequence: Synthetic oligonucleotide
ccaccucuguggugugcu

SEQ ID NO: 25167 - RNA, 18 nt, Artificial Sequence
  Description of Artificial Sequence: Synthetic oligonucleotide
cugagccaccucuguggu

SEQ ID NO: 25168 - RNA, 18 nt, Artificial Sequence
  Description of Artificial Sequence: Synthetic oligonucleotide
ggucccugagccaccucu

SEQ ID NO: 25169 - RNA, 18 nt, Artificial Sequence
  Description of Artificial Sequence: Synthetic oligonucleotide
accaaggucccugagcca

SEQ ID NO: 25170 - RNA, 18 nt, Artificial Sequence
  Description of Artificial Sequence: Synthetic oligonucleotide
caucuaccaaggucccug

SEQ ID NO: 25171 - RNA, 18 nt, Artificial Sequence
  Description of Artificial Sequence: Synthetic oligonucleotide
auucccaucuaccaaggu

SEQ ID NO: 25172 - RNA, 18 nt, Artificial Sequence
  Description of Artificial Sequence: Synthetic oligonucleotide
cucacauucccaucuacc

SEQ ID NO: 25173 - RNA, 18 nt, Artificial Sequence
  Description of Artificial Sequence: Synthetic oligonucleotide
agauucucacauucccau

SEQ ID NO: 25174 - RNA, 18 nt, Artificial Sequence
  Description of Artificial Sequence: Synthetic oligonucleotide
uuaauagauucucacauu

SEQ ID NO: 25175 - RNA, 18 nt, Artificial Sequence
  Description of Artificial Sequence: Synthetic oligonucleotide
cuauuuuaauagauucuc

SEQ ID NO: 25176 - RNA, 18 nt, Artificial Sequence
  Description of Artificial Sequence: Synthetic oligonucleotide
ccugccuauuuuaauaga

SEQ ID NO: 25177 - RNA, 18 nt, Artificial Sequence
  Description of Artificial Sequence: Synthetic oligonucleotide
agaucccugccuauuuua

SEQ ID NO: 25178 - RNA, 18 nt, Artificial Sequence
  Description of Artificial Sequence: Synthetic oligonucleotide
accggagaucccugccua

SEQ ID NO: 25179 - RNA, 18 nt, Artificial Sequence
  Description of Artificial Sequence: Synthetic oligonucleotide
agaggaccggagaucccu

SEQ ID NO: 25180 - RNA, 18 nt, Artificial Sequence
  Description of Artificial Sequence: Synthetic oligonucleotide
uugacagaggaccggaga

SEQ ID NO: 25181 - RNA, 18 nt, Artificial Sequence
  Description of Artificial Sequence: Synthetic oligonucleotide
gccucuugacagaggacc

SEQ ID NO: 25182 - RNA, 18 nt, Artificial Sequence
  Description of Artificial Sequence: Synthetic oligonucleotide
gcauugccucuugacaga

SEQ ID NO: 25183 - RNA, 18 nt, Artificial Sequence
  Description of Artificial Sequence: Synthetic oligonucleotide
cgucagcauugccucuug

SEQ ID NO: 25184 - RNA, 18 nt, Artificial Sequence
  Description of Artificial Sequence: Synthetic oligonucleotide
aaagccgucagcauugcc

SEQ ID NO: 25185 - RNA, 18 nt, Artificial Sequence
  Description of Artificial Sequence: Synthetic oligonucleotide
aggaaaaagccgucagca

SEQ ID NO: 25186 - RNA, 18 nt, Artificial Sequence
  Description of Artificial Sequence: Synthetic oligonucleotide
ccagcaggaaaaagccgu

SEQ ID NO: 25187 - RNA, 18 nt, Artificial Sequence
  Description of Artificial Sequence: Synthetic oligonucleotide
gcacgccagcaggaaaaa

SEQ ID NO: 25188 - RNA, 18 nt, Artificial Sequence
  Description of Artificial Sequence: Synthetic oligonucleotide
cagaggcacgccagcagg

SEQ ID NO: 25189 - RNA, 18 nt, Artificial Sequence
  Description of Artificial Sequence: Synthetic oligonucleotide
gugggcagaggcacgcca

SEQ ID NO: 25190 - RNA, 18 nt, Artificial Sequence
  Description of Artificial Sequence: Synthetic oligonucleotide
ggcuggugggcagaggca

SEQ ID NO: 25191 - RNA, 18 nt, Artificial Sequence
  Description of Artificial Sequence: Synthetic oligonucleotide
gggaaggcuggugggcag

SEQ ID NO: 25192 - RNA, 18 nt, Artificial Sequence
  Description of Artificial Sequence: Synthetic oligonucleotide
aaugaggaugugcaaggg

SEQ ID NO: 25193 - RNA, 18 nt, Artificial Sequence
  Description of Artificial Sequence: Synthetic oligonucleotide
acaaaugaggaugugcaa

SEQ ID NO: 25194 - RNA, 18 nt, Artificial Sequence
  Description of Artificial Sequence: Synthetic oligonucleotide
aggugacaaaugaggaug

SEQ ID NO: 25195 - RNA, 18 nt, Artificial Sequence
  Description of Artificial Sequence: Synthetic oligonucleotide
uuaggaggugacaaauga

SEQ ID NO: 25196 - RNA, 18 nt, Artificial Sequence
  Description of Artificial Sequence: Synthetic oligonucleotide
ucaaauuaggaggugaca

SEQ ID NO: 25197 - RNA, 18 nt, Artificial Sequence
  Description of Artificial Sequence: Synthetic oligonucleotide
auaauucaaauuaggagg

SEQ ID NO: 25198 - RNA, 18 nt, Artificial Sequence
  Description of Artificial Sequence: Synthetic oligonucleotide
gcccaauaauucaaauua

SEQ ID NO: 25199 - RNA, 18 nt, Artificial Sequence
  Description of Artificial Sequence: Synthetic oligonucleotide
gauuugcccaauaauuca

SEQ ID NO: 25200 - RNA, 18 nt, Artificial Sequence
  Description of Artificial Sequence: Synthetic oligonucleotide
ggccagauuugcccaaua

SEQ ID NO: 25201 - RNA, 18 nt, Artificial Sequence
  Description of Artificial Sequence: Synthetic oligonucleotide
uaagcggccagauuugcc

SEQ ID NO: 25202 - RNA, 18 nt, Artificial Sequence
  Description of Artificial Sequence: Synthetic oligonucleotide
ccaaauaagcggccagau

SEQ ID NO: 25203 - RNA, 18 nt, Artificial Sequence
  Description of Artificial Sequence: Synthetic oligonucleotide
cagucccaaauaagcggc

SEQ ID NO: 25204 - RNA, 18 nt, Artificial Sequence
  Description of Artificial Sequence: Synthetic oligonucleotide
gcugucagucccaaauaa

SEQ ID NO: 25205 - RNA, 18 nt, Artificial Sequence
  Description of Artificial Sequence: Synthetic oligonucleotide
aguuggcugucaguccca

SEQ ID NO: 25206 - RNA, 18 nt, Artificial Sequence
  Description of Artificial Sequence: Synthetic oligonucleotide
caagaaguuggcugucag

SEQ ID NO: 25207 - RNA, 18 nt, Artificial Sequence
  Description of Artificial Sequence: Synthetic oligonucleotide
augcucaagaaguuggcu

SEQ ID NO: 25208 - RNA, 18 nt, Artificial Sequence
  Description of Artificial Sequence: Synthetic oligonucleotide
aauagaugcucaagaagu

SEQ ID NO: 25209 - RNA, 18 nt, Artificial Sequence
  Description of Artificial Sequence: Synthetic oligonucleotide
guucaaauagaugcucaa

SEQ ID NO: 25210 - RNA, 18 nt, Artificial Sequence
  Description of Artificial Sequence: Synthetic oligonucleotide
aggcuguucaaauagaug

SEQ ID NO: 25211 - RNA, 18 nt, Artificial Sequence
  Description of Artificial Sequence: Synthetic oligonucleotide
agggaaggcuguucaaau

SEQ ID NO: 25212 - RNA, 18 nt, Artificial Sequence
  Description of Artificial Sequence: Synthetic oligonucleotide
gcgaaagggaaggcuguu

SEQ ID NO: 25213 - RNA, 18 nt, Artificial Sequence
  Description of Artificial Sequence: Synthetic oligonucleotide
ugggagcgaaagggaagg

SEQ ID NO: 25214 - RNA, 18 nt, Artificial Sequence
  Description of Artificial Sequence: Synthetic oligonucleotide
guggcugggagcgaaagg

SEQ ID NO: 25215 - RNA, 18 nt, Artificial Sequence
  Description of Artificial Sequence: Synthetic oligonucleotide
caaagguggcugggagcg

SEQ ID NO: 25216 - RNA, 18 nt, Artificial Sequence
  Description of Artificial Sequence: Synthetic oligonucleotide
caccucaaagguggcugg

SEQ ID NO: 25217 - RNA, 18 nt, Artificial Sequence
  Description of Artificial Sequence: Synthetic oligonucleotide
ggacucaccucaaaggug

SEQ ID NO: 25218 - RNA, 18 nt, Artificial Sequence
  Description of Artificial Sequence: Synthetic oligonucleotide
cacuuggacucaccucaa

SEQ ID NO: 25219 - RNA, 18 nt, Artificial Sequence
  Description of Artificial Sequence: Synthetic oligonucleotide
ccugccacuuggacucac

SEQ ID NO: 25220 - RNA, 18 nt, Artificial Sequence
  Description of Artificial Sequence: Synthetic oligonucleotide
ccuguccugccacuugga

SEQ ID NO: 25221 - RNA, 18 nt, Artificial Sequence
  Description of Artificial Sequence: Synthetic oligonucleotide
aggguccuguccugccac

SEQ ID NO: 25222 - RNA, 18 nt, Artificial Sequence
  Description of Artificial Sequence: Synthetic oligonucleotide
cacacaggguccuguccu

SEQ ID NO: 25223 - RNA, 18 nt, Artificial Sequence
  Description of Artificial Sequence: Synthetic oligonucleotide
ucugucacacaggguccu

SEQ ID NO: 25224 - RNA, 18 nt, Artificial Sequence
  Description of Artificial Sequence: Synthetic oligonucleotide
uccgcucugucacacagg

SEQ ID NO: 25225 - RNA, 18 nt, Artificial Sequence
  Description of Artificial Sequence: Synthetic oligonucleotide
agaccuccgcucugucac

SEQ ID NO: 25226 - RNA, 18 nt, Artificial Sequence
  Description of Artificial Sequence: Synthetic oligonucleotide
gcacaagaccuccgcucu

SEQ ID NO: 25227 - RNA, 18 nt, Artificial Sequence
  Description of Artificial Sequence: Synthetic oligonucleotide
agagggcacaagaccucc

SEQ ID NO: 25228 - RNA, 18 nt, Artificial Sequence
  Description of Artificial Sequence: Synthetic oligonucleotide
agcugagagggcacaaga

SEQ ID NO: 25229 - RNA, 18 nt, Artificial Sequence
  Description of Artificial Sequence: Synthetic oligonucleotide
gaagaagcugagagggca

SEQ ID NO: 25230 - RNA, 18 nt, Artificial Sequence
  Description of Artificial Sequence: Synthetic oligonucleotide
uggcgcucugcaagguga

SEQ ID NO: 25231 - RNA, 18 nt, Artificial Sequence
  Description of Artificial Sequence: Synthetic oligonucleotide
ggacuuggcgcucugcaa

SEQ ID NO: 25232 - RNA, 18 nt, Artificial Sequence
  Description of Artificial Sequence: Synthetic oligonucleotide
acucgggacuuggcgcuc

SEQ ID NO: 25233 - RNA, 18 nt, Artificial Sequence
  Description of Artificial Sequence: Synthetic oligonucleotide
aggccacucgggacuugg

SEQ ID NO: 25234 - RNA, 18 nt, Artificial Sequence
  Description of Artificial Sequence: Synthetic oligonucleotide
aaagaaggccacucggga

SEQ ID NO: 25235 - RNA, 18 nt, Artificial Sequence
  Description of Artificial Sequence: Synthetic oligonucleotide
ucuucaaagaaggccacu

SEQ ID NO: 25236 - RNA, 18 nt, Artificial Sequence
  Description of Artificial Sequence: Synthetic oligonucleotide
agagcucuucaaagaagg

SEQ ID NO: 25237 - RNA, 18 nt, Artificial Sequence
  Description of Artificial Sequence: Synthetic oligonucleotide
cugcuagagcucuucaaa

SEQ ID NO: 25238 - RNA, 18 nt, Artificial Sequence
  Description of Artificial Sequence: Synthetic oligonucleotide
gucaccugcuagagcucu

SEQ ID NO: 25239 - RNA, 18 nt, Artificial Sequence
  Description of Artificial Sequence: Synthetic oligonucleotide
gcugggucaccugcuaga

SEQ ID NO: 25240 - RNA, 18 nt, Artificial Sequence
  Description of Artificial Sequence: Synthetic oligonucleotide
ggguggcugggucaccug

SEQ ID NO: 25241 - RNA, 18 nt, Artificial Sequence
  Description of Artificial Sequence: Synthetic oligonucleotide
aggagaaguggcaggucc

SEQ ID NO: 25242 - RNA, 18 nt, Artificial Sequence
  Description of Artificial Sequence: Synthetic oligonucleotide
guagcaggagaaguggca

SEQ ID NO: 25243 - RNA, 18 nt, Artificial Sequence
  Description of Artificial Sequence: Synthetic oligonucleotide
ucccgguagcaggagaag

SEQ ID NO: 25244 - RNA, 18 nt, Artificial Sequence
  Description of Artificial Sequence: Synthetic oligonucleotide
cgcggucccgguagcagg

SEQ ID NO: 25245 - RNA, 18 nt, Artificial Sequence
  Description of Artificial Sequence: Synthetic oligonucleotide
caucccgcggucccggua

SEQ ID NO: 25246 - RNA, 18 nt, Artificial Sequence
  Description of Artificial Sequence: Synthetic oligonucleotide
ugguccaucccgcggucc

SEQ ID NO: 25247 - RNA, 18 nt, Artificial Sequence
  Description of Artificial Sequence: Synthetic oligonucleotide
auaucugguccaucccgc

SEQ ID NO: 25248 - RNA, 18 nt, Artificial Sequence
  Description of Artificial Sequence: Synthetic oligonucleotide
ucuugauaucugguccau

SEQ ID NO: 25249 - RNA, 18 nt, Artificial Sequence
  Description of Artificial Sequence: Synthetic oligonucleotide
ggcucucuugauaucugg

SEQ ID NO: 25250 - RNA, 18 nt, Artificial Sequence
  Description of Artificial Sequence: Synthetic oligonucleotide
uggauggcucucuugaua

SEQ ID NO: 25251 - RNA, 18 nt, Artificial Sequence
  Description of Artificial Sequence: Synthetic oligonucleotide
cccuauggauggcucucu

SEQ ID NO: 25252 - RNA, 18 nt, Artificial Sequence
  Description of Artificial Sequence: Synthetic oligonucleotide
cagcucccuauggauggc

SEQ ID NO: 25253 - RNA, 18 nt, Artificial Sequence
  Description of Artificial Sequence: Synthetic oligonucleotide
ccagccagcucccuaugg

SEQ ID NO: 25254 - RNA, 18 nt, Artificial Sequence
  Description of Artificial Sequence: Synthetic oligonucleotide
aacccccagccagcuccc

SEQ ID NO: 25255 - RNA, 18 nt, Artificial Sequence
  Description of Artificial Sequence: Synthetic oligonucleotide
acggaaacccccagccag

SEQ ID NO: 25256 - RNA, 18 nt, Artificial Sequence
  Description of Artificial Sequence: Synthetic oligonucleotide
cucccacggaaaccccca

SEQ ID NO: 25257 - RNA, 18 nt, Artificial Sequence
  Description of Artificial Sequence: Synthetic oligonucleotide
uggagcucccacggaaac

SEQ ID NO: 25258 - RNA, 18 nt, Artificial Sequence
  Description of Artificial Sequence: Synthetic oligonucleotide
aguucuggagcucccacg

SEQ ID NO: 25259 - RNA, 18 nt, Artificial Sequence
  Description of Artificial Sequence: Synthetic oligonucleotide
gggaaaguucuggagcuc

SEQ ID NO: 25260 - RNA, 18 nt, Artificial Sequence
  Description of Artificial Sequence: Synthetic oligonucleotide
cugggcucuucacucagc

SEQ ID NO: 25261 - RNA, 18 nt, Artificial Sequence
  Description of Artificial Sequence: Synthetic oligonucleotide
gggcugggcucuucacuc

SEQ ID NO: 25262 - RNA, 18 nt, Artificial Sequence
  Description of Artificial Sequence: Synthetic oligonucleotide
caauugcacauaagaggg

SEQ ID NO: 25263 - RNA, 18 nt, Artificial Sequence
  Description of Artificial Sequence: Synthetic oligonucleotide
caaggcaauugcacauaa

SEQ ID NO: 25264 - RNA, 18 nt, Artificial Sequence
  Description of Artificial Sequence: Synthetic oligonucleotide
uaguucaaggcaauugca

SEQ ID NO: 25265 - RNA, 18 nt, Artificial Sequence
  Description of Artificial Sequence: Synthetic oligonucleotide
ggucguaguucaaggcaa

SEQ ID NO: 25266 - RNA, 18 nt, Artificial Sequence
  Description of Artificial Sequence: Synthetic oligonucleotide
uacagggucguaguucaa

SEQ ID NO: 25267 - RNA, 18 nt, Artificial Sequence
  Description of Artificial Sequence: Synthetic oligonucleotide
aucucuacagggucguag

SEQ ID NO: 25268 - RNA, 18 nt, Artificial Sequence
  Description of Artificial Sequence: Synthetic oligonucleotide
gagaaaucucuacagggu

SEQ ID NO: 25269 - RNA, 18 nt, Artificial Sequence
  Description of Artificial Sequence: Synthetic oligonucleotide
caugagagaaaucucuac

SEQ ID NO: 25270 - RNA, 18 nt, Artificial Sequence
  Description of Artificial Sequence: Synthetic oligonucleotide
aacgccaugagagaaauc

SEQ ID NO: 25271 - RNA, 18 nt, Artificial Sequence
  Description of Artificial Sequence: Synthetic oligonucleotide
acuagaacgccaugagag

SEQ ID NO: 25272 - RNA, 18 nt, Artificial Sequence
  Description of Artificial Sequence: Synthetic oligonucleotide
agagaacuagaacgccau

SEQ ID NO: 25273 - RNA, 18 nt, Artificial Sequence
  Description of Artificial Sequence: Synthetic oligonucleotide
aggucagagaacuagaac

SEQ ID NO: 25274 - RNA, 18 nt, Artificial Sequence
  Description of Artificial Sequence: Synthetic oligonucleotide
gacucaggucagagaacu

SEQ ID NO: 25275 - RNA, 18 nt, Artificial Sequence
  Description of Artificial Sequence: Synthetic oligonucleotide
acaaagacucaggucaga

SEQ ID NO: 25276 - RNA, 18 nt, Artificial Sequence
  Description of Artificial Sequence: Synthetic oligonucleotide
uuaaaacaaagacucagg

SEQ ID NO: 25277 - RNA, 18 nt, Artificial Sequence
  Description of Artificial Sequence: Synthetic oligonucleotide
acuucuuaaaacaaagac

SEQ ID NO: 25278 - RNA, 18 nt, Artificial Sequence
  Description of Artificial Sequence: Synthetic oligonucleotide
caaauacuucuuaaaaca

SEQ ID NO: 25279 - RNA, 18 nt, Artificial Sequence
  Description of Artificial Sequence: Synthetic oligonucleotide
gaagacaaauacuucuua

SEQ ID NO: 25280 - RNA, 18 nt, Artificial Sequence
  Description of Artificial Sequence: Synthetic oligonucleotide
caaaggaagacaaauacu

SEQ ID NO: 25281 - RNA, 18 nt, Artificial Sequence
  Description of Artificial Sequence: Synthetic oligonucleotide
uuagacaaaggaagacaa

SEQ ID NO: 25282 - RNA, 18 nt, Artificial Sequence
  Description of Artificial Sequence: Synthetic oligonucleotide
ccacauuagacaaaggaa

SEQ ID NO: 25283 - RNA, 18 nt, Artificial Sequence
  Description of Artificial Sequence: Synthetic oligonucleotide
gaaucccacauuagacaa

SEQ ID NO: 25284 - RNA, 18 nt, Artificial Sequence
  Description of Artificial Sequence: Synthetic oligonucleotide
gucaggaaucccacauua

SEQ ID NO: 25285 - RNA, 18 nt, Artificial Sequence
  Description of Artificial Sequence: Synthetic oligonucleotide
agggagucaggaauccca

SEQ ID NO: 25286 - RNA, 18 nt, Artificial Sequence
  Description of Artificial Sequence: Synthetic oligonucleotide
gacgaagggagucaggaa

SEQ ID NO: 25287 - RNA, 18 nt, Artificial Sequence
  Description of Artificial Sequence: Synthetic oligonucleotide
ccuuggacgaagggaguc

SEQ ID NO: 25288 - RNA, 18 nt, Artificial Sequence
  Description of Artificial Sequence: Synthetic oligonucleotide
cggugccuuggacgaagg

SEQ ID NO: 25289 - RNA, 18 nt, Artificial Sequence
  Description of Artificial Sequence: Synthetic oligonucleotide
cacaccggugccuuggac

SEQ ID NO: 25290 - RNA, 18 nt, Artificial Sequence
  Description of Artificial Sequence: Synthetic oligonucleotide
acacacacaccggugccu

SEQ ID NO: 25291 - RNA, 18 nt, Artificial Sequence
  Description of Artificial Sequence: Synthetic oligonucleotide
aagacacacacacaccgg

SEQ ID NO: 25292 - RNA, 18 nt, Artificial Sequence
  Description of Artificial Sequence: Synthetic oligonucleotide
agugcaagacacacacac

SEQ ID NO: 25293 - RNA, 18 nt, Artificial Sequence
  Description of Artificial Sequence: Synthetic oligonucleotide
ucuggagugcaagacaca

SEQ ID NO: 25294 - RNA, 18 nt, Artificial Sequence
  Description of Artificial Sequence: Synthetic oligonucleotide
ucagcucuggagugcaag

SEQ ID NO: 25295 - RNA, 18 nt, Artificial Sequence
  Description of Artificial Sequence: Synthetic oligonucleotide
ggaggucagcucuggagu

SEQ ID NO: 25296 - RNA, 18 nt, Artificial Sequence
  Description of Artificial Sequence: Synthetic oligonucleotide
gcgguggaggucagcucu

SEQ ID NO: 25297 - RNA, 18 nt, Artificial Sequence
  Description of Artificial Sequence: Synthetic oligonucleotide
gcugggcgguggagguca

SEQ ID NO: 25298 - RNA, 18 nt, Artificial Sequence
  Description of Artificial Sequence: Synthetic oligonucleotide
cccaggcugggcggugga

SEQ ID NO: 25299 - RNA, 18 nt, Artificial Sequence
  Description of Artificial Sequence: Synthetic oligonucleotide
gacuucccaggcugggcg

SEQ ID NO: 25300 - RNA, 18 nt, Artificial Sequence
  Description of Artificial Sequence: Synthetic oligonucleotide
acaaugacuucccaggcu

SEQ ID NO: 25301 - RNA, 18 nt, Artificial Sequence
  Description of Artificial Sequence: Synthetic oligonucleotide
ucccuacaaugacuuccc

SEQ ID NO: 25302 - RNA, 18 nt, Artificial Sequence
  Description of Artificial Sequence: Synthetic oligonucleotide
cucacucccuacaaugac

SEQ ID NO: 25303 - RNA, 18 nt, Artificial Sequence
  Description of Artificial Sequence: Synthetic oligonucleotide
agugucucacucccuaca

SEQ ID NO: 25304 - RNA, 18 nt, Artificial Sequence
  Description of Artificial Sequence: Synthetic oligonucleotide
gcuucagugucucacucc

SEQ ID NO: 25305 - RNA, 18 nt, Artificial Sequence
  Description of Artificial Sequence: Synthetic oligonucleotide
ucagggcuucagugucuc

SEQ ID NO: 25306 - RNA, 18 nt, Artificial Sequence
  Description of Artificial Sequence: Synthetic oligonucleotide
gcuucucagggcuucagu

SEQ ID NO: 25307 - RNA, 18 nt, Artificial Sequence
  Description of Artificial Sequence: Synthetic oligonucleotide
cacuggcuucucagggcu

SEQ ID NO: 25308 - RNA, 18 nt, Artificial Sequence
  Description of Artificial Sequence: Synthetic oligonucleotide
gauggcacuggcuucuca

SEQ ID NO: 25309 - RNA, 18 nt, Artificial Sequence
  Description of Artificial Sequence: Synthetic oligonucleotide
gggaugauggcacuggcu

SEQ ID NO: 25310 - RNA, 18 nt, Artificial Sequence
  Description of Artificial Sequence: Synthetic oligonucleotide
auguuccggaacccuggg

SEQ ID NO: 25311 - RNA, 18 nt, Artificial Sequence
  Description of Artificial Sequence: Synthetic oligonucleotide
aaugaauguuccggaacc

SEQ ID NO: 25312 - RNA, 18 nt, Artificial Sequence
  Description of Artificial Sequence: Synthetic oligonucleotide
gggaaugaauguuccgga

SEQ ID NO: 25313 - RNA, 18 nt, Artificial Sequence
  Description of Artificial Sequence: Synthetic oligonucleotide
cagguccucaccgguggg

SEQ ID NO: 25314 - RNA, 18 nt, Artificial Sequence
  Description of Artificial Sequence: Synthetic oligonucleotide
caugccagguccucaccg

SEQ ID NO: 25315 - RNA, 18 nt, Artificial Sequence
  Description of Artificial Sequence: Synthetic oligonucleotide
cgcugcaugccagguccu

SEQ ID NO: 25316 - RNA, 18 nt, Artificial Sequence
  Description of Artificial Sequence: Synthetic oligonucleotide
ugcuucgcugcaugccag

SEQ ID NO: 25317 - RNA, 18 nt, Artificial Sequence
  Description of Artificial Sequence: Synthetic oligonucleotide
ugggcugcuucgcugcau

SEQ ID NO: 25318 - RNA, 18 nt, Artificial Sequence
  Description of Artificial Sequence: Synthetic oligonucleotide
cgggcugggcugcuucgc

SEQ ID NO: 25319 - RNA, 18 nt, Artificial Sequence
  Description of Artificial Sequence: Synthetic oligonucleotide
uccgccgggcugggcugc

SEQ ID NO: 25320 - RNA, 18 nt, Artificial Sequence
  Description of Artificial Sequence: Synthetic oligonucleotide
ugggauccgccgggcugg

SEQ ID NO: 25321 - RNA, 18 nt, Artificial Sequence
  Description of Artificial Sequence: Synthetic oligonucleotide
uggccugggauccgccgg

SEQ ID NO: 25322 - RNA, 18 nt, Artificial Sequence
  Description of Artificial Sequence: Synthetic oligonucleotide
cgugcuggccugggaucc

SEQ ID NO: 25323 - RNA, 18 nt, Artificial Sequence
  Description of Artificial Sequence: Synthetic oligonucleotide
gcaggcgugcuggccugg

SEQ ID NO: 25324 - RNA, 18 nt, Artificial Sequence
  Description of Artificial Sequence: Synthetic oligonucleotide
agccggcaggcgugcugg

SEQ ID NO: 25325 - RNA, 18 nt, Artificial Sequence
  Description of Artificial Sequence: Synthetic oligonucleotide
ugagaagccggcaggcgu

SEQ ID NO: 25326 - RNA, 18 nt, Artificial Sequence
  Description of Artificial Sequence: Synthetic oligonucleotide
gacgaugagaagccggca

SEQ ID NO: 25327 - RNA, 18 nt, Artificial Sequence
  Description of Artificial Sequence: Synthetic oligonucleotide
ucccugacgaugagaagc

SEQ ID NO: 25328 - RNA, 18 nt, Artificial Sequence
  Description of Artificial Sequence: Synthetic oligonucleotide
cgggcucccugacgauga

SEQ ID NO: 25329 - RNA, 18 nt, Artificial Sequence
  Description of Artificial Sequence: Synthetic oligonucleotide
cugggcgggcucccugac

SEQ ID NO: 25330 - RNA, 18 nt, Artificial Sequence
  Description of Artificial Sequence: Synthetic oligonucleotide
gagcucugggcgggcucc

SEQ ID NO: 25331 - RNA, 18 nt, Artificial Sequence
  Description of Artificial Sequence: Synthetic oligonucleotide
gucacgagcucugggcgg

SEQ ID NO: 25332 - RNA, 18 nt, Artificial Sequence
  Description of Artificial Sequence: Synthetic oligonucleotide
ugcucgucacgagcucug

SEQ ID NO: 25333 - RNA, 18 nt, Artificial Sequence
  Description of Artificial Sequence: Synthetic oligonucleotide
gcacuugcucgucacgag

SEQ ID NO: 25334 - RNA, 18 nt, Artificial Sequence
  Description of Artificial Sequence: Synthetic oligonucleotide
acccagcacuugcucguc

SEQ ID NO: 25335 - RNA, 18 nt, Artificial Sequence
  Description of Artificial Sequence: Synthetic oligonucleotide
gggacccagcacuugcuc

SEQ ID NO: 25336 - RNA, 18 nt, Artificial Sequence
  Description of Artificial Sequence: Synthetic oligonucleotide
ccagagcgccgccucggg

SEQ ID NO: 25337 - RNA, 18 nt, Artificial Sequence
  Description of Artificial Sequence: Synthetic oligonucleotide
gccagccagagcgccgcc

SEQ ID NO: 25338 - RNA, 18 nt, Artificial Sequence
  Description of Artificial Sequence: Synthetic oligonucleotide
cagcugccagccagagcg

SEQ ID NO: 25339 - RNA, 18 nt, Artificial Sequence
  Description of Artificial Sequence: Synthetic oligonucleotide
cccaccagcugccagcca

SEQ ID NO: 25340 - RNA, 18 nt, Artificial Sequence
  Description of Artificial Sequence: Synthetic oligonucleotide
uauuccccaccagcugcc

SEQ ID NO: 25341 - RNA, 18 nt, Artificial Sequence
  Description of Artificial Sequence: Synthetic oligonucleotide
cugccuauuccccaccag

SEQ ID NO: 25342 - RNA, 18 nt, Artificial Sequence
  Description of Artificial Sequence: Synthetic oligonucleotide
cugcccugccuauucccc

SEQ ID NO: 25343 - RNA, 18 nt, Artificial Sequence
  Description of Artificial Sequence: Synthetic oligonucleotide
cacagcugcccugccuau

SEQ ID NO: 25344 - RNA, 18 nt, Artificial Sequence
  Description of Artificial Sequence: Synthetic oligonucleotide
ccagccacagcugcccug

SEQ ID NO: 25345 - RNA, 18 nt, Artificial Sequence
  Description of Artificial Sequence: Synthetic oligonucleotide
ucuccccagccacagcug

SEQ ID NO: 25346 - RNA, 18 nt, Artificial Sequence
  Description of Artificial Sequence: Synthetic oligonucleotide
aagucucuccccagccac

SEQ ID NO: 25347 - RNA, 18 nt, Artificial Sequence
  Description of Artificial Sequence: Synthetic oligonucleotide
gccuaaagucucucccca

SEQ ID NO: 25348 - RNA, 18 nt, Artificial Sequence
  Description of Artificial Sequence: Synthetic oligonucleotide
cuucugccuaaagucucu

SEQ ID NO: 25349 - RNA, 18 nt, Artificial Sequence
  Description of Artificial Sequence: Synthetic oligonucleotide
cacagcuucugccuaaag

SEQ ID NO: 25350 - RNA, 18 nt, Artificial Sequence
  Description of Artificial Sequence: Synthetic oligonucleotide
ugcaucacagcuucugcc

SEQ ID NO: 25351 - RNA, 18 nt, Artificial Sequence
  Description of Artificial Sequence: Synthetic oligonucleotide
cagccugcaucacagcuu

SEQ ID NO: 25352 - RNA, 18 nt, Artificial Sequence
  Description of Artificial Sequence: Synthetic oligonucleotide
gcagucagccugcaucac

SEQ ID NO: 25353 - RNA, 18 nt, Artificial Sequence
  Description of Artificial Sequence: Synthetic oligonucleotide
ggcuggcagucagccugc

SEQ ID NO: 25354 - RNA, 18 nt, Artificial Sequence
  Description of Artificial Sequence: Synthetic oligonucleotide
cccucggcuggcagucag

SEQ ID NO: 25355 - RNA, 18 nt, Artificial Sequence
  Description of Artificial Sequence: Synthetic oligonucleotide
ccagccccucggcuggca

SEQ ID NO: 25356 - RNA, 18 nt, Artificial Sequence
  Description of Artificial Sequence: Synthetic oligonucleotide
acuacccagccccucggc

SEQ ID NO: 25357 - RNA, 18 nt, Artificial Sequence
  Description of Artificial Sequence: Synthetic oligonucleotide
acggcacuacccagcccc

SEQ ID NO: 25358 - RNA, 18 nt, Artificial Sequence
  Description of Artificial Sequence: Synthetic oligonucleotide
cccgcacggcacuaccca

SEQ ID NO: 25359 - RNA, 18 nt, Artificial Sequence
  Description of Artificial Sequence: Synthetic oligonucleotide
cagcucccgcacggcacu

SEQ ID NO: 25360 - RNA, 18 nt, Artificial Sequence
  Description of Artificial Sequence: Synthetic oligonucleotide
accaucagcucccgcacg

SEQ ID NO: 25361 - RNA, 18 nt, Artificial Sequence
  Description of Artificial Sequence: Synthetic oligonucleotide
ccuguaccaucagcuccc

SEQ ID NO: 25362 - RNA, 18 nt, Artificial Sequence
  Description of Artificial Sequence: Synthetic oligonucleotide
agugcccuguaccaucag

SEQ ID NO: 25363 - RNA, 18 nt, Artificial Sequence
  Description of Artificial Sequence: Synthetic oligonucleotide
cagcgagugcccuguacc

SEQ ID NO: 25364 - RNA, 18 nt, Artificial Sequence
  Description of Artificial Sequence: Synthetic oligonucleotide
gggacagcgagugcccug

SEQ ID NO: 25365 - RNA, 18 nt, Artificial Sequence
  Description of Artificial Sequence: Synthetic oligonucleotide
ucuaggguggccggaggg

SEQ ID NO: 25366 - RNA, 18 nt, Artificial Sequence
  Description of Artificial Sequence: Synthetic oligonucleotide
ccuggucuaggguggccg

SEQ ID NO: 25367 - RNA, 18 nt, Artificial Sequence
  Description of Artificial Sequence: Synthetic oligonucleotide
cggacccuggucuagggu

SEQ ID NO: 25368 - RNA, 18 nt, Artificial Sequence
  Description of Artificial Sequence: Synthetic oligonucleotide
ccucucggacccuggucu

SEQ ID NO: 25369 - RNA, 18 nt, Artificial Sequence
  Description of Artificial Sequence: Synthetic oligonucleotide
gccugccucucggacccu

SEQ ID NO: 25370 - RNA, 18 nt, Artificial Sequence
  Description of Artificial Sequence: Synthetic oligonucleotide
cuccugccugccucucgg

SEQ ID NO: 25371 - RNA, 18 nt, Artificial Sequence
  Description of Artificial Sequence: Synthetic oligonucleotide
aguggcuccugccugccu

SEQ ID NO: 25372 - RNA, 18 nt, Artificial Sequence
  Description of Artificial Sequence: Synthetic oligonucleotide
acaugaguggcuccugcc

SEQ ID NO: 25373 - RNA, 18 nt, Artificial Sequence
  Description of Artificial Sequence: Synthetic oligonucleotide
ggaagacaugaguggcuc

SEQ ID NO: 25374 - RNA, 18 nt, Artificial Sequence
  Description of Artificial Sequence: Synthetic oligonucleotide
gggaagacaugaguggcu

SEQ ID NO: 25375 - RNA, 18 nt, Artificial Sequence
  Description of Artificial Sequence: Synthetic oligonucleotide
ugggcgucgggcaauggg

SEQ ID NO: 25376 - RNA, 18 nt, Artificial Sequence
  Description of Artificial Sequence: Synthetic oligonucleotide
gucuaugggcgucgggca

SEQ ID NO: 25377 - RNA, 18 nt, Artificial Sequence
  Description of Artificial Sequence: Synthetic oligonucleotide
ggagcgucuaugggcguc

SEQ ID NO: 25378 - RNA, 18 nt, Artificial Sequence
  Description of Artificial Sequence: Synthetic oligonucleotide
aggaaggagcgucuaugg

SEQ ID NO: 25379 - RNA, 18 nt, Artificial Sequence
  Description of Artificial Sequence: Synthetic oligonucleotide
cacacaggaaggagcguc

SEQ ID NO: 25380 - RNA, 18 nt, Artificial Sequence
  Description of Artificial Sequence: Synthetic oligonucleotide
agccccacacaggaagga

SEQ ID NO: 25381 - RNA, 18 nt, Artificial Sequence
  Description of Artificial Sequence: Synthetic oligonucleotide
accccagccccacacagg

SEQ ID NO: 25382 - RNA, 18 nt, Artificial Sequence
  Description of Artificial Sequence: Synthetic oligonucleotide
ggaguaccccagccccac

SEQ ID NO: 25383 - RNA, 18 nt, Artificial Sequence
  Description of Artificial Sequence: Synthetic oligonucleotide
accagggaguaccccagc

SEQ ID NO: 25384 - RNA, 18 nt, Artificial Sequence
  Description of Artificial Sequence: Synthetic oligonucleotide
guacgaccagggaguacc

SEQ ID NO: 25385 - RNA, 18 nt, Artificial Sequence
  Description of Artificial Sequence: Synthetic oligonucleotide
cugcaguacgaccaggga

SEQ ID NO: 25386 - RNA, 18 nt, Artificial Sequence
  Description of Artificial Sequence: Synthetic oligonucleotide
gcugacugcaguacgacc

SEQ ID NO: 25387 - RNA, 18 nt, Artificial Sequence
  Description of Artificial Sequence: Synthetic oligonucleotide
cgggugcugacugcagua

SEQ ID NO: 25388 - RNA, 18 nt, Artificial Sequence
  Description of Artificial Sequence: Synthetic oligonucleotide
gguuacgggugcugacug

SEQ ID NO: 25389 - RNA, 18 nt, Artificial Sequence
  Description of Artificial Sequence: Synthetic oligonucleotide
agccggguuacgggugcu

SEQ ID NO: 25390 - RNA, 18 nt, Artificial Sequence
  Description of Artificial Sequence: Synthetic oligonucleotide
gucauagccggguuacgg

SEQ ID NO: 25391 - RNA, 18 nt, Artificial Sequence
  Description of Artificial Sequence: Synthetic oligonucleotide
cccuggucauagccgggu

SEQ ID NO: 25392 - RNA, 18 nt, Artificial Sequence
  Description of Artificial Sequence: Synthetic oligonucleotide
cagaucccuggucauagc

SEQ ID NO: 25393 - RNA, 18 nt, Artificial Sequence
  Description of Artificial Sequence: Synthetic oligonucleotide
gcuuacagaucccugguc

SEQ ID NO: 25394 - RNA, 18 nt, Artificial Sequence
  Description of Artificial Sequence: Synthetic oligonucleotide
acagggcuuacagauccc

SEQ ID NO: 25395 - RNA, 18 nt, Artificial Sequence
  Description of Artificial Sequence: Synthetic oligonucleotide
gagccacagggcuuacag

SEQ ID NO: 25396 - RNA, 18 nt, Artificial Sequence
  Description of Artificial Sequence: Synthetic oligonucleotide
cuguggagccacagggcu

SEQ ID NO: 25397 - RNA, 18 nt, Artificial Sequence
  Description of Artificial Sequence: Synthetic oligonucleotide
agcaccuguggagccaca

SEQ ID NO: 25398 - RNA, 18 nt, Artificial Sequence
  Description of Artificial Sequence: Synthetic oligonucleotide
gaagcagcaccuguggag

SEQ ID NO: 25399 - RNA, 18 nt, Artificial Sequence
  Description of Artificial Sequence: Synthetic oligonucleotide
agugagaagcagcaccug

SEQ ID NO: 25400 - RNA, 18 nt, Artificial Sequence
  Description of Artificial Sequence: Synthetic oligonucleotide
gggccagugagaagcagc

SEQ ID NO: 25401 - RNA, 18 nt, Artificial Sequence
  Description of Artificial Sequence: Synthetic oligonucleotide
agucugggccagugagaa

SEQ ID NO: 25402 - RNA, 18 nt, Artificial Sequence
  Description of Artificial Sequence: Synthetic oligonucleotide
cucagagucugggccagu

SEQ ID NO: 25403 - RNA, 18 nt, Artificial Sequence
  Description of Artificial Sequence: Synthetic oligonucleotide
uggagcucagagucuggg

SEQ ID NO: 25404 - RNA, 18 nt, Artificial Sequence
  Description of Artificial Sequence: Synthetic oligonucleotide
gccgguggagcucagagu

SEQ ID NO: 25405 - RNA, 18 nt, Artificial Sequence
  Description of Artificial Sequence: Synthetic oligonucleotide
acugggccgguggagcuc

SEQ ID NO: 25406 - RNA, 18 nt, Artificial Sequence
  Description of Artificial Sequence: Synthetic oligonucleotide
ugcagacugggccggugg

SEQ ID NO: 25407 - RNA, 18 nt, Artificial Sequence
  Description of Artificial Sequence: Synthetic oligonucleotide
ggccgugcagacugggcc

SEQ ID NO: 25408 - RNA, 18 nt, Artificial Sequence
  Description of Artificial Sequence: Synthetic oligonucleotide
agaugggccgugcagacu

SEQ ID NO: 25409 - RNA, 18 nt, Artificial Sequence
  Description of Artificial Sequence: Synthetic oligonucleotide
gaagcagaugggccgugc

SEQ ID NO: 25410 - RNA, 18 nt, Artificial Sequence
  Description of Artificial Sequence: Synthetic oligonucleotide
aaggugaagcagaugggc

SEQ ID NO: 25411 - RNA, 18 nt, Artificial Sequence
  Description of Artificial Sequence: Synthetic oligonucleotide
gagggaaggugaagcaga

SEQ ID NO: 25412 - RNA, 18 nt, Artificial Sequence
  Description of Artificial Sequence: Synthetic oligonucleotide
gcugggagggaaggugaa

SEQ ID NO: 25413 - RNA, 18 nt, Artificial Sequence
  Description of Artificial Sequence: Synthetic oligonucleotide
acguggcugggagggaag

SEQ ID NO: 25414 - RNA, 18 nt, Artificial Sequence
  Description of Artificial Sequence: Synthetic oligonucleotide
cuggcacguggcugggag

SEQ ID NO: 25415 - RNA, 18 nt, Artificial Sequence
  Description of Artificial Sequence: Synthetic oligonucleotide
ggccacuggcacguggcu

SEQ ID NO: 25416 - RNA, 18 nt, Artificial Sequence
  Description of Artificial Sequence: Synthetic oligonucleotide
gcuguggccacuggcacg

SEQ ID NO: 25417 - RNA, 18 nt, Artificial Sequence
  Description of Artificial Sequence: Synthetic oligonucleotide
agugggcuguggccacug

SEQ ID NO: 25418 - RNA, 18 nt, Artificial Sequence
  Description of Artificial Sequence: Synthetic oligonucleotide
ugggaagugggcuguggc

SEQ ID NO: 25419 - RNA, 18 nt, Artificial Sequence
  Description of Artificial Sequence: Synthetic oligonucleotide
uggguugggaagugggcu

SEQ ID NO: 25420 - RNA, 18 nt, Artificial Sequence
  Description of Artificial Sequence: Synthetic oligonucleotide
aacaguggguugggaagu

SEQ ID NO: 25421 - RNA, 18 nt, Artificial Sequence
  Description of Artificial Sequence: Synthetic oligonucleotide
gguacaacaguggguugg

SEQ ID NO: 25422 - RNA, 18 nt, Artificial Sequence
  Description of Artificial Sequence: Synthetic oligonucleotide
gccuggguacaacagugg

SEQ ID NO: 25423 - RNA, 18 nt, Artificial Sequence
  Description of Artificial Sequence: Synthetic oligonucleotide
gugaggccuggguacaac

SEQ ID NO: 25424 - RNA, 18 nt, Artificial Sequence
  Description of Artificial Sequence: Synthetic oligonucleotide
gcaaagugaggccugggu

SEQ ID NO: 25425 - RNA, 18 nt, Artificial Sequence
  Description of Artificial Sequence: Synthetic oligonucleotide
caacagcaaagugaggcc

SEQ ID NO: 25426 - RNA, 18 nt, Artificial Sequence
  Description of Artificial Sequence: Synthetic oligonucleotide
aagggcaacagcaaagug

SEQ ID NO: 25427 - RNA, 18 nt, Artificial Sequence
  Description of Artificial Sequence: Synthetic oligonucleotide
gggacaagggcaacagca

SEQ ID NO: 25428 - RNA, 18 nt, Artificial Sequence
  Description of Artificial Sequence: Synthetic oligonucleotide
gaagagggacaagggcaa

SEQ ID NO: 25429 - RNA, 18 nt, Artificial Sequence
  Description of Artificial Sequence: Synthetic oligonucleotide
ggcccgaagagggacaag

SEQ ID NO: 25430 - RNA, 18 nt, Artificial Sequence
  Description of Artificial Sequence: Synthetic oligonucleotide
uucagggcccgaagaggg

SEQ ID NO: 25431 - RNA, 18 nt, Artificial Sequence
  Description of Artificial Sequence: Synthetic oligonucleotide
gaaaauucagggcccgaa

SEQ ID NO: 25432 - RNA, 18 nt, Artificial Sequence
  Description of Artificial Sequence: Synthetic oligonucleotide
gaacagaaaauucagggc

SEQ ID NO: 25433 - RNA, 18 nt, Artificial Sequence
  Description of Artificial Sequence: Synthetic oligonucleotide
ccagggaacagaaaauuc

SEQ ID NO: 25434 - RNA, 18 nt, Artificial Sequence
  Description of Artificial Sequence: Synthetic oligonucleotide
ggcccccagggaacagaa

SEQ ID NO: 25435 - RNA, 18 nt, Artificial Sequence
  Description of Artificial Sequence: Synthetic oligonucleotide
uggcuggcccccagggaa

SEQ ID NO: 25436 - RNA, 18 nt, Artificial Sequence
  Description of Artificial Sequence: Synthetic oligonucleotide
ggcccuggcuggccccca

SEQ ID NO: 25437 - RNA, 18 nt, Artificial Sequence
  Description of Artificial Sequence: Synthetic oligonucleotide
caaagggcccuggcuggc

SEQ ID NO: 25438 - RNA, 18 nt, Artificial Sequence
  Description of Artificial Sequence: Synthetic oligonucleotide
gggcacaaagggcccugg

SEQ ID NO: 25439 - RNA, 18 nt, Artificial Sequence
  Description of Artificial Sequence: Synthetic oligonucleotide
caucaggccugugcuggg

SEQ ID NO: 25440 - RNA, 18 nt, Artificial Sequence
  Description of Artificial Sequence: Synthetic oligonucleotide
accugcaucaggccugug

SEQ ID NO: 25441 - RNA, 18 nt, Artificial Sequence
  Description of Artificial Sequence: Synthetic oligonucleotide
uggacaccugcaucaggc

SEQ ID NO: 25442 - RNA, 18 nt, Artificial Sequence
  Description of Artificial Sequence: Synthetic oligonucleotide
gugaguggacaccugcau

SEQ ID NO: 25443 - RNA, 18 nt, Artificial Sequence
  Description of Artificial Sequence: Synthetic oligonucleotide
caccugugaguggacacc

SEQ ID NO: 25444 - RNA, 18 nt, Artificial Sequence
  Description of Artificial Sequence: Synthetic oligonucleotide
agcgccaccugugagugg

SEQ ID NO: 25445 - RNA, 18 nt, Artificial Sequence
  Description of Artificial Sequence: Synthetic oligonucleotide
aggugagcgccaccugug

SEQ ID NO: 25446 - RNA, 18 nt, Artificial Sequence
  Description of Artificial Sequence: Synthetic oligonucleotide
agccuaggugagcgccac

SEQ ID NO: 25447 - RNA, 18 nt, Artificial Sequence
  Description of Artificial Sequence: Synthetic oligonucleotide
gugacagccuaggugagc

SEQ ID NO: 25448 - RNA, 18 nt, Artificial Sequence
  Description of Artificial Sequence: Synthetic oligonucleotide
guccugugacagccuagg

SEQ ID NO: 25449 - RNA, 18 nt, Artificial Sequence
  Description of Artificial Sequence: Synthetic oligonucleotide
gguggguccugugacagc

SEQ ID NO: 25450 - RNA, 18 nt, Artificial Sequence
  Description of Artificial Sequence: Synthetic oligonucleotide
auggagguggguccugug

SEQ ID NO: 25451 - RNA, 18 nt, Artificial Sequence
  Description of Artificial Sequence: Synthetic oligonucleotide
cuggcauggagguggguc

SEQ ID NO: 25452 - RNA, 18 nt, Artificial Sequence
  Description of Artificial Sequence: Synthetic oligonucleotide
guugccuggcauggaggu

SEQ ID NO: 25453 - RNA, 18 nt, Artificial Sequence
  Description of Artificial Sequence: Synthetic oligonucleotide
ccucuguugccuggcaug

SEQ ID NO: 25454 - RNA, 18 nt, Artificial Sequence
  Description of Artificial Sequence: Synthetic oligonucleotide
guggcccucuguugccug

SEQ ID NO: 25455 - RNA, 18 nt, Artificial Sequence
  Description of Artificial Sequence: Synthetic oligonucleotide
guucuguggcccucuguu

SEQ ID NO: 25456 - RNA, 18 nt, Artificial Sequence
  Description of Artificial Sequence: Synthetic oligonucleotide
gggugguucuguggcccu

SEQ ID NO: 25457 - RNA, 18 nt, Artificial Sequence
  Description of Artificial Sequence: Synthetic oligonucleotide
gaccaaggagugagccgu

SEQ ID NO: 25458 - RNA, 18 nt, Artificial Sequence
  Description of Artificial Sequence: Synthetic oligonucleotide
ccccagaccaaggaguga

SEQ ID NO: 25459 - RNA, 18 nt, Artificial Sequence
  Description of Artificial Sequence: Synthetic oligonucleotide
gguggccccagaccaagg

SEQ ID NO: 25460 - RNA, 18 nt, Artificial Sequence
  Description of Artificial Sequence: Synthetic oligonucleotide
aagaagguggccccagac

SEQ ID NO: 25461 - RNA, 18 nt, Artificial Sequence
  Description of Artificial Sequence: Synthetic oligonucleotide
agggcaagaagguggccc

SEQ ID NO: 25462 - RNA, 18 nt, Artificial Sequence
  Description of Artificial Sequence: Synthetic oligonucleotide
aagaaagggcaagaaggu

SEQ ID NO: 25463 - RNA, 18 nt, Artificial Sequence
  Description of Artificial Sequence: Synthetic oligonucleotide
aaaaaaagaaagggcaag

SEQ ID NO: 25464 - RNA, 18 nt, Artificial Sequence
  Description of Artificial Sequence: Synthetic oligonucleotide
aaaaaaaaaaaagaaagg

SEQ ID NO: 25465 - RNA, 18 nt, Artificial Sequence
  Description of Artificial Sequence: Synthetic oligonucleotide
aaaaaaaaaaaaaaaaag

SEQ ID NO: 25466 - RNA, 18 nt, Artificial Sequence
  Description of Artificial Sequence: Synthetic oligonucleotide
aaaaaaaaaaaaaaaaaa

SEQ ID NO: 25467 - RNA, 18 nt, Artificial Sequence
  Description of Artificial Sequence: Synthetic oligonucleotide
ucggaaaaaaaaaaaaaa

SEQ ID NO: 25468 - RNA, 18 nt, Artificial Sequence
  Description of Artificial Sequence: Synthetic oligonucleotide
ccaucucggaaaaaaaaa

SEQ ID NO: 25469 - RNA, 18 nt, Artificial Sequence
  Description of Artificial Sequence: Synthetic oligonucleotide
agacuccaucucggaaaa

SEQ ID NO: 25470 - RNA, 18 nt, Artificial Sequence
  Description of Artificial Sequence: Synthetic oligonucleotide
gagagagacuccaucucg

SEQ ID NO: 25471 - RNA, 18 nt, Artificial Sequence
  Description of Artificial Sequence: Synthetic oligonucleotide
ugacagagagagacucca

SEQ ID NO: 25472 - RNA, 18 nt, Artificial Sequence
  Description of Artificial Sequence: Synthetic oligonucleotide
cugggugacagagagaga

SEQ ID NO: 25473 - RNA, 18 nt, Artificial Sequence
  Description of Artificial Sequence: Synthetic oligonucleotide
cccaccugggugacagag

SEQ ID NO: 25474 - RNA, 18 nt, Artificial Sequence
  Description of Artificial Sequence: Synthetic oligonucleotide
acacucccaccuggguga

SEQ ID NO: 25475 - RNA, 18 nt, Artificial Sequence
  Description of Artificial Sequence: Synthetic oligonucleotide
ccaccacacucccaccug

SEQ ID NO: 25476 - RNA, 18 nt, Artificial Sequence
  Description of Artificial Sequence: Synthetic oligonucleotide
uugugccaccacacuccc

SEQ ID NO: 25477 - RNA, 18 nt, Artificial Sequence
  Description of Artificial Sequence: Synthetic oligonucleotide
cgagauugugccaccaca

SEQ ID NO: 25478 - RNA, 18 nt, Artificial Sequence
  Description of Artificial Sequence: Synthetic oligonucleotide
ugagccgagauugugcca

SEQ ID NO: 25479 - RNA, 18 nt, Artificial Sequence
  Description of Artificial Sequence: Synthetic oligonucleotide
ugcagugagccgagauug

SEQ ID NO: 25480 - RNA, 18 nt, Artificial Sequence
  Description of Artificial Sequence: Synthetic oligonucleotide
gagguugcagugagccga

SEQ ID NO: 25481 - RNA, 18 nt, Artificial Sequence
  Description of Artificial Sequence: Synthetic oligonucleotide
agguggagguugcaguga

SEQ ID NO: 25482 - RNA, 18 nt, Artificial Sequence
  Description of Artificial Sequence: Synthetic oligonucleotide
ucaggagguggagguugc

SEQ ID NO: 25483 - RNA, 18 nt, Artificial Sequence
  Description of Artificial Sequence: Synthetic oligonucleotide
ugaacucaggagguggag

SEQ ID NO: 25484 - RNA, 18 nt, Artificial Sequence
  Description of Artificial Sequence: Synthetic oligonucleotide
uugcuugaacucaggagg

SEQ ID NO: 25485 - RNA, 18 nt, Artificial Sequence
  Description of Artificial Sequence: Synthetic oligonucleotide
gagaauugcuugaacuca

SEQ ID NO: 25486 - RNA, 18 nt, Artificial Sequence
  Description of Artificial Sequence: Synthetic oligonucleotide
ggcaggagaauugcuuga

SEQ ID NO: 25487 - RNA, 18 nt, Artificial Sequence
  Description of Artificial Sequence: Synthetic oligonucleotide
gcugaggcaggagaauug

SEQ ID NO: 25488 - RNA, 18 nt, Artificial Sequence
  Description of Artificial Sequence: Synthetic oligonucleotide
gggaggcugaggcaggag

SEQ ID NO: 25489 - RNA, 18 nt, Artificial Sequence
  Description of Artificial Sequence: Synthetic oligonucleotide
uacuugggaggcugaggc

SEQ ID NO: 25490 - RNA, 18 nt, Artificial Sequence
  Description of Artificial Sequence: Synthetic oligonucleotide
ccagcuacuugggaggcu

SEQ ID NO: 25491 - RNA, 18 nt, Artificial Sequence
  Description of Artificial Sequence: Synthetic oligonucleotide
uagucccagcuacuuggg

SEQ ID NO: 25492 - RNA, 18 nt, Artificial Sequence
  Description of Artificial Sequence: Synthetic oligonucleotide
gccuguagucccagcuac

SEQ ID NO: 25493 - RNA, 18 nt, Artificial Sequence
  Description of Artificial Sequence: Synthetic oligonucleotide
ugcaugccuguaguccca

SEQ ID NO: 25494 - RNA, 18 nt, Artificial Sequence
  Description of Artificial Sequence: Synthetic oligonucleotide
gguggugcaugccuguag

SEQ ID NO: 25495 - RNA, 18 nt, Artificial Sequence
  Description of Artificial Sequence: Synthetic oligonucleotide
agugugguggugcaugcc

SEQ ID NO: 25496 - RNA, 18 nt, Artificial Sequence
  Description of Artificial Sequence: Synthetic oligonucleotide
ggccaagugugguggugc

SEQ ID NO: 25497 - RNA, 18 nt, Artificial Sequence
  Description of Artificial Sequence: Synthetic oligonucleotide
acauuggccaaguguggu

SEQ ID NO: 25498 - RNA, 18 nt, Artificial Sequence
  Description of Artificial Sequence: Synthetic oligonucleotide
acagaacauuggccaagu

SEQ ID NO: 25499 - RNA, 18 nt, Artificial Sequence
  Description of Artificial Sequence: Synthetic oligonucleotide
aaaauacagaacauuggc

SEQ ID NO: 25500 - RNA, 18 nt, Artificial Sequence
  Description of Artificial Sequence: Synthetic oligonucleotide
uauuaaaaauacagaaca

SEQ ID NO: 25501 - RNA, 18 nt, Artificial Sequence
  Description of Artificial Sequence: Synthetic oligonucleotide
gucccuauuaaaaauaca

SEQ ID NO: 25502 - RNA, 18 nt, Artificial Sequence
  Description of Artificial Sequence: Synthetic oligonucleotide
accccgucccuauuaaaa

SEQ ID NO: 25503 - RNA, 18 nt, Artificial Sequence
  Description of Artificial Sequence: Synthetic oligonucleotide
gcaaaaccccgucccuau

SEQ ID NO: 25504 - RNA, 18 nt, Artificial Sequence
  Description of Artificial Sequence: Synthetic oligonucleotide
acauggcaaaaccccguc

SEQ ID NO: 25505 - RNA, 18 nt, Artificial Sequence
  Description of Artificial Sequence: Synthetic oligonucleotide
agcuaacauggcaaaacc

SEQ ID NO: 25506 - RNA, 18 nt, Artificial Sequence
  Description of Artificial Sequence: Synthetic oligonucleotide
agccuagcuaacauggca

SEQ ID NO: 25507 - RNA, 18 nt, Artificial Sequence
  Description of Artificial Sequence: Synthetic oligonucleotide
agaccagccuagcuaaca

SEQ ID NO: 25508 - RNA, 18 nt, Artificial Sequence
  Description of Artificial Sequence: Synthetic oligonucleotide
guuugagaccagccuagc

SEQ ID NO: 25509 - RNA, 18 nt, Artificial Sequence
  Description of Artificial Sequence: Synthetic oligonucleotide
ugugaguuugagaccagc

SEQ ID NO: 25510 - RNA, 18 nt, Artificial Sequence
  Description of Artificial Sequence: Synthetic oligonucleotide
ccaggugugaguuugaga

SEQ ID NO: 25511 - RNA, 18 nt, Artificial Sequence
  Description of Artificial Sequence: Synthetic oligonucleotide
uaaucccaggugugaguu

SEQ ID NO: 25512 - RNA, 18 nt, Artificial Sequence
  Description of Artificial Sequence: Synthetic oligonucleotide
gccuguaaucccaggugu

SEQ ID NO: 25513 - RNA, 18 nt, Artificial Sequence
  Description of Artificial Sequence: Synthetic oligonucleotide
cucaugccuguaauccca

SEQ ID NO: 25514 - RNA, 18 nt, Artificial Sequence
  Description of Artificial Sequence: Synthetic oligonucleotide
aguggcucaugccuguaa

SEQ ID NO: 25515 - RNA, 18 nt, Artificial Sequence
  Description of Artificial Sequence: Synthetic oligonucleotide
ggugcaguggcucaugcc

SEQ ID NO: 25516 - RNA, 18 nt, Artificial Sequence
  Description of Artificial Sequence: Synthetic oligonucleotide
ggcugggugcaguggcuc

SEQ ID NO: 25517 - RNA, 18 nt, Artificial Sequence
  Description of Artificial Sequence: Synthetic oligonucleotide
gggcugggugcaguggcu

SEQ ID NO: 25518 - RNA, 18 nt, Artificial Sequence
  Description of Artificial Sequence: Synthetic oligonucleotide
aagaaagggcaagaaggg

SEQ ID NO: 25519 - RNA, 18 nt, Artificial Sequence
  Description of Artificial Sequence: Synthetic oligonucleotide
gagaaaagaaagggcaag

SEQ ID NO: 25520 - RNA, 18 nt, Artificial Sequence
  Description of Artificial Sequence: Synthetic oligonucleotide
ccauggagaaaagaaagg

SEQ ID NO: 25521 - RNA, 18 nt, Artificial Sequence
  Description of Artificial Sequence: Synthetic oligonucleotide
aucagccauggagaaaag

SEQ ID NO: 25522 - RNA, 18 nt, Artificial Sequence
  Description of Artificial Sequence: Synthetic oligonucleotide
gcagcaucagccauggag

SEQ ID NO: 25523 - RNA, 18 nt, Artificial Sequence
  Description of Artificial Sequence: Synthetic oligonucleotide
ccacagcagcaucagcca

SEQ ID NO: 25524 - RNA, 18 nt, Artificial Sequence
  Description of Artificial Sequence: Synthetic oligonucleotide
gcuggccacagcagcauc

SEQ ID NO: 25525 - RNA, 18 nt, Artificial Sequence
  Description of Artificial Sequence: Synthetic oligonucleotide
cccuggcuggccacagca

SEQ ID NO: 25526 - RNA, 18 nt, Artificial Sequence
  Description of Artificial Sequence: Synthetic oligonucleotide
aagggcccuggcuggcca

SEQ ID NO: 25527 - RNA, 18 nt, Artificial Sequence
  Description of Artificial Sequence: Synthetic oligonucleotide
aucucaagggcccuggcu

SEQ ID NO: 25528 - RNA, 18 nt, Artificial Sequence
  Description of Artificial Sequence: Synthetic oligonucleotide
gaaggaucucaagggccc

SEQ ID NO: 25529 - RNA, 18 nt, Artificial Sequence
  Description of Artificial Sequence: Synthetic oligonucleotide
aacuggaaggaucucaag

SEQ ID NO: 25530 - RNA, 18 nt, Artificial Sequence
  Description of Artificial Sequence: Synthetic oligonucleotide
agccaaacuggaaggauc

SEQ ID NO: 25531 - RNA, 18 nt, Artificial Sequence
  Description of Artificial Sequence: Synthetic oligonucleotide
auaacagccaaacuggaa

SEQ ID NO: 25532 - RNA, 18 nt, Artificial Sequence
  Description of Artificial Sequence: Synthetic oligonucleotide
uuugcauaacagccaaac

SEQ ID NO: 25533 - RNA, 18 nt, Artificial Sequence
  Description of Artificial Sequence: Synthetic oligonucleotide
ccugcuuugcauaacagc

SEQ ID NO: 25534 - RNA, 18 nt, Artificial Sequence
  Description of Artificial Sequence: Synthetic oligonucleotide
aaucaccugcuuugcaua

SEQ ID NO: 25535 - RNA, 18 nt, Artificial Sequence
  Description of Artificial Sequence: Synthetic oligonucleotide
agacaaaucaccugcuuu

SEQ ID NO: 25536 - RNA, 18 nt, Artificial Sequence
  Description of Artificial Sequence: Synthetic oligonucleotide
gauuaagacaaaucaccu

SEQ ID NO: 25537 - RNA, 18 nt, Artificial Sequence
  Description of Artificial Sequence: Synthetic oligonucleotide
uaucugauuaagacaaau

SEQ ID NO: 25538 - RNA, 18 nt, Artificial Sequence
  Description of Artificial Sequence: Synthetic oligonucleotide
ucuuuuaucugauuaaga

SEQ ID NO: 25539 - RNA, 18 nt, Artificial Sequence
  Description of Artificial Sequence: Synthetic oligonucleotide
cucuaucuuuuaucugau

SEQ ID NO: 25540 - RNA, 18 nt, Artificial Sequence
  Description of Artificial Sequence: Synthetic oligonucleotide
auagccucuaucuuuuau

SEQ ID NO: 25541 - RNA, 18 nt, Artificial Sequence
  Description of Artificial Sequence: Synthetic oligonucleotide
cccccauagccucuaucu

SEQ ID NO: 25542 - RNA, 18 nt, Artificial Sequence
  Description of Artificial Sequence: Synthetic oligonucleotide
ugaggcccccauagccuc

SEQ ID NO: 25543 - RNA, 18 nt, Artificial Sequence
  Description of Artificial Sequence: Synthetic oligonucleotide
aaucuugaggcccccaua

SEQ ID NO: 25544 - RNA, 18 nt, Artificial Sequence
  Description of Artificial Sequence: Synthetic oligonucleotide
ccaaaaaucuugaggccc

SEQ ID NO: 25545 - RNA, 18 nt, Artificial Sequence
  Description of Artificial Sequence: Synthetic oligonucleotide
gcucuccaaaaaucuuga

SEQ ID NO: 25546 - RNA, 18 nt, Artificial Sequence
  Description of Artificial Sequence: Synthetic oligonucleotide
ccucugcucuccaaaaau

SEQ ID NO: 25547 - RNA, 18 nt, Artificial Sequence
  Description of Artificial Sequence: Synthetic oligonucleotide
gaccaccucugcucucca

SEQ ID NO: 25548 - RNA, 18 nt, Artificial Sequence
  Description of Artificial Sequence: Synthetic oligonucleotide
ccagagaccaccucugcu

SEQ ID NO: 25549 - RNA, 18 nt, Artificial Sequence
  Description of Artificial Sequence: Synthetic oligonucleotide
aauugccagagaccaccu

SEQ ID NO: 25550 - RNA, 18 nt, Artificial Sequence
  Description of Artificial Sequence: Synthetic oligonucleotide
gauggaauugccagagac

SEQ ID NO: 25551 - RNA, 18 nt, Artificial Sequence
  Description of Artificial Sequence: Synthetic oligonucleotide
aaccagauggaauugcca

SEQ ID NO: 25552 - RNA, 18 nt, Artificial Sequence
  Description of Artificial Sequence: Synthetic oligonucleotide
cucaaaaccagauggaau

SEQ ID NO: 25553 - RNA, 18 nt, Artificial Sequence
  Description of Artificial Sequence: Synthetic oligonucleotide
aguuucucaaaaccagau

SEQ ID NO: 25554 - RNA, 18 nt, Artificial Sequence
  Description of Artificial Sequence: Synthetic oligonucleotide
ugcuaaguuucucaaaac

SEQ ID NO: 25555 - RNA, 18 nt, Artificial Sequence
  Description of Artificial Sequence: Synthetic oligonucleotide
ugagcugcuaaguuucuc

SEQ ID NO: 25556 - RNA, 18 nt, Artificial Sequence
  Description of Artificial Sequence: Synthetic oligonucleotide
cucugugagcugcuaagu

SEQ ID NO: 25557 - RNA, 18 nt, Artificial Sequence
  Description of Artificial Sequence: Synthetic oligonucleotide
cugugcucugugagcugc

SEQ ID NO: 25558 - RNA, 18 nt, Artificial Sequence
  Description of Artificial Sequence: Synthetic oligonucleotide
gaucucugugcucuguga

SEQ ID NO: 25559 - RNA, 18 nt, Artificial Sequence
  Description of Artificial Sequence: Synthetic oligonucleotide
ggcaggaucucugugcuc

SEQ ID NO: 25560 - RNA, 18 nt, Artificial Sequence
  Description of Artificial Sequence: Synthetic oligonucleotide
aagaaggcaggaucucug

SEQ ID NO: 25561 - RNA, 18 nt, Artificial Sequence
  Description of Artificial Sequence: Synthetic oligonucleotide
guaggaagaaggcaggau

SEQ ID NO: 25562 - RNA, 18 nt, Artificial Sequence
  Description of Artificial Sequence: Synthetic oligonucleotide
ugauaguaggaagaaggc

SEQ ID NO: 25563 - RNA, 18 nt, Artificial Sequence
  Description of Artificial Sequence: Synthetic oligonucleotide
cagccugauaguaggaag

SEQ ID NO: 25564 - RNA, 18 nt, Artificial Sequence
  Description of Artificial Sequence: Synthetic oligonucleotide
uaggucagccugauagua

SEQ ID NO: 25565 - RNA, 18 nt, Artificial Sequence
  Description of Artificial Sequence: Synthetic oligonucleotide
cccauuaggucagccuga

SEQ ID NO: 25566 - RNA, 18 nt, Artificial Sequence
  Description of Artificial Sequence: Synthetic oligonucleotide
ccaaccccauuaggucag

SEQ ID NO: 25567 - RNA, 18 nt, Artificial Sequence
  Description of Artificial Sequence: Synthetic oligonucleotide
gcagcccaaccccauuag

SEQ ID NO: 25568 - RNA, 18 nt, Artificial Sequence
  Description of Artificial Sequence: Synthetic oligonucleotide
gccgagcagcccaacccc

SEQ ID NO: 25569 - RNA, 18 nt, Artificial Sequence
  Description of Artificial Sequence: Synthetic oligonucleotide
caguugccgagcagccca

SEQ ID NO: 25570 - RNA, 18 nt, Artificial Sequence
  Description of Artificial Sequence: Synthetic oligonucleotide
ccaagcaguugccgagca

SEQ ID NO: 25571 - RNA, 18 nt, Artificial Sequence
  Description of Artificial Sequence: Synthetic oligonucleotide
gugacccaagcaguugcc

SEQ ID NO: 25572 - RNA, 18 nt, Artificial Sequence
  Description of Artificial Sequence: Synthetic oligonucleotide
gcaaggugacccaagcag

SEQ ID NO: 25573 - RNA, 18 nt, Artificial Sequence
  Description of Artificial Sequence: Synthetic oligonucleotide
gggcaaggugacccaagc

SEQ ID NO: 25574 - RNA, 18 nt, Artificial Sequence
  Description of Artificial Sequence: Synthetic oligonucleotide
agggcugguuuccuuggg

SEQ ID NO: 25575 - RNA, 18 nt, Artificial Sequence
  Description of Artificial Sequence: Synthetic oligonucleotide
cacccagggcugguuucc

SEQ ID NO: 25576 - RNA, 18 nt, Artificial Sequence
  Description of Artificial Sequence: Synthetic oligonucleotide
gguggcacccagggcugg

SEQ ID NO: 25577 - RNA, 18 nt, Artificial Sequence
  Description of Artificial Sequence: Synthetic oligonucleotide
ggcuggguggcacccagg

SEQ ID NO: 25578 - RNA, 18 nt, Artificial Sequence
  Description of Artificial Sequence: Synthetic oligonucleotide
uaaguggcuggguggcac

SEQ ID NO: 25579 - RNA, 18 nt, Artificial Sequence
  Description of Artificial Sequence: Synthetic oligonucleotide
gacccuaaguggcugggu

SEQ ID NO: 25580 - RNA, 18 nt, Artificial Sequence
  Description of Artificial Sequence: Synthetic oligonucleotide
cuguagacccuaaguggc

SEQ ID NO: 25581 - RNA, 18 nt, Artificial Sequence
  Description of Artificial Sequence: Synthetic oligonucleotide
ccacccuguagacccuaa

SEQ ID NO: 25582 - RNA, 18 nt, Artificial Sequence
  Description of Artificial Sequence: Synthetic oligonucleotide
gagucccacccuguagac

SEQ ID NO: 25583 - RNA, 18 nt, Artificial Sequence
  Description of Artificial Sequence: Synthetic oligonucleotide
gucuggagucccacccug

SEQ ID NO: 25584 - RNA, 18 nt, Artificial Sequence
  Description of Artificial Sequence: Synthetic oligonucleotide
ucuaggucuggaguccca

SEQ ID NO: 25585 - RNA, 18 nt, Artificial Sequence
  Description of Artificial Sequence: Synthetic oligonucleotide
uacgcucuaggucuggag

SEQ ID NO: 25586 - RNA, 18 nt, Artificial Sequence
  Description of Artificial Sequence: Synthetic oligonucleotide
auacuuacgcucuagguc

SEQ ID NO: 25587 - RNA, 18 nt, Artificial Sequence
  Description of Artificial Sequence: Synthetic oligonucleotide
cauccauacuuacgcucu

SEQ ID NO: 25588 - RNA, 18 nt, Artificial Sequence
  Description of Artificial Sequence: Synthetic oligonucleotide
cacaacauccauacuuac

SEQ ID NO: 25589 - RNA, 18 nt, Artificial Sequence
  Description of Artificial Sequence: Synthetic oligonucleotide
agggccacaacauccaua

SEQ ID NO: 25590 - RNA, 18 nt, Artificial Sequence
  Description of Artificial Sequence: Synthetic oligonucleotide
gacacagggccacaacau

SEQ ID NO: 25591 - RNA, 18 nt, Artificial Sequence
  Description of Artificial Sequence: Synthetic oligonucleotide
aggaagacacagggccac

SEQ ID NO: 25592 - RNA, 18 nt, Artificial Sequence
  Description of Artificial Sequence: Synthetic oligonucleotide
acacuaggaagacacagg

SEQ ID NO: 25593 - RNA, 18 nt, Artificial Sequence
  Description of Artificial Sequence: Synthetic oligonucleotide
gggucacacuaggaagac

SEQ ID NO: 25594 - RNA, 18 nt, Artificial Sequence
  Description of Artificial Sequence: Synthetic oligonucleotide
uggcugggucacacuagg

SEQ ID NO: 25595 - RNA, 18 nt, Artificial Sequence
  Description of Artificial Sequence: Synthetic oligonucleotide
gcuccuggcugggucaca

SEQ ID NO: 25596 - RNA, 18 nt, Artificial Sequence
  Description of Artificial Sequence: Synthetic oligonucleotide
cuuccgcuccuggcuggg

SEQ ID NO: 25597 - RNA, 18 nt, Artificial Sequence
  Description of Artificial Sequence: Synthetic oligonucleotide
ugaagcuuccgcuccugg

SEQ ID NO: 25598 - RNA, 18 nt, Artificial Sequence
  Description of Artificial Sequence: Synthetic oligonucleotide
acgccugaagcuuccgcu

SEQ ID NO: 25599 - RNA, 18 nt, Artificial Sequence
  Description of Artificial Sequence: Synthetic oligonucleotide
uacaaacgccugaagcuu

SEQ ID NO: 25600 - RNA, 18 nt, Artificial Sequence
  Description of Artificial Sequence: Synthetic oligonucleotide
cacuuuacaaacgccuga

SEQ ID NO: 25601 - RNA, 18 nt, Artificial Sequence
  Description of Artificial Sequence: Synthetic oligonucleotide
gaccucacuuuacaaacg

SEQ ID NO: 25602 - RNA, 18 nt, Artificial Sequence
  Description of Artificial Sequence: Synthetic oligonucleotide
agccagaccucacuuuac

SEQ ID NO: 25603 - RNA, 18 nt, Artificial Sequence
  Description of Artificial Sequence: Synthetic oligonucleotide
ggcagagccagaccucac

SEQ ID NO: 25604 - RNA, 18 nt, Artificial Sequence
  Description of Artificial Sequence: Synthetic oligonucleotide
gaggaggcagagccagac

SEQ ID NO: 25605 - RNA, 18 nt, Artificial Sequence
  Description of Artificial Sequence: Synthetic oligonucleotide
aaacggaggaggcagagc

SEQ ID NO: 25606 - RNA, 18 nt, Artificial Sequence
  Description of Artificial Sequence: Synthetic oligonucleotide
aaaaaaaacggaggaggc

SEQ ID NO: 25607 - RNA, 18 nt, Artificial Sequence
  Description of Artificial Sequence: Synthetic oligonucleotide
aaaaaaaaaaaaacggag

SEQ ID NO: 25608 - RNA, 18 nt, Artificial Sequence
  Description of Artificial Sequence: Synthetic oligonucleotide
acagaaaaaaaaaaaaaa

SEQ ID NO: 25609 - RNA, 18 nt, Artificial Sequence
  Description of Artificial Sequence: Synthetic oligonucleotide
cagaaacagaaaaaaaaa

SEQ ID NO: 25610 - RNA, 18 nt, Artificial Sequence
  Description of Artificial Sequence: Synthetic oligonucleotide
agaaacagaaacagaaaa

SEQ ID NO: 25611 - RNA, 18 nt, Artificial Sequence
  Description of Artificial Sequence: Synthetic oligonucleotide
aaaacagaaacagaaaca

SEQ ID NO: 25612 - RNA, 18 nt, Artificial Sequence
  Description of Artificial Sequence: Synthetic oligonucleotide
aaaaaaaaacagaaacag

SEQ ID NO: 25613 - RNA, 18 nt, Artificial Sequence
  Description of Artificial Sequence: Synthetic oligonucleotide
ucucaaaaaaaaaacaga

SEQ ID NO: 25614 - RNA, 18 nt, Artificial Sequence
  Description of Artificial Sequence: Synthetic oligonucleotide
cuccaucucaaaaaaaaa

SEQ ID NO: 25615 - RNA, 18 nt, Artificial Sequence
  Description of Artificial Sequence: Synthetic oligonucleotide
cgagacuccaucucaaaa

SEQ ID NO: 25616 - RNA, 18 nt, Artificial Sequence
  Description of Artificial Sequence: Synthetic oligonucleotide
cagagcgagacuccaucu

SEQ ID NO: 25617 - RNA, 18 nt, Artificial Sequence
  Description of Artificial Sequence: Synthetic oligonucleotide
ggcgacagagcgagacuc

SEQ ID NO: 25618 - RNA, 18 nt, Artificial Sequence
  Description of Artificial Sequence: Synthetic oligonucleotide
gccugggcgacagagcga

SEQ ID NO: 25619 - RNA, 18 nt, Artificial Sequence
  Description of Artificial Sequence: Synthetic oligonucleotide
cuccagccugggcgacag

SEQ ID NO: 25620 - RNA, 18 nt, Artificial Sequence
  Description of Artificial Sequence: Synthetic oligonucleotide
cugcacuccagccugggc

SEQ ID NO: 25621 - RNA, 18 nt, Artificial Sequence
  Description of Artificial Sequence: Synthetic oligonucleotide
ugacacugcacuccagcc

SEQ ID NO: 25622 - RNA, 18 nt, Artificial Sequence
  Description of Artificial Sequence: Synthetic oligonucleotide
gaucgugacacugcacuc

SEQ ID NO: 25623 - RNA, 18 nt, Artificial Sequence
  Description of Artificial Sequence: Synthetic oligonucleotide
gcugagaucgugacacug

SEQ ID NO: 25624 - RNA, 18 nt, Artificial Sequence
  Description of Artificial Sequence: Synthetic oligonucleotide
agugagcugagaucguga

SEQ ID NO: 25625 - RNA, 18 nt, Artificial Sequence
  Description of Artificial Sequence: Synthetic oligonucleotide
guugcagugagcugagau

SEQ ID NO: 25626 - RNA, 18 nt, Artificial Sequence
  Description of Artificial Sequence: Synthetic oligonucleotide
cggagguugcagugagcu

SEQ ID NO: 25627 - RNA, 18 nt, Artificial Sequence
  Description of Artificial Sequence: Synthetic oligonucleotide
ggaggcggagguugcagu

SEQ ID NO: 25628 - RNA, 18 nt, Artificial Sequence
  Description of Artificial Sequence: Synthetic oligonucleotide
accugggaggcggagguu

SEQ ID NO: 25629 - RNA, 18 nt, Artificial Sequence
  Description of Artificial Sequence: Synthetic oligonucleotide
cuuguaccugggaggcgg

SEQ ID NO: 25630 - RNA, 18 nt, Artificial Sequence
  Description of Artificial Sequence: Synthetic oligonucleotide
aaucucuuguaccuggga

SEQ ID NO: 25631 - RNA, 18 nt, Artificial Sequence
  Description of Artificial Sequence: Synthetic oligonucleotide
aggagaaucucuuguacc

SEQ ID NO: 25632 - RNA, 18 nt, Artificial Sequence
  Description of Artificial Sequence: Synthetic oligonucleotide
gaggcaggagaaucucuu

SEQ ID NO: 25633 - RNA, 18 nt, Artificial Sequence
  Description of Artificial Sequence: Synthetic oligonucleotide
aggcugaggcaggagaau

SEQ ID NO: 25634 - RNA, 18 nt, Artificial Sequence
  Description of Artificial Sequence: Synthetic oligonucleotide
ucgggaggcugaggcagg

SEQ ID NO: 25635 - RNA, 18 nt, Artificial Sequence
  Description of Artificial Sequence: Synthetic oligonucleotide
gcuacucgggaggcugag

SEQ ID NO: 25636 - RNA, 18 nt, Artificial Sequence
  Description of Artificial Sequence: Synthetic oligonucleotide
ucccagcuacucgggagg

SEQ ID NO: 25637 - RNA, 18 nt, Artificial Sequence
  Description of Artificial Sequence: Synthetic oligonucleotide
uguagucccagcuacucg

SEQ ID NO: 25638 - RNA, 18 nt, Artificial Sequence
  Description of Artificial Sequence: Synthetic oligonucleotide
acgccuguagucccagcu

SEQ ID NO: 25639 - RNA, 18 nt, Artificial Sequence
  Description of Artificial Sequence: Synthetic oligonucleotide
ggcacacgccuguagucc

SEQ ID NO: 25640 - RNA, 18 nt, Artificial Sequence
  Description of Artificial Sequence: Synthetic oligonucleotide
augguggcacacgccugu

SEQ ID NO: 25641 - RNA, 18 nt, Artificial Sequence
  Description of Artificial Sequence: Synthetic oligonucleotide
caggcaugguggcacacg

SEQ ID NO: 25642 - RNA, 18 nt, Artificial Sequence
  Description of Artificial Sequence: Synthetic oligonucleotide
uuagccaggcaugguggc

SEQ ID NO: 25643 - RNA, 18 nt, Artificial Sequence
  Description of Artificial Sequence: Synthetic oligonucleotide
aaaaauuagccaggcaug

SEQ ID NO: 25644 - RNA, 18 nt, Artificial Sequence
  Description of Artificial Sequence: Synthetic oligonucleotide
aauacaaaaauuagccag

SEQ ID NO: 25645 - RNA, 18 nt, Artificial Sequence
  Description of Artificial Sequence: Synthetic oligonucleotide
cuaaaaauacaaaaauua

SEQ ID NO: 25646 - RNA, 18 nt, Artificial Sequence
  Description of Artificial Sequence: Synthetic oligonucleotide
cucuacuaaaaauacaaa

SEQ ID NO: 25647 - RNA, 18 nt, Artificial Sequence
  Description of Artificial Sequence: Synthetic oligonucleotide
cccaucucuacuaaaaau

SEQ ID NO: 25648 - RNA, 18 nt, Artificial Sequence
  Description of Artificial Sequence: Synthetic oligonucleotide
gaaaccccaucucuacua

SEQ ID NO: 25649 - RNA, 18 nt, Artificial Sequence
  Description of Artificial Sequence: Synthetic oligonucleotide
auggcgaaaccccaucuc

SEQ ID NO: 25650 - RNA, 18 nt, Artificial Sequence
  Description of Artificial Sequence: Synthetic oligonucleotide
cuaacauggcgaaacccc

SEQ ID NO: 25651 - RNA, 18 nt, Artificial Sequence
  Description of Artificial Sequence: Synthetic oligonucleotide
ucuggcuaacauggcgaa

SEQ ID NO: 25652 - RNA, 18 nt, Artificial Sequence
  Description of Artificial Sequence: Synthetic oligonucleotide
accagucuggcuaacaug

SEQ ID NO: 25653 - RNA, 18 nt, Artificial Sequence
  Description of Artificial Sequence: Synthetic oligonucleotide
ucgagaccagucuggcua

SEQ ID NO: 25654 - RNA, 18 nt, Artificial Sequence
  Description of Artificial Sequence: Synthetic oligonucleotide
ggaguucgagaccagucu

SEQ ID NO: 25655 - RNA, 18 nt, Artificial Sequence
  Description of Artificial Sequence: Synthetic oligonucleotide
ggucaggaguucgagacc

SEQ ID NO: 25656 - RNA, 18 nt, Artificial Sequence
  Description of Artificial Sequence: Synthetic oligonucleotide
ccugaggucaggaguucg

SEQ ID NO: 25657 - RNA, 18 nt, Artificial Sequence
  Description of Artificial Sequence: Synthetic oligonucleotide
gaucaccugaggucagga

SEQ ID NO: 25658 - RNA, 18 nt, Artificial Sequence
  Description of Artificial Sequence: Synthetic oligonucleotide
gggaggaucaccugaggu

SEQ ID NO: 25659 - RNA, 18 nt, Artificial Sequence
  Description of Artificial Sequence: Synthetic oligonucleotide
gggugggaggaucaccug

SEQ ID NO: 25660 - RNA, 18 nt, Artificial Sequence
  Description of Artificial Sequence: Synthetic oligonucleotide
gaacuuugggaagccggg

SEQ ID NO: 25661 - RNA, 18 nt, Artificial Sequence
  Description of Artificial Sequence: Synthetic oligonucleotide
ucccagaacuuugggaag

SEQ ID NO: 25662 - RNA, 18 nt, Artificial Sequence
  Description of Artificial Sequence: Synthetic oligonucleotide
uauaaucccagaacuuug

SEQ ID NO: 25663 - RNA, 18 nt, Artificial Sequence
  Description of Artificial Sequence: Synthetic oligonucleotide
acgccuauaaucccagaa

SEQ ID NO: 25664 - RNA, 18 nt, Artificial Sequence
  Description of Artificial Sequence: Synthetic oligonucleotide
ggcucacgccuauaaucc

SEQ ID NO: 25665 - RNA, 18 nt, Artificial Sequence
  Description of Artificial Sequence: Synthetic oligonucleotide
augguggcucacgccuau

SEQ ID NO: 25666 - RNA, 18 nt, Artificial Sequence
  Description of Artificial Sequence: Synthetic oligonucleotide
cgggcaugguggcucacg

SEQ ID NO: 25667 - RNA, 18 nt, Artificial Sequence
  Description of Artificial Sequence: Synthetic oligonucleotide
gagaccgggcaugguggc

SEQ ID NO: 25668 - RNA, 18 nt, Artificial Sequence
  Description of Artificial Sequence: Synthetic oligonucleotide
gagaagagaccgggcaug

SEQ ID NO: 25669 - RNA, 18 nt, Artificial Sequence
  Description of Artificial Sequence: Synthetic oligonucleotide
agacugagaagagaccgg

SEQ ID NO: 25670 - RNA, 18 nt, Artificial Sequence
  Description of Artificial Sequence: Synthetic oligonucleotide
cuucaagacugagaagag

SEQ ID NO: 25671 - RNA, 18 nt, Artificial Sequence
  Description of Artificial Sequence: Synthetic oligonucleotide
augggcuucaagacugag

SEQ ID NO: 25672 - RNA, 18 nt, Artificial Sequence
  Description of Artificial Sequence: Synthetic oligonucleotide
cagggaugggcuucaaga

SEQ ID NO: 25673 - RNA, 18 nt, Artificial Sequence
  Description of Artificial Sequence: Synthetic oligonucleotide
aaauccagggaugggcuu

SEQ ID NO: 25674 - RNA, 18 nt, Artificial Sequence
  Description of Artificial Sequence: Synthetic oligonucleotide
gguggaaauccagggaug

SEQ ID NO: 25675 - RNA, 18 nt, Artificial Sequence
  Description of Artificial Sequence: Synthetic oligonucleotide
cuccugguggaaauccag

SEQ ID NO: 25676 - RNA, 18 nt, Artificial Sequence
  Description of Artificial Sequence: Synthetic oligonucleotide
aguaacuccugguggaaa

SEQ ID NO: 25677 - RNA, 18 nt, Artificial Sequence
  Description of Artificial Sequence: Synthetic oligonucleotide
aggaaaguaacuccuggu

SEQ ID NO: 25678 - RNA, 18 nt, Artificial Sequence
  Description of Artificial Sequence: Synthetic oligonucleotide
ucaggaggaaaguaacuc

SEQ ID NO: 25679 - RNA, 18 nt, Artificial Sequence
  Description of Artificial Sequence: Synthetic oligonucleotide
acaggucaggaggaaagu

SEQ ID NO: 25680 - RNA, 18 nt, Artificial Sequence
  Description of Artificial Sequence: Synthetic oligonucleotide
aauuuacaggucaggagg

SEQ ID NO: 25681 - RNA, 18 nt, Artificial Sequence
  Description of Artificial Sequence: Synthetic oligonucleotide
gaacaaauuuacagguca

SEQ ID NO: 25682 - RNA, 18 nt, Artificial Sequence
  Description of Artificial Sequence: Synthetic oligonucleotide
uuaaagaacaaauuuaca

SEQ ID NO: 25683 - RNA, 18 nt, Artificial Sequence
  Description of Artificial Sequence: Synthetic oligonucleotide
cauuguuaaagaacaaau

SEQ ID NO: 25684 - RNA, 18 nt, Artificial Sequence
  Description of Artificial Sequence: Synthetic oligonucleotide
gcagccauuguuaaagaa

SEQ ID NO: 25685 - RNA, 18 nt, Artificial Sequence
  Description of Artificial Sequence: Synthetic oligonucleotide
caccugcagccauuguua

SEQ ID NO: 25686 - RNA, 18 nt, Artificial Sequence
  Description of Artificial Sequence: Synthetic oligonucleotide
gcucccaccugcagccau

SEQ ID NO: 25687 - RNA, 18 nt, Artificial Sequence
  Description of Artificial Sequence: Synthetic oligonucleotide
cauaugcucccaccugca

SEQ ID NO: 25688 - RNA, 18 nt, Artificial Sequence
  Description of Artificial Sequence: Synthetic oligonucleotide
accaccauaugcucccac

SEQ ID NO: 25689 - RNA, 18 nt, Artificial Sequence
  Description of Artificial Sequence: Synthetic oligonucleotide
uauaaaccaccauaugcu

SEQ ID NO: 25690 - RNA, 18 nt, Artificial Sequence
  Description of Artificial Sequence: Synthetic oligonucleotide
guuuuuauaaaccaccau

SEQ ID NO: 25691 - RNA, 18 nt, Artificial Sequence
  Description of Artificial Sequence: Synthetic oligonucleotide
acagcguuuuuauaaacc

SEQ ID NO: 25692 - RNA, 18 nt, Artificial Sequence
  Description of Artificial Sequence: Synthetic oligonucleotide
gcccgacagcguuuuuau

SEQ ID NO: 25693 - RNA, 18 nt, Artificial Sequence
  Description of Artificial Sequence: Synthetic oligonucleotide
acaaagcccgacagcguu

SEQ ID NO: 25694 - RNA, 18 nt, Artificial Sequence
  Description of Artificial Sequence: Synthetic oligonucleotide
aggaaacaaagcccgaca

SEQ ID NO: 25695 - RNA, 18 nt, Artificial Sequence
  Description of Artificial Sequence: Synthetic oligonucleotide
aaagaaggaaacaaagcc

SEQ ID NO: 25696 - RNA, 18 nt, Artificial Sequence
  Description of Artificial Sequence: Synthetic oligonucleotide
cagcuaaagaaggaaaca

SEQ ID NO: 25697 - RNA, 18 nt, Artificial Sequence
  Description of Artificial Sequence: Synthetic oligonucleotide
cacggcagcuaaagaagg

SEQ ID NO: 25698 - RNA, 18 nt, Artificial Sequence
  Description of Artificial Sequence: Synthetic oligonucleotide
guagacacggcagcuaaa

SEQ ID NO: 25699 - RNA, 18 nt, Artificial Sequence
  Description of Artificial Sequence: Synthetic oligonucleotide
cagaaguagacacggcag

SEQ ID NO: 25700 - RNA, 18 nt, Artificial Sequence
  Description of Artificial Sequence: Synthetic oligonucleotide
gacuucagaaguagacac

SEQ ID NO: 25701 - RNA, 18 nt, Artificial Sequence
  Description of Artificial Sequence: Synthetic oligonucleotide
ucccagacuucagaagua

SEQ ID NO: 25702 - RNA, 18 nt, Artificial Sequence
  Description of Artificial Sequence: Synthetic oligonucleotide
gcacuucccagacuucag

SEQ ID NO: 25703 - RNA, 18 nt, Artificial Sequence
  Description of Artificial Sequence: Synthetic oligonucleotide
gcuuggcacuucccagac

SEQ ID NO: 25704 - RNA, 18 nt, Artificial Sequence
  Description of Artificial Sequence: Synthetic oligonucleotide
gcguggcuuggcacuucc

SEQ ID NO: 25705 - RNA, 18 nt, Artificial Sequence
  Description of Artificial Sequence: Synthetic oligonucleotide
aggccgcguggcuuggca

SEQ ID NO: 25706 - RNA, 18 nt, Artificial Sequence
  Description of Artificial Sequence: Synthetic oligonucleotide
ccuugaggccgcguggcu

SEQ ID NO: 25707 - RNA, 18 nt, Artificial Sequence
  Description of Artificial Sequence: Synthetic oligonucleotide
agcucccuugaggccgcg

SEQ ID NO: 25708 - RNA, 18 nt, Artificial Sequence
  Description of Artificial Sequence: Synthetic oligonucleotide
cagccagcucccuugagg

SEQ ID NO: 25709 - RNA, 18 nt, Artificial Sequence
  Description of Artificial Sequence: Synthetic oligonucleotide
aacaccagccagcucccu

SEQ ID NO: 25710 - RNA, 18 nt, Artificial Sequence
  Description of Artificial Sequence: Synthetic oligonucleotide
gcucaaacaccagccagc

SEQ ID NO: 25711 - RNA, 18 nt, Artificial Sequence
  Description of Artificial Sequence: Synthetic oligonucleotide
ccacagcucaaacaccag

SEQ ID NO: 25712 - RNA, 18 nt, Artificial Sequence
  Description of Artificial Sequence: Synthetic oligonucleotide
uucugccacagcucaaac

SEQ ID NO: 25713 - RNA, 18 nt, Artificial Sequence
  Description of Artificial Sequence: Synthetic oligonucleotide
ggugcuucugccacagcu

SEQ ID NO: 25714 - RNA, 18 nt, Artificial Sequence
  Description of Artificial Sequence: Synthetic oligonucleotide
ccccaggugcuucugcca

SEQ ID NO: 25715 - RNA, 18 nt, Artificial Sequence
  Description of Artificial Sequence: Synthetic oligonucleotide
uggagccccaggugcuuc

SEQ ID NO: 25716 - RNA, 18 nt, Artificial Sequence
  Description of Artificial Sequence: Synthetic oligonucleotide
cucccuggagccccaggu

SEQ ID NO: 25717 - RNA, 18 nt, Artificial Sequence
  Description of Artificial Sequence: Synthetic oligonucleotide
gccugcucccuggagccc

SEQ ID NO: 25718 - RNA, 18 nt, Artificial Sequence
  Description of Artificial Sequence: Synthetic oligonucleotide
ucccagccugcucccugg

SEQ ID NO: 25719 - RNA, 18 nt, Artificial Sequence
  Description of Artificial Sequence: Synthetic oligonucleotide
gcaguucccagccugcuc

SEQ ID NO: 25720 - RNA, 18 nt, Artificial Sequence
  Description of Artificial Sequence: Synthetic oligonucleotide
guccugcaguucccagcc

SEQ ID NO: 25721 - RNA, 18 nt, Artificial Sequence
  Description of Artificial Sequence: Synthetic oligonucleotide
gcaagguccugcaguucc

SEQ ID NO: 25722 - RNA, 18 nt, Artificial Sequence
  Description of Artificial Sequence: Synthetic oligonucleotide
gcugagcaagguccugca

SEQ ID NO: 25723 - RNA, 18 nt, Artificial Sequence
  Description of Artificial Sequence: Synthetic oligonucleotide
uccuggcugagcaagguc

SEQ ID NO: 25724 - RNA, 18 nt, Artificial Sequence
  Description of Artificial Sequence: Synthetic oligonucleotide
agugcuccuggcugagca

SEQ ID NO: 25725 - RNA, 18 nt, Artificial Sequence
  Description of Artificial Sequence: Synthetic oligonucleotide
gggaagugcuccuggcug

SEQ ID NO: 25726 - RNA, 18 nt, Artificial Sequence
  Description of Artificial Sequence: Synthetic oligonucleotide
uuccugccucaaggaggg

SEQ ID NO: 25727 - RNA, 18 nt, Artificial Sequence
  Description of Artificial Sequence: Synthetic oligonucleotide
caguauuccugccucaag

SEQ ID NO: 25728 - RNA, 18 nt, Artificial Sequence
  Description of Artificial Sequence: Synthetic oligonucleotide
caccucaguauuccugcc

SEQ ID NO: 25729 - RNA, 18 nt, Artificial Sequence
  Description of Artificial Sequence: Synthetic oligonucleotide
ggaggcaccucaguauuc

SEQ ID NO: 25730 - RNA, 18 nt, Artificial Sequence
  Description of Artificial Sequence: Synthetic oligonucleotide
gggaggcaccucaguauu

SEQ ID NO: 25731 - RNA, 18 nt, Artificial Sequence
  Description of Artificial Sequence: Synthetic oligonucleotide
accuucuccaucuguggg

SEQ ID NO: 25732 - RNA, 18 nt, Artificial Sequence
  Description of Artificial Sequence: Synthetic oligonucleotide
ucuccaccuucuccaucu

SEQ ID NO: 25733 - RNA, 18 nt, Artificial Sequence
  Description of Artificial Sequence: Synthetic oligonucleotide
ccuccucuccaccuucuc

SEQ ID NO: 25734 - RNA, 18 nt, Artificial Sequence
  Description of Artificial Sequence: Synthetic oligonucleotide
cccauccuccucuccacc

SEQ ID NO: 25735 - RNA, 18 nt, Artificial Sequence
  Description of Artificial Sequence: Synthetic oligonucleotide
ugaggcccauccuccucu

SEQ ID NO: 25736 - RNA, 18 nt, Artificial Sequence
  Description of Artificial Sequence: Synthetic oligonucleotide
gcuccugaggcccauccu

SEQ ID NO: 25737 - RNA, 18 nt, Artificial Sequence
  Description of Artificial Sequence: Synthetic oligonucleotide
gagaugcuccugaggccc

SEQ ID NO: 25738 - RNA, 18 nt, Artificial Sequence
  Description of Artificial Sequence: Synthetic oligonucleotide
ggcuugagaugcuccuga

SEQ ID NO: 25739 - RNA, 18 nt, Artificial Sequence
  Description of Artificial Sequence: Synthetic oligonucleotide
gggcuugagaugcuccug

SEQ ID NO: 25740 - RNA, 18 nt, Artificial Sequence
  Description of Artificial Sequence: Synthetic oligonucleotide
cuuucuccugcuacuggg

SEQ ID NO: 25741 - RNA, 18 nt, Artificial Sequence
  Description of Artificial Sequence: Synthetic oligonucleotide
ucuuucuuucuccugcua

SEQ ID NO: 25742 - RNA, 18 nt, Artificial Sequence
  Description of Artificial Sequence: Synthetic oligonucleotide
cucuuucuuucuuucucc

SEQ ID NO: 25743 - RNA, 18 nt, Artificial Sequence
  Description of Artificial Sequence: Synthetic oligonucleotide
ggcaucucuuucuuucuu

SEQ ID NO: 25744 - RNA, 18 nt, Artificial Sequence
  Description of Artificial Sequence: Synthetic oligonucleotide
aaccaggcaucucuuucu

SEQ ID NO: 25745 - RNA, 18 nt, Artificial Sequence
  Description of Artificial Sequence: Synthetic oligonucleotide
gugaaaaccaggcaucuc

SEQ ID NO: 25746 - RNA, 18 nt, Artificial Sequence
  Description of Artificial Sequence: Synthetic oligonucleotide
agucugugaaaaccaggc

SEQ ID NO: 25747 - RNA, 18 nt, Artificial Sequence
  Description of Artificial Sequence: Synthetic oligonucleotide
gaaccagucugugaaaac

SEQ ID NO: 25748 - RNA, 18 nt, Artificial Sequence
  Description of Artificial Sequence: Synthetic oligonucleotide
cacaggaaccagucugug

SEQ ID NO: 25749 - RNA, 18 nt, Artificial Sequence
  Description of Artificial Sequence: Synthetic oligonucleotide
ccagccacaggaaccagu

SEQ ID NO: 25750 - RNA, 18 nt, Artificial Sequence
  Description of Artificial Sequence: Synthetic oligonucleotide
ucaucccagccacaggaa

SEQ ID NO: 25751 - RNA, 18 nt, Artificial Sequence
  Description of Artificial Sequence: Synthetic oligonucleotide
ugcagucaucccagccac

SEQ ID NO: 25752 - RNA, 18 nt, Artificial Sequence
  Description of Artificial Sequence: Synthetic oligonucleotide
aaggaugcagucauccca

SEQ ID NO: 25753 - RNA, 18 nt, Artificial Sequence
  Description of Artificial Sequence: Synthetic oligonucleotide
aaaaaaaggaugcaguca

SEQ ID NO: 25754 - RNA, 18 nt, Artificial Sequence
  Description of Artificial Sequence: Synthetic oligonucleotide
aaaaaaaaaaaaggaugc

SEQ ID NO: 25755 - RNA, 18 nt, Artificial Sequence
  Description of Artificial Sequence: Synthetic oligonucleotide
caaaaaaaaaaaaaaaag

SEQ ID NO: 25756 - RNA, 18 nt, Artificial Sequence
  Description of Artificial Sequence: Synthetic oligonucleotide
cgucucaaaaaaaaaaaa

SEQ ID NO: 25757 - RNA, 18 nt, Artificial Sequence
  Description of Artificial Sequence: Synthetic oligonucleotide
aacuccgucucaaaaaaa

SEQ ID NO: 25758 - RNA, 18 nt, Artificial Sequence
  Description of Artificial Sequence: Synthetic oligonucleotide
gcaaaaacuccgucucaa

SEQ ID NO: 25759 - RNA, 18 nt, Artificial Sequence
  Description of Artificial Sequence: Synthetic oligonucleotide
caaaggcaaaaacuccgu

SEQ ID NO: 25760 - RNA, 18 nt, Artificial Sequence
  Description of Artificial Sequence: Synthetic oligonucleotide
ggcgacaaaggcaaaaac

SEQ ID NO: 25761 - RNA, 18 nt, Artificial Sequence
  Description of Artificial Sequence: Synthetic oligonucleotide
gccugggcgacaaaggca

SEQ ID NO: 25762 - RNA, 18 nt, Artificial Sequence
  Description of Artificial Sequence: Synthetic oligonucleotide
cuccagccugggcgacaa

SEQ ID NO: 25763 - RNA, 18 nt, Artificial Sequence
  Description of Artificial Sequence: Synthetic oligonucleotide
uugcacuccagccugggc

SEQ ID NO: 25764 - RNA, 18 nt, Artificial Sequence
  Description of Artificial Sequence: Synthetic oligonucleotide
cgccauugcacuccagcc

SEQ ID NO: 25765 - RNA, 18 nt, Artificial Sequence
  Description of Artificial Sequence: Synthetic oligonucleotide
gaucacgccauugcacuc

SEQ ID NO: 25766 - RNA, 18 nt, Artificial Sequence
  Description of Artificial Sequence: Synthetic oligonucleotide
gccgagaucacgccauug

SEQ ID NO: 25767 - RNA, 18 nt, Artificial Sequence
  Description of Artificial Sequence: Synthetic oligonucleotide
ggugagccgagaucacgc

SEQ ID NO: 25768 - RNA, 18 nt, Artificial Sequence
  Description of Artificial Sequence: Synthetic oligonucleotide
guugcggugagccgagau

SEQ ID NO: 25769 - RNA, 18 nt, Artificial Sequence
  Description of Artificial Sequence: Synthetic oligonucleotide
cggagguugcggugagcc

SEQ ID NO: 25770 - RNA, 18 nt, Artificial Sequence
  Description of Artificial Sequence: Synthetic oligonucleotide
ggaggcggagguugcggu

SEQ ID NO: 25771 - RNA, 18 nt, Artificial Sequence
  Description of Artificial Sequence: Synthetic oligonucleotide
auccgggaggcggagguu

SEQ ID NO: 25772 - RNA, 18 nt, Artificial Sequence
  Description of Artificial Sequence: Synthetic oligonucleotide
cuugaauccgggaggcgg

SEQ ID NO: 25773 - RNA, 18 nt, Artificial Sequence
  Description of Artificial Sequence: Synthetic oligonucleotide
aauugcuugaauccggga

SEQ ID NO: 25774 - RNA, 18 nt, Artificial Sequence
  Description of Artificial Sequence: Synthetic oligonucleotide
aggagaauugcuugaauc

SEQ ID NO: 25775 - RNA, 18 nt, Artificial Sequence
  Description of Artificial Sequence: Synthetic oligonucleotide
gaggcaggagaauugcuu

SEQ ID NO: 25776 - RNA, 18 nt, Artificial Sequence
  Description of Artificial Sequence: Synthetic oligonucleotide
aggcugaggcaggagaau

SEQ ID NO: 25777 - RNA, 18 nt, Artificial Sequence
  Description of Artificial Sequence: Synthetic oligonucleotide
ucgggaggcugaggcagg

SEQ ID NO: 25778 - RNA, 18 nt, Artificial Sequence
  Description of Artificial Sequence: Synthetic oligonucleotide
gcuacucgggaggcugag

SEQ ID NO: 25779 - RNA, 18 nt, Artificial Sequence
  Description of Artificial Sequence: Synthetic oligonucleotide
ucccagcuacucgggagg

SEQ ID NO: 25780 - RNA, 18 nt, Artificial Sequence
  Description of Artificial Sequence: Synthetic oligonucleotide
uguaaucccagcuacucg

SEQ ID NO: 25781 - RNA, 18 nt, Artificial Sequence
  Description of Artificial Sequence: Synthetic oligonucleotide
gugccuguaaucccagcu

SEQ ID NO: 25782 - RNA, 18 nt, Artificial Sequence
  Description of Artificial Sequence: Synthetic oligonucleotide
ggugcgugccuguaaucc

SEQ ID NO: 25783 - RNA, 18 nt, Artificial Sequence
  Description of Artificial Sequence: Synthetic oligonucleotide
guggaggugcgugccugu

SEQ ID NO: 25784 - RNA, 18 nt, Artificial Sequence
  Description of Artificial Sequence: Synthetic oligonucleotide
cggacguggaggugcgug

SEQ ID NO: 25785 - RNA, 18 nt, Artificial Sequence
  Description of Artificial Sequence: Synthetic oligonucleotide
uuagccggacguggaggu

SEQ ID NO: 25786 - RNA, 18 nt, Artificial Sequence
  Description of Artificial Sequence: Synthetic oligonucleotide
caaaauuagccggacgug

SEQ ID NO: 25787 - RNA, 18 nt, Artificial Sequence
  Description of Artificial Sequence: Synthetic oligonucleotide
aaauacaaaauuagccgg

SEQ ID NO: 25788 - RNA, 18 nt, Artificial Sequence
  Description of Artificial Sequence: Synthetic oligonucleotide
acuaaaaauacaaaauua

SEQ ID NO: 25789 - RNA, 18 nt, Artificial Sequence
  Description of Artificial Sequence: Synthetic oligonucleotide
ucuccacuaaaaauacaa

SEQ ID NO: 25790 - RNA, 18 nt, Artificial Sequence
  Description of Artificial Sequence: Synthetic oligonucleotide
ccccgucuccacuaaaaa

SEQ ID NO: 25791 - RNA, 18 nt, Artificial Sequence
  Description of Artificial Sequence: Synthetic oligonucleotide
agaaaccccgucuccacu

SEQ ID NO: 25792 - RNA, 18 nt, Artificial Sequence
  Description of Artificial Sequence: Synthetic oligonucleotide
cauggagaaaccccgucu

SEQ ID NO: 25793 - RNA, 18 nt, Artificial Sequence
  Description of Artificial Sequence: Synthetic oligonucleotide
accgacauggagaaaccc

SEQ ID NO: 25794 - RNA, 18 nt, Artificial Sequence
  Description of Artificial Sequence: Synthetic oligonucleotide
gccugaccgacauggaga

SEQ ID NO: 25795 - RNA, 18 nt, Artificial Sequence
  Description of Artificial Sequence: Synthetic oligonucleotide
gaccagccugaccgacau

SEQ ID NO: 25796 - RNA, 18 nt, Artificial Sequence
  Description of Artificial Sequence: Synthetic oligonucleotide
uucgagaccagccugacc

SEQ ID NO: 25797 - RNA, 18 nt, Artificial Sequence
  Description of Artificial Sequence: Synthetic oligonucleotide
gggaguucgagaccagcc

SEQ ID NO: 25798 - RNA, 18 nt, Artificial Sequence
  Description of Artificial Sequence: Synthetic oligonucleotide
aggucgggaguucgagac

SEQ ID NO: 25799 - RNA, 18 nt, Artificial Sequence
  Description of Artificial Sequence: Synthetic oligonucleotide
accugaggucgggaguuc

SEQ ID NO: 25800 - RNA, 18 nt, Artificial Sequence
  Description of Artificial Sequence: Synthetic oligonucleotide
agaucaccugaggucggg

SEQ ID NO: 25801 - RNA, 18 nt, Artificial Sequence
  Description of Artificial Sequence: Synthetic oligonucleotide
ugggcagaucaccugagg

SEQ ID NO: 25802 - RNA, 18 nt, Artificial Sequence
  Description of Artificial Sequence: Synthetic oligonucleotide
cgaggugggcagaucacc

SEQ ID NO: 25803 - RNA, 18 nt, Artificial Sequence
  Description of Artificial Sequence: Synthetic oligonucleotide
gaggccgaggugggcaga

SEQ ID NO: 25804 - RNA, 18 nt, Artificial Sequence
  Description of Artificial Sequence: Synthetic oligonucleotide
uuugggaggccgaggugg

SEQ ID NO: 25805 - RNA, 18 nt, Artificial Sequence
  Description of Artificial Sequence: Synthetic oligonucleotide
agcacuuugggaggccga

SEQ ID NO: 25806 - RNA, 18 nt, Artificial Sequence
  Description of Artificial Sequence: Synthetic oligonucleotide
aucccagcacuuugggag

SEQ ID NO: 25807 - RNA, 18 nt, Artificial Sequence
  Description of Artificial Sequence: Synthetic oligonucleotide
cuguaaucccagcacuuu

SEQ ID NO: 25808 - RNA, 18 nt, Artificial Sequence
  Description of Artificial Sequence: Synthetic oligonucleotide
caugccuguaaucccagc

SEQ ID NO: 25809 - RNA, 18 nt, Artificial Sequence
  Description of Artificial Sequence: Synthetic oligonucleotide
uggcucaugccuguaauc

SEQ ID NO: 25810 - RNA, 18 nt, Artificial Sequence
  Description of Artificial Sequence: Synthetic oligonucleotide
cgcgguggcucaugccug

SEQ ID NO: 25811 - RNA, 18 nt, Artificial Sequence
  Description of Artificial Sequence: Synthetic oligonucleotide
ccaagcgcgguggcucau

SEQ ID NO: 25812 - RNA, 18 nt, Artificial Sequence
  Description of Artificial Sequence: Synthetic oligonucleotide
ucuggccaagcgcggugg

SEQ ID NO: 25813 - RNA, 18 nt, Artificial Sequence
  Description of Artificial Sequence: Synthetic oligonucleotide
cgcagucuggccaagcgc

SEQ ID NO: 25814 - RNA, 18 nt, Artificial Sequence
  Description of Artificial Sequence: Synthetic oligonucleotide
aaggacgcagucuggcca

SEQ ID NO: 25815 - RNA, 18 nt, Artificial Sequence
  Description of Artificial Sequence: Synthetic oligonucleotide
uuaaaaaggacgcagucu

SEQ ID NO: 25816 - RNA, 18 nt, Artificial Sequence
  Description of Artificial Sequence: Synthetic oligonucleotide
uucgcuuaaaaaggacgc

SEQ ID NO: 25817 - RNA, 18 nt, Artificial Sequence
  Description of Artificial Sequence: Synthetic oligonucleotide
aaauguucgcuuaaaaag

SEQ ID NO: 25818 - RNA, 18 nt, Artificial Sequence
  Description of Artificial Sequence: Synthetic oligonucleotide
cccuaaaauguucgcuua

SEQ ID NO: 25819 - RNA, 18 nt, Artificial Sequence
  Description of Artificial Sequence: Synthetic oligonucleotide
ccaggcccuaaaauguuc

SEQ ID NO: 25820 - RNA, 18 nt, Artificial Sequence
  Description of Artificial Sequence: Synthetic oligonucleotide
aacucccaggcccuaaaa

SEQ ID NO: 25821 - RNA, 18 nt, Artificial Sequence
  Description of Artificial Sequence: Synthetic oligonucleotide
ugacaaacucccaggccc

SEQ ID NO: 25822 - RNA, 18 nt, Artificial Sequence
  Description of Artificial Sequence: Synthetic oligonucleotide
uuacuugacaaacuccca

SEQ ID NO: 25823 - RNA, 18 nt, Artificial Sequence
  Description of Artificial Sequence: Synthetic oligonucleotide
cuuccuuacuugacaaac

SEQ ID NO: 25824 - RNA, 18 nt, Artificial Sequence
  Description of Artificial Sequence: Synthetic oligonucleotide
ugagacuuccuuacuuga

SEQ ID NO: 25825 - RNA, 18 nt, Artificial Sequence
  Description of Artificial Sequence: Synthetic oligonucleotide
gggcuugagacuuccuua

SEQ ID NO: 25826 - RNA, 18 nt, Artificial Sequence
  Description of Artificial Sequence: Synthetic oligonucleotide
ucuuugggcuugagacuu

SEQ ID NO: 25827 - RNA, 18 nt, Artificial Sequence
  Description of Artificial Sequence: Synthetic oligonucleotide
gcugcucuuugggcuuga

SEQ ID NO: 25828 - RNA, 18 nt, Artificial Sequence
  Description of Artificial Sequence: Synthetic oligonucleotide
aggacgcugcucuuuggg

SEQ ID NO: 25829 - RNA, 18 nt, Artificial Sequence
  Description of Artificial Sequence: Synthetic oligonucleotide
uggucaggacgcugcucu

SEQ ID NO: 25830 - RNA, 18 nt, Artificial Sequence
  Description of Artificial Sequence: Synthetic oligonucleotide
caccauggucaggacgcu

SEQ ID NO: 25831 - RNA, 18 nt, Artificial Sequence
  Description of Artificial Sequence: Synthetic oligonucleotide
gaaaccaccauggucagg

SEQ ID NO: 25832 - RNA, 18 nt, Artificial Sequence
  Description of Artificial Sequence: Synthetic oligonucleotide
guaaugaaaccaccaugg

SEQ ID NO: 25833 - RNA, 18 nt, Artificial Sequence
  Description of Artificial Sequence: Synthetic oligonucleotide
ggcucguaaugaaaccac

SEQ ID NO: 25834 - RNA, 18 nt, Artificial Sequence
  Description of Artificial Sequence: Synthetic oligonucleotide
agaagggcucguaaugaa

SEQ ID NO: 25835 - RNA, 18 nt, Artificial Sequence
  Description of Artificial Sequence: Synthetic oligonucleotide
ccagcagaagggcucgua

SEQ ID NO: 25836 - RNA, 18 nt, Artificial Sequence
  Description of Artificial Sequence: Synthetic oligonucleotide
gagagccagcagaagggc

SEQ ID NO: 25837 - RNA, 18 nt, Artificial Sequence
  Description of Artificial Sequence: Synthetic oligonucleotide
ugccugagagccagcaga

SEQ ID NO: 25838 - RNA, 18 nt, Artificial Sequence
  Description of Artificial Sequence: Synthetic oligonucleotide
gcuucugccugagagcca

SEQ ID NO: 25839 - RNA, 18 nt, Artificial Sequence
  Description of Artificial Sequence: Synthetic oligonucleotide
gggcuucugccugagagc

SEQ ID NO: 25840 - RNA, 18 nt, Artificial Sequence
  Description of Artificial Sequence: Synthetic oligonucleotide
uggucccggugcuguggg

SEQ ID NO: 25841 - RNA, 18 nt, Artificial Sequence
  Description of Artificial Sequence: Synthetic oligonucleotide
augaauggucccggugcu

SEQ ID NO: 25842 - RNA, 18 nt, Artificial Sequence
  Description of Artificial Sequence: Synthetic oligonucleotide
accucaugaauggucccg

SEQ ID NO: 25843 - RNA, 18 nt, Artificial Sequence
  Description of Artificial Sequence: Synthetic oligonucleotide
cagugaccucaugaaugg

SEQ ID NO: 25844 - RNA, 18 nt, Artificial Sequence
  Description of Artificial Sequence: Synthetic oligonucleotide
cugggcagugaccucaug

SEQ ID NO: 25845 - RNA, 18 nt, Artificial Sequence
  Description of Artificial Sequence: Synthetic oligonucleotide
augagcugggcagugacc

SEQ ID NO: 25846 - RNA, 18 nt, Artificial Sequence
  Description of Artificial Sequence: Synthetic oligonucleotide
acaucaugagcugggcag

SEQ ID NO: 25847 - RNA, 18 nt, Artificial Sequence
  Description of Artificial Sequence: Synthetic oligonucleotide
cacggacaucaugagcug

SEQ ID NO: 25848 - RNA, 18 nt, Artificial Sequence
  Description of Artificial Sequence: Synthetic oligonucleotide
agccucacggacaucaug

SEQ ID NO: 25849 - RNA, 18 nt, Artificial Sequence
  Description of Artificial Sequence: Synthetic oligonucleotide
aggacagccucacggaca

SEQ ID NO: 25850 - RNA, 18 nt, Artificial Sequence
  Description of Artificial Sequence: Synthetic oligonucleotide
ccaaaaggacagccucac

SEQ ID NO: 25851 - RNA, 18 nt, Artificial Sequence
  Description of Artificial Sequence: Synthetic oligonucleotide
acuggccaaaaggacagc

SEQ ID NO: 25852 - RNA, 18 nt, Artificial Sequence
  Description of Artificial Sequence: Synthetic oligonucleotide
cggcuacuggccaaaagg

SEQ ID NO: 25853 - RNA, 18 nt, Artificial Sequence
  Description of Artificial Sequence: Synthetic oligonucleotide
gcacacggcuacuggcca

SEQ ID NO: 25854 - RNA, 18 nt, Artificial Sequence
  Description of Artificial Sequence: Synthetic oligonucleotide
cagcugcacacggcuacu

SEQ ID NO: 25855 - RNA, 18 nt, Artificial Sequence
  Description of Artificial Sequence: Synthetic oligonucleotide
ccacacagcugcacacgg

SEQ ID NO: 25856 - RNA, 18 nt, Artificial Sequence
  Description of Artificial Sequence: Synthetic oligonucleotide
cugugccacacagcugca

SEQ ID NO: 25857 - RNA, 18 nt, Artificial Sequence
  Description of Artificial Sequence: Synthetic oligonucleotide
gccaucugugccacacag

SEQ ID NO: 25858 - RNA, 18 nt, Artificial Sequence
  Description of Artificial Sequence: Synthetic oligonucleotide
acgaagccaucugugcca

SEQ ID NO: 25859 - RNA, 18 nt, Artificial Sequence
  Description of Artificial Sequence: Synthetic oligonucleotide
gaugaacgaagccaucug

SEQ ID NO: 25860 - RNA, 18 nt, Artificial Sequence
  Description of Artificial Sequence: Synthetic oligonucleotide
aucaggaugaacgaagcc

SEQ ID NO: 25861 - RNA, 18 nt, Artificial Sequence
  Description of Artificial Sequence: Synthetic oligonucleotide
ccuugaucaggaugaacg

SEQ ID NO: 25862 - RNA, 18 nt, Artificial Sequence
  Description of Artificial Sequence: Synthetic oligonucleotide
gggccuugaucaggauga

SEQ ID NO: 25863 - RNA, 18 nt, Artificial Sequence
  Description of Artificial Sequence: Synthetic oligonucleotide
ugcuguggcugagguggg

SEQ ID NO: 25864 - RNA, 18 nt, Artificial Sequence
  Description of Artificial Sequence: Synthetic oligonucleotide
gggacugcuguggcugag

SEQ ID NO: 25865 - RNA, 18 nt, Artificial Sequence
  Description of Artificial Sequence: Synthetic oligonucleotide
gguggacaacacagguug

SEQ ID NO: 25866 - RNA, 18 nt, Artificial Sequence
  Description of Artificial Sequence: Synthetic oligonucleotide
aauaggguggacaacaca

SEQ ID NO: 25867 - RNA, 18 nt, Artificial Sequence
  Description of Artificial Sequence: Synthetic oligonucleotide
ugaauaauaggguggaca

SEQ ID NO: 25868 - RNA, 18 nt, Artificial Sequence
  Description of Artificial Sequence: Synthetic oligonucleotide
guacaugaauaauagggu

SEQ ID NO: 25869 - RNA, 18 nt, Artificial Sequence
  Description of Artificial Sequence: Synthetic oligonucleotide
ggcagguacaugaauaau

SEQ ID NO: 25870 - RNA, 18 nt, Artificial Sequence
  Description of Artificial Sequence: Synthetic oligonucleotide
ggccuggcagguacauga

SEQ ID NO: 25871 - RNA, 18 nt, Artificial Sequence
  Description of Artificial Sequence: Synthetic oligonucleotide
agcagggccuggcaggua

SEQ ID NO: 25872 - RNA, 18 nt, Artificial Sequence
  Description of Artificial Sequence: Synthetic oligonucleotide
uaucuagcagggccuggc

SEQ ID NO: 25873 - RNA, 18 nt, Artificial Sequence
  Description of Artificial Sequence: Synthetic oligonucleotide
ggugcuaucuagcagggc

SEQ ID NO: 25874 - RNA, 18 nt, Artificial Sequence
  Description of Artificial Sequence: Synthetic oligonucleotide
gggugcuaucuagcaggg

SEQ ID NO: 25875 - RNA, 18 nt, Artificial Sequence
  Description of Artificial Sequence: Synthetic oligonucleotide
guuauguaaugccacggg

SEQ ID NO: 25876 - RNA, 18 nt, Artificial Sequence
  Description of Artificial Sequence: Synthetic oligonucleotide
gaaguguuauguaaugcc

SEQ ID NO: 25877 - RNA, 18 nt, Artificial Sequence
  Description of Artificial Sequence: Synthetic oligonucleotide
cucaugaaguguuaugua

SEQ ID NO: 25878 - RNA, 18 nt, Artificial Sequence
  Description of Artificial Sequence: Synthetic oligonucleotide
agccacucaugaaguguu

SEQ ID NO: 25879 - RNA, 18 nt, Artificial Sequence
  Description of Artificial Sequence: Synthetic oligonucleotide
gacacagccacucaugaa

SEQ ID NO: 25880 - RNA, 18 nt, Artificial Sequence
  Description of Artificial Sequence: Synthetic oligonucleotide
uacaagacacagccacuc

SEQ ID NO: 25881 - RNA, 18 nt, Artificial Sequence
  Description of Artificial Sequence: Synthetic oligonucleotide
aaaauuacaagacacagc

SEQ ID NO: 25882 - RNA, 18 nt, Artificial Sequence
  Description of Artificial Sequence: Synthetic oligonucleotide
uccccaaaauuacaagac

SEQ ID NO: 25883 - RNA, 18 nt, Artificial Sequence
  Description of Artificial Sequence: Synthetic oligonucleotide
accuguccccaaaauuac

SEQ ID NO: 25884 - RNA, 18 nt, Artificial Sequence
  Description of Artificial Sequence: Synthetic oligonucleotide
gagaaaccuguccccaaa

SEQ ID NO: 25885 - RNA, 18 nt, Artificial Sequence
  Description of Artificial Sequence: Synthetic oligonucleotide
aaagagagaaaccugucc

SEQ ID NO: 25886 - RNA, 18 nt, Artificial Sequence
  Description of Artificial Sequence: Synthetic oligonucleotide
gagggaaagagagaaacc

SEQ ID NO: 25887 - RNA, 18 nt, Artificial Sequence
  Description of Artificial Sequence: Synthetic oligonucleotide
aaagagagggaaagagag

SEQ ID NO: 25888 - RNA, 18 nt, Artificial Sequence
  Description of Artificial Sequence: Synthetic oligonucleotide
aaaaaaaagagagggaaa

SEQ ID NO: 25889 - RNA, 18 nt, Artificial Sequence
  Description of Artificial Sequence: Synthetic oligonucleotide
uugacaaaaaaaagagag

SEQ ID NO: 25890 - RNA, 18 nt, Artificial Sequence
  Description of Artificial Sequence: Synthetic oligonucleotide
ggcuuuugacaaaaaaaa

SEQ ID NO: 25891 - RNA, 18 nt, Artificial Sequence
  Description of Artificial Sequence: Synthetic oligonucleotide
cucugggcuuuugacaaa

SEQ ID NO: 25892 - RNA, 18 nt, Artificial Sequence
  Description of Artificial Sequence: Synthetic oligonucleotide
ucagucucugggcuuuug

SEQ ID NO: 25893 - RNA, 18 nt, Artificial Sequence
  Description of Artificial Sequence: Synthetic oligonucleotide
gguugucagucucugggc

SEQ ID NO: 25894 - RNA, 18 nt, Artificial Sequence
  Description of Artificial Sequence: Synthetic oligonucleotide
cagcugguugucagucuc

SEQ ID NO: 25895 - RNA, 18 nt, Artificial Sequence
  Description of Artificial Sequence: Synthetic oligonucleotide
cacugcagcugguuguca

SEQ ID NO: 25896 - RNA, 18 nt, Artificial Sequence
  Description of Artificial Sequence: Synthetic oligonucleotide
uuagacacugcagcuggu

SEQ ID NO: 25897 - RNA, 18 nt, Artificial Sequence
  Description of Artificial Sequence: Synthetic oligonucleotide
aacacuuagacacugcag

SEQ ID NO: 25898 - RNA, 18 nt, Artificial Sequence
  Description of Artificial Sequence: Synthetic oligonucleotide
ugaggaacacuuagacac

SEQ ID NO: 25899 - RNA, 18 nt, Artificial Sequence
  Description of Artificial Sequence: Synthetic oligonucleotide
gucagugaggaacacuua

SEQ ID NO: 25900 - RNA, 18 nt, Artificial Sequence
  Description of Artificial Sequence: Synthetic oligonucleotide
acccugucagugaggaac

SEQ ID NO: 25901 - RNA, 18 nt, Artificial Sequence
  Description of Artificial Sequence: Synthetic oligonucleotide
gccccacccugucaguga

SEQ ID NO: 25902 - RNA, 18 nt, Artificial Sequence
  Description of Artificial Sequence: Synthetic oligonucleotide
gugaggccccacccuguc

SEQ ID NO: 25903 - RNA, 18 nt, Artificial Sequence
  Description of Artificial Sequence: Synthetic oligonucleotide
ggguggugaggccccacc

SEQ ID NO: 25904 - RNA, 18 nt, Artificial Sequence
  Description of Artificial Sequence: Synthetic oligonucleotide
gccaacgcugcucccucc

SEQ ID NO: 25905 - RNA, 18 nt, Artificial Sequence
  Description of Artificial Sequence: Synthetic oligonucleotide
ucccugccaacgcugcuc

SEQ ID NO: 25906 - RNA, 18 nt, Artificial Sequence
  Description of Artificial Sequence: Synthetic oligonucleotide
cugucucccugccaacgc

SEQ ID NO: 25907 - RNA, 18 nt, Artificial Sequence
  Description of Artificial Sequence: Synthetic oligonucleotide
ccaggcugucucccugcc

SEQ ID NO: 25908 - RNA, 18 nt, Artificial Sequence
  Description of Artificial Sequence: Synthetic oligonucleotide
cugggccaggcugucucc

SEQ ID NO: 25909 - RNA, 18 nt, Artificial Sequence
  Description of Artificial Sequence: Synthetic oligonucleotide
ggucacugggccaggcug

SEQ ID NO: 25910 - RNA, 18 nt, Artificial Sequence
  Description of Artificial Sequence: Synthetic oligonucleotide
cccagggucacugggcca

SEQ ID NO: 25911 - RNA, 18 nt, Artificial Sequence
  Description of Artificial Sequence: Synthetic oligonucleotide
uugggcccagggucacug

SEQ ID NO: 25912 - RNA, 18 nt, Artificial Sequence
  Description of Artificial Sequence: Synthetic oligonucleotide
cuggcuugggcccagggu

SEQ ID NO: 25913 - RNA, 18 nt, Artificial Sequence
  Description of Artificial Sequence: Synthetic oligonucleotide
gggcuggcuugggcccag

SEQ ID NO: 25914 - RNA, 18 nt, Artificial Sequence
  Description of Artificial Sequence: Synthetic oligonucleotide
ccugaaagcccuggaggg

SEQ ID NO: 25915 - RNA, 18 nt, Artificial Sequence
  Description of Artificial Sequence: Synthetic oligonucleotide
gcuucccugaaagcccug

SEQ ID NO: 25916 - RNA, 18 nt, Artificial Sequence
  Description of Artificial Sequence: Synthetic oligonucleotide
auggcgcuucccugaaag

SEQ ID NO: 25917 - RNA, 18 nt, Artificial Sequence
  Description of Artificial Sequence: Synthetic oligonucleotide
aauggauggcgcuucccu

SEQ ID NO: 25918 - RNA, 18 nt, Artificial Sequence
  Description of Artificial Sequence: Synthetic oligonucleotide
uugaaaauggauggcgcu

SEQ ID NO: 25919 - RNA, 18 nt, Artificial Sequence
  Description of Artificial Sequence: Synthetic oligonucleotide
caucuuugaaaauggaug

SEQ ID NO: 25920 - RNA, 18 nt, Artificial Sequence
  Description of Artificial Sequence: Synthetic oligonucleotide
uuugacaucuuugaaaau

SEQ ID NO: 25921 - RNA, 18 nt, Artificial Sequence
  Description of Artificial Sequence: Synthetic oligonucleotide
ugacguuugacaucuuug

SEQ ID NO: 25922 - RNA, 18 nt, Artificial Sequence
  Description of Artificial Sequence: Synthetic oligonucleotide
agaagugacguuugacau

SEQ ID NO: 25923 - RNA, 18 nt, Artificial Sequence
  Description of Artificial Sequence: Synthetic oligonucleotide
caggaagaagugacguuu

SEQ ID NO: 25924 - RNA, 18 nt, Artificial Sequence
  Description of Artificial Sequence: Synthetic oligonucleotide
cccuacaggaagaaguga

SEQ ID NO: 25925 - RNA, 18 nt, Artificial Sequence
  Description of Artificial Sequence: Synthetic oligonucleotide
ucgggcccuacaggaaga

SEQ ID NO: 25926 - RNA, 18 nt, Artificial Sequence
  Description of Artificial Sequence: Synthetic oligonucleotide
aggacucgggcccuacag

SEQ ID NO: 25927 - RNA, 18 nt, Artificial Sequence
  Description of Artificial Sequence: Synthetic oligonucleotide
gaggcaggacucgggccc

SEQ ID NO: 25928 - RNA, 18 nt, Artificial Sequence
  Description of Artificial Sequence: Synthetic oligonucleotide
gauaggaggcaggacucg

SEQ ID NO: 25929 - RNA, 18 nt, Artificial Sequence
  Description of Artificial Sequence: Synthetic oligonucleotide
gcccugauaggaggcagg

SEQ ID NO: 25930 - RNA, 18 nt, Artificial Sequence
  Description of Artificial Sequence: Synthetic oligonucleotide
aucuggcccugauaggag

SEQ ID NO: 25931 - RNA, 18 nt, Artificial Sequence
  Description of Artificial Sequence: Synthetic oligonucleotide
cuaugaucuggcccugau

SEQ ID NO: 25932 - RNA, 18 nt, Artificial Sequence
  Description of Artificial Sequence: Synthetic oligonucleotide
gccuucuaugaucuggcc

SEQ ID NO: 25933 - RNA, 18 nt, Artificial Sequence
  Description of Artificial Sequence: Synthetic oligonucleotide
aaauagccuucuaugauc

SEQ ID NO: 25934 - RNA, 18 nt, Artificial Sequence
  Description of Artificial Sequence: Synthetic oligonucleotide
auagaaaauagccuucua

SEQ ID NO: 25935 - RNA, 18 nt, Artificial Sequence
  Description of Artificial Sequence: Synthetic oligonucleotide
ccagaauagaaaauagcc

SEQ ID NO: 25936 - RNA, 18 nt, Artificial Sequence
  Description of Artificial Sequence: Synthetic oligonucleotide
guuccccagaauagaaaa

SEQ ID NO: 25937 - RNA, 18 nt, Artificial Sequence
  Description of Artificial Sequence: Synthetic oligonucleotide
uaaucguuccccagaaua

SEQ ID NO: 25938 - RNA, 18 nt, Artificial Sequence
  Description of Artificial Sequence: Synthetic oligonucleotide
aguuauaaucguucccca

SEQ ID NO: 25939 - RNA, 18 nt, Artificial Sequence
  Description of Artificial Sequence: Synthetic oligonucleotide
auuuaaguuauaaucguu

SEQ ID NO: 25940 - RNA, 18 nt, Artificial Sequence
  Description of Artificial Sequence: Synthetic oligonucleotide
caaucauuuaaguuauaa

SEQ ID NO: 25941 - RNA, 18 nt, Artificial Sequence
  Description of Artificial Sequence: Synthetic oligonucleotide
uaaaacaaucauuuaagu

SEQ ID NO: 25942 - RNA, 18 nt, Artificial Sequence
  Description of Artificial Sequence: Synthetic oligonucleotide
uuuauuaaaacaaucauu

SEQ ID NO: 25943 - RNA, 18 nt, Artificial Sequence
  Description of Artificial Sequence: Synthetic oligonucleotide
gaauuuuuauuaaaacaa

SEQ ID NO: 25944 - RNA, 18 nt, Artificial Sequence
  Description of Artificial Sequence: Synthetic oligonucleotide
gcuuagaauuuuuauuaa

SEQ ID NO: 25945 - RNA, 18 nt, Artificial Sequence
  Description of Artificial Sequence: Synthetic oligonucleotide
uuccagcuuagaauuuuu

SEQ ID NO: 25946 - RNA, 18 nt, Artificial Sequence
  Description of Artificial Sequence: Synthetic oligonucleotide
gucuucugccuugggcuu

SEQ ID NO: 25947 - RNA, 18 nt, Artificial Sequence
  Description of Artificial Sequence: Synthetic oligonucleotide
gauaggucuucugccuug

SEQ ID NO: 25948 - RNA, 18 nt, Artificial Sequence
  Description of Artificial Sequence: Synthetic oligonucleotide
augcagauaggucuucug

SEQ ID NO: 25949 - RNA, 18 nt, Artificial Sequence
  Description of Artificial Sequence: Synthetic oligonucleotide
cucaaaugcagauagguc

SEQ ID NO: 25950 - RNA, 18 nt, Artificial Sequence
  Description of Artificial Sequence: Synthetic oligonucleotide
gagggcucaaaugcagau

SEQ ID NO: 25951 - RNA, 18 nt, Artificial Sequence
  Description of Artificial Sequence: Synthetic oligonucleotide
acuuugagggcucaaaug

SEQ ID NO: 25952 - RNA, 18 nt, Artificial Sequence
  Description of Artificial Sequence: Synthetic oligonucleotide
aaccuacuuugagggcuc

SEQ ID NO: 25953 - RNA, 18 nt, Artificial Sequence
  Description of Artificial Sequence: Synthetic oligonucleotide
ggaacaaccuacuuugag

SEQ ID NO: 25954 - RNA, 18 nt, Artificial Sequence
  Description of Artificial Sequence: Synthetic oligonucleotide
caccaucaccacauagag

SEQ ID NO: 25955 - RNA, 18 nt, Artificial Sequence
  Description of Artificial Sequence: Synthetic oligonucleotide
ggcagcaccaucaccaca

SEQ ID NO: 25956 - RNA, 18 nt, Artificial Sequence
  Description of Artificial Sequence: Synthetic oligonucleotide
cagagggcagcaccauca

SEQ ID NO: 25957 - RNA, 18 nt, Artificial Sequence
  Description of Artificial Sequence: Synthetic oligonucleotide
uaucacagagggcagcac

SEQ ID NO: 25958 - RNA, 18 nt, Artificial Sequence
  Description of Artificial Sequence: Synthetic oligonucleotide
guuaguaucacagagggc

SEQ ID NO: 25959 - RNA, 18 nt, Artificial Sequence
  Description of Artificial Sequence: Synthetic oligonucleotide
cacggguuaguaucacag

SEQ ID NO: 25960 - RNA, 18 nt, Artificial Sequence
  Description of Artificial Sequence: Synthetic oligonucleotide
ucaugcacggguuaguau

SEQ ID NO: 25961 - RNA, 18 nt, Artificial Sequence
  Description of Artificial Sequence: Synthetic oligonucleotide
caagcucaugcacggguu

SEQ ID NO: 25962 - RNA, 18 nt, Artificial Sequence
  Description of Artificial Sequence: Synthetic oligonucleotide
acaggcaagcucaugcac

SEQ ID NO: 25963 - RNA, 18 nt, Artificial Sequence
  Description of Artificial Sequence: Synthetic oligonucleotide
cagagacaggcaagcuca

SEQ ID NO: 25964 - RNA, 18 nt, Artificial Sequence
  Description of Artificial Sequence: Synthetic oligonucleotide
gaggacagagacaggcaa

SEQ ID NO: 25965 - RNA, 18 nt, Artificial Sequence
  Description of Artificial Sequence: Synthetic oligonucleotide
ggcccgaggacagagaca

SEQ ID NO: 25966 - RNA, 18 nt, Artificial Sequence
  Description of Artificial Sequence: Synthetic oligonucleotide
aguguggcccgaggacag

SEQ ID NO: 25967 - RNA, 18 nt, Artificial Sequence
  Description of Artificial Sequence: Synthetic oligonucleotide
ggcucaguguggcccgag

SEQ ID NO: 25968 - RNA, 18 nt, Artificial Sequence
  Description of Artificial Sequence: Synthetic oligonucleotide
guaagggcucaguguggc

SEQ ID NO: 25969 - RNA, 18 nt, Artificial Sequence
  Description of Artificial Sequence: Synthetic oligonucleotide
cccucguaagggcucagu

SEQ ID NO: 25970 - RNA, 18 nt, Artificial Sequence
  Description of Artificial Sequence: Synthetic oligonucleotide
accugcccucguaagggc

SEQ ID NO: 25971 - RNA, 18 nt, Artificial Sequence
  Description of Artificial Sequence: Synthetic oligonucleotide
gcaccaccugcccucgua

SEQ ID NO: 25972 - RNA, 18 nt, Artificial Sequence
  Description of Artificial Sequence: Synthetic oligonucleotide
cccaggcaccaccugccc

SEQ ID NO: 25973 - RNA, 18 nt, Artificial Sequence
  Description of Artificial Sequence: Synthetic oligonucleotide
caguacccaggcaccacc

SEQ ID NO: 25974 - RNA, 18 nt, Artificial Sequence
  Description of Artificial Sequence: Synthetic oligonucleotide
gcggccaguacccaggca

SEQ ID NO: 25975 - RNA, 18 nt, Artificial Sequence
  Description of Artificial Sequence: Synthetic oligonucleotide
augcugcggccaguaccc

SEQ ID NO: 25976 - RNA, 18 nt, Artificial Sequence
  Description of Artificial Sequence: Synthetic oligonucleotide
aaagcaugcugcggccag

SEQ ID NO: 25977 - RNA, 18 nt, Artificial Sequence
  Description of Artificial Sequence: Synthetic oligonucleotide
gacucaaagcaugcugcg

SEQ ID NO: 25978 - RNA, 18 nt, Artificial Sequence
  Description of Artificial Sequence: Synthetic oligonucleotide
uuuuagacucaaagcaug

SEQ ID NO: 25979 - RNA, 18 nt, Artificial Sequence
  Description of Artificial Sequence: Synthetic oligonucleotide
ccuacuuuuagacucaaa

SEQ ID NO: 25980 - RNA, 18 nt, Artificial Sequence
  Description of Artificial Sequence: Synthetic oligonucleotide
gggugccuacuuuuagac

SEQ ID NO: 25981 - RNA, 18 nt, Artificial Sequence
  Description of Artificial Sequence: Synthetic oligonucleotide
agggugggugccuacuuu

SEQ ID NO: 25982 - RNA, 18 nt, Artificial Sequence
  Description of Artificial Sequence: Synthetic oligonucleotide
uucacagggugggugccu

SEQ ID NO: 25983 - RNA, 18 nt, Artificial Sequence
  Description of Artificial Sequence: Synthetic oligonucleotide
cuggcuucacaggguggg

SEQ ID NO: 25984 - RNA, 18 nt, Artificial Sequence
  Description of Artificial Sequence: Synthetic oligonucleotide
cuggucuggcuucacagg

SEQ ID NO: 25985 - RNA, 18 nt, Artificial Sequence
  Description of Artificial Sequence: Synthetic oligonucleotide
ggaggcuggucuggcuuc

SEQ ID NO: 25986 - RNA, 18 nt, Artificial Sequence
  Description of Artificial Sequence: Synthetic oligonucleotide
gcccuggaggcuggucug

SEQ ID NO: 25987 - RNA, 18 nt, Artificial Sequence
  Description of Artificial Sequence: Synthetic oligonucleotide
gggcccuggaggcugguc

SEQ ID NO: 25988 - RNA, 18 nt, Artificial Sequence
  Description of Artificial Sequence: Synthetic oligonucleotide
acgaggcagucuucuggg

SEQ ID NO: 25989 - RNA, 18 nt, Artificial Sequence
  Description of Artificial Sequence: Synthetic oligonucleotide
ucggaacgaggcagucuu

SEQ ID NO: 25990 - RNA, 18 nt, Artificial Sequence
  Description of Artificial Sequence: Synthetic oligonucleotide
gcucuucggaacgaggca

SEQ ID NO: 25991 - RNA, 18 nt, Artificial Sequence
  Description of Artificial Sequence: Synthetic oligonucleotide
gacaugcucuucggaacg

SEQ ID NO: 25992 - RNA, 18 nt, Artificial Sequence
  Description of Artificial Sequence: Synthetic oligonucleotide
cccaugacaugcucuucg

SEQ ID NO: 25993 - RNA, 18 nt, Artificial Sequence
  Description of Artificial Sequence: Synthetic oligonucleotide
acagccccaugacaugcu

SEQ ID NO: 25994 - RNA, 18 nt, Artificial Sequence
  Description of Artificial Sequence: Synthetic oligonucleotide
guccuacagccccaugac

SEQ ID NO: 25995 - RNA, 18 nt, Artificial Sequence
  Description of Artificial Sequence: Synthetic oligonucleotide
ggcugguccuacagcccc

SEQ ID NO: 25996 - RNA, 18 nt, Artificial Sequence
  Description of Artificial Sequence: Synthetic oligonucleotide
agaauggcugguccuaca

SEQ ID NO: 25997 - RNA, 18 nt, Artificial Sequence
  Description of Artificial Sequence: Synthetic oligonucleotide
ugggaagaauggcugguc

SEQ ID NO: 25998 - RNA, 18 nt, Artificial Sequence
  Description of Artificial Sequence: Synthetic oligonucleotide
cgagaugggaagaauggc

SEQ ID NO: 25999 - RNA, 18 nt, Artificial Sequence
  Description of Artificial Sequence: Synthetic oligonucleotide
ugacccgagaugggaaga

SEQ ID NO: 26000 - RNA, 18 nt, Artificial Sequence
  Description of Artificial Sequence: Synthetic oligonucleotide
aacaaugacccgagaugg

SEQ ID NO: 26001 - RNA, 18 nt, Artificial Sequence
  Description of Artificial Sequence: Synthetic oligonucleotide
agcccaacaaugacccga

SEQ ID NO: 26002 - RNA, 18 nt, Artificial Sequence
  Description of Artificial Sequence: Synthetic oligonucleotide
uccccagcccaacaauga

SEQ ID NO: 26003 - RNA, 18 nt, Artificial Sequence
  Description of Artificial Sequence: Synthetic oligonucleotide
aaccuuccccagcccaac

SEQ ID NO: 26004 - RNA, 18 nt, Artificial Sequence
  Description of Artificial Sequence: Synthetic oligonucleotide
gccauaaccuuccccagc

SEQ ID NO: 26005 - RNA, 18 nt, Artificial Sequence
  Description of Artificial Sequence: Synthetic oligonucleotide
aagaagccauaaccuucc

SEQ ID NO: 26006 - RNA, 18 nt, Artificial Sequence
  Description of Artificial Sequence: Synthetic oligonucleotide
uggacaagaagccauaac

SEQ ID NO: 26007 - RNA, 18 nt, Artificial Sequence
  Description of Artificial Sequence: Synthetic oligonucleotide
cugacuggacaagaagcc

SEQ ID NO: 26008 - RNA, 18 nt, Artificial Sequence
  Description of Artificial Sequence: Synthetic oligonucleotide
cacaccugacuggacaag

SEQ ID NO: 26009 - RNA, 18 nt, Artificial Sequence
  Description of Artificial Sequence: Synthetic oligonucleotide
uuagacacaccugacugg

SEQ ID NO: 26010 - RNA, 18 nt, Artificial Sequence
  Description of Artificial Sequence: Synthetic oligonucleotide
gacuuuuagacacaccug

SEQ ID NO: 26011 - RNA, 18 nt, Artificial Sequence
  Description of Artificial Sequence: Synthetic oligonucleotide
caaaggacuuuuagacac

SEQ ID NO: 26012 - RNA, 18 nt, Artificial Sequence
  Description of Artificial Sequence: Synthetic oligonucleotide
caagacaaaggacuuuua

SEQ ID NO: 26013 - RNA, 18 nt, Artificial Sequence
  Description of Artificial Sequence: Synthetic oligonucleotide
gccaccaagacaaaggac

SEQ ID NO: 26014 - RNA, 18 nt, Artificial Sequence
  Description of Artificial Sequence: Synthetic oligonucleotide
aguaugccaccaagacaa

SEQ ID NO: 26015 - RNA, 18 nt, Artificial Sequence
  Description of Artificial Sequence: Synthetic oligonucleotide
cuaggaguaugccaccaa

SEQ ID NO: 26016 - RNA, 18 nt, Artificial Sequence
  Description of Artificial Sequence: Synthetic oligonucleotide
ccaugcuaggaguaugcc

SEQ ID NO: 26017 - RNA, 18 nt, Artificial Sequence
  Description of Artificial Sequence: Synthetic oligonucleotide
cauuuccaugcuaggagu

SEQ ID NO: 26018 - RNA, 18 nt, Artificial Sequence
  Description of Artificial Sequence: Synthetic oligonucleotide
gaccccauuuccaugcua

SEQ ID NO: 26019 - RNA, 18 nt, Artificial Sequence
  Description of Artificial Sequence: Synthetic oligonucleotide
agauugaccccauuucca

SEQ ID NO: 26020 - RNA, 18 nt, Artificial Sequence
  Description of Artificial Sequence: Synthetic oligonucleotide
ugcccagauugaccccau

SEQ ID NO: 26021 - RNA, 18 nt, Artificial Sequence
  Description of Artificial Sequence: Synthetic oligonucleotide
caaagugcccagauugac

SEQ ID NO: 26022 - RNA, 18 nt, Artificial Sequence
  Description of Artificial Sequence: Synthetic oligonucleotide
gucuccaaagugcccaga

SEQ ID NO: 26023 - RNA, 18 nt, Artificial Sequence
  Description of Artificial Sequence: Synthetic oligonucleotide
caccagucuccaaagugc

SEQ ID NO: 26024 - RNA, 18 nt, Artificial Sequence
  Description of Artificial Sequence: Synthetic oligonucleotide
aaacacaccagucuccaa

SEQ ID NO: 26025 - RNA, 18 nt, Artificial Sequence
  Description of Artificial Sequence: Synthetic oligonucleotide
gaguuaaacacaccaguc

SEQ ID NO: 26026 - RNA, 18 nt, Artificial Sequence
  Description of Artificial Sequence: Synthetic oligonucleotide
aucuugaguuaaacacac

SEQ ID NO: 26027 - RNA, 18 nt, Artificial Sequence
  Description of Artificial Sequence: Synthetic oligonucleotide
ucuugaucuugaguuaaa

SEQ ID NO: 26028 - RNA, 18 nt, Artificial Sequence
  Description of Artificial Sequence: Synthetic oligonucleotide
aaaggucuugaucuugag

SEQ ID NO: 26029 - RNA, 18 nt, Artificial Sequence
  Description of Artificial Sequence: Synthetic oligonucleotide
gcauaaaaggucuugauc

SEQ ID NO: 26030 - RNA, 18 nt, Artificial Sequence
  Description of Artificial Sequence: Synthetic oligonucleotide
ucaacgcauaaaaggucu

SEQ ID NO: 26031 - RNA, 18 nt, Artificial Sequence
  Description of Artificial Sequence: Synthetic oligonucleotide
ggcugucaacgcauaaaa

SEQ ID NO: 26032 - RNA, 18 nt, Artificial Sequence
  Description of Artificial Sequence: Synthetic oligonucleotide
ugagaggcugucaacgca

SEQ ID NO: 26033 - RNA, 18 nt, Artificial Sequence
  Description of Artificial Sequence: Synthetic oligonucleotide
ggucuugagaggcuguca

SEQ ID NO: 26034 - RNA, 18 nt, Artificial Sequence
  Description of Artificial Sequence: Synthetic oligonucleotide
ccaugggucuugagaggc

SEQ ID NO: 26035 - RNA, 18 nt, Artificial Sequence
  Description of Artificial Sequence: Synthetic oligonucleotide
ugugaccaugggucuuga

SEQ ID NO: 26036 - RNA, 18 nt, Artificial Sequence
  Description of Artificial Sequence: Synthetic oligonucleotide
ccaggugugaccaugggu

SEQ ID NO: 26037 - RNA, 18 nt, Artificial Sequence
  Description of Artificial Sequence: Synthetic oligonucleotide
agcugccaggugugacca

SEQ ID NO: 26038 - RNA, 18 nt, Artificial Sequence
  Description of Artificial Sequence: Synthetic oligonucleotide
ccagaagcugccaggugu

SEQ ID NO: 26039 - RNA, 18 nt, Artificial Sequence
  Description of Artificial Sequence: Synthetic oligonucleotide
cacuaccagaagcugcca

SEQ ID NO: 26040 - RNA, 18 nt, Artificial Sequence
  Description of Artificial Sequence: Synthetic oligonucleotide
ugccccacuaccagaagc

SEQ ID NO: 26041 - RNA, 18 nt, Artificial Sequence
  Description of Artificial Sequence: Synthetic oligonucleotide
ccuuuugccccacuacca

SEQ ID NO: 26042 - RNA, 18 nt, Artificial Sequence
  Description of Artificial Sequence: Synthetic oligonucleotide
gcaacccuuuugccccac

SEQ ID NO: 26043 - RNA, 18 nt, Artificial Sequence
  Description of Artificial Sequence: Synthetic oligonucleotide
cacaagcaacccuuuugc

SEQ ID NO: 26044 - RNA, 18 nt, Artificial Sequence
  Description of Artificial Sequence: Synthetic oligonucleotide
gccagcacaagcaacccu

SEQ ID NO: 26045 - RNA, 18 nt, Artificial Sequence
  Description of Artificial Sequence: Synthetic oligonucleotide
aaugagccagcacaagca

SEQ ID NO: 26046 - RNA, 18 nt, Artificial Sequence
  Description of Artificial Sequence: Synthetic oligonucleotide
aggaaaaugagccagcac

SEQ ID NO: 26047 - RNA, 18 nt, Artificial Sequence
  Description of Artificial Sequence: Synthetic oligonucleotide
ucuaaaggaaaaugagcc

SEQ ID NO: 26048 - RNA, 18 nt, Artificial Sequence
  Description of Artificial Sequence: Synthetic oligonucleotide
aaagcucuaaaggaaaau

SEQ ID NO: 26049 - RNA, 18 nt, Artificial Sequence
  Description of Artificial Sequence: Synthetic oligonucleotide
aagggaaagcucuaaagg

SEQ ID NO: 26050 - RNA, 18 nt, Artificial Sequence
  Description of Artificial Sequence: Synthetic oligonucleotide
gcagaaagggaaagcucu

SEQ ID NO: 26051 - RNA, 18 nt, Artificial Sequence
  Description of Artificial Sequence: Synthetic oligonucleotide
ugugugcagaaagggaaa

SEQ ID NO: 26052 - RNA, 18 nt, Artificial Sequence
  Description of Artificial Sequence: Synthetic oligonucleotide
uuaccccuucuacuccug

SEQ ID NO: 26053 - RNA, 18 nt, Artificial Sequence
  Description of Artificial Sequence: Synthetic oligonucleotide
agaguuuaccccuucuac

SEQ ID NO: 26054 - RNA, 18 nt, Artificial Sequence
  Description of Artificial Sequence: Synthetic oligonucleotide
gaggaagaguuuaccccu

SEQ ID NO: 26055 - RNA, 18 nt, Artificial Sequence
  Description of Artificial Sequence: Synthetic oligonucleotide
cagaugaggaagaguuua

SEQ ID NO: 26056 - RNA, 18 nt, Artificial Sequence
  Description of Artificial Sequence: Synthetic oligonucleotide
uguggcagaugaggaaga

SEQ ID NO: 26057 - RNA, 18 nt, Artificial Sequence
  Description of Artificial Sequence: Synthetic oligonucleotide
aggccuguggcagaugag

SEQ ID NO: 26058 - RNA, 18 nt, Artificial Sequence
  Description of Artificial Sequence: Synthetic oligonucleotide
aaggcaggccuguggcag

SEQ ID NO: 26059 - RNA, 18 nt, Artificial Sequence
  Description of Artificial Sequence: Synthetic oligonucleotide
gaggcaaggcaggccugu

SEQ ID NO: 26060 - RNA, 18 nt, Artificial Sequence
  Description of Artificial Sequence: Synthetic oligonucleotide
ggccugaggcaaggcagg

SEQ ID NO: 26061 - RNA, 18 nt, Artificial Sequence
  Description of Artificial Sequence: Synthetic oligonucleotide
gacguggccugaggcaag

SEQ ID NO: 26062 - RNA, 18 nt, Artificial Sequence
  Description of Artificial Sequence: Synthetic oligonucleotide
aaggugacguggccugag

SEQ ID NO: 26063 - RNA, 18 nt, Artificial Sequence
  Description of Artificial Sequence: Synthetic oligonucleotide
ccuggcaacauggcuggg

SEQ ID NO: 26064 - RNA, 18 nt, Artificial Sequence
  Description of Artificial Sequence: Synthetic oligonucleotide
caugcccuggcaacaugg

SEQ ID NO: 26065 - RNA, 18 nt, Artificial Sequence
  Description of Artificial Sequence: Synthetic oligonucleotide
guccucaugcccuggcaa

SEQ ID NO: 26066 - RNA, 18 nt, Artificial Sequence
  Description of Artificial Sequence: Synthetic oligonucleotide
ucuuaguccucaugcccu

SEQ ID NO: 26067 - RNA, 18 nt, Artificial Sequence
  Description of Artificial Sequence: Synthetic oligonucleotide
aagcaucuuaguccucau

SEQ ID NO: 26068 - RNA, 18 nt, Artificial Sequence
  Description of Artificial Sequence: Synthetic oligonucleotide
agggcaagcaucuuaguc

SEQ ID NO: 26069 - RNA, 18 nt, Artificial Sequence
  Description of Artificial Sequence: Synthetic oligonucleotide
uuggcagggcaagcaucu

SEQ ID NO: 26070 - RNA, 18 nt, Artificial Sequence
  Description of Artificial Sequence: Synthetic oligonucleotide
cgggcuuggcagggcaag

SEQ ID NO: 26071 - RNA, 18 nt, Artificial Sequence
  Description of Artificial Sequence: Synthetic oligonucleotide
cccuccgggcuuggcagg

SEQ ID NO: 26072 - RNA, 18 nt, Artificial Sequence
  Description of Artificial Sequence: Synthetic oligonucleotide
ucauccccuccgggcuug

SEQ ID NO: 26073 - RNA, 18 nt, Artificial Sequence
  Description of Artificial Sequence: Synthetic oligonucleotide
gcugcucauccccuccgg

SEQ ID NO: 26074 - RNA, 18 nt, Artificial Sequence
  Description of Artificial Sequence: Synthetic oligonucleotide
cugaggcugcucaucccc

SEQ ID NO: 26075 - RNA, 18 nt, Artificial Sequence
  Description of Artificial Sequence: Synthetic oligonucleotide
accagcugaggcugcuca

SEQ ID NO: 26076 - RNA, 18 nt, Artificial Sequence
  Description of Artificial Sequence: Synthetic oligonucleotide
gcggcaccagcugaggcu

SEQ ID NO: 26077 - RNA, 18 nt, Artificial Sequence
  Description of Artificial Sequence: Synthetic oligonucleotide
cuguggcggcaccagcug

SEQ ID NO: 26078 - RNA, 18 nt, Artificial Sequence
  Description of Artificial Sequence: Synthetic oligonucleotide
gcugucuguggcggcacc

SEQ ID NO: 26079 - RNA, 18 nt, Artificial Sequence
  Description of Artificial Sequence: Synthetic oligonucleotide
ggugugcugucuguggcg

SEQ ID NO: 26080 - RNA, 18 nt, Artificial Sequence
  Description of Artificial Sequence: Synthetic oligonucleotide
ucuguggugugcugucug

SEQ ID NO: 26081 - RNA, 18 nt, Artificial Sequence
  Description of Artificial Sequence: Synthetic oligonucleotide
ccaccucuguggugugcu

SEQ ID NO: 26082 - RNA, 18 nt, Artificial Sequence
  Description of Artificial Sequence: Synthetic oligonucleotide
cugagccaccucuguggu

SEQ ID NO: 26083 - RNA, 18 nt, Artificial Sequence
  Description of Artificial Sequence: Synthetic oligonucleotide
ggucccugagccaccucu

SEQ ID NO: 26084 - RNA, 18 nt, Artificial Sequence
  Description of Artificial Sequence: Synthetic oligonucleotide
accaaggucccugagcca

SEQ ID NO: 26085 - RNA, 18 nt, Artificial Sequence
  Description of Artificial Sequence: Synthetic oligonucleotide
caucuaccaaggucccug

SEQ ID NO: 26086 - RNA, 18 nt, Artificial Sequence
  Description of Artificial Sequence: Synthetic oligonucleotide
auucccaucuaccaaggu

SEQ ID NO: 26087 - RNA, 18 nt, Artificial Sequence
  Description of Artificial Sequence: Synthetic oligonucleotide
cucacauucccaucuacc

SEQ ID NO: 26088 - RNA, 18 nt, Artificial Sequence
  Description of Artificial Sequence: Synthetic oligonucleotide
agauucucacauucccau

SEQ ID NO: 26089 - RNA, 18 nt, Artificial Sequence
  Description of Artificial Sequence: Synthetic oligonucleotide
uuaauagauucucacauu

SEQ ID NO: 26090 - RNA, 18 nt, Artificial Sequence
  Description of Artificial Sequence: Synthetic oligonucleotide
cuauuuuaauagauucuc

SEQ ID NO: 26091 - RNA, 18 nt, Artificial Sequence
  Description of Artificial Sequence: Synthetic oligonucleotide
ccugccuauuuuaauaga

SEQ ID NO: 26092 - RNA, 18 nt, Artificial Sequence
  Description of Artificial Sequence: Synthetic oligonucleotide
agaucccugccuauuuua

SEQ ID NO: 26093 - RNA, 18 nt, Artificial Sequence
  Description of Artificial Sequence: Synthetic oligonucleotide
accggagaucccugccua

SEQ ID NO: 26094 - RNA, 18 nt, Artificial Sequence
  Description of Artificial Sequence: Synthetic oligonucleotide
agaggaccggagaucccu

SEQ ID NO: 26095 - RNA, 18 nt, Artificial Sequence
  Description of Artificial Sequence: Synthetic oligonucleotide
uugacagaggaccggaga

SEQ ID NO: 26096 - RNA, 18 nt, Artificial Sequence
  Description of Artificial Sequence: Synthetic oligonucleotide
gccucuugacagaggacc

SEQ ID NO: 26097 - RNA, 18 nt, Artificial Sequence
  Description of Artificial Sequence: Synthetic oligonucleotide
gcauugccucuugacaga

SEQ ID NO: 26098 - RNA, 18 nt, Artificial Sequence
  Description of Artificial Sequence: Synthetic oligonucleotide
cgucagcauugccucuug

SEQ ID NO: 26099 - RNA, 18 nt, Artificial Sequence
  Description of Artificial Sequence: Synthetic oligonucleotide
aaagccgucagcauugcc

SEQ ID NO: 26100 - RNA, 18 nt, Artificial Sequence
  Description of Artificial Sequence: Synthetic oligonucleotide
aggaaaaagccgucagca

SEQ ID NO: 26101 - RNA, 18 nt, Artificial Sequence
  Description of Artificial Sequence: Synthetic oligonucleotide
ccagcaggaaaaagccgu

SEQ ID NO: 26102 - RNA, 18 nt, Artificial Sequence
  Description of Artificial Sequence: Synthetic oligonucleotide
gcacgccagcaggaaaaa

SEQ ID NO: 26103 - RNA, 18 nt, Artificial Sequence
  Description of Artificial Sequence: Synthetic oligonucleotide
cagaggcacgccagcagg

SEQ ID NO: 26104 - RNA, 18 nt, Artificial Sequence
  Description of Artificial Sequence: Synthetic oligonucleotide
gugggcagaggcacgcca

SEQ ID NO: 26105 - RNA, 18 nt, Artificial Sequence
  Description of Artificial Sequence: Synthetic oligonucleotide
ggcuggugggcagaggca

SEQ ID NO: 26106 - RNA, 18 nt, Artificial Sequence
  Description of Artificial Sequence: Synthetic oligonucleotide
gggaaggcuggugggcag

SEQ ID NO: 26107 - RNA, 18 nt, Artificial Sequence
  Description of Artificial Sequence: Synthetic oligonucleotide
aaugaggaugugcaaggg

SEQ ID NO: 26108 - RNA, 18 nt, Artificial Sequence
  Description of Artificial Sequence: Synthetic oligonucleotide
acaaaugaggaugugcaa

SEQ ID NO: 26109 - RNA, 18 nt, Artificial Sequence
  Description of Artificial Sequence: Synthetic oligonucleotide
aggugacaaaugaggaug

SEQ ID NO: 26110 - RNA, 18 nt, Artificial Sequence
  Description of Artificial Sequence: Synthetic oligonucleotide
uuaggaggugacaaauga

SEQ ID NO: 26111 - RNA, 18 nt, Artificial Sequence
  Description of Artificial Sequence: Synthetic oligonucleotide
ucaaauuaggaggugaca

SEQ ID NO: 26112 - RNA, 18 nt, Artificial Sequence
  Description of Artificial Sequence: Synthetic oligonucleotide
auaauucaaauuaggagg

SEQ ID NO: 26113 - RNA, 18 nt, Artificial Sequence
  Description of Artificial Sequence: Synthetic oligonucleotide
gcccaauaauucaaauua

SEQ ID NO: 26114 - RNA, 18 nt, Artificial Sequence
  Description of Artificial Sequence: Synthetic oligonucleotide
gauuugcccaauaauuca

SEQ ID NO: 26115 - RNA, 18 nt, Artificial Sequence
  Description of Artificial Sequence: Synthetic oligonucleotide
ggccagauuugcccaaua

SEQ ID NO: 26116 - RNA, 18 nt, Artificial Sequence
  Description of Artificial Sequence: Synthetic oligonucleotide
uaagcggccagauuugcc

SEQ ID NO: 26117 - RNA, 18 nt, Artificial Sequence
  Description of Artificial Sequence: Synthetic oligonucleotide
ccaaauaagcggccagau

SEQ ID NO: 26118 - RNA, 18 nt, Artificial Sequence
  Description of Artificial Sequence: Synthetic oligonucleotide
cagucccaaauaagcggc

SEQ ID NO: 26119 - RNA, 18 nt, Artificial Sequence
  Description of Artificial Sequence: Synthetic oligonucleotide
gcugucagucccaaauaa

SEQ ID NO: 26120 - RNA, 18 nt, Artificial Sequence
  Description of Artificial Sequence: Synthetic oligonucleotide
aguuggcugucaguccca

SEQ ID NO: 26121 - RNA, 18 nt, Artificial Sequence
  Description of Artificial Sequence: Synthetic oligonucleotide
caagaaguuggcugucag

SEQ ID NO: 26122 - RNA, 18 nt, Artificial Sequence
  Description of Artificial Sequence: Synthetic oligonucleotide
augcucaagaaguuggcu

SEQ ID NO: 26123 - RNA, 18 nt, Artificial Sequence
  Description of Artificial Sequence: Synthetic oligonucleotide
aauagaugcucaagaagu

SEQ ID NO: 26124 - RNA, 18 nt, Artificial Sequence
  Description of Artificial Sequence: Synthetic oligonucleotide
guucaaauagaugcucaa

SEQ ID NO: 26125 - RNA, 18 nt, Artificial Sequence
  Description of Artificial Sequence: Synthetic oligonucleotide
aggcuguucaaauagaug

SEQ ID NO: 26126 - RNA, 18 nt, Artificial Sequence
  Description of Artificial Sequence: Synthetic oligonucleotide
agggaaggcuguucaaau

SEQ ID NO: 26127 - RNA, 18 nt, Artificial Sequence
  Description of Artificial Sequence: Synthetic oligonucleotide
gcgaaagggaaggcuguu

SEQ ID NO: 26128 - RNA, 18 nt, Artificial Sequence
  Description of Artificial Sequence: Synthetic oligonucleotide
ugggagcgaaagggaagg

SEQ ID NO: 26129 - RNA, 18 nt, Artificial Sequence
  Description of Artificial Sequence: Synthetic oligonucleotide
guggcugggagcgaaagg

SEQ ID NO: 26130 - RNA, 18 nt, Artificial Sequence
  Description of Artificial Sequence: Synthetic oligonucleotide
caaagguggcugggagcg

SEQ ID NO: 26131 - RNA, 18 nt, Artificial Sequence
  Description of Artificial Sequence: Synthetic oligonucleotide
caccucaaagguggcugg

SEQ ID NO: 26132 - RNA, 18 nt, Artificial Sequence
  Description of Artificial Sequence: Synthetic oligonucleotide
ggacucaccucaaaggug

SEQ ID NO: 26133 - RNA, 18 nt, Artificial Sequence
  Description of Artificial Sequence: Synthetic oligonucleotide
cacuuggacucaccucaa

SEQ ID NO: 26134 - RNA, 18 nt, Artificial Sequence
  Description of Artificial Sequence: Synthetic oligonucleotide
ccugccacuuggacucac

SEQ ID NO: 26135 - RNA, 18 nt, Artificial Sequence
  Description of Artificial Sequence: Synthetic oligonucleotide
ccuguccugccacuugga

SEQ ID NO: 26136 - RNA, 18 nt, Artificial Sequence
  Description of Artificial Sequence: Synthetic oligonucleotide
aggguccuguccugccac

SEQ ID NO: 26137 - RNA, 18 nt, Artificial Sequence
  Description of Artificial Sequence: Synthetic oligonucleotide
cacacaggguccuguccu

SEQ ID NO: 26138 - RNA, 18 nt, Artificial Sequence
  Description of Artificial Sequence: Synthetic oligonucleotide
ucugucacacaggguccu

SEQ ID NO: 26139 - RNA, 18 nt, Artificial Sequence
  Description of Artificial Sequence: Synthetic oligonucleotide
uccgcucugucacacagg

SEQ ID NO: 26140 - RNA, 18 nt, Artificial Sequence
  Description of Artificial Sequence: Synthetic oligonucleotide
agaccuccgcucugucac

SEQ ID NO: 26141 - RNA, 18 nt, Artificial Sequence
  Description of Artificial Sequence: Synthetic oligonucleotide
gcacaagaccuccgcucu

SEQ ID NO: 26142 - RNA, 18 nt, Artificial Sequence
  Description of Artificial Sequence: Synthetic oligonucleotide
agagggcacaagaccucc

SEQ ID NO: 26143 - RNA, 18 nt, Artificial Sequence
  Description of Artificial Sequence: Synthetic oligonucleotide
agcugagagggcacaaga

SEQ ID NO: 26144 - RNA, 18 nt, Artificial Sequence
  Description of Artificial Sequence: Synthetic oligonucleotide
gaagaagcugagagggca

SEQ ID NO: 26145 - RNA, 18 nt, Artificial Sequence
  Description of Artificial Sequence: Synthetic oligonucleotide
uggcgcucugcaagguga

SEQ ID NO: 26146 - RNA, 18 nt, Artificial Sequence
  Description of Artificial Sequence: Synthetic oligonucleotide
ggacuuggcgcucugcaa

SEQ ID NO: 26147 - RNA, 18 nt, Artificial Sequence
  Description of Artificial Sequence: Synthetic oligonucleotide
acucgggacuuggcgcuc

SEQ ID NO: 26148 - RNA, 18 nt, Artificial Sequence
  Description of Artificial Sequence: Synthetic oligonucleotide
aggccacucgggacuugg

SEQ ID NO: 26149 - RNA, 18 nt, Artificial Sequence
  Description of Artificial Sequence: Synthetic oligonucleotide
aaagaaggccacucggga

SEQ ID NO: 26150 - RNA, 18 nt, Artificial Sequence
  Description of Artificial Sequence: Synthetic oligonucleotide
ucuucaaagaaggccacu

SEQ ID NO: 26151 - RNA, 18 nt, Artificial Sequence
  Description of Artificial Sequence: Synthetic oligonucleotide
agagcucuucaaagaagg

SEQ ID NO: 26152 - RNA, 18 nt, Artificial Sequence
  Description of Artificial Sequence: Synthetic oligonucleotide
cugcuagagcucuucaaa

SEQ ID NO: 26153 - RNA, 18 nt, Artificial Sequence
  Description of Artificial Sequence: Synthetic oligonucleotide
gucaccugcuagagcucu

SEQ ID NO: 26154 - RNA, 18 nt, Artificial Sequence
  Description of Artificial Sequence: Synthetic oligonucleotide
gcugggucaccugcuaga

SEQ ID NO: 26155 - RNA, 18 nt, Artificial Sequence
  Description of Artificial Sequence: Synthetic oligonucleotide
ggguggcugggucaccug

SEQ ID NO: 26156 - RNA, 18 nt, Artificial Sequence
  Description of Artificial Sequence: Synthetic oligonucleotide
aggagaaguggcaggucc

SEQ ID NO: 26157 - RNA, 18 nt, Artificial Sequence
  Description of Artificial Sequence: Synthetic oligonucleotide
guagcaggagaaguggca

SEQ ID NO: 26158 - RNA, 18 nt, Artificial Sequence
  Description of Artificial Sequence: Synthetic oligonucleotide
ucccgguagcaggagaag

SEQ ID NO: 26159 - RNA, 18 nt, Artificial Sequence
  Description of Artificial Sequence: Synthetic oligonucleotide
cgcggucccgguagcagg

SEQ ID NO: 26160 - RNA, 18 nt, Artificial Sequence
  Description of Artificial Sequence: Synthetic oligonucleotide
caucccgcggucccggua

SEQ ID NO: 26161 - RNA, 18 nt, Artificial Sequence
  Description of Artificial Sequence: Synthetic oligonucleotide
ugguccaucccgcggucc

SEQ ID NO: 26162 - RNA, 18 nt, Artificial Sequence
  Description of Artificial Sequence: Synthetic oligonucleotide
auaucugguccaucccgc

SEQ ID NO: 26163 - RNA, 18 nt, Artificial Sequence
  Description of Artificial Sequence: Synthetic oligonucleotide
ucuugauaucugguccau

SEQ ID NO: 26164 - RNA, 18 nt, Artificial Sequence
  Description of Artificial Sequence: Synthetic oligonucleotide
ggcucucuugauaucugg

SEQ ID NO: 26165 - RNA, 18 nt, Artificial Sequence
  Description of Artificial Sequence: Synthetic oligonucleotide
uggauggcucucuugaua

SEQ ID NO: 26166 - RNA, 18 nt, Artificial Sequence
  Description of Artificial Sequence: Synthetic oligonucleotide
cccuauggauggcucucu

SEQ ID NO: 26167 - RNA, 18 nt, Artificial Sequence
  Description of Artificial Sequence: Synthetic oligonucleotide
cagcucccuauggauggc

SEQ ID NO: 26168 - RNA, 18 nt, Artificial Sequence
  Description of Artificial Sequence: Synthetic oligonucleotide
ccagccagcucccuaugg

SEQ ID NO: 26169 - RNA, 18 nt, Artificial Sequence
  Description of Artificial Sequence: Synthetic oligonucleotide
aacccccagccagcuccc

SEQ ID NO: 26170 - RNA, 18 nt, Artificial Sequence
  Description of Artificial Sequence: Synthetic oligonucleotide
acggaaacccccagccag

SEQ ID NO: 26171 - RNA, 18 nt, Artificial Sequence
  Description of Artificial Sequence: Synthetic oligonucleotide
cucccacggaaaccccca

SEQ ID NO: 26172 - RNA, 18 nt, Artificial Sequence
  Description of Artificial Sequence: Synthetic oligonucleotide
uggagcucccacggaaac

SEQ ID NO: 26173 - RNA, 18 nt, Artificial Sequence
  Description of Artificial Sequence: Synthetic oligonucleotide
aguucuggagcucccacg

SEQ ID NO: 26174 - RNA, 18 nt, Artificial Sequence
  Description of Artificial Sequence: Synthetic oligonucleotide
gggaaaguucuggagcuc

SEQ ID NO: 26175 - RNA, 18 nt, Artificial Sequence
  Description of Artificial Sequence: Synthetic oligonucleotide
cugggcucuucacucagc

SEQ ID NO: 26176 - RNA, 18 nt, Artificial Sequence
  Description of Artificial Sequence: Synthetic oligonucleotide
gggcugggcucuucacuc

SEQ ID NO: 26177 - RNA, 18 nt, Artificial Sequence
  Description of Artificial Sequence: Synthetic oligonucleotide
caauugcacauaagaggg

SEQ ID NO: 26178 - RNA, 18 nt, Artificial Sequence
  Description of Artificial Sequence: Synthetic oligonucleotide
caaggcaauugcacauaa

SEQ ID NO: 26179 - RNA, 18 nt, Artificial Sequence
  Description of Artificial Sequence: Synthetic oligonucleotide
uaguucaaggcaauugca

SEQ ID NO: 26180 - RNA, 18 nt, Artificial Sequence
  Description of Artificial Sequence: Synthetic oligonucleotide
ggucguaguucaaggcaa

SEQ ID NO: 26181 - RNA, 18 nt, Artificial Sequence
  Description of Artificial Sequence: Synthetic oligonucleotide
uacagggucguaguucaa

SEQ ID NO: 26182 - RNA, 18 nt, Artificial Sequence
  Description of Artificial Sequence: Synthetic oligonucleotide
aucucuacagggucguag

SEQ ID NO: 26183 - RNA, 18 nt, Artificial Sequence
  Description of Artificial Sequence: Synthetic oligonucleotide
gagaaaucucuacagggu

SEQ ID NO: 26184 - RNA, 18 nt, Artificial Sequence
  Description of Artificial Sequence: Synthetic oligonucleotide
caugagagaaaucucuac

SEQ ID NO: 26185 - RNA, 18 nt, Artificial Sequence
  Description of Artificial Sequence: Synthetic oligonucleotide
aacgccaugagagaaauc

SEQ ID NO: 26186 - RNA, 18 nt, Artificial Sequence
  Description of Artificial Sequence: Synthetic oligonucleotide
acuagaacgccaugagag

SEQ ID NO: 26187 - RNA, 18 nt, Artificial Sequence
  Description of Artificial Sequence: Synthetic oligonucleotide
agagaacuagaacgccau

SEQ ID NO: 26188 - RNA, 18 nt, Artificial Sequence
  Description of Artificial Sequence: Synthetic oligonucleotide
aggucagagaacuagaac

SEQ ID NO: 26189 - RNA, 18 nt, Artificial Sequence
  Description of Artificial Sequence: Synthetic oligonucleotide
gacucaggucagagaacu

SEQ ID NO: 26190 - RNA, 18 nt, Artificial Sequence
  Description of Artificial Sequence: Synthetic oligonucleotide
acaaagacucaggucaga

SEQ ID NO: 26191 - RNA, 18 nt, Artificial Sequence
  Description of Artificial Sequence: Synthetic oligonucleotide
uuaaaacaaagacucagg

SEQ ID NO: 26192 - RNA, 18 nt, Artificial Sequence
  Description of Artificial Sequence: Synthetic oligonucleotide
acuucuuaaaacaaagac

SEQ ID NO: 26193 - RNA, 18 nt, Artificial Sequence
  Description of Artificial Sequence: Synthetic oligonucleotide
caaauacuucuuaaaaca

SEQ ID NO: 26194 - RNA, 18 nt, Artificial Sequence
  Description of Artificial Sequence: Synthetic oligonucleotide
gaagacaaauacuucuua

SEQ ID NO: 26195 - RNA, 18 nt, Artificial Sequence
  Description of Artificial Sequence: Synthetic oligonucleotide
caaaggaagacaaauacu

SEQ ID NO: 26196 - RNA, 18 nt, Artificial Sequence
  Description of Artificial Sequence: Synthetic oligonucleotide
uuagacaaaggaagacaa

SEQ ID NO: 26197 - RNA, 18 nt, Artificial Sequence
  Description of Artificial Sequence: Synthetic oligonucleotide
ccacauuagacaaaggaa

SEQ ID NO: 26198 - RNA, 18 nt, Artificial Sequence
  Description of Artificial Sequence: Synthetic oligonucleotide
gaaucccacauuagacaa

SEQ ID NO: 26199 - RNA, 18 nt, Artificial Sequence
  Description of Artificial Sequence: Synthetic oligonucleotide
gucaggaaucccacauua

SEQ ID NO: 26200 - RNA, 18 nt, Artificial Sequence
  Description of Artificial Sequence: Synthetic oligonucleotide
agggagucaggaauccca

SEQ ID NO: 26201 - RNA, 18 nt, Artificial Sequence
  Description of Artificial Sequence: Synthetic oligonucleotide
gacgaagggagucaggaa

SEQ ID NO: 26202 - RNA, 18 nt, Artificial Sequence
  Description of Artificial Sequence: Synthetic oligonucleotide
ccuuggacgaagggaguc

SEQ ID NO: 26203 - RNA, 18 nt, Artificial Sequence
  Description of Artificial Sequence: Synthetic oligonucleotide
cggugccuuggacgaagg

SEQ ID NO: 26204 - RNA, 18 nt, Artificial Sequence
  Description of Artificial Sequence: Synthetic oligonucleotide
cacaccggugccuuggac

SEQ ID NO: 26205 - RNA, 18 nt, Artificial Sequence
  Description of Artificial Sequence: Synthetic oligonucleotide
acacacacaccggugccu

SEQ ID NO: 26206 - RNA, 18 nt, Artificial Sequence
  Description of Artificial Sequence: Synthetic oligonucleotide
aagacacacacacaccgg

SEQ ID NO: 26207 - RNA, 18 nt, Artificial Sequence
  Description of Artificial Sequence: Synthetic oligonucleotide
agugcaagacacacacac

SEQ ID NO: 26208 - RNA, 18 nt, Artificial Sequence
  Description of Artificial Sequence: Synthetic oligonucleotide
ucuggagugcaagacaca

SEQ ID NO: 26209 - RNA, 18 nt, Artificial Sequence
  Description of Artificial Sequence: Synthetic oligonucleotide
ucagcucuggagugcaag

SEQ ID NO: 26210 - RNA, 18 nt, Artificial Sequence
  Description of Artificial Sequence: Synthetic oligonucleotide
ggaggucagcucuggagu

SEQ ID NO: 26211 - RNA, 18 nt, Artificial Sequence
  Description of Artificial Sequence: Synthetic oligonucleotide
gcgguggaggucagcucu

SEQ ID NO: 26212 - RNA, 18 nt, Artificial Sequence
  Description of Artificial Sequence: Synthetic oligonucleotide
gcugggcgguggagguca

SEQ ID NO: 26213 - RNA, 18 nt, Artificial Sequence
  Description of Artificial Sequence: Synthetic oligonucleotide
cccaggcugggcggugga

SEQ ID NO: 26214 - RNA, 18 nt, Artificial Sequence
  Description of Artificial Sequence: Synthetic oligonucleotide
gacuucccaggcugggcg

SEQ ID NO: 26215 - RNA, 18 nt, Artificial Sequence
  Description of Artificial Sequence: Synthetic oligonucleotide
acaaugacuucccaggcu

SEQ ID NO: 26216 - RNA, 18 nt, Artificial Sequence
  Description of Artificial Sequence: Synthetic oligonucleotide
ucccuacaaugacuuccc

SEQ ID NO: 26217 - RNA, 18 nt, Artificial Sequence
  Description of Artificial Sequence: Synthetic oligonucleotide
cucacucccuacaaugac

SEQ ID NO: 26218 - RNA, 18 nt, Artificial Sequence
  Description of Artificial Sequence: Synthetic oligonucleotide
agugucucacucccuaca

SEQ ID NO: 26219 - RNA, 18 nt, Artificial Sequence
  Description of Artificial Sequence: Synthetic oligonucleotide
gcuucagugucucacucc

SEQ ID NO: 26220 - RNA, 18 nt, Artificial Sequence
  Description of Artificial Sequence: Synthetic oligonucleotide
ucagggcuucagugucuc

SEQ ID NO: 26221 - RNA, 18 nt, Artificial Sequence
  Description of Artificial Sequence: Synthetic oligonucleotide
gcuucucagggcuucagu

SEQ ID NO: 26222 - RNA, 18 nt, Artificial Sequence
  Description of Artificial Sequence: Synthetic oligonucleotide
cacuggcuucucagggcu

SEQ ID NO: 26223 - RNA, 18 nt, Artificial Sequence
  Description of Artificial Sequence: Synthetic oligonucleotide
gauggcacuggcuucuca

SEQ ID NO: 26224 - RNA, 18 nt, Artificial Sequence
  Description of Artificial Sequence: Synthetic oligonucleotide
gggaugauggcacuggcu

SEQ ID NO: 26225 - RNA, 18 nt, Artificial Sequence
  Description of Artificial Sequence: Synthetic oligonucleotide
auguuccggaacccuggg

SEQ ID NO: 26226 - RNA, 18 nt, Artificial Sequence
  Description of Artificial Sequence: Synthetic oligonucleotide
aaugaauguuccggaacc

SEQ ID NO: 26227 - RNA, 18 nt, Artificial Sequence
  Description of Artificial Sequence: Synthetic oligonucleotide
gggaaugaauguuccgga

SEQ ID NO: 26228 - RNA, 18 nt, Artificial Sequence
  Description of Artificial Sequence: Synthetic oligonucleotide
cagguccucaccgguggg

SEQ ID NO: 26229 - RNA, 18 nt, Artificial Sequence
  Description of Artificial Sequence: Synthetic oligonucleotide
caugccagguccucaccg

SEQ ID NO: 26230 - RNA, 18 nt, Artificial Sequence
  Description of Artificial Sequence: Synthetic oligonucleotide
cgcugcaugccagguccu

SEQ ID NO: 26231 - RNA, 18 nt, Artificial Sequence
  Description of Artificial Sequence: Synthetic oligonucleotide
ugcuucgcugcaugccag

SEQ ID NO: 26232 - RNA, 18 nt, Artificial Sequence
  Description of Artificial Sequence: Synthetic oligonucleotide
ugggcugcuucgcugcau

SEQ ID NO: 26233 - RNA, 18 nt, Artificial Sequence
  Description of Artificial Sequence: Synthetic oligonucleotide
cgggcugggcugcuucgc

SEQ ID NO: 26234 - RNA, 18 nt, Artificial Sequence
  Description of Artificial Sequence: Synthetic oligonucleotide
uccgccgggcugggcugc

SEQ ID NO: 26235 - RNA, 18 nt, Artificial Sequence
  Description of Artificial Sequence: Synthetic oligonucleotide
ugggauccgccgggcugg

SEQ ID NO: 26236 - RNA, 18 nt, Artificial Sequence
  Description of Artificial Sequence: Synthetic oligonucleotide
uggccugggauccgccgg

SEQ ID NO: 26237 - RNA, 18 nt, Artificial Sequence
  Description of Artificial Sequence: Synthetic oligonucleotide
cgugcuggccugggaucc

SEQ ID NO: 26238 - RNA, 18 nt, Artificial Sequence
  Description of Artificial Sequence: Synthetic oligonucleotide
gcaggcgugcuggccugg

SEQ ID NO: 26239 - RNA, 18 nt, Artificial Sequence
  Description of Artificial Sequence: Synthetic oligonucleotide
agccggcaggcgugcugg

SEQ ID NO: 26240 - RNA, 18 nt, Artificial Sequence
  Description of Artificial Sequence: Synthetic oligonucleotide
ugagaagccggcaggcgu

SEQ ID NO: 26241 - RNA, 18 nt, Artificial Sequence
  Description of Artificial Sequence: Synthetic oligonucleotide
gacgaugagaagccggca

SEQ ID NO: 26242 - RNA, 18 nt, Artificial Sequence
  Description of Artificial Sequence: Synthetic oligonucleotide
ucccugacgaugagaagc

SEQ ID NO: 26243 - RNA, 18 nt, Artificial Sequence
  Description of Artificial Sequence: Synthetic oligonucleotide
cgggcucccugacgauga

SEQ ID NO: 26244 - RNA, 18 nt, Artificial Sequence
  Description of Artificial Sequence: Synthetic oligonucleotide
cugggcgggcucccugac

SEQ ID NO: 26245 - RNA, 18 nt, Artificial Sequence
  Description of Artificial Sequence: Synthetic oligonucleotide
gagcucugggcgggcucc

SEQ ID NO: 26246 - RNA, 18 nt, Artificial Sequence
  Description of Artificial Sequence: Synthetic oligonucleotide
gucacgagcucugggcgg

SEQ ID NO: 26247 - RNA, 18 nt, Artificial Sequence
  Description of Artificial Sequence: Synthetic oligonucleotide
ugcucgucacgagcucug

SEQ ID NO: 26248 - RNA, 18 nt, Artificial Sequence
  Description of Artificial Sequence: Synthetic oligonucleotide
gcacuugcucgucacgag

SEQ ID NO: 26249 - RNA, 18 nt, Artificial Sequence
  Description of Artificial Sequence: Synthetic oligonucleotide
acccagcacuugcucguc

SEQ ID NO: 26250 - RNA, 18 nt, Artificial Sequence
  Description of Artificial Sequence: Synthetic oligonucleotide
gggacccagcacuugcuc

SEQ ID NO: 26251 - RNA, 18 nt, Artificial Sequence
  Description of Artificial Sequence: Synthetic oligonucleotide
ccagagcgccgccucggg

SEQ ID NO: 26252 - RNA, 18 nt, Artificial Sequence
  Description of Artificial Sequence: Synthetic oligonucleotide
gccagccagagcgccgcc

SEQ ID NO: 26253 - RNA, 18 nt, Artificial Sequence
  Description of Artificial Sequence: Synthetic oligonucleotide
cagcugccagccagagcg

SEQ ID NO: 26254 - RNA, 18 nt, Artificial Sequence
  Description of Artificial Sequence: Synthetic oligonucleotide
cccaccagcugccagcca

SEQ ID NO: 26255 - RNA, 18 nt, Artificial Sequence
  Description of Artificial Sequence: Synthetic oligonucleotide
uauuccccaccagcugcc

SEQ ID NO: 26256 - RNA, 18 nt, Artificial Sequence
  Description of Artificial Sequence: Synthetic oligonucleotide
cugccuauuccccaccag

SEQ ID NO: 26257 - RNA, 18 nt, Artificial Sequence
  Description of Artificial Sequence: Synthetic oligonucleotide
cugcccugccuauucccc

SEQ ID NO: 26258 - RNA, 18 nt, Artificial Sequence
  Description of Artificial Sequence: Synthetic oligonucleotide
cacagcugcccugccuau

SEQ ID NO: 26259 - RNA, 18 nt, Artificial Sequence
  Description of Artificial Sequence: Synthetic oligonucleotide
ccagccacagcugcccug

SEQ ID NO: 26260 - RNA, 18 nt, Artificial Sequence
  Description of Artificial Sequence: Synthetic oligonucleotide
ucuccccagccacagcug

SEQ ID NO: 26261 - RNA, 18 nt, Artificial Sequence
  Description of Artificial Sequence: Synthetic oligonucleotide
aagucucuccccagccac

SEQ ID NO: 26262 - RNA, 18 nt, Artificial Sequence
  Description of Artificial Sequence: Synthetic oligonucleotide
gccuaaagucucucccca

SEQ ID NO: 26263 - RNA, 18 nt, Artificial Sequence
  Description of Artificial Sequence: Synthetic oligonucleotide
cuucugccuaaagucucu

SEQ ID NO: 26264 - RNA, 18 nt, Artificial Sequence
  Description of Artificial Sequence: Synthetic oligonucleotide
cacagcuucugccuaaag

SEQ ID NO: 26265 - RNA, 18 nt, Artificial Sequence
  Description of Artificial Sequence: Synthetic oligonucleotide
ugcaucacagcuucugcc

SEQ ID NO: 26266 - RNA, 18 nt, Artificial Sequence
  Description of Artificial Sequence: Synthetic oligonucleotide
cagccugcaucacagcuu

SEQ ID NO: 26267 - RNA, 18 nt, Artificial Sequence
  Description of Artificial Sequence: Synthetic oligonucleotide
gcagucagccugcaucac

SEQ ID NO: 26268 - RNA, 18 nt, Artificial Sequence
  Description of Artificial Sequence: Synthetic oligonucleotide
ggcuggcagucagccugc

SEQ ID NO: 26269 - RNA, 18 nt, Artificial Sequence
  Description of Artificial Sequence: Synthetic oligonucleotide
cccucggcuggcagucag

SEQ ID NO: 26270 - RNA, 18 nt, Artificial Sequence
  Description of Artificial Sequence: Synthetic oligonucleotide
ccagccccucggcuggca

SEQ ID NO: 26271 - RNA, 18 nt, Artificial Sequence
  Description of Artificial Sequence: Synthetic oligonucleotide
acuacccagccccucggc

SEQ ID NO: 26272 - RNA, 18 nt, Artificial Sequence
  Description of Artificial Sequence: Synthetic oligonucleotide
acggcacuacccagcccc

SEQ ID NO: 26273 - RNA, 18 nt, Artificial Sequence
  Description of Artificial Sequence: Synthetic oligonucleotide
cccgcacggcacuaccca

SEQ ID NO: 26274 - RNA, 18 nt, Artificial Sequence
  Description of Artificial Sequence: Synthetic oligonucleotide
cagcucccgcacggcacu

SEQ ID NO: 26275 - RNA, 18 nt, Artificial Sequence
  Description of Artificial Sequence: Synthetic oligonucleotide
accaucagcucccgcacg

SEQ ID NO: 26276 - RNA, 18 nt, Artificial Sequence
  Description of Artificial Sequence: Synthetic oligonucleotide
ccuguaccaucagcuccc

SEQ ID NO: 26277 - RNA, 18 nt, Artificial Sequence
  Description of Artificial Sequence: Synthetic oligonucleotide
agugcccuguaccaucag

SEQ ID NO: 26278 - RNA, 18 nt, Artificial Sequence
  Description of Artificial Sequence: Synthetic oligonucleotide
cagcgagugcccuguacc

SEQ ID NO: 26279 - RNA, 18 nt, Artificial Sequence
  Description of Artificial Sequence: Synthetic oligonucleotide
gggacagcgagugcccug

SEQ ID NO: 26280 - RNA, 18 nt, Artificial Sequence
  Description of Artificial Sequence: Synthetic oligonucleotide
ucuaggguggccggaggg

SEQ ID NO: 26281 - RNA, 18 nt, Artificial Sequence
  Description of Artificial Sequence: Synthetic oligonucleotide
ccuggucuaggguggccg

SEQ ID NO: 26282 - RNA, 18 nt, Artificial Sequence
  Description of Artificial Sequence: Synthetic oligonucleotide
cggacccuggucuagggu

SEQ ID NO: 26283 - RNA, 18 nt, Artificial Sequence
  Description of Artificial Sequence: Synthetic oligonucleotide
ccucucggacccuggucu

SEQ ID NO: 26284 - RNA, 18 nt, Artificial Sequence
  Description of Artificial Sequence: Synthetic oligonucleotide
gccugccucucggacccu

SEQ ID NO: 26285 - RNA, 18 nt, Artificial Sequence
  Description of Artificial Sequence: Synthetic oligonucleotide
cuccugccugccucucgg

SEQ ID NO: 26286 - RNA, 18 nt, Artificial Sequence
  Description of Artificial Sequence: Synthetic oligonucleotide
aguggcuccugccugccu

SEQ ID NO: 26287 - RNA, 18 nt, Artificial Sequence
  Description of Artificial Sequence: Synthetic oligonucleotide
acaugaguggcuccugcc

SEQ ID NO: 26288 - RNA, 18 nt, Artificial Sequence
  Description of Artificial Sequence: Synthetic oligonucleotide
ggaagacaugaguggcuc

SEQ ID NO: 26289 - RNA, 18 nt, Artificial Sequence
  Description of Artificial Sequence: Synthetic oligonucleotide
gggaagacaugaguggcu

SEQ ID NO: 26290 - RNA, 18 nt, Artificial Sequence
  Description of Artificial Sequence: Synthetic oligonucleotide
ugggcgucgggcaauggg

SEQ ID NO: 26291 - RNA, 18 nt, Artificial Sequence
  Description of Artificial Sequence: Synthetic oligonucleotide
gucuaugggcgucgggca

SEQ ID NO: 26292 - RNA, 18 nt, Artificial Sequence
  Description of Artificial Sequence: Synthetic oligonucleotide
ggagcgucuaugggcguc

SEQ ID NO: 26293 - RNA, 18 nt, Artificial Sequence
  Description of Artificial Sequence: Synthetic oligonucleotide
aggaaggagcgucuaugg

SEQ ID NO: 26294 - RNA, 18 nt, Artificial Sequence
  Description of Artificial Sequence: Synthetic oligonucleotide
cacacaggaaggagcguc

SEQ ID NO: 26295 - RNA, 18 nt, Artificial Sequence
  Description of Artificial Sequence: Synthetic oligonucleotide
agccccacacaggaagga

SEQ ID NO: 26296 - RNA, 18 nt, Artificial Sequence
  Description of Artificial Sequence: Synthetic oligonucleotide
accccagccccacacagg

SEQ ID NO: 26297 - RNA, 18 nt, Artificial Sequence
  Description of Artificial Sequence: Synthetic oligonucleotide
ggaguaccccagccccac

SEQ ID NO: 26298 - RNA, 18 nt, Artificial Sequence
  Description of Artificial Sequence: Synthetic oligonucleotide
accagggaguaccccagc

SEQ ID NO: 26299 - RNA, 18 nt, Artificial Sequence
  Description of Artificial Sequence: Synthetic oligonucleotide
guacgaccagggaguacc

SEQ ID NO: 26300 - RNA, 18 nt, Artificial Sequence
  Description of Artificial Sequence: Synthetic oligonucleotide
cugcaguacgaccaggga

SEQ ID NO: 26301 - RNA, 18 nt, Artificial Sequence
  Description of Artificial Sequence: Synthetic oligonucleotide
gcugacugcaguacgacc

SEQ ID NO: 26302 - RNA, 18 nt, Artificial Sequence
  Description of Artificial Sequence: Synthetic oligonucleotide
cgggugcugacugcagua

SEQ ID NO: 26303 - RNA, 18 nt, Artificial Sequence
  Description of Artificial Sequence: Synthetic oligonucleotide
gguuacgggugcugacug

SEQ ID NO: 26304 - RNA, 18 nt, Artificial Sequence
  Description of Artificial Sequence: Synthetic oligonucleotide
agccggguuacgggugcu

SEQ ID NO: 26305 - RNA, 18 nt, Artificial Sequence
  Description of Artificial Sequence: Synthetic oligonucleotide
gucauagccggguuacgg

SEQ ID NO: 26306 - RNA, 18 nt, Artificial Sequence
  Description of Artificial Sequence: Synthetic oligonucleotide
cccuggucauagccgggu

SEQ ID NO: 26307 - RNA, 18 nt, Artificial Sequence
  Description of Artificial Sequence: Synthetic oligonucleotide
cagaucccuggucauagc

SEQ ID NO: 26308 - RNA, 18 nt, Artificial Sequence
  Description of Artificial Sequence: Synthetic oligonucleotide
gcuuacagaucccugguc

SEQ ID NO: 26309 - RNA, 18 nt, Artificial Sequence
  Description of Artificial Sequence: Synthetic oligonucleotide
acagggcuuacagauccc

SEQ ID NO: 26310 - RNA, 18 nt, Artificial Sequence
  Description of Artificial Sequence: Synthetic oligonucleotide
gagccacagggcuuacag

SEQ ID NO: 26311 - RNA, 18 nt, Artificial Sequence
  Description of Artificial Sequence: Synthetic oligonucleotide
cuguggagccacagggcu

SEQ ID NO: 26312 - RNA, 18 nt, Artificial Sequence
  Description of Artificial Sequence: Synthetic oligonucleotide
agcaccuguggagccaca

SEQ ID NO: 26313 - RNA, 18 nt, Artificial Sequence
  Description of Artificial Sequence: Synthetic oligonucleotide
gaagcagcaccuguggag

SEQ ID NO: 26314 - RNA, 18 nt, Artificial Sequence
  Description of Artificial Sequence: Synthetic oligonucleotide
agugagaagcagcaccug

SEQ ID NO: 26315 - RNA, 18 nt, Artificial Sequence
  Description of Artificial Sequence: Synthetic oligonucleotide
gggccagugagaagcagc

SEQ ID NO: 26316 - RNA, 18 nt, Artificial Sequence
  Description of Artificial Sequence: Synthetic oligonucleotide
agucugggccagugagaa

SEQ ID NO: 26317 - RNA, 18 nt, Artificial Sequence
  Description of Artificial Sequence: Synthetic oligonucleotide
cucagagucugggccagu

SEQ ID NO: 26318 - RNA, 18 nt, Artificial Sequence
  Description of Artificial Sequence: Synthetic oligonucleotide
uggagcucagagucuggg

SEQ ID NO: 26319 - RNA, 18 nt, Artificial Sequence
  Description of Artificial Sequence: Synthetic oligonucleotide
gccgguggagcucagagu

SEQ ID NO: 26320 - RNA, 18 nt, Artificial Sequence
  Description of Artificial Sequence: Synthetic oligonucleotide
acugggccgguggagcuc

SEQ ID NO: 26321 - RNA, 18 nt, Artificial Sequence
  Description of Artificial Sequence: Synthetic oligonucleotide
ugcagacugggccggugg

SEQ ID NO: 26322 - RNA, 18 nt, Artificial Sequence
  Description of Artificial Sequence: Synthetic oligonucleotide
ggccgugcagacugggcc

SEQ ID NO: 26323 - RNA, 18 nt, Artificial Sequence
  Description of Artificial Sequence: Synthetic oligonucleotide
agaugggccgugcagacu

SEQ ID NO: 26324 - RNA, 18 nt, Artificial Sequence
  Description of Artificial Sequence: Synthetic oligonucleotide
gaagcagaugggccgugc

SEQ ID NO: 26325 - RNA, 18 nt, Artificial Sequence
  Description of Artificial Sequence: Synthetic oligonucleotide
aaggugaagcagaugggc

SEQ ID NO: 26326 - RNA, 18 nt, Artificial Sequence
  Description of Artificial Sequence: Synthetic oligonucleotide
gagggaaggugaagcaga

SEQ ID NO: 26327 - RNA, 18 nt, Artificial Sequence
  Description of Artificial Sequence: Synthetic oligonucleotide
gcugggagggaaggugaa

SEQ ID NO: 26328 - RNA, 18 nt, Artificial Sequence
  Description of Artificial Sequence: Synthetic oligonucleotide
acguggcugggagggaag

SEQ ID NO: 26329 - RNA, 18 nt, Artificial Sequence
  Description of Artificial Sequence: Synthetic oligonucleotide
cuggcacguggcugggag

SEQ ID NO: 26330 - RNA, 18 nt, Artificial Sequence
  Description of Artificial Sequence: Synthetic oligonucleotide
ggccacuggcacguggcu

SEQ ID NO: 26331 - RNA, 18 nt, Artificial Sequence
  Description of Artificial Sequence: Synthetic oligonucleotide
gcuguggccacuggcacg

SEQ ID NO: 26332 - RNA, 18 nt, Artificial Sequence
  Description of Artificial Sequence: Synthetic oligonucleotide
agugggcuguggccacug

SEQ ID NO: 26333 - RNA, 18 nt, Artificial Sequence
  Description of Artificial Sequence: Synthetic oligonucleotide
ugggaagugggcuguggc

SEQ ID NO: 26334 - RNA, 18 nt, Artificial Sequence
  Description of Artificial Sequence: Synthetic oligonucleotide
uggguugggaagugggcu

SEQ ID NO: 26335 - RNA, 18 nt, Artificial Sequence
  Description of Artificial Sequence: Synthetic oligonucleotide
aacaguggguugggaagu

SEQ ID NO: 26336 - RNA, 18 nt, Artificial Sequence
  Description of Artificial Sequence: Synthetic oligonucleotide
gguacaacaguggguugg

SEQ ID NO: 26337 - RNA, 18 nt, Artificial Sequence
  Description of Artificial Sequence: Synthetic oligonucleotide
gccuggguacaacagugg

SEQ ID NO: 26338 - RNA, 18 nt, Artificial Sequence
  Description of Artificial Sequence: Synthetic oligonucleotide
gugaggccuggguacaac

SEQ ID NO: 26339 - RNA, 18 nt, Artificial Sequence
  Description of Artificial Sequence: Synthetic oligonucleotide
gcaaagugaggccugggu

SEQ ID NO: 26340 - RNA, 18 nt, Artificial Sequence
  Description of Artificial Sequence: Synthetic oligonucleotide
caacagcaaagugaggcc

SEQ ID NO: 26341 - RNA, 18 nt, Artificial Sequence
  Description of Artificial Sequence: Synthetic oligonucleotide
aagggcaacagcaaagug

SEQ ID NO: 26342 - RNA, 18 nt, Artificial Sequence
  Description of Artificial Sequence: Synthetic oligonucleotide
gggacaagggcaacagca

SEQ ID NO: 26343 - RNA, 18 nt, Artificial Sequence
  Description of Artificial Sequence: Synthetic oligonucleotide
gaagagggacaagggcaa

SEQ ID NO: 26344 - RNA, 18 nt, Artificial Sequence
  Description of Artificial Sequence: Synthetic oligonucleotide
ggcccgaagagggacaag

SEQ ID NO: 26345 - RNA, 18 nt, Artificial Sequence
  Description of Artificial Sequence: Synthetic oligonucleotide
uucagggcccgaagaggg

SEQ ID NO: 26346 - RNA, 18 nt, Artificial Sequence
  Description of Artificial Sequence: Synthetic oligonucleotide
gaaaauucagggcccgaa

SEQ ID NO: 26347 - RNA, 18 nt, Artificial Sequence
  Description of Artificial Sequence: Synthetic oligonucleotide
gaacagaaaauucagggc

SEQ ID NO: 26348 - RNA, 18 nt, Artificial Sequence
  Description of Artificial Sequence: Synthetic oligonucleotide
ccagggaacagaaaauuc

SEQ ID NO: 26349 - RNA, 18 nt, Artificial Sequence
  Description of Artificial Sequence: Synthetic oligonucleotide
ggcccccagggaacagaa

SEQ ID NO: 26350 - RNA, 18 nt, Artificial Sequence
  Description of Artificial Sequence: Synthetic oligonucleotide
uggcuggcccccagggaa

SEQ ID NO: 26351 - RNA, 18 nt, Artificial Sequence
  Description of Artificial Sequence: Synthetic oligonucleotide
ggcccuggcuggccccca

SEQ ID NO: 26352 - RNA, 18 nt, Artificial Sequence
  Description of Artificial Sequence: Synthetic oligonucleotide
caaagggcccuggcuggc

SEQ ID NO: 26353 - RNA, 18 nt, Artificial Sequence
  Description of Artificial Sequence: Synthetic oligonucleotide
gggcacaaagggcccugg

SEQ ID NO: 26354 - RNA, 18 nt, Artificial Sequence
  Description of Artificial Sequence: Synthetic oligonucleotide
caucaggccugugcuggg

SEQ ID NO: 26355 - RNA, 18 nt, Artificial Sequence
  Description of Artificial Sequence: Synthetic oligonucleotide
accugcaucaggccugug

SEQ ID NO: 26356 - RNA, 18 nt, Artificial Sequence
  Description of Artificial Sequence: Synthetic oligonucleotide
uggacaccugcaucaggc

SEQ ID NO: 26357 - RNA, 18 nt, Artificial Sequence
  Description of Artificial Sequence: Synthetic oligonucleotide
gugaguggacaccugcau

SEQ ID NO: 26358 - RNA, 18 nt, Artificial Sequence
  Description of Artificial Sequence: Synthetic oligonucleotide
caccugugaguggacacc

SEQ ID NO: 26359 - RNA, 18 nt, Artificial Sequence
  Description of Artificial Sequence: Synthetic oligonucleotide
agcgccaccugugagugg

SEQ ID NO: 26360 - RNA, 18 nt, Artificial Sequence
  Description of Artificial Sequence: Synthetic oligonucleotide
aggugagcgccaccugug

SEQ ID NO: 26361 - RNA, 18 nt, Artificial Sequence
  Description of Artificial Sequence: Synthetic oligonucleotide
agccuaggugagcgccac

SEQ ID NO: 26362 - RNA, 18 nt, Artificial Sequence
  Description of Artificial Sequence: Synthetic oligonucleotide
gugacagccuaggugagc

SEQ ID NO: 26363 - RNA, 18 nt, Artificial Sequence
  Description of Artificial Sequence: Synthetic oligonucleotide
guccugugacagccuagg

SEQ ID NO: 26364 - RNA, 18 nt, Artificial Sequence
  Description of Artificial Sequence: Synthetic oligonucleotide
gguggguccugugacagc

SEQ ID NO: 26365 - RNA, 18 nt, Artificial Sequence
  Description of Artificial Sequence: Synthetic oligonucleotide
auggagguggguccugug

SEQ ID NO: 26366 - RNA, 18 nt, Artificial Sequence
  Description of Artificial Sequence: Synthetic oligonucleotide
cuggcauggagguggguc

SEQ ID NO: 26367 - RNA, 18 nt, Artificial Sequence
  Description of Artificial Sequence: Synthetic oligonucleotide
guugccuggcauggaggu

SEQ ID NO: 26368 - RNA, 18 nt, Artificial Sequence
  Description of Artificial Sequence: Synthetic oligonucleotide
ccucuguugccuggcaug

SEQ ID NO: 26369 - RNA, 18 nt, Artificial Sequence
  Description of Artificial Sequence: Synthetic oligonucleotide
guggcccucuguugccug

SEQ ID NO: 26370 - RNA, 18 nt, Artificial Sequence
  Description of Artificial Sequence: Synthetic oligonucleotide
guucuguggcccucuguu

SEQ ID NO: 26371 - RNA, 18 nt, Artificial Sequence
  Description of Artificial Sequence: Synthetic oligonucleotide
gggugguucuguggcccu

SEQ ID NO: 26372 - RNA, 18 nt, Artificial Sequence
  Description of Artificial Sequence: Synthetic oligonucleotide
gaccaaggagugagccgu

SEQ ID NO: 26373 - RNA, 18 nt, Artificial Sequence
  Description of Artificial Sequence: Synthetic oligonucleotide
ccccagaccaaggaguga

SEQ ID NO: 26374 - RNA, 18 nt, Artificial Sequence
  Description of Artificial Sequence: Synthetic oligonucleotide
gguggccccagaccaagg

SEQ ID NO: 26375 - RNA, 18 nt, Artificial Sequence
  Description of Artificial Sequence: Synthetic oligonucleotide
aagaagguggccccagac

SEQ ID NO: 26376 - RNA, 18 nt, Artificial Sequence
  Description of Artificial Sequence: Synthetic oligonucleotide
agggcaagaagguggccc

SEQ ID NO: 26377 - RNA, 18 nt, Artificial Sequence
  Description of Artificial Sequence: Synthetic oligonucleotide
aagaaagggcaagaaggu

SEQ ID NO: 26378 - RNA, 18 nt, Artificial Sequence
  Description of Artificial Sequence: Synthetic oligonucleotide
aaaaaaagaaagggcaag

SEQ ID NO: 26379 - RNA, 18 nt, Artificial Sequence
  Description of Artificial Sequence: Synthetic oligonucleotide
aaaaaaaaaaaagaaagg

SEQ ID NO: 26380 - RNA, 18 nt, Artificial Sequence
  Description of Artificial Sequence: Synthetic oligonucleotide
aaaaaaaaaaaaaaaaag

SEQ ID NO: 26381 - RNA, 18 nt, Artificial Sequence
  Description of Artificial Sequence: Synthetic oligonucleotide
aaaaaaaaaaaaaaaaaa

SEQ ID NO: 26382 - RNA, 18 nt, Artificial Sequence
  Description of Artificial Sequence: Synthetic oligonucleotide
ucggaaaaaaaaaaaaaa

SEQ ID NO: 26383 - RNA, 18 nt, Artificial Sequence
  Description of Artificial Sequence: Synthetic oligonucleotide
ccaucucggaaaaaaaaa

SEQ ID NO: 26384 - RNA, 18 nt, Artificial Sequence
  Description of Artificial Sequence: Synthetic oligonucleotide
agacuccaucucggaaaa

SEQ ID NO: 26385 - RNA, 18 nt, Artificial Sequence
  Description of Artificial Sequence: Synthetic oligonucleotide
gagagagacuccaucucg

SEQ ID NO: 26386 - RNA, 18 nt, Artificial Sequence
  Description of Artificial Sequence: Synthetic oligonucleotide
ugacagagagagacucca

SEQ ID NO: 26387 - RNA, 18 nt, Artificial Sequence
  Description of Artificial Sequence: Synthetic oligonucleotide
cugggugacagagagaga

SEQ ID NO: 26388 - RNA, 18 nt, Artificial Sequence
  Description of Artificial Sequence: Synthetic oligonucleotide
cccaccugggugacagag

SEQ ID NO: 26389 - RNA, 18 nt, Artificial Sequence
  Description of Artificial Sequence: Synthetic oligonucleotide
acacucccaccuggguga

SEQ ID NO: 26390 - RNA, 18 nt, Artificial Sequence
  Description of Artificial Sequence: Synthetic oligonucleotide
ccaccacacucccaccug

SEQ ID NO: 26391 - RNA, 18 nt, Artificial Sequence
  Description of Artificial Sequence: Synthetic oligonucleotide
uugugccaccacacuccc

SEQ ID NO: 26392 - RNA, 18 nt, Artificial Sequence
  Description of Artificial Sequence: Synthetic oligonucleotide
cgagauugugccaccaca

SEQ ID NO: 26393 - RNA, 18 nt, Artificial Sequence
  Description of Artificial Sequence: Synthetic oligonucleotide
ugagccgagauugugcca

SEQ ID NO: 26394 - RNA, 18 nt, Artificial Sequence
  Description of Artificial Sequence: Synthetic oligonucleotide
ugcagugagccgagauug

SEQ ID NO: 26395 - RNA, 18 nt, Artificial Sequence
  Description of Artificial Sequence: Synthetic oligonucleotide
gagguugcagugagccga

SEQ ID NO: 26396 - RNA, 18 nt, Artificial Sequence
  Description of Artificial Sequence: Synthetic oligonucleotide
agguggagguugcaguga

SEQ ID NO: 26397 - RNA, 18 nt, Artificial Sequence
  Description of Artificial Sequence: Synthetic oligonucleotide
ucaggagguggagguugc

SEQ ID NO: 26398 - RNA, 18 nt, Artificial Sequence
  Description of Artificial Sequence: Synthetic oligonucleotide
ugaacucaggagguggag

SEQ ID NO: 26399 - RNA, 18 nt, Artificial Sequence
  Description of Artificial Sequence: Synthetic oligonucleotide
uugcuugaacucaggagg

SEQ ID NO: 26400 - RNA, 18 nt, Artificial Sequence
  Description of Artificial Sequence: Synthetic oligonucleotide
gagaauugcuugaacuca

SEQ ID NO: 26401 - RNA, 18 nt, Artificial Sequence
  Description of Artificial Sequence: Synthetic oligonucleotide
ggcaggagaauugcuuga

SEQ ID NO: 26402 - RNA, 18 nt, Artificial Sequence
  Description of Artificial Sequence: Synthetic oligonucleotide
gcugaggcaggagaauug

SEQ ID NO: 26403 - RNA, 18 nt, Artificial Sequence
  Description of Artificial Sequence: Synthetic oligonucleotide
gggaggcugaggcaggag

SEQ ID NO: 26404 - RNA, 18 nt, Artificial Sequence
  Description of Artificial Sequence: Synthetic oligonucleotide
uacuugggaggcugaggc

SEQ ID NO: 26405 - RNA, 18 nt, Artificial Sequence
  Description of Artificial Sequence: Synthetic oligonucleotide
ccagcuacuugggaggcu

SEQ ID NO: 26406 - RNA, 18 nt, Artificial Sequence
  Description of Artificial Sequence: Synthetic oligonucleotide
uagucccagcuacuuggg

SEQ ID NO: 26407 - RNA, 18 nt, Artificial Sequence
  Description of Artificial Sequence: Synthetic oligonucleotide
gccuguagucccagcuac

SEQ ID NO: 26408 - RNA, 18 nt, Artificial Sequence
  Description of Artificial Sequence: Synthetic oligonucleotide
ugcaugccuguaguccca

SEQ ID NO: 26409 - RNA, 18 nt, Artificial Sequence
  Description of Artificial Sequence: Synthetic oligonucleotide
gguggugcaugccuguag

SEQ ID NO: 26410 - RNA, 18 nt, Artificial Sequence
  Description of Artificial Sequence: Synthetic oligonucleotide
agugugguggugcaugcc

SEQ ID NO: 26411 - RNA, 18 nt, Artificial Sequence
  Description of Artificial Sequence: Synthetic oligonucleotide
ggccaagugugguggugc

SEQ ID NO: 26412 - RNA, 18 nt, Artificial Sequence
  Description of Artificial Sequence: Synthetic oligonucleotide
acauuggccaaguguggu

SEQ ID NO: 26413 - RNA, 18 nt, Artificial Sequence
  Description of Artificial Sequence: Synthetic oligonucleotide
acagaacauuggccaagu

SEQ ID NO: 26414 - RNA, 18 nt, Artificial Sequence
  Description of Artificial Sequence: Synthetic oligonucleotide
aaaauacagaacauuggc

SEQ ID NO: 26415 - RNA, 18 nt, Artificial Sequence
  Description of Artificial Sequence: Synthetic oligonucleotide
uauuaaaaauacagaaca

SEQ ID NO: 26416 - RNA, 18 nt, Artificial Sequence
  Description of Artificial Sequence: Synthetic oligonucleotide
gucccuauuaaaaauaca

SEQ ID NO: 26417 - RNA, 18 nt, Artificial Sequence
  Description of Artificial Sequence: Synthetic oligonucleotide
accccgucccuauuaaaa

SEQ ID NO: 26418 - RNA, 18 nt, Artificial Sequence
  Description of Artificial Sequence: Synthetic oligonucleotide
gcaaaaccccgucccuau

SEQ ID NO: 26419 - RNA, 18 nt, Artificial Sequence
  Description of Artificial Sequence: Synthetic oligonucleotide
acauggcaaaaccccguc

SEQ ID NO: 26420 - RNA, 18 nt, Artificial Sequence
  Description of Artificial Sequence: Synthetic oligonucleotide
agcuaacauggcaaaacc

SEQ ID NO: 26421 - RNA, 18 nt, Artificial Sequence
  Description of Artificial Sequence: Synthetic oligonucleotide
agccuagcuaacauggca

SEQ ID NO: 26422 - RNA, 18 nt, Artificial Sequence
  Description of Artificial Sequence: Synthetic oligonucleotide
agaccagccuagcuaaca

SEQ ID NO: 26423 - RNA, 18 nt, Artificial Sequence
  Description of Artificial Sequence: Synthetic oligonucleotide
guuugagaccagccuagc

SEQ ID NO: 26424 - RNA, 18 nt, Artificial Sequence
  Description of Artificial Sequence: Synthetic oligonucleotide
ugugaguuugagaccagc

SEQ ID NO: 26425 - RNA, 18 nt, Artificial Sequence
  Description of Artificial Sequence: Synthetic oligonucleotide
ccaggugugaguuugaga

SEQ ID NO: 26426 - RNA, 18 nt, Artificial Sequence
  Description of Artificial Sequence: Synthetic oligonucleotide
uaaucccaggugugaguu

SEQ ID NO: 26427 - RNA, 18 nt, Artificial Sequence
  Description of Artificial Sequence: Synthetic oligonucleotide
gccuguaaucccaggugu

SEQ ID NO: 26428 - RNA, 18 nt, Artificial Sequence
  Description of Artificial Sequence: Synthetic oligonucleotide
cucaugccuguaauccca

SEQ ID NO: 26429 - RNA, 18 nt, Artificial Sequence
  Description of Artificial Sequence: Synthetic oligonucleotide
aguggcucaugccuguaa

SEQ ID NO: 26430 - RNA, 18 nt, Artificial Sequence
  Description of Artificial Sequence: Synthetic oligonucleotide
ggugcaguggcucaugcc

SEQ ID NO: 26431 - RNA, 18 nt, Artificial Sequence
  Description of Artificial Sequence: Synthetic oligonucleotide
ggcugggugcaguggcuc

SEQ ID NO: 26432 - RNA, 18 nt, Artificial Sequence
  Description of Artificial Sequence: Synthetic oligonucleotide
gggcugggugcaguggcu

SEQ ID NO: 26433 - RNA, 18 nt, Artificial Sequence
  Description of Artificial Sequence: Synthetic oligonucleotide
aagaaagggcaagaaggg

SEQ ID NO: 26434 - RNA, 18 nt, Artificial Sequence
  Description of Artificial Sequence: Synthetic oligonucleotide
gagaaaagaaagggcaag

SEQ ID NO: 26435 - RNA, 18 nt, Artificial Sequence
  Description of Artificial Sequence: Synthetic oligonucleotide
ccauggagaaaagaaagg

SEQ ID NO: 26436 - RNA, 18 nt, Artificial Sequence
  Description of Artificial Sequence: Synthetic oligonucleotide
aucagccauggagaaaag

SEQ ID NO: 26437 - RNA, 18 nt, Artificial Sequence
  Description of Artificial Sequence: Synthetic oligonucleotide
gcagcaucagccauggag

SEQ ID NO: 26438 - RNA, 18 nt, Artificial Sequence
  Description of Artificial Sequence: Synthetic oligonucleotide
ccacagcagcaucagcca

SEQ ID NO: 26439 - RNA, 18 nt, Artificial Sequence
  Description of Artificial Sequence: Synthetic oligonucleotide
gcuggccacagcagcauc

SEQ ID NO: 26440 - RNA, 18 nt, Artificial Sequence
  Description of Artificial Sequence: Synthetic oligonucleotide
cccuggcuggccacagca

SEQ ID NO: 26441 - RNA, 18 nt, Artificial Sequence
  Description of Artificial Sequence: Synthetic oligonucleotide
aagggcccuggcuggcca

SEQ ID NO: 26442 - RNA, 18 nt, Artificial Sequence
  Description of Artificial Sequence: Synthetic oligonucleotide
aucucaagggcccuggcu

SEQ ID NO: 26443 - RNA, 18 nt, Artificial Sequence
  Description of Artificial Sequence: Synthetic oligonucleotide
gaaggaucucaagggccc

SEQ ID NO: 26444 - RNA, 18 nt, Artificial Sequence
  Description of Artificial Sequence: Synthetic oligonucleotide
aacuggaaggaucucaag

SEQ ID NO: 26445 - RNA, 18 nt, Artificial Sequence
  Description of Artificial Sequence: Synthetic oligonucleotide
agccaaacuggaaggauc

SEQ ID NO: 26446 - RNA, 18 nt, Artificial Sequence
  Description of Artificial Sequence: Synthetic oligonucleotide
auaacagccaaacuggaa

SEQ ID NO: 26447 - RNA, 18 nt, Artificial Sequence
  Description of Artificial Sequence: Synthetic oligonucleotide
uuugcauaacagccaaac

SEQ ID NO: 26448 - RNA, 18 nt, Artificial Sequence
  Description of Artificial Sequence: Synthetic oligonucleotide
ccugcuuugcauaacagc

SEQ ID NO: 26449 - RNA, 18 nt, Artificial Sequence
  Description of Artificial Sequence: Synthetic oligonucleotide
aaucaccugcuuugcaua

SEQ ID NO: 26450 - RNA, 18 nt, Artificial Sequence
  Description of Artificial Sequence: Synthetic oligonucleotide
agacaaaucaccugcuuu

SEQ ID NO: 26451 - RNA, 18 nt, Artificial Sequence
  Description of Artificial Sequence: Synthetic oligonucleotide
gauuaagacaaaucaccu

SEQ ID NO: 26452 - RNA, 18 nt, Artificial Sequence
  Description of Artificial Sequence: Synthetic oligonucleotide
uaucugauuaagacaaau

SEQ ID NO: 26453 - RNA, 18 nt, Artificial Sequence
  Description of Artificial Sequence: Synthetic oligonucleotide
ucuuuuaucugauuaaga

SEQ ID NO: 26454 - RNA, 18 nt, Artificial Sequence
  Description of Artificial Sequence: Synthetic oligonucleotide
cucuaucuuuuaucugau

SEQ ID NO: 26455 - RNA, 18 nt, Artificial Sequence
  Description of Artificial Sequence: Synthetic oligonucleotide
auagccucuaucuuuuau

SEQ ID NO: 26456 - RNA, 18 nt, Artificial Sequence
  Description of Artificial Sequence: Synthetic oligonucleotide
cccccauagccucuaucu

SEQ ID NO: 26457 - RNA, 18 nt, Artificial Sequence
  Description of Artificial Sequence: Synthetic oligonucleotide
ugaggcccccauagccuc

SEQ ID NO: 26458 - RNA, 18 nt, Artificial Sequence
  Description of Artificial Sequence: Synthetic oligonucleotide
aaucuugaggcccccaua

SEQ ID NO: 26459 - RNA, 18 nt, Artificial Sequence
  Description of Artificial Sequence: Synthetic oligonucleotide
ccaaaaaucuugaggccc

SEQ ID NO: 26460 - RNA, 18 nt, Artificial Sequence
  Description of Artificial Sequence: Synthetic oligonucleotide
gcucuccaaaaaucuuga

SEQ ID NO: 26461 - RNA, 18 nt, Artificial Sequence
  Description of Artificial Sequence: Synthetic oligonucleotide
ccucugcucuccaaaaau

SEQ ID NO: 26462 - RNA, 18 nt, Artificial Sequence
  Description of Artificial Sequence: Synthetic oligonucleotide
gaccaccucugcucucca

SEQ ID NO: 26463 - RNA, 18 nt, Artificial Sequence
  Description of Artificial Sequence: Synthetic oligonucleotide
ccagagaccaccucugcu

SEQ ID NO: 26464 - RNA, 18 nt, Artificial Sequence
  Description of Artificial Sequence: Synthetic oligonucleotide
aauugccagagaccaccu

SEQ ID NO: 26465 - RNA, 18 nt, Artificial Sequence
  Description of Artificial Sequence: Synthetic oligonucleotide
gauggaauugccagagac

SEQ ID NO: 26466 - RNA, 18 nt, Artificial Sequence
  Description of Artificial Sequence: Synthetic oligonucleotide
aaccagauggaauugcca

SEQ ID NO: 26467 - RNA, 18 nt, Artificial Sequence
  Description of Artificial Sequence: Synthetic oligonucleotide
cucaaaaccagauggaau

SEQ ID NO: 26468 - RNA, 18 nt, Artificial Sequence
  Description of Artificial Sequence: Synthetic oligonucleotide
aguuucucaaaaccagau

SEQ ID NO: 26469 - RNA, 18 nt, Artificial Sequence
  Description of Artificial Sequence: Synthetic oligonucleotide
ugcuaaguuucucaaaac

SEQ ID NO: 26470 - RNA, 18 nt, Artificial Sequence
  Description of Artificial Sequence: Synthetic oligonucleotide
ugagcugcuaaguuucuc

SEQ ID NO: 26471 - RNA, 18 nt, Artificial Sequence
  Description of Artificial Sequence: Synthetic oligonucleotide
cucugugagcugcuaagu

SEQ ID NO: 26472 - RNA, 18 nt, Artificial Sequence
  Description of Artificial Sequence: Synthetic oligonucleotide
cugugcucugugagcugc

SEQ ID NO: 26473 - RNA, 18 nt, Artificial Sequence
  Description of Artificial Sequence: Synthetic oligonucleotide
gaucucugugcucuguga

SEQ ID NO: 26474 - RNA, 18 nt, Artificial Sequence
  Description of Artificial Sequence: Synthetic oligonucleotide
ggcaggaucucugugcuc

SEQ ID NO: 26475 - RNA, 18 nt, Artificial Sequence
  Description of Artificial Sequence: Synthetic oligonucleotide
aagaaggcaggaucucug

SEQ ID NO: 26476 - RNA, 18 nt, Artificial Sequence
  Description of Artificial Sequence: Synthetic oligonucleotide
guaggaagaaggcaggau

SEQ ID NO: 26477 - RNA, 18 nt, Artificial Sequence
  Description of Artificial Sequence: Synthetic oligonucleotide
ugauaguaggaagaaggc

SEQ ID NO: 26478 - RNA, 18 nt, Artificial Sequence
  Description of Artificial Sequence: Synthetic oligonucleotide
cagccugauaguaggaag

SEQ ID NO: 26479 - RNA, 18 nt, Artificial Sequence
  Description of Artificial Sequence: Synthetic oligonucleotide
uaggucagccugauagua

SEQ ID NO: 26480 - RNA, 18 nt, Artificial Sequence
  Description of Artificial Sequence: Synthetic oligonucleotide
cccauuaggucagccuga

SEQ ID NO: 26481 - RNA, 18 nt, Artificial Sequence
  Description of Artificial Sequence: Synthetic oligonucleotide
ccaaccccauuaggucag

SEQ ID NO: 26482 - RNA, 18 nt, Artificial Sequence
  Description of Artificial Sequence: Synthetic oligonucleotide
gcagcccaaccccauuag

SEQ ID NO: 26483 - RNA, 18 nt, Artificial Sequence
  Description of Artificial Sequence: Synthetic oligonucleotide
gccgagcagcccaacccc

SEQ ID NO: 26484 - RNA, 18 nt, Artificial Sequence
  Description of Artificial Sequence: Synthetic oligonucleotide
caguugccgagcagccca

SEQ ID NO: 26485 - RNA, 18 nt, Artificial Sequence
  Description of Artificial Sequence: Synthetic oligonucleotide
ccaagcaguugccgagca

SEQ ID NO: 26486 - RNA, 18 nt, Artificial Sequence
  Description of Artificial Sequence: Synthetic oligonucleotide
gugacccaagcaguugcc

SEQ ID NO: 26487 - RNA, 18 nt, Artificial Sequence
  Description of Artificial Sequence: Synthetic oligonucleotide
gcaaggugacccaagcag

SEQ ID NO: 26488 - RNA, 18 nt, Artificial Sequence
  Description of Artificial Sequence: Synthetic oligonucleotide
gggcaaggugacccaagc

SEQ ID NO: 26489 - RNA, 18 nt, Artificial Sequence
  Description of Artificial Sequence: Synthetic oligonucleotide
agggcugguuuccuuggg

SEQ ID NO: 26490 - RNA, 18 nt, Artificial Sequence
  Description of Artificial Sequence: Synthetic oligonucleotide
cacccagggcugguuucc

SEQ ID NO: 26491 - RNA, 18 nt, Artificial Sequence
  Description of Artificial Sequence: Synthetic oligonucleotide
gguggcacccagggcugg

SEQ ID NO: 26492 - RNA, 18 nt, Artificial Sequence
  Description of Artificial Sequence: Synthetic oligonucleotide
ggcuggguggcacccagg

SEQ ID NO: 26493 - RNA, 18 nt, Artificial Sequence
  Description of Artificial Sequence: Synthetic oligonucleotide
uaaguggcuggguggcac

SEQ ID NO: 26494 - RNA, 18 nt, Artificial Sequence
  Description of Artificial Sequence: Synthetic oligonucleotide
gacccuaaguggcugggu

SEQ ID NO: 26495 - RNA, 18 nt, Artificial Sequence
  Description of Artificial Sequence: Synthetic oligonucleotide
cuguagacccuaaguggc

SEQ ID NO: 26496 - RNA, 18 nt, Artificial Sequence
  Description of Artificial Sequence: Synthetic oligonucleotide
ccacccuguagacccuaa

SEQ ID NO: 26497 - RNA, 18 nt, Artificial Sequence
  Description of Artificial Sequence: Synthetic oligonucleotide
gagucccacccuguagac

SEQ ID NO: 26498 - RNA, 18 nt, Artificial Sequence
  Description of Artificial Sequence: Synthetic oligonucleotide
gucuggagucccacccug

SEQ ID NO: 26499 - RNA, 18 nt, Artificial Sequence
  Description of Artificial Sequence: Synthetic oligonucleotide
ucuaggucuggaguccca

SEQ ID NO: 26500 - RNA, 18 nt, Artificial Sequence
  Description of Artificial Sequence: Synthetic oligonucleotide
uacgcucuaggucuggag

SEQ ID NO: 26501 - RNA, 18 nt, Artificial Sequence
  Description of Artificial Sequence: Synthetic oligonucleotide
auacuuacgcucuagguc

SEQ ID NO: 26502 - RNA, 18 nt, Artificial Sequence
  Description of Artificial Sequence: Synthetic oligonucleotide
cauccauacuuacgcucu

SEQ ID NO: 26503 - RNA, 18 nt, Artificial Sequence
  Description of Artificial Sequence: Synthetic oligonucleotide
cacaacauccauacuuac

SEQ ID NO: 26504 - RNA, 18 nt, Artificial Sequence
  Description of Artificial Sequence: Synthetic oligonucleotide
agggccacaacauccaua

SEQ ID NO: 26505 - RNA, 18 nt, Artificial Sequence
  Description of Artificial Sequence: Synthetic oligonucleotide
gacacagggccacaacau

SEQ ID NO: 26506 - RNA, 18 nt, Artificial Sequence
  Description of Artificial Sequence: Synthetic oligonucleotide
aggaagacacagggccac

SEQ ID NO: 26507 - RNA, 18 nt, Artificial Sequence
  Description of Artificial Sequence: Synthetic oligonucleotide
acacuaggaagacacagg

SEQ ID NO: 26508 - RNA, 18 nt, Artificial Sequence
  Description of Artificial Sequence: Synthetic oligonucleotide
gggucacacuaggaagac

SEQ ID NO: 26509 - RNA, 18 nt, Artificial Sequence
  Description of Artificial Sequence: Synthetic oligonucleotide
uggcugggucacacuagg

SEQ ID NO: 26510 - RNA, 18 nt, Artificial Sequence
  Description of Artificial Sequence: Synthetic oligonucleotide
gcuccuggcugggucaca

SEQ ID NO: 26511 - RNA, 18 nt, Artificial Sequence
  Description of Artificial Sequence: Synthetic oligonucleotide
cuuccgcuccuggcuggg

SEQ ID NO: 26512 - RNA, 18 nt, Artificial Sequence
  Description of Artificial Sequence: Synthetic oligonucleotide
ugaagcuuccgcuccugg

SEQ ID NO: 26513 - RNA, 18 nt, Artificial Sequence
  Description of Artificial Sequence: Synthetic oligonucleotide
acgccugaagcuuccgcu

SEQ ID NO: 26514 - RNA, 18 nt, Artificial Sequence
  Description of Artificial Sequence: Synthetic oligonucleotide
uacaaacgccugaagcuu

SEQ ID NO: 26515 - RNA, 18 nt, Artificial Sequence
  Description of Artificial Sequence: Synthetic oligonucleotide
cacuuuacaaacgccuga

SEQ ID NO: 26516 - RNA, 18 nt, Artificial Sequence
  Description of Artificial Sequence: Synthetic oligonucleotide
gaccucacuuuacaaacg

SEQ ID NO: 26517 - RNA, 18 nt, Artificial Sequence
  Description of Artificial Sequence: Synthetic oligonucleotide
agccagaccucacuuuac

SEQ ID NO: 26518 - RNA, 18 nt, Artificial Sequence
  Description of Artificial Sequence: Synthetic oligonucleotide
ggcagagccagaccucac

SEQ ID NO: 26519 - RNA, 18 nt, Artificial Sequence
  Description of Artificial Sequence: Synthetic oligonucleotide
gaggaggcagagccagac

SEQ ID NO: 26520 - RNA, 18 nt, Artificial Sequence
  Description of Artificial Sequence: Synthetic oligonucleotide
aaacggaggaggcagagc

SEQ ID NO: 26521 - RNA, 18 nt, Artificial Sequence
  Description of Artificial Sequence: Synthetic oligonucleotide
aaaaaaaacggaggaggc

SEQ ID NO: 26522 - RNA, 18 nt, Artificial Sequence
  Description of Artificial Sequence: Synthetic oligonucleotide
aaaaaaaaaaaaacggag

SEQ ID NO: 26523 - RNA, 18 nt, Artificial Sequence
  Description of Artificial Sequence: Synthetic oligonucleotide
acagaaaaaaaaaaaaaa

SEQ ID NO: 26524 - RNA, 18 nt, Artificial Sequence
  Description of Artificial Sequence: Synthetic oligonucleotide
cagaaacagaaaaaaaaa

SEQ ID NO: 26525 - RNA, 18 nt, Artificial Sequence
  Description of Artificial Sequence: Synthetic oligonucleotide
agaaacagaaacagaaaa

SEQ ID NO: 26526 - RNA, 18 nt, Artificial Sequence
  Description of Artificial Sequence: Synthetic oligonucleotide
aaaacagaaacagaaaca

SEQ ID NO: 26527 - RNA, 18 nt, Artificial Sequence
  Description of Artificial Sequence: Synthetic oligonucleotide
aaaaaaaaacagaaacag

SEQ ID NO: 26528 - RNA, 18 nt, Artificial Sequence
  Description of Artificial Sequence: Synthetic oligonucleotide
ucucaaaaaaaaaacaga

SEQ ID NO: 26529 - RNA, 18 nt, Artificial Sequence
  Description of Artificial Sequence: Synthetic oligonucleotide
cuccaucucaaaaaaaaa

SEQ ID NO: 26530 - RNA, 18 nt, Artificial Sequence
  Description of Artificial Sequence: Synthetic oligonucleotide
cgagacuccaucucaaaa

SEQ ID NO: 26531 - RNA, 18 nt, Artificial Sequence
  Description of Artificial Sequence: Synthetic oligonucleotide
cagagcgagacuccaucu

SEQ ID NO: 26532 - RNA, 18 nt, Artificial Sequence
  Description of Artificial Sequence: Synthetic oligonucleotide
ggcgacagagcgagacuc

SEQ ID NO: 26533 - RNA, 18 nt, Artificial Sequence
  Description of Artificial Sequence: Synthetic oligonucleotide
gccugggcgacagagcga

SEQ ID NO: 26534 - RNA, 18 nt, Artificial Sequence
  Description of Artificial Sequence: Synthetic oligonucleotide
cuccagccugggcgacag

SEQ ID NO: 26535 - RNA, 18 nt, Artificial Sequence
  Description of Artificial Sequence: Synthetic oligonucleotide
cugcacuccagccugggc

SEQ ID NO: 26536 - RNA, 18 nt, Artificial Sequence
  Description of Artificial Sequence: Synthetic oligonucleotide
ugacacugcacuccagcc

SEQ ID NO: 26537 - RNA, 18 nt, Artificial Sequence
  Description of Artificial Sequence: Synthetic oligonucleotide
gaucgugacacugcacuc

SEQ ID NO: 26538 - RNA, 18 nt, Artificial Sequence
  Description of Artificial Sequence: Synthetic oligonucleotide
gcugagaucgugacacug

SEQ ID NO: 26539 - RNA, 18 nt, Artificial Sequence
  Description of Artificial Sequence: Synthetic oligonucleotide
agugagcugagaucguga

SEQ ID NO: 26540 - RNA, 18 nt, Artificial Sequence
  Description of Artificial Sequence: Synthetic oligonucleotide
guugcagugagcugagau

SEQ ID NO: 26541 - RNA, 18 nt, Artificial Sequence
  Description of Artificial Sequence: Synthetic oligonucleotide
cggagguugcagugagcu

SEQ ID NO: 26542 - RNA, 18 nt, Artificial Sequence
  Description of Artificial Sequence: Synthetic oligonucleotide
ggaggcggagguugcagu

SEQ ID NO: 26543 - RNA, 18 nt, Artificial Sequence
  Description of Artificial Sequence: Synthetic oligonucleotide
accugggaggcggagguu

SEQ ID NO: 26544 - RNA, 18 nt, Artificial Sequence
  Description of Artificial Sequence: Synthetic oligonucleotide
cuuguaccugggaggcgg

SEQ ID NO: 26545 - RNA, 18 nt, Artificial Sequence
  Description of Artificial Sequence: Synthetic oligonucleotide
aaucucuuguaccuggga

SEQ ID NO: 26546 - RNA, 18 nt, Artificial Sequence
  Description of Artificial Sequence: Synthetic oligonucleotide
aggagaaucucuuguacc

SEQ ID NO: 26547 - RNA, 18 nt, Artificial Sequence
  Description of Artificial Sequence: Synthetic oligonucleotide
gaggcaggagaaucucuu

SEQ ID NO: 26548 - RNA, 18 nt, Artificial Sequence
  Description of Artificial Sequence: Synthetic oligonucleotide
aggcugaggcaggagaau

SEQ ID NO: 26549 - RNA, 18 nt, Artificial Sequence
  Description of Artificial Sequence: Synthetic oligonucleotide
ucgggaggcugaggcagg

SEQ ID NO: 26550 - RNA, 18 nt, Artificial Sequence
  Description of Artificial Sequence: Synthetic oligonucleotide
gcuacucgggaggcugag

SEQ ID NO: 26551 - RNA, 18 nt, Artificial Sequence
  Description of Artificial Sequence: Synthetic oligonucleotide
ucccagcuacucgggagg

SEQ ID NO: 26552 - RNA, 18 nt, Artificial Sequence
  Description of Artificial Sequence: Synthetic oligonucleotide
uguagucccagcuacucg

SEQ ID NO: 26553 - RNA, 18 nt, Artificial Sequence
  Description of Artificial Sequence: Synthetic oligonucleotide
acgccuguagucccagcu

SEQ ID NO: 26554 - RNA, 18 nt, Artificial Sequence
  Description of Artificial Sequence: Synthetic oligonucleotide
ggcacacgccuguagucc

SEQ ID NO: 26555 - RNA, 18 nt, Artificial Sequence
  Description of Artificial Sequence: Synthetic oligonucleotide
augguggcacacgccugu

SEQ ID NO: 26556 - RNA, 18 nt, Artificial Sequence
  Description of Artificial Sequence: Synthetic oligonucleotide
caggcaugguggcacacg

SEQ ID NO: 26557 - RNA, 18 nt, Artificial Sequence
  Description of Artificial Sequence: Synthetic oligonucleotide
uuagccaggcaugguggc

SEQ ID NO: 26558 - RNA, 18 nt, Artificial Sequence
  Description of Artificial Sequence: Synthetic oligonucleotide
aaaaauuagccaggcaug

SEQ ID NO: 26559 - RNA, 18 nt, Artificial Sequence
  Description of Artificial Sequence: Synthetic oligonucleotide
aauacaaaaauuagccag

SEQ ID NO: 26560 - RNA, 18 nt, Artificial Sequence
  Description of Artificial Sequence: Synthetic oligonucleotide
cuaaaaauacaaaaauua

SEQ ID NO: 26561 - RNA, 18 nt, Artificial Sequence
  Description of Artificial Sequence: Synthetic oligonucleotide
cucuacuaaaaauacaaa

SEQ ID NO: 26562 - RNA, 18 nt, Artificial Sequence
  Description of Artificial Sequence: Synthetic oligonucleotide
cccaucucuacuaaaaau

SEQ ID NO: 26563 - RNA, 18 nt, Artificial Sequence
  Description of Artificial Sequence: Synthetic oligonucleotide
gaaaccccaucucuacua

SEQ ID NO: 26564 - RNA, 18 nt, Artificial Sequence
  Description of Artificial Sequence: Synthetic oligonucleotide
auggcgaaaccccaucuc

SEQ ID NO: 26565 - RNA, 18 nt, Artificial Sequence
  Description of Artificial Sequence: Synthetic oligonucleotide
cuaacauggcgaaacccc

SEQ ID NO: 26566 - RNA, 18 nt, Artificial Sequence
  Description of Artificial Sequence: Synthetic oligonucleotide
ucuggcuaacauggcgaa

SEQ ID NO: 26567 - RNA, 18 nt, Artificial Sequence
  Description of Artificial Sequence: Synthetic oligonucleotide
accagucuggcuaacaug

SEQ ID NO: 26568 - RNA, 18 nt, Artificial Sequence
  Description of Artificial Sequence: Synthetic oligonucleotide
ucgagaccagucuggcua

SEQ ID NO: 26569 - RNA, 18 nt, Artificial Sequence
  Description of Artificial Sequence: Synthetic oligonucleotide
ggaguucgagaccagucu

SEQ ID NO: 26570 - RNA, 18 nt, Artificial Sequence
  Description of Artificial Sequence: Synthetic oligonucleotide
ggucaggaguucgagacc

SEQ ID NO: 26571 - RNA, 18 nt, Artificial Sequence
  Description of Artificial Sequence: Synthetic oligonucleotide
ccugaggucaggaguucg

SEQ ID NO: 26572 - RNA, 18 nt, Artificial Sequence
  Description of Artificial Sequence: Synthetic oligonucleotide
gaucaccugaggucagga

SEQ ID NO: 26573 - RNA, 18 nt, Artificial Sequence
  Description of Artificial Sequence: Synthetic oligonucleotide
gggaggaucaccugaggu

SEQ ID NO: 26574 - RNA, 18 nt, Artificial Sequence
  Description of Artificial Sequence: Synthetic oligonucleotide
gggugggaggaucaccug

SEQ ID NO: 26575 - RNA, 18 nt, Artificial Sequence
  Description of Artificial Sequence: Synthetic oligonucleotide
gaacuuugggaagccggg

SEQ ID NO: 26576 - RNA, 18 nt, Artificial Sequence
  Description of Artificial Sequence: Synthetic oligonucleotide
ucccagaacuuugggaag

SEQ ID NO: 26577 - RNA, 18 nt, Artificial Sequence
  Description of Artificial Sequence: Synthetic oligonucleotide
uauaaucccagaacuuug

SEQ ID NO: 26578 - RNA, 18 nt, Artificial Sequence
  Description of Artificial Sequence: Synthetic oligonucleotide
acgccuauaaucccagaa

SEQ ID NO: 26579 - RNA, 18 nt, Artificial Sequence
  Description of Artificial Sequence: Synthetic oligonucleotide
ggcucacgccuauaaucc

SEQ ID NO: 26580 - RNA, 18 nt, Artificial Sequence
  Description of Artificial Sequence: Synthetic oligonucleotide
augguggcucacgccuau

SEQ ID NO: 26581 - RNA, 18 nt, Artificial Sequence
  Description of Artificial Sequence: Synthetic oligonucleotide
cgggcaugguggcucacg

SEQ ID NO: 26582 - RNA, 18 nt, Artificial Sequence
  Description of Artificial Sequence: Synthetic oligonucleotide
gagaccgggcaugguggc

SEQ ID NO: 26583 - RNA, 18 nt, Artificial Sequence
  Description of Artificial Sequence: Synthetic oligonucleotide
gagaagagaccgggcaug

SEQ ID NO: 26584 - RNA, 18 nt, Artificial Sequence
  Description of Artificial Sequence: Synthetic oligonucleotide
agacugagaagagaccgg

SEQ ID NO: 26585 - RNA, 18 nt, Artificial Sequence
  Description of Artificial Sequence: Synthetic oligonucleotide
cuucaagacugagaagag

SEQ ID NO: 26586 - RNA, 18 nt, Artificial Sequence
  Description of Artificial Sequence: Synthetic oligonucleotide
augggcuucaagacugag

SEQ ID NO: 26587 - RNA, 18 nt, Artificial Sequence
  Description of Artificial Sequence: Synthetic oligonucleotide
cagggaugggcuucaaga

SEQ ID NO: 26588 - RNA, 18 nt, Artificial Sequence
  Description of Artificial Sequence: Synthetic oligonucleotide
aaauccagggaugggcuu

SEQ ID NO: 26589 - RNA, 18 nt, Artificial Sequence
  Description of Artificial Sequence: Synthetic oligonucleotide
gguggaaauccagggaug

SEQ ID NO: 26590 - RNA, 18 nt, Artificial Sequence
  Description of Artificial Sequence: Synthetic oligonucleotide
cuccugguggaaauccag

SEQ ID NO: 26591 - RNA, 18 nt, Artificial Sequence
  Description of Artificial Sequence: Synthetic oligonucleotide
aguaacuccugguggaaa

SEQ ID NO: 26592 - RNA, 18 nt, Artificial Sequence
  Description of Artificial Sequence: Synthetic oligonucleotide
aggaaaguaacuccuggu

SEQ ID NO: 26593 - RNA, 18 nt, Artificial Sequence
  Description of Artificial Sequence: Synthetic oligonucleotide
ucaggaggaaaguaacuc

SEQ ID NO: 26594 - RNA, 18 nt, Artificial Sequence
  Description of Artificial Sequence: Synthetic oligonucleotide
acaggucaggaggaaagu

SEQ ID NO: 26595 - RNA, 18 nt, Artificial Sequence
  Description of Artificial Sequence: Synthetic oligonucleotide
aauuuacaggucaggagg

SEQ ID NO: 26596 - RNA, 18 nt, Artificial Sequence
  Description of Artificial Sequence: Synthetic oligonucleotide
gaacaaauuuacagguca

SEQ ID NO: 26597 - RNA, 18 nt, Artificial Sequence
  Description of Artificial Sequence: Synthetic oligonucleotide
uuaaagaacaaauuuaca

SEQ ID NO: 26598 - RNA, 18 nt, Artificial Sequence
  Description of Artificial Sequence: Synthetic oligonucleotide
cauuguuaaagaacaaau

SEQ ID NO: 26599 - RNA, 18 nt, Artificial Sequence
  Description of Artificial Sequence: Synthetic oligonucleotide
gcagccauuguuaaagaa

SEQ ID NO: 26600 - RNA, 18 nt, Artificial Sequence
  Description of Artificial Sequence: Synthetic oligonucleotide
caccugcagccauuguua

SEQ ID NO: 26601 - RNA, 18 nt, Artificial Sequence
  Description of Artificial Sequence: Synthetic oligonucleotide
gcucccaccugcagccau

SEQ ID NO: 26602 - RNA, 18 nt, Artificial Sequence
  Description of Artificial Sequence: Synthetic oligonucleotide
cauaugcucccaccugca

SEQ ID NO: 26603 - RNA, 18 nt, Artificial Sequence
  Description of Artificial Sequence: Synthetic oligonucleotide
accaccauaugcucccac

SEQ ID NO: 26604 - RNA, 18 nt, Artificial Sequence
  Description of Artificial Sequence: Synthetic oligonucleotide
uauaaaccaccauaugcu

SEQ ID NO: 26605 - RNA, 18 nt, Artificial Sequence
  Description of Artificial Sequence: Synthetic oligonucleotide
guuuuuauaaaccaccau

SEQ ID NO: 26606 - RNA, 18 nt, Artificial Sequence
  Description of Artificial Sequence: Synthetic oligonucleotide
acagcguuuuuauaaacc

SEQ ID NO: 26607 - RNA, 18 nt, Artificial Sequence
  Description of Artificial Sequence: Synthetic oligonucleotide
gcccgacagcguuuuuau

SEQ ID NO: 26608 - RNA, 18 nt, Artificial Sequence
  Description of Artificial Sequence: Synthetic oligonucleotide
acaaagcccgacagcguu

SEQ ID NO: 26609 - RNA, 18 nt, Artificial Sequence
  Description of Artificial Sequence: Synthetic oligonucleotide
aggaaacaaagcccgaca

SEQ ID NO: 26610 - RNA, 18 nt, Artificial Sequence
  Description of Artificial Sequence: Synthetic oligonucleotide
aaagaaggaaacaaagcc

SEQ ID NO: 26611 - RNA, 18 nt, Artificial Sequence
  Description of Artificial Sequence: Synthetic oligonucleotide
cagcuaaagaaggaaaca

SEQ ID NO: 26612 - RNA, 18 nt, Artificial Sequence
  Description of Artificial Sequence: Synthetic oligonucleotide
cacggcagcuaaagaagg

SEQ ID NO: 26613 - RNA, 18 nt, Artificial Sequence
  Description of Artificial Sequence: Synthetic oligonucleotide
guagacacggcagcuaaa

SEQ ID NO: 26614 - RNA, 18 nt, Artificial Sequence
  Description of Artificial Sequence: Synthetic oligonucleotide
cagaaguagacacggcag

SEQ ID NO: 26615 - RNA, 18 nt, Artificial Sequence
  Description of Artificial Sequence: Synthetic oligonucleotide
gacuucagaaguagacac

SEQ ID NO: 26616 - RNA, 18 nt, Artificial Sequence
  Description of Artificial Sequence: Synthetic oligonucleotide
ucccagacuucagaagua

SEQ ID NO: 26617 - RNA, 18 nt, Artificial Sequence
  Description of Artificial Sequence: Synthetic oligonucleotide
gcacuucccagacuucag

SEQ ID NO: 26618 - RNA, 18 nt, Artificial Sequence
  Description of Artificial Sequence: Synthetic oligonucleotide
gcuuggcacuucccagac

SEQ ID NO: 26619 - RNA, 18 nt, Artificial Sequence
  Description of Artificial Sequence: Synthetic oligonucleotide
gcguggcuuggcacuucc

SEQ ID NO: 26620 - RNA, 18 nt, Artificial Sequence
  Description of Artificial Sequence: Synthetic oligonucleotide
aggccgcguggcuuggca

SEQ ID NO: 26621 - RNA, 18 nt, Artificial Sequence
  Description of Artificial Sequence: Synthetic oligonucleotide
ccuugaggccgcguggcu

SEQ ID NO: 26622 - RNA, 18 nt, Artificial Sequence
  Description of Artificial Sequence: Synthetic oligonucleotide
agcucccuugaggccgcg

SEQ ID NO: 26623 - RNA, 18 nt, Artificial Sequence
  Description of Artificial Sequence: Synthetic oligonucleotide
cagccagcucccuugagg

SEQ ID NO: 26624 - RNA, 18 nt, Artificial Sequence
  Description of Artificial Sequence: Synthetic oligonucleotide
aacaccagccagcucccu

SEQ ID NO: 26625 - RNA, 18 nt, Artificial Sequence
  Description of Artificial Sequence: Synthetic oligonucleotide
gcucaaacaccagccagc

SEQ ID NO: 26626 - RNA, 18 nt, Artificial Sequence
  Description of Artificial Sequence: Synthetic oligonucleotide
ccacagcucaaacaccag

SEQ ID NO: 26627 - RNA, 18 nt, Artificial Sequence
  Description of Artificial Sequence: Synthetic oligonucleotide
uucugccacagcucaaac

SEQ ID NO: 26628 - RNA, 18 nt, Artificial Sequence
  Description of Artificial Sequence: Synthetic oligonucleotide
ggugcuucugccacagcu

SEQ ID NO: 26629 - RNA, 18 nt, Artificial Sequence
  Description of Artificial Sequence: Synthetic oligonucleotide
ccccaggugcuucugcca

SEQ ID NO: 26630 - RNA, 18 nt, Artificial Sequence
  Description of Artificial Sequence: Synthetic oligonucleotide
uggagccccaggugcuuc

SEQ ID NO: 26631 - RNA, 18 nt, Artificial Sequence
  Description of Artificial Sequence: Synthetic oligonucleotide
cucccuggagccccaggu

SEQ ID NO: 26632 - RNA, 18 nt, Artificial Sequence
  Description of Artificial Sequence: Synthetic oligonucleotide
gccugcucccuggagccc

SEQ ID NO: 26633 - RNA, 18 nt, Artificial Sequence
  Description of Artificial Sequence: Synthetic oligonucleotide
ucccagccugcucccugg

SEQ ID NO: 26634 - RNA, 18 nt, Artificial Sequence
  Description of Artificial Sequence: Synthetic oligonucleotide
gcaguucccagccugcuc

SEQ ID NO: 26635 - RNA, 18 nt, Artificial Sequence
  Description of Artificial Sequence: Synthetic oligonucleotide
guccugcaguucccagcc

SEQ ID NO: 26636 - RNA, 18 nt, Artificial Sequence
  Description of Artificial Sequence: Synthetic oligonucleotide
gcaagguccugcaguucc

SEQ ID NO: 26637 - RNA, 18 nt, Artificial Sequence
  Description of Artificial Sequence: Synthetic oligonucleotide
gcugagcaagguccugca

SEQ ID NO: 26638 - RNA, 18 nt, Artificial Sequence
  Description of Artificial Sequence: Synthetic oligonucleotide
uccuggcugagcaagguc

SEQ ID NO: 26639 - RNA, 18 nt, Artificial Sequence
  Description of Artificial Sequence: Synthetic oligonucleotide
agugcuccuggcugagca

SEQ ID NO: 26640 - RNA, 18 nt, Artificial Sequence
  Description of Artificial Sequence: Synthetic oligonucleotide
gggaagugcuccuggcug

SEQ ID NO: 26641 - RNA, 18 nt, Artificial Sequence
  Description of Artificial Sequence: Synthetic oligonucleotide
uuccugccucaaggaggg

SEQ ID NO: 26642 - RNA, 18 nt, Artificial Sequence
  Description of Artificial Sequence: Synthetic oligonucleotide
caguauuccugccucaag

SEQ ID NO: 26643 - RNA, 18 nt, Artificial Sequence
  Description of Artificial Sequence: Synthetic oligonucleotide
caccucaguauuccugcc

SEQ ID NO: 26644 - RNA, 18 nt, Artificial Sequence
  Description of Artificial Sequence: Synthetic oligonucleotide
ggaggcaccucaguauuc

SEQ ID NO: 26645 - RNA, 18 nt, Artificial Sequence
  Description of Artificial Sequence: Synthetic oligonucleotide
gggaggcaccucaguauu

SEQ ID NO: 26646 - RNA, 18 nt, Artificial Sequence
  Description of Artificial Sequence: Synthetic oligonucleotide
accuucuccaucuguggg

SEQ ID NO: 26647 - RNA, 18 nt, Artificial Sequence
  Description of Artificial Sequence: Synthetic oligonucleotide
ucuccaccuucuccaucu

SEQ ID NO: 26648 - RNA, 18 nt, Artificial Sequence
  Description of Artificial Sequence: Synthetic oligonucleotide
ccuccucuccaccuucuc

SEQ ID NO: 26649 - RNA, 18 nt, Artificial Sequence
  Description of Artificial Sequence: Synthetic oligonucleotide
cccauccuccucuccacc

SEQ ID NO: 26650 - RNA, 18 nt, Artificial Sequence
  Description of Artificial Sequence: Synthetic oligonucleotide
ugaggcccauccuccucu

SEQ ID NO: 26651 - RNA, 18 nt, Artificial Sequence
  Description of Artificial Sequence: Synthetic oligonucleotide
gcuccugaggcccauccu

SEQ ID NO: 26652 - RNA, 18 nt, Artificial Sequence
  Description of Artificial Sequence: Synthetic oligonucleotide
gagaugcuccugaggccc

SEQ ID NO: 26653 - RNA, 18 nt, Artificial Sequence
  Description of Artificial Sequence: Synthetic oligonucleotide
ggcuugagaugcuccuga

SEQ ID NO: 26654 - RNA, 18 nt, Artificial Sequence
  Description of Artificial Sequence: Synthetic oligonucleotide
gggcuugagaugcuccug

SEQ ID NO: 26655 - RNA, 18 nt, Artificial Sequence
  Description of Artificial Sequence: Synthetic oligonucleotide
cuuucuccugcuacuggg

SEQ ID NO: 26656 - RNA, 18 nt, Artificial Sequence
  Description of Artificial Sequence: Synthetic oligonucleotide
ucuuucuuucuccugcua

SEQ ID NO: 26657 - RNA, 18 nt, Artificial Sequence
  Description of Artificial Sequence: Synthetic oligonucleotide
cucuuucuuucuuucucc

SEQ ID NO: 26658 - RNA, 18 nt, Artificial Sequence
  Description of Artificial Sequence: Synthetic oligonucleotide
ggcaucucuuucuuucuu

SEQ ID NO: 26659 - RNA, 18 nt, Artificial Sequence
  Description of Artificial Sequence: Synthetic oligonucleotide
aaccaggcaucucuuucu

SEQ ID NO: 26660 - RNA, 18 nt, Artificial Sequence
  Description of Artificial Sequence: Synthetic oligonucleotide
gugaaaaccaggcaucuc

SEQ ID NO: 26661 - RNA, 18 nt, Artificial Sequence
  Description of Artificial Sequence: Synthetic oligonucleotide
agucugugaaaaccaggc

SEQ ID NO: 26662 - RNA, 18 nt, Artificial Sequence
  Description of Artificial Sequence: Synthetic oligonucleotide
gaaccagucugugaaaac

SEQ ID NO: 26663 - RNA, 18 nt, Artificial Sequence
  Description of Artificial Sequence: Synthetic oligonucleotide
cacaggaaccagucugug

SEQ ID NO: 26664 - RNA, 18 nt, Artificial Sequence
  Description of Artificial Sequence: Synthetic oligonucleotide
ccagccacaggaaccagu

SEQ ID NO: 26665 - RNA, 18 nt, Artificial Sequence
  Description of Artificial Sequence: Synthetic oligonucleotide
ucaucccagccacaggaa

SEQ ID NO: 26666 - RNA, 18 nt, Artificial Sequence
  Description of Artificial Sequence: Synthetic oligonucleotide
ugcagucaucccagccac

SEQ ID NO: 26667 - RNA, 18 nt, Artificial Sequence
  Description of Artificial Sequence: Synthetic oligonucleotide
aaggaugcagucauccca

SEQ ID NO: 26668 - RNA, 18 nt, Artificial Sequence
  Description of Artificial Sequence: Synthetic oligonucleotide
aaaaaaaggaugcaguca

SEQ ID NO: 26669 - RNA, 18 nt, Artificial Sequence
  Description of Artificial Sequence: Synthetic oligonucleotide
aaaaaaaaaaaaggaugc

SEQ ID NO: 26670 - RNA, 18 nt, Artificial Sequence
  Description of Artificial Sequence: Synthetic oligonucleotide
caaaaaaaaaaaaaaaag

SEQ ID NO: 26671 - RNA, 18 nt, Artificial Sequence
  Description of Artificial Sequence: Synthetic oligonucleotide
cgucucaaaaaaaaaaaa

SEQ ID NO: 26672 - RNA, 18 nt, Artificial Sequence
  Description of Artificial Sequence: Synthetic oligonucleotide
aacuccgucucaaaaaaa

SEQ ID NO: 26673 - RNA, 18 nt, Artificial Sequence
  Description of Artificial Sequence: Synthetic oligonucleotide
gcaaaaacuccgucucaa

SEQ ID NO: 26674 - RNA, 18 nt, Artificial Sequence
  Description of Artificial Sequence: Synthetic oligonucleotide
caaaggcaaaaacuccgu

SEQ ID NO: 26675 - RNA, 18 nt, Artificial Sequence
  Description of Artificial Sequence: Synthetic oligonucleotide
ggcgacaaaggcaaaaac

SEQ ID NO: 26676 - RNA, 18 nt, Artificial Sequence
  Description of Artificial Sequence: Synthetic oligonucleotide
gccugggcgacaaaggca

SEQ ID NO: 26677 - RNA, 18 nt, Artificial Sequence
  Description of Artificial Sequence: Synthetic oligonucleotide
cuccagccugggcgacaa

SEQ ID NO: 26678 - RNA, 18 nt, Artificial Sequence
  Description of Artificial Sequence: Synthetic oligonucleotide
uugcacuccagccugggc

SEQ ID NO: 26679 - RNA, 18 nt, Artificial Sequence
  Description of Artificial Sequence: Synthetic oligonucleotide
cgccauugcacuccagcc

SEQ ID NO: 26680 - RNA, 18 nt, Artificial Sequence
  Description of Artificial Sequence: Synthetic oligonucleotide
gaucacgccauugcacuc

SEQ ID NO: 26681 - RNA, 18 nt, Artificial Sequence
  Description of Artificial Sequence: Synthetic oligonucleotide
gccgagaucacgccauug

SEQ ID NO: 26682 - RNA, 18 nt, Artificial Sequence
  Description of Artificial Sequence: Synthetic oligonucleotide
ggugagccgagaucacgc

SEQ ID NO: 26683 - RNA, 18 nt, Artificial Sequence
  Description of Artificial Sequence: Synthetic oligonucleotide
guugcggugagccgagau

SEQ ID NO: 26684 - RNA, 18 nt, Artificial Sequence
  Description of Artificial Sequence: Synthetic oligonucleotide
cggagguugcggugagcc

SEQ ID NO: 26685 - RNA, 18 nt, Artificial Sequence
  Description of Artificial Sequence: Synthetic oligonucleotide
ggaggcggagguugcggu

SEQ ID NO: 26686 - RNA, 18 nt, Artificial Sequence
  Description of Artificial Sequence: Synthetic oligonucleotide
auccgggaggcggagguu

SEQ ID NO: 26687 - RNA, 18 nt, Artificial Sequence
  Description of Artificial Sequence: Synthetic oligonucleotide
cuugaauccgggaggcgg

SEQ ID NO: 26688 - RNA, 18 nt, Artificial Sequence
  Description of Artificial Sequence: Synthetic oligonucleotide
aauugcuugaauccggga

SEQ ID NO: 26689 - RNA, 18 nt, Artificial Sequence
  Description of Artificial Sequence: Synthetic oligonucleotide
aggagaauugcuugaauc

SEQ ID NO: 26690 - RNA, 18 nt, Artificial Sequence
  Description of Artificial Sequence: Synthetic oligonucleotide
gaggcaggagaauugcuu

SEQ ID NO: 26691 - RNA, 18 nt, Artificial Sequence
  Description of Artificial Sequence: Synthetic oligonucleotide
aggcugaggcaggagaau

SEQ ID NO: 26692 - RNA, 18 nt, Artificial Sequence
  Description of Artificial Sequence: Synthetic oligonucleotide
ucgggaggcugaggcagg

SEQ ID NO: 26693 - RNA, 18 nt, Artificial Sequence
  Description of Artificial Sequence: Synthetic oligonucleotide
gcuacucgggaggcugag

SEQ ID NO: 26694 - RNA, 18 nt, Artificial Sequence
  Description of Artificial Sequence: Synthetic oligonucleotide
ucccagcuacucgggagg

SEQ ID NO: 26695 - RNA, 18 nt, Artificial Sequence
  Description of Artificial Sequence: Synthetic oligonucleotide
uguaaucccagcuacucg

SEQ ID NO: 26696 - RNA, 18 nt, Artificial Sequence
  Description of Artificial Sequence: Synthetic oligonucleotide
gugccuguaaucccagcu

SEQ ID NO: 26697 - RNA, 18 nt, Artificial Sequence
  Description of Artificial Sequence: Synthetic oligonucleotide
ggugcgugccuguaaucc

SEQ ID NO: 26698 - RNA, 18 nt, Artificial Sequence
  Description of Artificial Sequence: Synthetic oligonucleotide
guggaggugcgugccugu

SEQ ID NO: 26699 - RNA, 18 nt, Artificial Sequence
  Description of Artificial Sequence: Synthetic oligonucleotide
cggacguggaggugcgug

SEQ ID NO: 26700 - RNA, 18 nt, Artificial Sequence
  Description of Artificial Sequence: Synthetic oligonucleotide
uuagccggacguggaggu

SEQ ID NO: 26701 - RNA, 18 nt, Artificial Sequence
  Description of Artificial Sequence: Synthetic oligonucleotide
caaaauuagccggacgug

SEQ ID NO: 26702 - RNA, 18 nt, Artificial Sequence
  Description of Artificial Sequence: Synthetic oligonucleotide
aaauacaaaauuagccgg

SEQ ID NO: 26703 - RNA, 18 nt, Artificial Sequence
  Description of Artificial Sequence: Synthetic oligonucleotide
acuaaaaauacaaaauua

SEQ ID NO: 26704 - RNA, 18 nt, Artificial Sequence
  Description of Artificial Sequence: Synthetic oligonucleotide
ucuccacuaaaaauacaa

SEQ ID NO: 26705 - RNA, 18 nt, Artificial Sequence
  Description of Artificial Sequence: Synthetic oligonucleotide
ccccgucuccacuaaaaa

SEQ ID NO: 26706 - RNA, 18 nt, Artificial Sequence
  Description of Artificial Sequence: Synthetic oligonucleotide
agaaaccccgucuccacu

SEQ ID NO: 26707 - RNA, 18 nt, Artificial Sequence
  Description of Artificial Sequence: Synthetic oligonucleotide
cauggagaaaccccgucu

SEQ ID NO: 26708 - RNA, 18 nt, Artificial Sequence
  Description of Artificial Sequence: Synthetic oligonucleotide
accgacauggagaaaccc

SEQ ID NO: 26709 - RNA, 18 nt, Artificial Sequence
  Description of Artificial Sequence: Synthetic oligonucleotide
gccugaccgacauggaga

SEQ ID NO: 26710 - RNA, 18 nt, Artificial Sequence
  Description of Artificial Sequence: Synthetic oligonucleotide
gaccagccugaccgacau

SEQ ID NO: 26711 - RNA, 18 nt, Artificial Sequence
  Description of Artificial Sequence: Synthetic oligonucleotide
uucgagaccagccugacc

SEQ ID NO: 26712 - RNA, 18 nt, Artificial Sequence
  Description of Artificial Sequence: Synthetic oligonucleotide
gggaguucgagaccagcc

SEQ ID NO: 26713 - RNA, 18 nt, Artificial Sequence
  Description of Artificial Sequence: Synthetic oligonucleotide
aggucgggaguucgagac

SEQ ID NO: 26714 - RNA, 18 nt, Artificial Sequence
  Description of Artificial Sequence: Synthetic oligonucleotide
accugaggucgggaguuc

SEQ ID NO: 26715 - RNA, 18 nt, Artificial Sequence
  Description of Artificial Sequence: Synthetic oligonucleotide
agaucaccugaggucggg

SEQ ID NO: 26716 - RNA, 18 nt, Artificial Sequence
  Description of Artificial Sequence: Synthetic oligonucleotide
ugggcagaucaccugagg

SEQ ID NO: 26717 - RNA, 18 nt, Artificial Sequence
  Description of Artificial Sequence: Synthetic oligonucleotide
cgaggugggcagaucacc

SEQ ID NO: 26718 - RNA, 18 nt, Artificial Sequence
  Description of Artificial Sequence: Synthetic oligonucleotide
gaggccgaggugggcaga

SEQ ID NO: 26719 - RNA, 18 nt, Artificial Sequence
  Description of Artificial Sequence: Synthetic oligonucleotide
uuugggaggccgaggugg

SEQ ID NO: 26720 - RNA, 18 nt, Artificial Sequence
  Description of Artificial Sequence: Synthetic oligonucleotide
agcacuuugggaggccga

SEQ ID NO: 26721 - RNA, 18 nt, Artificial Sequence
  Description of Artificial Sequence: Synthetic oligonucleotide
aucccagcacuuugggag

SEQ ID NO: 26722 - RNA, 18 nt, Artificial Sequence
  Description of Artificial Sequence: Synthetic oligonucleotide
cuguaaucccagcacuuu

SEQ ID NO: 26723 - RNA, 18 nt, Artificial Sequence
  Description of Artificial Sequence: Synthetic oligonucleotide
caugccuguaaucccagc

SEQ ID NO: 26724 - RNA, 18 nt, Artificial Sequence
  Description of Artificial Sequence: Synthetic oligonucleotide
uggcucaugccuguaauc

SEQ ID NO: 26725 - RNA, 18 nt, Artificial Sequence
  Description of Artificial Sequence: Synthetic oligonucleotide
cgcgguggcucaugccug

SEQ ID NO: 26726 - RNA, 18 nt, Artificial Sequence
  Description of Artificial Sequence: Synthetic oligonucleotide
ccaagcgcgguggcucau

SEQ ID NO: 26727 - RNA, 18 nt, Artificial Sequence
  Description of Artificial Sequence: Synthetic oligonucleotide
ucuggccaagcgcggugg

SEQ ID NO: 26728 - RNA, 18 nt, Artificial Sequence
  Description of Artificial Sequence: Synthetic oligonucleotide
cgcagucuggccaagcgc

SEQ ID NO: 26729 - RNA, 18 nt, Artificial Sequence
  Description of Artificial Sequence: Synthetic oligonucleotide
aaggacgcagucuggcca

SEQ ID NO: 26730 - RNA, 18 nt, Artificial Sequence
  Description of Artificial Sequence: Synthetic oligonucleotide
uuaaaaaggacgcagucu

SEQ ID NO: 26731 - RNA, 18 nt, Artificial Sequence
  Description of Artificial Sequence: Synthetic oligonucleotide
uucgcuuaaaaaggacgc

SEQ ID NO: 26732 - RNA, 18 nt, Artificial Sequence
  Description of Artificial Sequence: Synthetic oligonucleotide
aaauguucgcuuaaaaag

SEQ ID NO: 26733 - RNA, 18 nt, Artificial Sequence
  Description of Artificial Sequence: Synthetic oligonucleotide
cccuaaaauguucgcuua

SEQ ID NO: 26734 - RNA, 18 nt, Artificial Sequence
  Description of Artificial Sequence: Synthetic oligonucleotide
ccaggcccuaaaauguuc

SEQ ID NO: 26735 - RNA, 18 nt, Artificial Sequence
  Description of Artificial Sequence: Synthetic oligonucleotide
aacucccaggcccuaaaa

SEQ ID NO: 26736 - RNA, 18 nt, Artificial Sequence
  Description of Artificial Sequence: Synthetic oligonucleotide
ugacaaacucccaggccc

SEQ ID NO: 26737 - RNA, 18 nt, Artificial Sequence
  Description of Artificial Sequence: Synthetic oligonucleotide
uuacuugacaaacuccca

SEQ ID NO: 26738 - RNA, 18 nt, Artificial Sequence
  Description of Artificial Sequence: Synthetic oligonucleotide
cuuccuuacuugacaaac

SEQ ID NO: 26739 - RNA, 18 nt, Artificial Sequence
  Description of Artificial Sequence: Synthetic oligonucleotide
ugagacuuccuuacuuga

SEQ ID NO: 26740 - RNA, 18 nt, Artificial Sequence
  Description of Artificial Sequence: Synthetic oligonucleotide
gggcuugagacuuccuua

SEQ ID NO: 26741 - RNA, 18 nt, Artificial Sequence
  Description of Artificial Sequence: Synthetic oligonucleotide
ucuuugggcuugagacuu

SEQ ID NO: 26742 - RNA, 18 nt, Artificial Sequence
  Description of Artificial Sequence: Synthetic oligonucleotide
gcugcucuuugggcuuga

SEQ ID NO: 26743 - RNA, 18 nt, Artificial Sequence
  Description of Artificial Sequence: Synthetic oligonucleotide
aggacgcugcucuuuggg

SEQ ID NO: 26744 - RNA, 18 nt, Artificial Sequence
  Description of Artificial Sequence: Synthetic oligonucleotide
uggucaggacgcugcucu

SEQ ID NO: 26745 - RNA, 18 nt, Artificial Sequence
  Description of Artificial Sequence: Synthetic oligonucleotide
caccauggucaggacgcu

SEQ ID NO: 26746 - RNA, 18 nt, Artificial Sequence
  Description of Artificial Sequence: Synthetic oligonucleotide
gaaaccaccauggucagg

SEQ ID NO: 26747 - RNA, 18 nt, Artificial Sequence
  Description of Artificial Sequence: Synthetic oligonucleotide
guaaugaaaccaccaugg

SEQ ID NO: 26748 - RNA, 18 nt, Artificial Sequence
  Description of Artificial Sequence: Synthetic oligonucleotide
ggcucguaaugaaaccac

SEQ ID NO: 26749 - RNA, 18 nt, Artificial Sequence
  Description of Artificial Sequence: Synthetic oligonucleotide
agaagggcucguaaugaa

SEQ ID NO: 26750 - RNA, 18 nt, Artificial Sequence
  Description of Artificial Sequence: Synthetic oligonucleotide
ccagcagaagggcucgua

SEQ ID NO: 26751 - RNA, 18 nt, Artificial Sequence
  Description of Artificial Sequence: Synthetic oligonucleotide
gagagccagcagaagggc

SEQ ID NO: 26752 - RNA, 18 nt, Artificial Sequence
  Description of Artificial Sequence: Synthetic oligonucleotide
ugccugagagccagcaga

SEQ ID NO: 26753 - RNA, 18 nt, Artificial Sequence
  Description of Artificial Sequence: Synthetic oligonucleotide
gcuucugccugagagcca

SEQ ID NO: 26754 - RNA, 18 nt, Artificial Sequence
  Description of Artificial Sequence: Synthetic oligonucleotide
gggcuucugccugagagc

SEQ ID NO: 26755 - RNA, 18 nt, Artificial Sequence
  Description of Artificial Sequence: Synthetic oligonucleotide
uggucccggugcuguggg

SEQ ID NO: 26756 - RNA, 18 nt, Artificial Sequence
  Description of Artificial Sequence: Synthetic oligonucleotide
augaauggucccggugcu

SEQ ID NO: 26757 - RNA, 18 nt, Artificial Sequence
  Description of Artificial Sequence: Synthetic oligonucleotide
accucaugaauggucccg

SEQ ID NO: 26758 - RNA, 18 nt, Artificial Sequence
  Description of Artificial Sequence: Synthetic oligonucleotide
cagugaccucaugaaugg

SEQ ID NO: 26759 - RNA, 18 nt, Artificial Sequence
  Description of Artificial Sequence: Synthetic oligonucleotide
cugggcagugaccucaug

SEQ ID NO: 26760 - RNA, 18 nt, Artificial Sequence
  Description of Artificial Sequence: Synthetic oligonucleotide
augagcugggcagugacc

SEQ ID NO: 26761 - RNA, 18 nt, Artificial Sequence
  Description of Artificial Sequence: Synthetic oligonucleotide
acaucaugagcugggcag

SEQ ID NO: 26762 - RNA, 18 nt, Artificial Sequence
  Description of Artificial Sequence: Synthetic oligonucleotide
cacggacaucaugagcug

SEQ ID NO: 26763 - RNA, 18 nt, Artificial Sequence
  Description of Artificial Sequence: Synthetic oligonucleotide
agccucacggacaucaug

SEQ ID NO: 26764 - RNA, 18 nt, Artificial Sequence
  Description of Artificial Sequence: Synthetic oligonucleotide
aggacagccucacggaca

SEQ ID NO: 26765 - RNA, 18 nt, Artificial Sequence
  Description of Artificial Sequence: Synthetic oligonucleotide
ccaaaaggacagccucac

SEQ ID NO: 26766 - RNA, 18 nt, Artificial Sequence
  Description of Artificial Sequence: Synthetic oligonucleotide
acuggccaaaaggacagc

SEQ ID NO: 26767 - RNA, 18 nt, Artificial Sequence
  Description of Artificial Sequence: Synthetic oligonucleotide
cggcuacuggccaaaagg

SEQ ID NO: 26768 - RNA, 18 nt, Artificial Sequence
  Description of Artificial Sequence: Synthetic oligonucleotide
gcacacggcuacuggcca

SEQ ID NO: 26769 - RNA, 18 nt, Artificial Sequence
  Description of Artificial Sequence: Synthetic oligonucleotide
cagcugcacacggcuacu

SEQ ID NO: 26770 - RNA, 18 nt, Artificial Sequence
  Description of Artificial Sequence: Synthetic oligonucleotide
ccacacagcugcacacgg

SEQ ID NO: 26771 - RNA, 18 nt, Artificial Sequence
  Description of Artificial Sequence: Synthetic oligonucleotide
cugugccacacagcugca

SEQ ID NO: 26772 - RNA, 18 nt, Artificial Sequence
  Description of Artificial Sequence: Synthetic oligonucleotide
gccaucugugccacacag

SEQ ID NO: 26773 - RNA, 18 nt, Artificial Sequence
  Description of Artificial Sequence: Synthetic oligonucleotide
acgaagccaucugugcca

SEQ ID NO: 26774 - RNA, 18 nt, Artificial Sequence
  Description of Artificial Sequence: Synthetic oligonucleotide
gaugaacgaagccaucug

SEQ ID NO: 26775 - RNA, 18 nt, Artificial Sequence
  Description of Artificial Sequence: Synthetic oligonucleotide
aucaggaugaacgaagcc

SEQ ID NO: 26776 - RNA, 18 nt, Artificial Sequence
  Description of Artificial Sequence: Synthetic oligonucleotide
ccuugaucaggaugaacg

SEQ ID NO: 26777 - RNA, 18 nt, Artificial Sequence
  Description of Artificial Sequence: Synthetic oligonucleotide
gggccuugaucaggauga

SEQ ID NO: 26778 - RNA, 18 nt, Artificial Sequence
  Description of Artificial Sequence: Synthetic oligonucleotide
ugcuguggcugagguggg

SEQ ID NO: 26779 - RNA, 18 nt, Artificial Sequence
  Description of Artificial Sequence: Synthetic oligonucleotide
gggacugcuguggcugag

SEQ ID NO: 26780 - RNA, 18 nt, Artificial Sequence
  Description of Artificial Sequence: Synthetic oligonucleotide
gguggacaacacagguug

SEQ ID NO: 26781 - RNA, 18 nt, Artificial Sequence
  Description of Artificial Sequence: Synthetic oligonucleotide
aauaggguggacaacaca

SEQ ID NO: 26782 - RNA, 18 nt, Artificial Sequence
  Description of Artificial Sequence: Synthetic oligonucleotide
ugaauaauaggguggaca

SEQ ID NO: 26783 - RNA, 18 nt, Artificial Sequence
  Description of Artificial Sequence: Synthetic oligonucleotide
guacaugaauaauagggu

SEQ ID NO: 26784 - RNA, 18 nt, Artificial Sequence
  Description of Artificial Sequence: Synthetic oligonucleotide
ggcagguacaugaauaau

SEQ ID NO: 26785 - RNA, 18 nt, Artificial Sequence
  Description of Artificial Sequence: Synthetic oligonucleotide
ggccuggcagguacauga

SEQ ID NO: 26786 - RNA, 18 nt, Artificial Sequence
  Description of Artificial Sequence: Synthetic oligonucleotide
agcagggccuggcaggua

SEQ ID NO: 26787 - RNA, 18 nt, Artificial Sequence
  Description of Artificial Sequence: Synthetic oligonucleotide
uaucuagcagggccuggc

SEQ ID NO: 26788 - RNA, 18 nt, Artificial Sequence
  Description of Artificial Sequence: Synthetic oligonucleotide
ggugcuaucuagcagggc

SEQ ID NO: 26789 - RNA, 18 nt, Artificial Sequence
  Description of Artificial Sequence: Synthetic oligonucleotide
gggugcuaucuagcaggg

SEQ ID NO: 26790 - RNA, 18 nt, Artificial Sequence
  Description of Artificial Sequence: Synthetic oligonucleotide
guuauguaaugccacggg

SEQ ID NO: 26791 - RNA, 18 nt, Artificial Sequence
  Description of Artificial Sequence: Synthetic oligonucleotide
gaaguguuauguaaugcc

SEQ ID NO: 26792 - RNA, 18 nt, Artificial Sequence
  Description of Artificial Sequence: Synthetic oligonucleotide
cucaugaaguguuaugua

SEQ ID NO: 26793 - RNA, 18 nt, Artificial Sequence
  Description of Artificial Sequence: Synthetic oligonucleotide
agccacucaugaaguguu

SEQ ID NO: 26794 - RNA, 18 nt, Artificial Sequence
  Description of Artificial Sequence: Synthetic oligonucleotide
gacacagccacucaugaa

SEQ ID NO: 26795 - RNA, 18 nt, Artificial Sequence
  Description of Artificial Sequence: Synthetic oligonucleotide
uacaagacacagccacuc

SEQ ID NO: 26796 - RNA, 18 nt, Artificial Sequence
  Description of Artificial Sequence: Synthetic oligonucleotide
aaaauuacaagacacagc

SEQ ID NO: 26797 - RNA, 18 nt, Artificial Sequence
  Description of Artificial Sequence: Synthetic oligonucleotide
uccccaaaauuacaagac

SEQ ID NO: 26798 - RNA, 18 nt, Artificial Sequence
  Description of Artificial Sequence: Synthetic oligonucleotide
accuguccccaaaauuac

SEQ ID NO: 26799 - RNA, 18 nt, Artificial Sequence
  Description of Artificial Sequence: Synthetic oligonucleotide
gagaaaccuguccccaaa

SEQ ID NO: 26800 - RNA, 18 nt, Artificial Sequence
  Description of Artificial Sequence: Synthetic oligonucleotide
aaagagagaaaccugucc

SEQ ID NO: 26801 - RNA, 18 nt, Artificial Sequence
  Description of Artificial Sequence: Synthetic oligonucleotide
gagggaaagagagaaacc

SEQ ID NO: 26802 - RNA, 18 nt, Artificial Sequence
  Description of Artificial Sequence: Synthetic oligonucleotide
aaagagagggaaagagag

SEQ ID NO: 26803 - RNA, 18 nt, Artificial Sequence
  Description of Artificial Sequence: Synthetic oligonucleotide
aaaaaaaagagagggaaa

SEQ ID NO: 26804 - RNA, 18 nt, Artificial Sequence
  Description of Artificial Sequence: Synthetic oligonucleotide
uugacaaaaaaaagagag

SEQ ID NO: 26805 - RNA, 18 nt, Artificial Sequence
  Description of Artificial Sequence: Synthetic oligonucleotide
ggcuuuugacaaaaaaaa

SEQ ID NO: 26806 - RNA, 18 nt, Artificial Sequence
  Description of Artificial Sequence: Synthetic oligonucleotide
cucugggcuuuugacaaa

SEQ ID NO: 26807 - RNA, 18 nt, Artificial Sequence
  Description of Artificial Sequence: Synthetic oligonucleotide
ucagucucugggcuuuug

SEQ ID NO: 26808 - RNA, 18 nt, Artificial Sequence
  Description of Artificial Sequence: Synthetic oligonucleotide
gguugucagucucugggc

SEQ ID NO: 26809 - RNA, 18 nt, Artificial Sequence
  Description of Artificial Sequence: Synthetic oligonucleotide
cagcugguugucagucuc

SEQ ID NO: 26810 - RNA, 18 nt, Artificial Sequence
  Description of Artificial Sequence: Synthetic oligonucleotide
cacugcagcugguuguca

SEQ ID NO: 26811 - RNA, 18 nt, Artificial Sequence
  Description of Artificial Sequence: Synthetic oligonucleotide
uuagacacugcagcuggu

SEQ ID NO: 26812 - RNA, 18 nt, Artificial Sequence
  Description of Artificial Sequence: Synthetic oligonucleotide
aacacuuagacacugcag

SEQ ID NO: 26813 - RNA, 18 nt, Artificial Sequence
  Description of Artificial Sequence: Synthetic oligonucleotide
ugaggaacacuuagacac

SEQ ID NO: 26814 - RNA, 18 nt, Artificial Sequence
  Description of Artificial Sequence: Synthetic oligonucleotide
gucagugaggaacacuua

SEQ ID NO: 26815 - RNA, 18 nt, Artificial Sequence
  Description of Artificial Sequence: Synthetic oligonucleotide
acccugucagugaggaac

SEQ ID NO: 26816 - RNA, 18 nt, Artificial Sequence
  Description of Artificial Sequence: Synthetic oligonucleotide
gccccacccugucaguga

SEQ ID NO: 26817 - RNA, 18 nt, Artificial Sequence
  Description of Artificial Sequence: Synthetic oligonucleotide
gugaggccccacccuguc

SEQ ID NO: 26818 - RNA, 18 nt, Artificial Sequence
  Description of Artificial Sequence: Synthetic oligonucleotide
ggguggugaggccccacc

SEQ ID NO: 26819 - RNA, 18 nt, Artificial Sequence
  Description of Artificial Sequence: Synthetic oligonucleotide
gccaacgcugcucccucc

SEQ ID NO: 26820 - RNA, 18 nt, Artificial Sequence
  Description of Artificial Sequence: Synthetic oligonucleotide
ucccugccaacgcugcuc

SEQ ID NO: 26821 - RNA, 18 nt, Artificial Sequence
  Description of Artificial Sequence: Synthetic oligonucleotide
cugucucccugccaacgc

SEQ ID NO: 26822 - RNA, 18 nt, Artificial Sequence
  Description of Artificial Sequence: Synthetic oligonucleotide
ccaggcugucucccugcc

SEQ ID NO: 26823 - RNA, 18 nt, Artificial Sequence
  Description of Artificial Sequence: Synthetic oligonucleotide
cugggccaggcugucucc

SEQ ID NO: 26824 - RNA, 18 nt, Artificial Sequence
  Description of Artificial Sequence: Synthetic oligonucleotide
ggucacugggccaggcug

SEQ ID NO: 26825 - RNA, 18 nt, Artificial Sequence
  Description of Artificial Sequence: Synthetic oligonucleotide
cccagggucacugggcca

SEQ ID NO: 26826 - RNA, 18 nt, Artificial Sequence
  Description of Artificial Sequence: Synthetic oligonucleotide
uugggcccagggucacug

SEQ ID NO: 26827 - RNA, 18 nt, Artificial Sequence
  Description of Artificial Sequence: Synthetic oligonucleotide
cuggcuugggcccagggu

SEQ ID NO: 26828 - RNA, 18 nt, Artificial Sequence
  Description of Artificial Sequence: Synthetic oligonucleotide
gggcuggcuugggcccag

SEQ ID NO: 26829 - RNA, 18 nt, Artificial Sequence
  Description of Artificial Sequence: Synthetic oligonucleotide
ccugaaagcccuggaggg

SEQ ID NO: 26830 - RNA, 18 nt, Artificial Sequence
  Description of Artificial Sequence: Synthetic oligonucleotide
gcuucccugaaagcccug

SEQ ID NO: 26831 - RNA, 18 nt, Artificial Sequence
  Description of Artificial Sequence: Synthetic oligonucleotide
auggcgcuucccugaaag

SEQ ID NO: 26832 - RNA, 18 nt, Artificial Sequence
  Description of Artificial Sequence: Synthetic oligonucleotide
aauggauggcgcuucccu

SEQ ID NO: 26833 - RNA, 18 nt, Artificial Sequence
  Description of Artificial Sequence: Synthetic oligonucleotide
uugaaaauggauggcgcu

SEQ ID NO: 26834 - RNA, 18 nt, Artificial Sequence
  Description of Artificial Sequence: Synthetic oligonucleotide
caucuuugaaaauggaug

SEQ ID NO: 26835 - RNA, 18 nt, Artificial Sequence
  Description of Artificial Sequence: Synthetic oligonucleotide
uuugacaucuuugaaaau

SEQ ID NO: 26836 - RNA, 18 nt, Artificial Sequence
  Description of Artificial Sequence: Synthetic oligonucleotide
ugacguuugacaucuuug

SEQ ID NO: 26837 - RNA, 18 nt, Artificial Sequence
  Description of Artificial Sequence: Synthetic oligonucleotide
agaagugacguuugacau

SEQ ID NO: 26838 - RNA, 18 nt, Artificial Sequence
  Description of Artificial Sequence: Synthetic oligonucleotide
caggaagaagugacguuu

SEQ ID NO: 26839 - RNA, 18 nt, Artificial Sequence
  Description of Artificial Sequence: Synthetic oligonucleotide
cccuacaggaagaaguga

SEQ ID NO: 26840 - RNA, 18 nt, Artificial Sequence
  Description of Artificial Sequence: Synthetic oligonucleotide
ucgggcccuacaggaaga

SEQ ID NO: 26841 - RNA, 18 nt, Artificial Sequence
  Description of Artificial Sequence: Synthetic oligonucleotide
aggacucgggcccuacag

SEQ ID NO: 26842 - RNA, 18 nt, Artificial Sequence
  Description of Artificial Sequence: Synthetic oligonucleotide
gaggcaggacucgggccc

SEQ ID NO: 26843 - RNA, 18 nt, Artificial Sequence
  Description of Artificial Sequence: Synthetic oligonucleotide
gauaggaggcaggacucg

SEQ ID NO: 26844 - RNA, 18 nt, Artificial Sequence
  Description of Artificial Sequence: Synthetic oligonucleotide
gcccugauaggaggcagg

SEQ ID NO: 26845 - RNA, 18 nt, Artificial Sequence
  Description of Artificial Sequence: Synthetic oligonucleotide
aucuggcccugauaggag

SEQ ID NO: 26846 - RNA, 18 nt, Artificial Sequence
  Description of Artificial Sequence: Synthetic oligonucleotide
cuaugaucuggcccugau

SEQ ID NO: 26847 - RNA, 18 nt, Artificial Sequence
  Description of Artificial Sequence: Synthetic oligonucleotide
gccuucuaugaucuggcc

SEQ ID NO: 26848 - RNA, 18 nt, Artificial Sequence
  Description of Artificial Sequence: Synthetic oligonucleotide
aaauagccuucuaugauc

SEQ ID NO: 26849 - RNA, 18 nt, Artificial Sequence
  Description of Artificial Sequence: Synthetic oligonucleotide
auagaaaauagccuucua

SEQ ID NO: 26850 - RNA, 18 nt, Artificial Sequence
  Description of Artificial Sequence: Synthetic oligonucleotide
ccagaauagaaaauagcc

SEQ ID NO: 26851 - RNA, 18 nt, Artificial Sequence
  Description of Artificial Sequence: Synthetic oligonucleotide
guuccccagaauagaaaa

SEQ ID NO: 26852 - RNA, 18 nt, Artificial Sequence
  Description of Artificial Sequence: Synthetic oligonucleotide
uaaucguuccccagaaua

SEQ ID NO: 26853 - RNA, 18 nt, Artificial Sequence
  Description of Artificial Sequence: Synthetic oligonucleotide
aguuauaaucguucccca

SEQ ID NO: 26854 - RNA, 18 nt, Artificial Sequence
  Description of Artificial Sequence: Synthetic oligonucleotide
auuuaaguuauaaucguu

SEQ ID NO: 26855 - RNA, 18 nt, Artificial Sequence
  Description of Artificial Sequence: Synthetic oligonucleotide
caaucauuuaaguuauaa

SEQ ID NO: 26856 - RNA, 18 nt, Artificial Sequence
  Description of Artificial Sequence: Synthetic oligonucleotide
uaaaacaaucauuuaagu

SEQ ID NO: 26857 - RNA, 18 nt, Artificial Sequence
  Description of Artificial Sequence: Synthetic oligonucleotide
uuuauuaaaacaaucauu

SEQ ID NO: 26858 - RNA, 18 nt, Artificial Sequence
  Description of Artificial Sequence: Synthetic oligonucleotide
gaauuuuuauuaaaacaa

SEQ ID NO: 26859 - RNA, 18 nt, Artificial Sequence
  Description of Artificial Sequence: Synthetic oligonucleotide
gcuuagaauuuuuauuaa

SEQ ID NO: 26860 - RNA, 18 nt, Artificial Sequence
  Description of Artificial Sequence: Synthetic oligonucleotide
uuccagcuuagaauuuuu

SEQ ID NO: 26861 - RNA, 18 nt, Artificial Sequence
  Description of Artificial Sequence: Synthetic oligonucleotide
gucuucugccuugggcuu

SEQ ID NO: 26862 - RNA, 18 nt, Artificial Sequence
  Description of Artificial Sequence: Synthetic oligonucleotide
gauaggucuucugccuug

SEQ ID NO: 26863 - RNA, 18 nt, Artificial Sequence
  Description of Artificial Sequence: Synthetic oligonucleotide
augcagauaggucuucug

SEQ ID NO: 26864 - RNA, 18 nt, Artificial Sequence
  Description of Artificial Sequence: Synthetic oligonucleotide
cucaaaugcagauagguc

SEQ ID NO: 26865 - RNA, 18 nt, Artificial Sequence
  Description of Artificial Sequence: Synthetic oligonucleotide
gagggcucaaaugcagau

SEQ ID NO: 26866 - RNA, 18 nt, Artificial Sequence
  Description of Artificial Sequence: Synthetic oligonucleotide
gagaguaccugggaacaa

SEQ ID NO: 26867 - RNA, 18 nt, Artificial Sequence
  Description of Artificial Sequence: Synthetic oligonucleotide
acauagagaguaccuggg

SEQ ID NO: 26868 - RNA, 18 nt, Artificial Sequence
  Description of Artificial Sequence: Synthetic oligonucleotide
ucaccacauagagaguac

SEQ ID NO: 26869 - RNA, 18 nt, Artificial Sequence
  Description of Artificial Sequence: Synthetic oligonucleotide
caccaucaccacauagag

SEQ ID NO: 26870 - RNA, 18 nt, Artificial Sequence
  Description of Artificial Sequence: Synthetic oligonucleotide
ggcagcaccaucaccaca

SEQ ID NO: 26871 - RNA, 18 nt, Artificial Sequence
  Description of Artificial Sequence: Synthetic oligonucleotide
cagagggcagcaccauca

SEQ ID NO: 26872 - RNA, 18 nt, Artificial Sequence
  Description of Artificial Sequence: Synthetic oligonucleotide
uaucacagagggcagcac

SEQ ID NO: 26873 - RNA, 18 nt, Artificial Sequence
  Description of Artificial Sequence: Synthetic oligonucleotide
guuaguaucacagagggc

SEQ ID NO: 26874 - RNA, 18 nt, Artificial Sequence
  Description of Artificial Sequence: Synthetic oligonucleotide
cacggguuaguaucacag

SEQ ID NO: 26875 - RNA, 18 nt, Artificial Sequence
  Description of Artificial Sequence: Synthetic oligonucleotide
ucaugcacggguuaguau

SEQ ID NO: 26876 - RNA, 18 nt, Artificial Sequence
  Description of Artificial Sequence: Synthetic oligonucleotide
caagcucaugcacggguu

SEQ ID NO: 26877 - RNA, 18 nt, Artificial Sequence
  Description of Artificial Sequence: Synthetic oligonucleotide
acaggcaagcucaugcac

SEQ ID NO: 26878 - RNA, 18 nt, Artificial Sequence
  Description of Artificial Sequence: Synthetic oligonucleotide
cagagacaggcaagcuca

SEQ ID NO: 26879 - RNA, 18 nt, Artificial Sequence
  Description of Artificial Sequence: Synthetic oligonucleotide
gaggacagagacaggcaa

SEQ ID NO: 26880 - RNA, 18 nt, Artificial Sequence
  Description of Artificial Sequence: Synthetic oligonucleotide
ggcccgaggacagagaca

SEQ ID NO: 26881 - RNA, 18 nt, Artificial Sequence
  Description of Artificial Sequence: Synthetic oligonucleotide
aguguggcccgaggacag

SEQ ID NO: 26882 - RNA, 18 nt, Artificial Sequence
  Description of Artificial Sequence: Synthetic oligonucleotide
ggcucaguguggcccgag

SEQ ID NO: 26883 - RNA, 18 nt, Artificial Sequence
  Description of Artificial Sequence: Synthetic oligonucleotide
guaagggcucaguguggc

SEQ ID NO: 26884 - RNA, 18 nt, Artificial Sequence
  Description of Artificial Sequence: Synthetic oligonucleotide
cccucguaagggcucagu

SEQ ID NO: 26885 - RNA, 18 nt, Artificial Sequence
  Description of Artificial Sequence: Synthetic oligonucleotide
accugcccucguaagggc

SEQ ID NO: 26886 - RNA, 18 nt, Artificial Sequence
  Description of Artificial Sequence: Synthetic oligonucleotide
gcaccaccugcccucgua

SEQ ID NO: 26887 - RNA, 18 nt, Artificial Sequence
  Description of Artificial Sequence: Synthetic oligonucleotide
cccaggcaccaccugccc

SEQ ID NO: 26888 - RNA, 18 nt, Artificial Sequence
  Description of Artificial Sequence: Synthetic oligonucleotide
caguacccaggcaccacc

SEQ ID NO: 26889 - RNA, 18 nt, Artificial Sequence
  Description of Artificial Sequence: Synthetic oligonucleotide
gcggccaguacccaggca

SEQ ID NO: 26890 - RNA, 18 nt, Artificial Sequence
  Description of Artificial Sequence: Synthetic oligonucleotide
augcugcggccaguaccc

SEQ ID NO: 26891 - RNA, 18 nt, Artificial Sequence
  Description of Artificial Sequence: Synthetic oligonucleotide
aaagcaugcugcggccag

SEQ ID NO: 26892 - RNA, 18 nt, Artificial Sequence
  Description of Artificial Sequence: Synthetic oligonucleotide
gacucaaagcaugcugcg

SEQ ID NO: 26893 - RNA, 18 nt, Artificial Sequence
  Description of Artificial Sequence: Synthetic oligonucleotide
uuuuagacucaaagcaug

SEQ ID NO: 26894 - RNA, 18 nt, Artificial Sequence
  Description of Artificial Sequence: Synthetic oligonucleotide
ccuacuuuuagacucaaa

SEQ ID NO: 26895 - RNA, 18 nt, Artificial Sequence
  Description of Artificial Sequence: Synthetic oligonucleotide
gggugccuacuuuuagac

SEQ ID NO: 26896 - RNA, 18 nt, Artificial Sequence
  Description of Artificial Sequence: Synthetic oligonucleotide
agggugggugccuacuuu

SEQ ID NO: 26897 - RNA, 18 nt, Artificial Sequence
  Description of Artificial Sequence: Synthetic oligonucleotide
uucacagggugggugccu

SEQ ID NO: 26898 - RNA, 18 nt, Artificial Sequence
  Description of Artificial Sequence: Synthetic oligonucleotide
cuggcuucacaggguggg

SEQ ID NO: 26899 - RNA, 18 nt, Artificial Sequence
  Description of Artificial Sequence: Synthetic oligonucleotide
cuggucuggcuucacagg

SEQ ID NO: 26900 - RNA, 18 nt, Artificial Sequence
  Description of Artificial Sequence: Synthetic oligonucleotide
ggaggcuggucuggcuuc

SEQ ID NO: 26901 - RNA, 18 nt, Artificial Sequence
  Description of Artificial Sequence: Synthetic oligonucleotide
gcccuggaggcuggucug

SEQ ID NO: 26902 - RNA, 18 nt, Artificial Sequence
  Description of Artificial Sequence: Synthetic oligonucleotide
gggcccuggaggcugguc

SEQ ID NO: 26903 - RNA, 18 nt, Artificial Sequence
  Description of Artificial Sequence: Synthetic oligonucleotide
acgaggcagucuucuggg

SEQ ID NO: 26904 - RNA, 18 nt, Artificial Sequence
  Description of Artificial Sequence: Synthetic oligonucleotide
ucggaacgaggcagucuu

SEQ ID NO: 26905 - RNA, 18 nt, Artificial Sequence
  Description of Artificial Sequence: Synthetic oligonucleotide
gcucuucggaacgaggca

SEQ ID NO: 26906 - RNA, 18 nt, Artificial Sequence
  Description of Artificial Sequence: Synthetic oligonucleotide
gacaugcucuucggaacg

SEQ ID NO: 26907 - RNA, 18 nt, Artificial Sequence
  Description of Artificial Sequence: Synthetic oligonucleotide
cccaugacaugcucuucg

SEQ ID NO: 26908 - RNA, 18 nt, Artificial Sequence
  Description of Artificial Sequence: Synthetic oligonucleotide
acagccccaugacaugcu

SEQ ID NO: 26909 - RNA, 18 nt, Artificial Sequence
  Description of Artificial Sequence: Synthetic oligonucleotide
guccuacagccccaugac

SEQ ID NO: 26910 - RNA, 18 nt, Artificial Sequence
  Description of Artificial Sequence: Synthetic oligonucleotide
ggcugguccuacagcccc

SEQ ID NO: 26911 - RNA, 18 nt, Artificial Sequence
  Description of Artificial Sequence: Synthetic oligonucleotide
agaauggcugguccuaca

SEQ ID NO: 26912 - RNA, 18 nt, Artificial Sequence
  Description of Artificial Sequence: Synthetic oligonucleotide
ugggaagaauggcugguc

SEQ ID NO: 26913 - RNA, 18 nt, Artificial Sequence
  Description of Artificial Sequence: Synthetic oligonucleotide
cgagaugggaagaauggc

SEQ ID NO: 26914 - RNA, 18 nt, Artificial Sequence
  Description of Artificial Sequence: Synthetic oligonucleotide
ugacccgagaugggaaga

SEQ ID NO: 26915 - RNA, 18 nt, Artificial Sequence
  Description of Artificial Sequence: Synthetic oligonucleotide
aacaaugacccgagaugg

SEQ ID NO: 26916 - RNA, 18 nt, Artificial Sequence
  Description of Artificial Sequence: Synthetic oligonucleotide
agcccaacaaugacccga

SEQ ID NO: 26917 - RNA, 18 nt, Artificial Sequence
  Description of Artificial Sequence: Synthetic oligonucleotide
uccccagcccaacaauga

SEQ ID NO: 26918 - RNA, 18 nt, Artificial Sequence
  Description of Artificial Sequence: Synthetic oligonucleotide
aaccuuccccagcccaac

SEQ ID NO: 26919 - RNA, 18 nt, Artificial Sequence
  Description of Artificial Sequence: Synthetic oligonucleotide
gccauaaccuuccccagc

SEQ ID NO: 26920 - RNA, 18 nt, Artificial Sequence
  Description of Artificial Sequence: Synthetic oligonucleotide
aagaagccauaaccuucc

SEQ ID NO: 26921 - RNA, 18 nt, Artificial Sequence
  Description of Artificial Sequence: Synthetic oligonucleotide
uggacaagaagccauaac

SEQ ID NO: 26922 - RNA, 18 nt, Artificial Sequence
  Description of Artificial Sequence: Synthetic oligonucleotide
cugacuggacaagaagcc

SEQ ID NO: 26923 - RNA, 18 nt, Artificial Sequence
  Description of Artificial Sequence: Synthetic oligonucleotide
cacaccugacuggacaag

SEQ ID NO: 26924 - RNA, 18 nt, Artificial Sequence
  Description of Artificial Sequence: Synthetic oligonucleotide
uuagacacaccugacugg

SEQ ID NO: 26925 - RNA, 18 nt, Artificial Sequence
  Description of Artificial Sequence: Synthetic oligonucleotide
gacuuuuagacacaccug

SEQ ID NO: 26926 - RNA, 18 nt, Artificial Sequence
  Description of Artificial Sequence: Synthetic oligonucleotide
caaaggacuuuuagacac

SEQ ID NO: 26927 - RNA, 18 nt, Artificial Sequence
  Description of Artificial Sequence: Synthetic oligonucleotide
caagacaaaggacuuuua

SEQ ID NO: 26928 - RNA, 18 nt, Artificial Sequence
  Description of Artificial Sequence: Synthetic oligonucleotide
gccaccaagacaaaggac

SEQ ID NO: 26929 - RNA, 18 nt, Artificial Sequence
  Description of Artificial Sequence: Synthetic oligonucleotide
aguaugccaccaagacaa

SEQ ID NO: 26930 - RNA, 18 nt, Artificial Sequence
  Description of Artificial Sequence: Synthetic oligonucleotide
cuaggaguaugccaccaa

SEQ ID NO: 26931 - RNA, 18 nt, Artificial Sequence
  Description of Artificial Sequence: Synthetic oligonucleotide
ccaugcuaggaguaugcc

SEQ ID NO: 26932 - RNA, 18 nt, Artificial Sequence
  Description of Artificial Sequence: Synthetic oligonucleotide
cauuuccaugcuaggagu

SEQ ID NO: 26933 - RNA, 18 nt, Artificial Sequence
  Description of Artificial Sequence: Synthetic oligonucleotide
gaccccauuuccaugcua

SEQ ID NO: 26934 - RNA, 18 nt, Artificial Sequence
  Description of Artificial Sequence: Synthetic oligonucleotide
agauugaccccauuucca

SEQ ID NO: 26935 - RNA, 18 nt, Artificial Sequence
  Description of Artificial Sequence: Synthetic oligonucleotide
ugcccagauugaccccau

SEQ ID NO: 26936 - RNA, 18 nt, Artificial Sequence
  Description of Artificial Sequence: Synthetic oligonucleotide
caaagugcccagauugac

SEQ ID NO: 26937 - RNA, 18 nt, Artificial Sequence
  Description of Artificial Sequence: Synthetic oligonucleotide
gucuccaaagugcccaga

SEQ ID NO: 26938 - RNA, 18 nt, Artificial Sequence
  Description of Artificial Sequence: Synthetic oligonucleotide
caccagucuccaaagugc

SEQ ID NO: 26939 - RNA, 18 nt, Artificial Sequence
  Description of Artificial Sequence: Synthetic oligonucleotide
aaacacaccagucuccaa

SEQ ID NO: 26940 - RNA, 18 nt, Artificial Sequence
  Description of Artificial Sequence: Synthetic oligonucleotide
gaguuaaacacaccaguc

SEQ ID NO: 26941 - RNA, 18 nt, Artificial Sequence
  Description of Artificial Sequence: Synthetic oligonucleotide
aucuugaguuaaacacac

SEQ ID NO: 26942 - RNA, 18 nt, Artificial Sequence
  Description of Artificial Sequence: Synthetic oligonucleotide
ucuugaucuugaguuaaa

SEQ ID NO: 26943 - RNA, 18 nt, Artificial Sequence
  Description of Artificial Sequence: Synthetic oligonucleotide
aaaggucuugaucuugag

SEQ ID NO: 26944 - RNA, 18 nt, Artificial Sequence
  Description of Artificial Sequence: Synthetic oligonucleotide
gcauaaaaggucuugauc

SEQ ID NO: 26945 - RNA, 18 nt, Artificial Sequence
  Description of Artificial Sequence: Synthetic oligonucleotide
ucaacgcauaaaaggucu

SEQ ID NO: 26946 - RNA, 18 nt, Artificial Sequence
  Description of Artificial Sequence: Synthetic oligonucleotide
ggcugucaacgcauaaaa

SEQ ID NO: 26947 - RNA, 18 nt, Artificial Sequence
  Description of Artificial Sequence: Synthetic oligonucleotide
ugagaggcugucaacgca

SEQ ID NO: 26948 - RNA, 18 nt, Artificial Sequence
  Description of Artificial Sequence: Synthetic oligonucleotide
ggucuugagaggcuguca

SEQ ID NO: 26949 - RNA, 18 nt, Artificial Sequence
  Description of Artificial Sequence: Synthetic oligonucleotide
ccaugggucuugagaggc

SEQ ID NO: 26950 - RNA, 18 nt, Artificial Sequence
  Description of Artificial Sequence: Synthetic oligonucleotide
ugugaccaugggucuuga

SEQ ID NO: 26951 - RNA, 18 nt, Artificial Sequence
  Description of Artificial Sequence: Synthetic oligonucleotide
ccaggugugaccaugggu

SEQ ID NO: 26952 - RNA, 18 nt, Artificial Sequence
  Description of Artificial Sequence: Synthetic oligonucleotide
agcugccaggugugacca

SEQ ID NO: 26953 - RNA, 18 nt, Artificial Sequence
  Description of Artificial Sequence: Synthetic oligonucleotide
ccagaagcugccaggugu

SEQ ID NO: 26954 - RNA, 18 nt, Artificial Sequence
  Description of Artificial Sequence: Synthetic oligonucleotide
cacuaccagaagcugcca

SEQ ID NO: 26955 - RNA, 18 nt, Artificial Sequence
  Description of Artificial Sequence: Synthetic oligonucleotide
ugccccacuaccagaagc

SEQ ID NO: 26956 - RNA, 18 nt, Artificial Sequence
  Description of Artificial Sequence: Synthetic oligonucleotide
ccuuuugccccacuacca

SEQ ID NO: 26957 - RNA, 18 nt, Artificial Sequence
  Description of Artificial Sequence: Synthetic oligonucleotide
gcaacccuuuugccccac

SEQ ID NO: 26958 - RNA, 18 nt, Artificial Sequence
  Description of Artificial Sequence: Synthetic oligonucleotide
cacaagcaacccuuuugc

SEQ ID NO: 26959 - RNA, 18 nt, Artificial Sequence
  Description of Artificial Sequence: Synthetic oligonucleotide
gccagcacaagcaacccu

SEQ ID NO: 26960 - RNA, 18 nt, Artificial Sequence
  Description of Artificial Sequence: Synthetic oligonucleotide
aaugagccagcacaagca

SEQ ID NO: 26961 - RNA, 18 nt, Artificial Sequence
  Description of Artificial Sequence: Synthetic oligonucleotide
aggaaaaugagccagcac

SEQ ID NO: 26962 - RNA, 18 nt, Artificial Sequence
  Description of Artificial Sequence: Synthetic oligonucleotide
ucuaaaggaaaaugagcc

SEQ ID NO: 26963 - RNA, 18 nt, Artificial Sequence
  Description of Artificial Sequence: Synthetic oligonucleotide
aaagcucuaaaggaaaau

SEQ ID NO: 26964 - RNA, 18 nt, Artificial Sequence
  Description of Artificial Sequence: Synthetic oligonucleotide
uuaccccuucuacuccug

SEQ ID NO: 26965 - RNA, 18 nt, Artificial Sequence
  Description of Artificial Sequence: Synthetic oligonucleotide
agaguuuaccccuucuac

SEQ ID NO: 26966 - RNA, 18 nt, Artificial Sequence
  Description of Artificial Sequence: Synthetic oligonucleotide
gaggaagaguuuaccccu

SEQ ID NO: 26967 - RNA, 18 nt, Artificial Sequence
  Description of Artificial Sequence: Synthetic oligonucleotide
cagaugaggaagaguuua

SEQ ID NO: 26968 - RNA, 18 nt, Artificial Sequence
  Description of Artificial Sequence: Synthetic oligonucleotide
uguggcagaugaggaaga

SEQ ID NO: 26969 - RNA, 18 nt, Artificial Sequence
  Description of Artificial Sequence: Synthetic oligonucleotide
aggccuguggcagaugag

SEQ ID NO: 26970 - RNA, 18 nt, Artificial Sequence
  Description of Artificial Sequence: Synthetic oligonucleotide
aaggcaggccuguggcag

SEQ ID NO: 26971 - RNA, 18 nt, Artificial Sequence
  Description of Artificial Sequence: Synthetic oligonucleotide
gaggcaaggcaggccugu

SEQ ID NO: 26972 - RNA, 18 nt, Artificial Sequence
  Description of Artificial Sequence: Synthetic oligonucleotide
ggccugaggcaaggcagg

SEQ ID NO: 26973 - RNA, 18 nt, Artificial Sequence
  Description of Artificial Sequence: Synthetic oligonucleotide
gacguggccugaggcaag

SEQ ID NO: 26974 - RNA, 18 nt, Artificial Sequence
  Description of Artificial Sequence: Synthetic oligonucleotide
aaggugacguggccugag

SEQ ID NO: 26975 - RNA, 18 nt, Artificial Sequence
  Description of Artificial Sequence: Synthetic oligonucleotide
ccuggcaacauggcuggg

SEQ ID NO: 26976 - RNA, 18 nt, Artificial Sequence
  Description of Artificial Sequence: Synthetic oligonucleotide
caugcccuggcaacaugg

SEQ ID NO: 26977 - RNA, 18 nt, Artificial Sequence
  Description of Artificial Sequence: Synthetic oligonucleotide
guccucaugcccuggcaa

SEQ ID NO: 26978 - RNA, 18 nt, Artificial Sequence
  Description of Artificial Sequence: Synthetic oligonucleotide
ucuuaguccucaugcccu

SEQ ID NO: 26979 - RNA, 18 nt, Artificial Sequence
  Description of Artificial Sequence: Synthetic oligonucleotide
aagcaucuuaguccucau

SEQ ID NO: 26980 - RNA, 18 nt, Artificial Sequence
  Description of Artificial Sequence: Synthetic oligonucleotide
agggcaagcaucuuaguc

SEQ ID NO: 26981 - RNA, 18 nt, Artificial Sequence
  Description of Artificial Sequence: Synthetic oligonucleotide
uuggcagggcaagcaucu

SEQ ID NO: 26982 - RNA, 18 nt, Artificial Sequence
  Description of Artificial Sequence: Synthetic oligonucleotide
cgggcuuggcagggcaag

SEQ ID NO: 26983 - RNA, 18 nt, Artificial Sequence
  Description of Artificial Sequence: Synthetic oligonucleotide
cccuccgggcuuggcagg

SEQ ID NO: 26984 - RNA, 18 nt, Artificial Sequence
  Description of Artificial Sequence: Synthetic oligonucleotide
ucauccccuccgggcuug

SEQ ID NO: 26985 - RNA, 18 nt, Artificial Sequence
  Description of Artificial Sequence: Synthetic oligonucleotide
gcugcucauccccuccgg

SEQ ID NO: 26986 - RNA, 18 nt, Artificial Sequence
  Description of Artificial Sequence: Synthetic oligonucleotide
cugaggcugcucaucccc

SEQ ID NO: 26987 - RNA, 18 nt, Artificial Sequence
  Description of Artificial Sequence: Synthetic oligonucleotide
accagcugaggcugcuca

SEQ ID NO: 26988 - RNA, 18 nt, Artificial Sequence
  Description of Artificial Sequence: Synthetic oligonucleotide
gcggcaccagcugaggcu

SEQ ID NO: 26989 - RNA, 18 nt, Artificial Sequence
  Description of Artificial Sequence: Synthetic oligonucleotide
cuguggcggcaccagcug

SEQ ID NO: 26990 - RNA, 18 nt, Artificial Sequence
  Description of Artificial Sequence: Synthetic oligonucleotide
gcugucuguggcggcacc

SEQ ID NO: 26991 - RNA, 18 nt, Artificial Sequence
  Description of Artificial Sequence: Synthetic oligonucleotide
ggugugcugucuguggcg

SEQ ID NO: 26992 - RNA, 18 nt, Artificial Sequence
  Description of Artificial Sequence: Synthetic oligonucleotide
ucuguggugugcugucug

SEQ ID NO: 26993 - RNA, 18 nt, Artificial Sequence
  Description of Artificial Sequence: Synthetic oligonucleotide
ccaccucuguggugugcu

SEQ ID NO: 26994 - RNA, 18 nt, Artificial Sequence
  Description of Artificial Sequence: Synthetic oligonucleotide
cugagccaccucuguggu

SEQ ID NO: 26995 - RNA, 18 nt, Artificial Sequence
  Description of Artificial Sequence: Synthetic oligonucleotide
ggucccugagccaccucu

SEQ ID NO: 26996 - RNA, 18 nt, Artificial Sequence
  Description of Artificial Sequence: Synthetic oligonucleotide
accaaggucccugagcca

SEQ ID NO: 26997 - RNA, 18 nt, Artificial Sequence
  Description of Artificial Sequence: Synthetic oligonucleotide
caucuaccaaggucccug

SEQ ID NO: 26998 - RNA, 18 nt, Artificial Sequence
  Description of Artificial Sequence: Synthetic oligonucleotide
auucccaucuaccaaggu

SEQ ID NO: 26999 - RNA, 18 nt, Artificial Sequence
  Description of Artificial Sequence: Synthetic oligonucleotide
cucacauucccaucuacc

SEQ ID NO: 27000 - RNA, 18 nt, Artificial Sequence
  Description of Artificial Sequence: Synthetic oligonucleotide
agauucucacauucccau

SEQ ID NO: 27001 - RNA, 18 nt, Artificial Sequence
  Description of Artificial Sequence: Synthetic oligonucleotide
uuaauagauucucacauu

SEQ ID NO: 27002 - RNA, 18 nt, Artificial Sequence
  Description of Artificial Sequence: Synthetic oligonucleotide
cuauuuuaauagauucuc

SEQ ID NO: 27003 - RNA, 18 nt, Artificial Sequence
  Description of Artificial Sequence: Synthetic oligonucleotide
ccugccuauuuuaauaga

SEQ ID NO: 27004 - RNA, 18 nt, Artificial Sequence
  Description of Artificial Sequence: Synthetic oligonucleotide
agaucccugccuauuuua

SEQ ID NO: 27005 - RNA, 18 nt, Artificial Sequence
  Description of Artificial Sequence: Synthetic oligonucleotide
accggagaucccugccua

SEQ ID NO: 27006 - RNA, 18 nt, Artificial Sequence
  Description of Artificial Sequence: Synthetic oligonucleotide
agaggaccggagaucccu

SEQ ID NO: 27007 - RNA, 18 nt, Artificial Sequence
  Description of Artificial Sequence: Synthetic oligonucleotide
uugacagaggaccggaga

SEQ ID NO: 27008 - RNA, 18 nt, Artificial Sequence
  Description of Artificial Sequence: Synthetic oligonucleotide
gccucuugacagaggacc

SEQ ID NO: 27009 - RNA, 18 nt, Artificial Sequence
  Description of Artificial Sequence: Synthetic oligonucleotide
gcauugccucuugacaga

SEQ ID NO: 27010 - RNA, 18 nt, Artificial Sequence
  Description of Artificial Sequence: Synthetic oligonucleotide
cgucagcauugccucuug

SEQ ID NO: 27011 - RNA, 18 nt, Artificial Sequence
  Description of Artificial Sequence: Synthetic oligonucleotide
aaagccgucagcauugcc

SEQ ID NO: 27012 - RNA, 18 nt, Artificial Sequence
  Description of Artificial Sequence: Synthetic oligonucleotide
aggaaaaagccgucagca

SEQ ID NO: 27013 - RNA, 18 nt, Artificial Sequence
  Description of Artificial Sequence: Synthetic oligonucleotide
ccagcaggaaaaagccgu

SEQ ID NO: 27014 - RNA, 18 nt, Artificial Sequence
  Description of Artificial Sequence: Synthetic oligonucleotide
gcacgccagcaggaaaaa

SEQ ID NO: 27015 - RNA, 18 nt, Artificial Sequence
  Description of Artificial Sequence: Synthetic oligonucleotide
cagaggcacgccagcagg

SEQ ID NO: 27016 - RNA, 18 nt, Artificial Sequence
  Description of Artificial Sequence: Synthetic oligonucleotide
gugggcagaggcacgcca

SEQ ID NO: 27017 - RNA, 18 nt, Artificial Sequence
  Description of Artificial Sequence: Synthetic oligonucleotide
ggcuggugggcagaggca

SEQ ID NO: 27018 - RNA, 18 nt, Artificial Sequence
  Description of Artificial Sequence: Synthetic oligonucleotide
gggaaggcuggugggcag

SEQ ID NO: 27019 - RNA, 18 nt, Artificial Sequence
  Description of Artificial Sequence: Synthetic oligonucleotide
aaugaggaugugcaaggg

SEQ ID NO: 27020 - RNA, 18 nt, Artificial Sequence
  Description of Artificial Sequence: Synthetic oligonucleotide
acaaaugaggaugugcaa

SEQ ID NO: 27021 - RNA, 18 nt, Artificial Sequence
  Description of Artificial Sequence: Synthetic oligonucleotide
aggugacaaaugaggaug

SEQ ID NO: 27022 - RNA, 18 nt, Artificial Sequence
  Description of Artificial Sequence: Synthetic oligonucleotide
uuaggaggugacaaauga

SEQ ID NO: 27023 - RNA, 18 nt, Artificial Sequence
  Description of Artificial Sequence: Synthetic oligonucleotide
ucaaauuaggaggugaca

SEQ ID NO: 27024 - RNA, 18 nt, Artificial Sequence
  Description of Artificial Sequence: Synthetic oligonucleotide
auaauucaaauuaggagg

SEQ ID NO: 27025 - RNA, 18 nt, Artificial Sequence
  Description of Artificial Sequence: Synthetic oligonucleotide
gcccaauaauucaaauua

SEQ ID NO: 27026 - RNA, 18 nt, Artificial Sequence
  Description of Artificial Sequence: Synthetic oligonucleotide
gauuugcccaauaauuca

SEQ ID NO: 27027 - RNA, 18 nt, Artificial Sequence
  Description of Artificial Sequence: Synthetic oligonucleotide
ggccagauuugcccaaua

SEQ ID NO: 27028 - RNA, 18 nt, Artificial Sequence
  Description of Artificial Sequence: Synthetic oligonucleotide
uaagcggccagauuugcc

SEQ ID NO: 27029 - RNA, 18 nt, Artificial Sequence
  Description of Artificial Sequence: Synthetic oligonucleotide
ccaaauaagcggccagau

SEQ ID NO: 27030 - RNA, 18 nt, Artificial Sequence
  Description of Artificial Sequence: Synthetic oligonucleotide
cagucccaaauaagcggc

SEQ ID NO: 27031 - RNA, 18 nt, Artificial Sequence
  Description of Artificial Sequence: Synthetic oligonucleotide
gcugucagucccaaauaa

SEQ ID NO: 27032 - RNA, 18 nt, Artificial Sequence
  Description of Artificial Sequence: Synthetic oligonucleotide
aguuggcugucaguccca

SEQ ID NO: 27033 - RNA, 18 nt, Artificial Sequence
  Description of Artificial Sequence: Synthetic oligonucleotide
caagaaguuggcugucag

SEQ ID NO: 27034 - RNA, 18 nt, Artificial Sequence
  Description of Artificial Sequence: Synthetic oligonucleotide
augcucaagaaguuggcu

SEQ ID NO: 27035 - RNA, 18 nt, Artificial Sequence
  Description of Artificial Sequence: Synthetic oligonucleotide
aauagaugcucaagaagu

SEQ ID NO: 27036 - RNA, 18 nt, Artificial Sequence
  Description of Artificial Sequence: Synthetic oligonucleotide
guucaaauagaugcucaa

SEQ ID NO: 27037 - RNA, 18 nt, Artificial Sequence
  Description of Artificial Sequence: Synthetic oligonucleotide
aggcuguucaaauagaug

SEQ ID NO: 27038 - RNA, 18 nt, Artificial Sequence
  Description of Artificial Sequence: Synthetic oligonucleotide
agggaaggcuguucaaau

SEQ ID NO: 27039 - RNA, 18 nt, Artificial Sequence
  Description of Artificial Sequence: Synthetic oligonucleotide
gcgaaagggaaggcuguu

SEQ ID NO: 27040 - RNA, 18 nt, Artificial Sequence
  Description of Artificial Sequence: Synthetic oligonucleotide
ugggagcgaaagggaagg

SEQ ID NO: 27041 - RNA, 18 nt, Artificial Sequence
  Description of Artificial Sequence: Synthetic oligonucleotide
guggcugggagcgaaagg

SEQ ID NO: 27042 - RNA, 18 nt, Artificial Sequence
  Description of Artificial Sequence: Synthetic oligonucleotide
caaagguggcugggagcg

SEQ ID NO: 27043 - RNA, 18 nt, Artificial Sequence
  Description of Artificial Sequence: Synthetic oligonucleotide
caccucaaagguggcugg

SEQ ID NO: 27044 - RNA, 18 nt, Artificial Sequence
  Description of Artificial Sequence: Synthetic oligonucleotide
ggacucaccucaaaggug

SEQ ID NO: 27045 - RNA, 18 nt, Artificial Sequence
  Description of Artificial Sequence: Synthetic oligonucleotide
cacuuggacucaccucaa

SEQ ID NO: 27046 - RNA, 18 nt, Artificial Sequence
  Description of Artificial Sequence: Synthetic oligonucleotide
ccugccacuuggacucac

SEQ ID NO: 27047 - RNA, 18 nt, Artificial Sequence
  Description of Artificial Sequence: Synthetic oligonucleotide
ccuguccugccacuugga

SEQ ID NO: 27048 - RNA, 18 nt, Artificial Sequence
  Description of Artificial Sequence: Synthetic oligonucleotide
aggguccuguccugccac

SEQ ID NO: 27049 - RNA, 18 nt, Artificial Sequence
  Description of Artificial Sequence: Synthetic oligonucleotide
cacacaggguccuguccu

SEQ ID NO: 27050 - RNA, 18 nt, Artificial Sequence
  Description of Artificial Sequence: Synthetic oligonucleotide
ucugucacacaggguccu

SEQ ID NO: 27051 - RNA, 18 nt, Artificial Sequence
  Description of Artificial Sequence: Synthetic oligonucleotide
uccgcucugucacacagg

SEQ ID NO: 27052 - RNA, 18 nt, Artificial Sequence
  Description of Artificial Sequence: Synthetic oligonucleotide
agaccuccgcucugucac

SEQ ID NO: 27053 - RNA, 18 nt, Artificial Sequence
  Description of Artificial Sequence: Synthetic oligonucleotide
gcacaagaccuccgcucu

SEQ ID NO: 27054 - RNA, 18 nt, Artificial Sequence
  Description of Artificial Sequence: Synthetic oligonucleotide
agagggcacaagaccucc

SEQ ID NO: 27055 - RNA, 18 nt, Artificial Sequence
  Description of Artificial Sequence: Synthetic oligonucleotide
agcugagagggcacaaga

SEQ ID NO: 27056 - RNA, 18 nt, Artificial Sequence
  Description of Artificial Sequence: Synthetic oligonucleotide
gaagaagcugagagggca

SEQ ID NO: 27057 - RNA, 18 nt, Artificial Sequence
  Description of Artificial Sequence: Synthetic oligonucleotide
uggcgcucugcaagguga

SEQ ID NO: 27058 - RNA, 18 nt, Artificial Sequence
  Description of Artificial Sequence: Synthetic oligonucleotide
ggacuuggcgcucugcaa

SEQ ID NO: 27059 - RNA, 18 nt, Artificial Sequence
  Description of Artificial Sequence: Synthetic oligonucleotide
acucgggacuuggcgcuc

SEQ ID NO: 27060 - RNA, 18 nt, Artificial Sequence
  Description of Artificial Sequence: Synthetic oligonucleotide
aggccacucgggacuugg

SEQ ID NO: 27061 - RNA, 18 nt, Artificial Sequence
  Description of Artificial Sequence: Synthetic oligonucleotide
aaagaaggccacucggga

SEQ ID NO: 27062 - RNA, 18 nt, Artificial Sequence
  Description of Artificial Sequence: Synthetic oligonucleotide
ucuucaaagaaggccacu

SEQ ID NO: 27063 - RNA, 18 nt, Artificial Sequence
  Description of Artificial Sequence: Synthetic oligonucleotide
agagcucuucaaagaagg

SEQ ID NO: 27064 - RNA, 18 nt, Artificial Sequence
  Description of Artificial Sequence: Synthetic oligonucleotide
cugcuagagcucuucaaa

SEQ ID NO: 27065 - RNA, 18 nt, Artificial Sequence
  Description of Artificial Sequence: Synthetic oligonucleotide
gucaccugcuagagcucu

SEQ ID NO: 27066 - RNA, 18 nt, Artificial Sequence
  Description of Artificial Sequence: Synthetic oligonucleotide
gcugggucaccugcuaga

SEQ ID NO: 27067 - RNA, 18 nt, Artificial Sequence
  Description of Artificial Sequence: Synthetic oligonucleotide
ggguggcugggucaccug

SEQ ID NO: 27068 - RNA, 18 nt, Artificial Sequence
  Description of Artificial Sequence: Synthetic oligonucleotide
aggagaaguggcaggucc

SEQ ID NO: 27069 - RNA, 18 nt, Artificial Sequence
  Description of Artificial Sequence: Synthetic oligonucleotide
guagcaggagaaguggca

SEQ ID NO: 27070 - RNA, 18 nt, Artificial Sequence
  Description of Artificial Sequence: Synthetic oligonucleotide
ucccgguagcaggagaag

SEQ ID NO: 27071 - RNA, 18 nt, Artificial Sequence
  Description of Artificial Sequence: Synthetic oligonucleotide
cgcggucccgguagcagg

SEQ ID NO: 27072 - RNA, 18 nt, Artificial Sequence
  Description of Artificial Sequence: Synthetic oligonucleotide
caucccgcggucccggua

SEQ ID NO: 27073 - RNA, 18 nt, Artificial Sequence
  Description of Artificial Sequence: Synthetic oligonucleotide
ugguccaucccgcggucc

SEQ ID NO: 27074 - RNA, 18 nt, Artificial Sequence
  Description of Artificial Sequence: Synthetic oligonucleotide
auaucugguccaucccgc

SEQ ID NO: 27075 - RNA, 18 nt, Artificial Sequence
  Description of Artificial Sequence: Synthetic oligonucleotide
ucuugauaucugguccau

SEQ ID NO: 27076 - RNA, 18 nt, Artificial Sequence
  Description of Artificial Sequence: Synthetic oligonucleotide
ggcucucuugauaucugg

SEQ ID NO: 27077 - RNA, 18 nt, Artificial Sequence
  Description of Artificial Sequence: Synthetic oligonucleotide
uggauggcucucuugaua

SEQ ID NO: 27078 - RNA, 18 nt, Artificial Sequence
  Description of Artificial Sequence: Synthetic oligonucleotide
cccuauggauggcucucu

SEQ ID NO: 27079 - RNA, 18 nt, Artificial Sequence
  Description of Artificial Sequence: Synthetic oligonucleotide
cagcucccuauggauggc

SEQ ID NO: 27080 - RNA, 18 nt, Artificial Sequence
  Description of Artificial Sequence: Synthetic oligonucleotide
ccagccagcucccuaugg

SEQ ID NO: 27081 - RNA, 18 nt, Artificial Sequence
  Description of Artificial Sequence: Synthetic oligonucleotide
aacccccagccagcuccc

SEQ ID NO: 27082 - RNA, 18 nt, Artificial Sequence
  Description of Artificial Sequence: Synthetic oligonucleotide
acggaaacccccagccag

SEQ ID NO: 27083 - RNA, 18 nt, Artificial Sequence
  Description of Artificial Sequence: Synthetic oligonucleotide
cucccacggaaaccccca

SEQ ID NO: 27084 - RNA, 18 nt, Artificial Sequence
  Description of Artificial Sequence: Synthetic oligonucleotide
uggagcucccacggaaac

SEQ ID NO: 27085 - RNA, 18 nt, Artificial Sequence
  Description of Artificial Sequence: Synthetic oligonucleotide
aguucuggagcucccacg

SEQ ID NO: 27086 - RNA, 18 nt, Artificial Sequence
  Description of Artificial Sequence: Synthetic oligonucleotide
gggaaaguucuggagcuc

SEQ ID NO: 27087 - RNA, 18 nt, Artificial Sequence
  Description of Artificial Sequence: Synthetic oligonucleotide
cugggcucuucacucagc

SEQ ID NO: 27088 - RNA, 18 nt, Artificial Sequence
  Description of Artificial Sequence: Synthetic oligonucleotide
gggcugggcucuucacuc

SEQ ID NO: 27089 - RNA, 18 nt, Artificial Sequence
  Description of Artificial Sequence: Synthetic oligonucleotide
caauugcacauaagaggg

SEQ ID NO: 27090 - RNA, 18 nt, Artificial Sequence
  Description of Artificial Sequence: Synthetic oligonucleotide
caaggcaauugcacauaa

SEQ ID NO: 27091 - RNA, 18 nt, Artificial Sequence
  Description of Artificial Sequence: Synthetic oligonucleotide
uaguucaaggcaauugca

SEQ ID NO: 27092 - RNA, 18 nt, Artificial Sequence
  Description of Artificial Sequence: Synthetic oligonucleotide
ggucguaguucaaggcaa

SEQ ID NO: 27093 - RNA, 18 nt, Artificial Sequence
  Description of Artificial Sequence: Synthetic oligonucleotide
uacagggucguaguucaa

SEQ ID NO: 27094 - RNA, 18 nt, Artificial Sequence
  Description of Artificial Sequence: Synthetic oligonucleotide
aucucuacagggucguag

SEQ ID NO: 27095 - RNA, 18 nt, Artificial Sequence
  Description of Artificial Sequence: Synthetic oligonucleotide
gagaaaucucuacagggu

SEQ ID NO: 27096 - RNA, 18 nt, Artificial Sequence
  Description of Artificial Sequence: Synthetic oligonucleotide
caugagagaaaucucuac

SEQ ID NO: 27097 - RNA, 18 nt, Artificial Sequence
  Description of Artificial Sequence: Synthetic oligonucleotide
aacgccaugagagaaauc

SEQ ID NO: 27098 - RNA, 18 nt, Artificial Sequence
  Description of Artificial Sequence: Synthetic oligonucleotide
acuagaacgccaugagag

SEQ ID NO: 27099 - RNA, 18 nt, Artificial Sequence
  Description of Artificial Sequence: Synthetic oligonucleotide
agagaacuagaacgccau

SEQ ID NO: 27100 - RNA, 18 nt, Artificial Sequence
  Description of Artificial Sequence: Synthetic oligonucleotide
aggucagagaacuagaac

SEQ ID NO: 27101 - RNA, 18 nt, Artificial Sequence
  Description of Artificial Sequence: Synthetic oligonucleotide
gacucaggucagagaacu

SEQ ID NO: 27102 - RNA, 18 nt, Artificial Sequence
  Description of Artificial Sequence: Synthetic oligonucleotide
acaaagacucaggucaga

SEQ ID NO: 27103 - RNA, 18 nt, Artificial Sequence
  Description of Artificial Sequence: Synthetic oligonucleotide
uuaaaacaaagacucagg

SEQ ID NO: 27104 - RNA, 18 nt, Artificial Sequence
  Description of Artificial Sequence: Synthetic oligonucleotide
acuucuuaaaacaaagac

SEQ ID NO: 27105 - RNA, 18 nt, Artificial Sequence
  Description of Artificial Sequence: Synthetic oligonucleotide
caaauacuucuuaaaaca

SEQ ID NO: 27106 - RNA, 18 nt, Artificial Sequence
  Description of Artificial Sequence: Synthetic oligonucleotide
gaagacaaauacuucuua

SEQ ID NO: 27107 - RNA, 18 nt, Artificial Sequence
  Description of Artificial Sequence: Synthetic oligonucleotide
caaaggaagacaaauacu

SEQ ID NO: 27108 - RNA, 18 nt, Artificial Sequence
  Description of Artificial Sequence: Synthetic oligonucleotide
uuagacaaaggaagacaa

SEQ ID NO: 27109 - RNA, 18 nt, Artificial Sequence
  Description of Artificial Sequence: Synthetic oligonucleotide
ccacauuagacaaaggaa

SEQ ID NO: 27110 - RNA, 18 nt, Artificial Sequence
  Description of Artificial Sequence: Synthetic oligonucleotide
gaaucccacauuagacaa

SEQ ID NO: 27111 - RNA, 18 nt, Artificial Sequence
  Description of Artificial Sequence: Synthetic oligonucleotide
gucaggaaucccacauua

SEQ ID NO: 27112 - RNA, 18 nt, Artificial Sequence
  Description of Artificial Sequence: Synthetic oligonucleotide
agggagucaggaauccca

SEQ ID NO: 27113 - RNA, 18 nt, Artificial Sequence
  Description of Artificial Sequence: Synthetic oligonucleotide
gacgaagggagucaggaa

SEQ ID NO: 27114 - RNA, 18 nt, Artificial Sequence
  Description of Artificial Sequence: Synthetic oligonucleotide
ccuuggacgaagggaguc

SEQ ID NO: 27115 - RNA, 18 nt, Artificial Sequence
  Description of Artificial Sequence: Synthetic oligonucleotide
cggugccuuggacgaagg

SEQ ID NO: 27116 - RNA, 18 nt, Artificial Sequence
  Description of Artificial Sequence: Synthetic oligonucleotide
cacaccggugccuuggac

SEQ ID NO: 27117 - RNA, 18 nt, Artificial Sequence
  Description of Artificial Sequence: Synthetic oligonucleotide
acacacacaccggugccu

SEQ ID NO: 27118 - RNA, 18 nt, Artificial Sequence
  Description of Artificial Sequence: Synthetic oligonucleotide
aagacacacacacaccgg

SEQ ID NO: 27119 - RNA, 18 nt, Artificial Sequence
  Description of Artificial Sequence: Synthetic oligonucleotide
agugcaagacacacacac

SEQ ID NO: 27120 - RNA, 18 nt, Artificial Sequence
  Description of Artificial Sequence: Synthetic oligonucleotide
ucuggagugcaagacaca

SEQ ID NO: 27121 - RNA, 18 nt, Artificial Sequence
  Description of Artificial Sequence: Synthetic oligonucleotide
ucagcucuggagugcaag

SEQ ID NO: 27122 - RNA, 18 nt, Artificial Sequence
  Description of Artificial Sequence: Synthetic oligonucleotide
ggaggucagcucuggagu

SEQ ID NO: 27123 - RNA, 18 nt, Artificial Sequence
  Description of Artificial Sequence: Synthetic oligonucleotide
gcgguggaggucagcucu

SEQ ID NO: 27124 - RNA, 18 nt, Artificial Sequence
  Description of Artificial Sequence: Synthetic oligonucleotide
gcugggcgguggagguca

SEQ ID NO: 27125 - RNA, 18 nt, Artificial Sequence
  Description of Artificial Sequence: Synthetic oligonucleotide
cccaggcugggcggugga

SEQ ID NO: 27126 - RNA, 18 nt, Artificial Sequence
  Description of Artificial Sequence: Synthetic oligonucleotide
gacuucccaggcugggcg

SEQ ID NO: 27127 - RNA, 18 nt, Artificial Sequence
  Description of Artificial Sequence: Synthetic oligonucleotide
acaaugacuucccaggcu

SEQ ID NO: 27128 - RNA, 18 nt, Artificial Sequence
  Description of Artificial Sequence: Synthetic oligonucleotide
ucccuacaaugacuuccc

SEQ ID NO: 27129 - RNA, 18 nt, Artificial Sequence
  Description of Artificial Sequence: Synthetic oligonucleotide
cucacucccuacaaugac

SEQ ID NO: 27130 - RNA, 18 nt, Artificial Sequence
  Description of Artificial Sequence: Synthetic oligonucleotide
agugucucacucccuaca

SEQ ID NO: 27131 - RNA, 18 nt, Artificial Sequence
  Description of Artificial Sequence: Synthetic oligonucleotide
gcuucagugucucacucc

SEQ ID NO: 27132 - RNA, 18 nt, Artificial Sequence
  Description of Artificial Sequence: Synthetic oligonucleotide
ucagggcuucagugucuc

SEQ ID NO: 27133 - RNA, 18 nt, Artificial Sequence
  Description of Artificial Sequence: Synthetic oligonucleotide
gcuucucagggcuucagu

SEQ ID NO: 27134 - RNA, 18 nt, Artificial Sequence
  Description of Artificial Sequence: Synthetic oligonucleotide
cacuggcuucucagggcu

SEQ ID NO: 27135 - RNA, 18 nt, Artificial Sequence
  Description of Artificial Sequence: Synthetic oligonucleotide
gauggcacuggcuucuca

SEQ ID NO: 27136 - RNA, 18 nt, Artificial Sequence
  Description of Artificial Sequence: Synthetic oligonucleotide
gggaugauggcacuggcu

SEQ ID NO: 27137 - RNA, 18 nt, Artificial Sequence
  Description of Artificial Sequence: Synthetic oligonucleotide
auguuccggaacccuggg

SEQ ID NO: 27138 - RNA, 18 nt, Artificial Sequence
  Description of Artificial Sequence: Synthetic oligonucleotide
aaugaauguuccggaacc

SEQ ID NO: 27139 - RNA, 18 nt, Artificial Sequence
  Description of Artificial Sequence: Synthetic oligonucleotide
gggaaugaauguuccgga

SEQ ID NO: 27140 - RNA, 18 nt, Artificial Sequence
  Description of Artificial Sequence: Synthetic oligonucleotide
cagguccucaccgguggg

SEQ ID NO: 27141 - RNA, 18 nt, Artificial Sequence
  Description of Artificial Sequence: Synthetic oligonucleotide
caugccagguccucaccg

SEQ ID NO: 27142 - RNA, 18 nt, Artificial Sequence
  Description of Artificial Sequence: Synthetic oligonucleotide
cgcugcaugccagguccu

SEQ ID NO: 27143 - RNA, 18 nt, Artificial Sequence
  Description of Artificial Sequence: Synthetic oligonucleotide
ugcuucgcugcaugccag

SEQ ID NO: 27144 - RNA, 18 nt, Artificial Sequence
  Description of Artificial Sequence: Synthetic oligonucleotide
ugggcugcuucgcugcau

SEQ ID NO: 27145 - RNA, 18 nt, Artificial Sequence
  Description of Artificial Sequence: Synthetic oligonucleotide
cgggcugggcugcuucgc

SEQ ID NO: 27146 - RNA, 18 nt, Artificial Sequence
  Description of Artificial Sequence: Synthetic oligonucleotide
uccgccgggcugggcugc

SEQ ID NO: 27147 - RNA, 18 nt, Artificial Sequence
  Description of Artificial Sequence: Synthetic oligonucleotide
ugggauccgccgggcugg

SEQ ID NO: 27148 - RNA, 18 nt, Artificial Sequence
  Description of Artificial Sequence: Synthetic oligonucleotide
uggccugggauccgccgg

SEQ ID NO: 27149 - RNA, 18 nt, Artificial Sequence
  Description of Artificial Sequence: Synthetic oligonucleotide
cgugcuggccugggaucc

SEQ ID NO: 27150 - RNA, 18 nt, Artificial Sequence
  Description of Artificial Sequence: Synthetic oligonucleotide
gcaggcgugcuggccugg

SEQ ID NO: 27151 - RNA, 18 nt, Artificial Sequence
  Description of Artificial Sequence: Synthetic oligonucleotide
agccggcaggcgugcugg

SEQ ID NO: 27152 - RNA, 18 nt, Artificial Sequence
  Description of Artificial Sequence: Synthetic oligonucleotide
ugagaagccggcaggcgu

SEQ ID NO: 27153 - RNA, 18 nt, Artificial Sequence
  Description of Artificial Sequence: Synthetic oligonucleotide
gacgaugagaagccggca

SEQ ID NO: 27154 - RNA, 18 nt, Artificial Sequence
  Description of Artificial Sequence: Synthetic oligonucleotide
ucccugacgaugagaagc

SEQ ID NO: 27155 - RNA, 18 nt, Artificial Sequence
  Description of Artificial Sequence: Synthetic oligonucleotide
cgggcucccugacgauga

SEQ ID NO: 27156 - RNA, 18 nt, Artificial Sequence
  Description of Artificial Sequence: Synthetic oligonucleotide
cugggcgggcucccugac

SEQ ID NO: 27157 - RNA, 18 nt, Artificial Sequence
  Description of Artificial Sequence: Synthetic oligonucleotide
gagcucugggcgggcucc

SEQ ID NO: 27158 - RNA, 18 nt, Artificial Sequence
  Description of Artificial Sequence: Synthetic oligonucleotide
gucacgagcucugggcgg

SEQ ID NO: 27159 - RNA, 18 nt, Artificial Sequence
  Description of Artificial Sequence: Synthetic oligonucleotide
ugcucgucacgagcucug

SEQ ID NO: 27160 - RNA, 18 nt, Artificial Sequence
  Description of Artificial Sequence: Synthetic oligonucleotide
gcacuugcucgucacgag

SEQ ID NO: 27161 - RNA, 18 nt, Artificial Sequence
  Description of Artificial Sequence: Synthetic oligonucleotide
acccagcacuugcucguc

SEQ ID NO: 27162 - RNA, 18 nt, Artificial Sequence
  Description of Artificial Sequence: Synthetic oligonucleotide
gggacccagcacuugcuc

SEQ ID NO: 27163 - RNA, 18 nt, Artificial Sequence
  Description of Artificial Sequence: Synthetic oligonucleotide
ccagagcgccgccucggg

SEQ ID NO: 27164 - RNA, 18 nt, Artificial Sequence
  Description of Artificial Sequence: Synthetic oligonucleotide
gccagccagagcgccgcc

SEQ ID NO: 27165 - RNA, 18 nt, Artificial Sequence
  Description of Artificial Sequence: Synthetic oligonucleotide
cagcugccagccagagcg

SEQ ID NO: 27166 - RNA, 18 nt, Artificial Sequence
  Description of Artificial Sequence: Synthetic oligonucleotide
cccaccagcugccagcca

SEQ ID NO: 27167 - RNA, 18 nt, Artificial Sequence
  Description of Artificial Sequence: Synthetic oligonucleotide
uauuccccaccagcugcc

SEQ ID NO: 27168 - RNA, 18 nt, Artificial Sequence
  Description of Artificial Sequence: Synthetic oligonucleotide
cugccuauuccccaccag

SEQ ID NO: 27169 - RNA, 18 nt, Artificial Sequence
  Description of Artificial Sequence: Synthetic oligonucleotide
cugcccugccuauucccc

SEQ ID NO: 27170 - RNA, 18 nt, Artificial Sequence
  Description of Artificial Sequence: Synthetic oligonucleotide
cacagcugcccugccuau

SEQ ID NO: 27171 - RNA, 18 nt, Artificial Sequence
  Description of Artificial Sequence: Synthetic oligonucleotide
ccagccacagcugcccug

SEQ ID NO: 27172 - RNA, 18 nt, Artificial Sequence
  Description of Artificial Sequence: Synthetic oligonucleotide
ucuccccagccacagcug

SEQ ID NO: 27173 - RNA, 18 nt, Artificial Sequence
  Description of Artificial Sequence: Synthetic oligonucleotide
aagucucuccccagccac

SEQ ID NO: 27174 - RNA, 18 nt, Artificial Sequence
  Description of Artificial Sequence: Synthetic oligonucleotide
gccuaaagucucucccca

SEQ ID NO: 27175 - RNA, 18 nt, Artificial Sequence
  Description of Artificial Sequence: Synthetic oligonucleotide
cuucugccuaaagucucu

SEQ ID NO: 27176 - RNA, 18 nt, Artificial Sequence
  Description of Artificial Sequence: Synthetic oligonucleotide
cacagcuucugccuaaag

SEQ ID NO: 27177 - RNA, 18 nt, Artificial Sequence
  Description of Artificial Sequence: Synthetic oligonucleotide
ugcaucacagcuucugcc

SEQ ID NO: 27178 - RNA, 18 nt, Artificial Sequence
  Description of Artificial Sequence: Synthetic oligonucleotide
cagccugcaucacagcuu

SEQ ID NO: 27179 - RNA, 18 nt, Artificial Sequence
  Description of Artificial Sequence: Synthetic oligonucleotide
gcagucagccugcaucac

SEQ ID NO: 27180 - RNA, 18 nt, Artificial Sequence
  Description of Artificial Sequence: Synthetic oligonucleotide
ggcuggcagucagccugc

SEQ ID NO: 27181 - RNA, 18 nt, Artificial Sequence
  Description of Artificial Sequence: Synthetic oligonucleotide
cccucggcuggcagucag

SEQ ID NO: 27182 - RNA, 18 nt, Artificial Sequence
  Description of Artificial Sequence: Synthetic oligonucleotide
ccagccccucggcuggca

SEQ ID NO: 27183 - RNA, 18 nt, Artificial Sequence
  Description of Artificial Sequence: Synthetic oligonucleotide
acuacccagccccucggc

SEQ ID NO: 27184 - RNA, 18 nt, Artificial Sequence
  Description of Artificial Sequence: Synthetic oligonucleotide
acggcacuacccagcccc

SEQ ID NO: 27185 - RNA, 18 nt, Artificial Sequence
  Description of Artificial Sequence: Synthetic oligonucleotide
cccgcacggcacuaccca

SEQ ID NO: 27186 - RNA, 18 nt, Artificial Sequence
  Description of Artificial Sequence: Synthetic oligonucleotide
cagcucccgcacggcacu

SEQ ID NO: 27187 - RNA, 18 nt, Artificial Sequence
  Description of Artificial Sequence: Synthetic oligonucleotide
accaucagcucccgcacg

SEQ ID NO: 27188 - RNA, 18 nt, Artificial Sequence
  Description of Artificial Sequence: Synthetic oligonucleotide
ccuguaccaucagcuccc

SEQ ID NO: 27189 - RNA, 18 nt, Artificial Sequence
  Description of Artificial Sequence: Synthetic oligonucleotide
agugcccuguaccaucag

SEQ ID NO: 27190 - RNA, 18 nt, Artificial Sequence
  Description of Artificial Sequence: Synthetic oligonucleotide
cagcgagugcccuguacc

SEQ ID NO: 27191 - RNA, 18 nt, Artificial Sequence
  Description of Artificial Sequence: Synthetic oligonucleotide
gggacagcgagugcccug

SEQ ID NO: 27192 - RNA, 18 nt, Artificial Sequence
  Description of Artificial Sequence: Synthetic oligonucleotide
ucuaggguggccggaggg

SEQ ID NO: 27193 - RNA, 18 nt, Artificial Sequence
  Description of Artificial Sequence: Synthetic oligonucleotide
ccuggucuaggguggccg

SEQ ID NO: 27194 - RNA, 18 nt, Artificial Sequence
  Description of Artificial Sequence: Synthetic oligonucleotide
cggacccuggucuagggu

SEQ ID NO: 27195 - RNA, 18 nt, Artificial Sequence
  Description of Artificial Sequence: Synthetic oligonucleotide
ccucucggacccuggucu

SEQ ID NO: 27196 - RNA, 18 nt, Artificial Sequence
  Description of Artificial Sequence: Synthetic oligonucleotide
gccugccucucggacccu

SEQ ID NO: 27197 - RNA, 18 nt, Artificial Sequence
  Description of Artificial Sequence: Synthetic oligonucleotide
cuccugccugccucucgg

SEQ ID NO: 27198 - RNA, 18 nt, Artificial Sequence
  Description of Artificial Sequence: Synthetic oligonucleotide
aguggcuccugccugccu

SEQ ID NO: 27199 - RNA, 18 nt, Artificial Sequence
  Description of Artificial Sequence: Synthetic oligonucleotide
acaugaguggcuccugcc

SEQ ID NO: 27200 - RNA, 18 nt, Artificial Sequence
  Description of Artificial Sequence: Synthetic oligonucleotide
ggaagacaugaguggcuc

SEQ ID NO: 27201 - RNA, 18 nt, Artificial Sequence
  Description of Artificial Sequence: Synthetic oligonucleotide
gggaagacaugaguggcu

SEQ ID NO: 27202 - RNA, 18 nt, Artificial Sequence
  Description of Artificial Sequence: Synthetic oligonucleotide
ugggcgucgggcaauggg

SEQ ID NO: 27203 - RNA, 18 nt, Artificial Sequence
  Description of Artificial Sequence: Synthetic oligonucleotide
gucuaugggcgucgggca

SEQ ID NO: 27204 - RNA, 18 nt, Artificial Sequence
  Description of Artificial Sequence: Synthetic oligonucleotide
ggagcgucuaugggcguc

SEQ ID NO: 27205 - RNA, 18 nt, Artificial Sequence
  Description of Artificial Sequence: Synthetic oligonucleotide
aggaaggagcgucuaugg

SEQ ID NO: 27206 - RNA, 18 nt, Artificial Sequence
  Description of Artificial Sequence: Synthetic oligonucleotide
cacacaggaaggagcguc

SEQ ID NO: 27207 - RNA, 18 nt, Artificial Sequence
  Description of Artificial Sequence: Synthetic oligonucleotide
agccccacacaggaagga

SEQ ID NO: 27208 - RNA, 18 nt, Artificial Sequence
  Description of Artificial Sequence: Synthetic oligonucleotide
accccagccccacacagg

SEQ ID NO: 27209 - RNA, 18 nt, Artificial Sequence
  Description of Artificial Sequence: Synthetic oligonucleotide
ggaguaccccagccccac

SEQ ID NO: 27210 - RNA, 18 nt, Artificial Sequence
  Description of Artificial Sequence: Synthetic oligonucleotide
accagggaguaccccagc

SEQ ID NO: 27211 - RNA, 18 nt, Artificial Sequence
  Description of Artificial Sequence: Synthetic oligonucleotide
guacgaccagggaguacc

SEQ ID NO: 27212 - RNA, 18 nt, Artificial Sequence
  Description of Artificial Sequence: Synthetic oligonucleotide
cugcaguacgaccaggga

SEQ ID NO: 27213 - RNA, 18 nt, Artificial Sequence
  Description of Artificial Sequence: Synthetic oligonucleotide
gcugacugcaguacgacc

SEQ ID NO: 27214 - RNA, 18 nt, Artificial Sequence
  Description of Artificial Sequence: Synthetic oligonucleotide
cgggugcugacugcagua

SEQ ID NO: 27215 - RNA, 18 nt, Artificial Sequence
  Description of Artificial Sequence: Synthetic oligonucleotide
gguuacgggugcugacug

SEQ ID NO: 27216 - RNA, 18 nt, Artificial Sequence
  Description of Artificial Sequence: Synthetic oligonucleotide
agccggguuacgggugcu

SEQ ID NO: 27217 - RNA, 18 nt, Artificial Sequence
  Description of Artificial Sequence: Synthetic oligonucleotide
gucauagccggguuacgg

SEQ ID NO: 27218 - RNA, 18 nt, Artificial Sequence
  Description of Artificial Sequence: Synthetic oligonucleotide
cccuggucauagccgggu

SEQ ID NO: 27219 - RNA, 18 nt, Artificial Sequence
  Description of Artificial Sequence: Synthetic oligonucleotide
cagaucccuggucauagc

SEQ ID NO: 27220 - RNA, 18 nt, Artificial Sequence
  Description of Artificial Sequence: Synthetic oligonucleotide
gcuuacagaucccugguc

SEQ ID NO: 27221 - RNA, 18 nt, Artificial Sequence
  Description of Artificial Sequence: Synthetic oligonucleotide
acagggcuuacagauccc

SEQ ID NO: 27222 - RNA, 18 nt, Artificial Sequence
  Description of Artificial Sequence: Synthetic oligonucleotide
gagccacagggcuuacag

SEQ ID NO: 27223 - RNA, 18 nt, Artificial Sequence
  Description of Artificial Sequence: Synthetic oligonucleotide
cuguggagccacagggcu

SEQ ID NO: 27224 - RNA, 18 nt, Artificial Sequence
  Description of Artificial Sequence: Synthetic oligonucleotide
agcaccuguggagccaca

SEQ ID NO: 27225 - RNA, 18 nt, Artificial Sequence
  Description of Artificial Sequence: Synthetic oligonucleotide
gaagcagcaccuguggag

SEQ ID NO: 27226 - RNA, 18 nt, Artificial Sequence
  Description of Artificial Sequence: Synthetic oligonucleotide
agugagaagcagcaccug

SEQ ID NO: 27227 - RNA, 18 nt, Artificial Sequence
  Description of Artificial Sequence: Synthetic oligonucleotide
gggccagugagaagcagc

SEQ ID NO: 27228 - RNA, 18 nt, Artificial Sequence
  Description of Artificial Sequence: Synthetic oligonucleotide
agucugggccagugagaa

SEQ ID NO: 27229 - RNA, 18 nt, Artificial Sequence
  Description of Artificial Sequence: Synthetic oligonucleotide
cucagagucugggccagu

SEQ ID NO: 27230 - RNA, 18 nt, Artificial Sequence
  Description of Artificial Sequence: Synthetic oligonucleotide
uggagcucagagucuggg

SEQ ID NO: 27231 - RNA, 18 nt, Artificial Sequence
  Description of Artificial Sequence: Synthetic oligonucleotide
gccgguggagcucagagu

SEQ ID NO: 27232 - RNA, 18 nt, Artificial Sequence
  Description of Artificial Sequence: Synthetic oligonucleotide
acugggccgguggagcuc

SEQ ID NO: 27233 - RNA, 18 nt, Artificial Sequence
  Description of Artificial Sequence: Synthetic oligonucleotide
ugcagacugggccggugg

SEQ ID NO: 27234 - RNA, 18 nt, Artificial Sequence
  Description of Artificial Sequence: Synthetic oligonucleotide
ggccgugcagacugggcc

SEQ ID NO: 27235 - RNA, 18 nt, Artificial Sequence
  Description of Artificial Sequence: Synthetic oligonucleotide
agaugggccgugcagacu

SEQ ID NO: 27236 - RNA, 18 nt, Artificial Sequence
  Description of Artificial Sequence: Synthetic oligonucleotide
gaagcagaugggccgugc

SEQ ID NO: 27237 - RNA, 18 nt, Artificial Sequence
  Description of Artificial Sequence: Synthetic oligonucleotide
aaggugaagcagaugggc

SEQ ID NO: 27238 - RNA, 18 nt, Artificial Sequence
  Description of Artificial Sequence: Synthetic oligonucleotide
gagggaaggugaagcaga

SEQ ID NO: 27239 - RNA, 18 nt, Artificial Sequence
  Description of Artificial Sequence: Synthetic oligonucleotide
gcugggagggaaggugaa

SEQ ID NO: 27240 - RNA, 18 nt, Artificial Sequence
  Description of Artificial Sequence: Synthetic oligonucleotide
acguggcugggagggaag

SEQ ID NO: 27241 - RNA, 18 nt, Artificial Sequence
  Description of Artificial Sequence: Synthetic oligonucleotide
cuggcacguggcugggag

SEQ ID NO: 27242 - RNA, 18 nt, Artificial Sequence
  Description of Artificial Sequence: Synthetic oligonucleotide
ggccacuggcacguggcu

SEQ ID NO: 27243 - RNA, 18 nt, Artificial Sequence
  Description of Artificial Sequence: Synthetic oligonucleotide
gcuguggccacuggcacg

SEQ ID NO: 27244 - RNA, 18 nt, Artificial Sequence
  Description of Artificial Sequence: Synthetic oligonucleotide
agugggcuguggccacug

SEQ ID NO: 27245 - RNA, 18 nt, Artificial Sequence
  Description of Artificial Sequence: Synthetic oligonucleotide
ugggaagugggcuguggc

SEQ ID NO: 27246 - RNA, 18 nt, Artificial Sequence
  Description of Artificial Sequence: Synthetic oligonucleotide
uggguugggaagugggcu

SEQ ID NO: 27247 - RNA, 18 nt, Artificial Sequence
  Description of Artificial Sequence: Synthetic oligonucleotide
aacaguggguugggaagu

SEQ ID NO: 27248 - RNA, 18 nt, Artificial Sequence
  Description of Artificial Sequence: Synthetic oligonucleotide
gguacaacaguggguugg

SEQ ID NO: 27249 - RNA, 18 nt, Artificial Sequence
  Description of Artificial Sequence: Synthetic oligonucleotide
gccuggguacaacagugg

SEQ ID NO: 27250 - RNA, 18 nt, Artificial Sequence
  Description of Artificial Sequence: Synthetic oligonucleotide
gugaggccuggguacaac

SEQ ID NO: 27251 - RNA, 18 nt, Artificial Sequence
  Description of Artificial Sequence: Synthetic oligonucleotide
gcaaagugaggccugggu

SEQ ID NO: 27252 - RNA, 18 nt, Artificial Sequence
  Description of Artificial Sequence: Synthetic oligonucleotide
caacagcaaagugaggcc

SEQ ID NO: 27253 - RNA, 18 nt, Artificial Sequence
  Description of Artificial Sequence: Synthetic oligonucleotide
aagggcaacagcaaagug

SEQ ID NO: 27254 - RNA, 18 nt, Artificial Sequence
  Description of Artificial Sequence: Synthetic oligonucleotide
gggacaagggcaacagca

SEQ ID NO: 27255 - RNA, 18 nt, Artificial Sequence
  Description of Artificial Sequence: Synthetic oligonucleotide
gaagagggacaagggcaa

SEQ ID NO: 27256 - RNA, 18 nt, Artificial Sequence
  Description of Artificial Sequence: Synthetic oligonucleotide
ggcccgaagagggacaag

SEQ ID NO: 27257 - RNA, 18 nt, Artificial Sequence
  Description of Artificial Sequence: Synthetic oligonucleotide
uucagggcccgaagaggg

SEQ ID NO: 27258 - RNA, 18 nt, Artificial Sequence
  Description of Artificial Sequence: Synthetic oligonucleotide
gaaaauucagggcccgaa

SEQ ID NO: 27259 - RNA, 18 nt, Artificial Sequence
  Description of Artificial Sequence: Synthetic oligonucleotide
gaacagaaaauucagggc

SEQ ID NO: 27260 - RNA, 18 nt, Artificial Sequence
  Description of Artificial Sequence: Synthetic oligonucleotide
ccagggaacagaaaauuc

SEQ ID NO: 27261 - RNA, 18 nt, Artificial Sequence
  Description of Artificial Sequence: Synthetic oligonucleotide
ggcccccagggaacagaa

SEQ ID NO: 27262 - RNA, 18 nt, Artificial Sequence
  Description of Artificial Sequence: Synthetic oligonucleotide
uggcuggcccccagggaa

SEQ ID NO: 27263 - RNA, 18 nt, Artificial Sequence
  Description of Artificial Sequence: Synthetic oligonucleotide
ggcccuggcuggccccca

SEQ ID NO: 27264 - RNA, 18 nt, Artificial Sequence
  Description of Artificial Sequence: Synthetic oligonucleotide
caaagggcccuggcuggc

SEQ ID NO: 27265 - RNA, 18 nt, Artificial Sequence
  Description of Artificial Sequence: Synthetic oligonucleotide
gggcacaaagggcccugg

SEQ ID NO: 27266 - RNA, 18 nt, Artificial Sequence
  Description of Artificial Sequence: Synthetic oligonucleotide
caucaggccugugcuggg

SEQ ID NO: 27267 - RNA, 18 nt, Artificial Sequence
  Description of Artificial Sequence: Synthetic oligonucleotide
accugcaucaggccugug

SEQ ID NO: 27268 - RNA, 18 nt, Artificial Sequence
  Description of Artificial Sequence: Synthetic oligonucleotide
uggacaccugcaucaggc

SEQ ID NO: 27269 - RNA, 18 nt, Artificial Sequence
  Description of Artificial Sequence: Synthetic oligonucleotide
gugaguggacaccugcau

SEQ ID NO: 27270 - RNA, 18 nt, Artificial Sequence
  Description of Artificial Sequence: Synthetic oligonucleotide
caccugugaguggacacc

SEQ ID NO: 27271 - RNA, 18 nt, Artificial Sequence
  Description of Artificial Sequence: Synthetic oligonucleotide
agcgccaccugugagugg

SEQ ID NO: 27272 - RNA, 18 nt, Artificial Sequence
  Description of Artificial Sequence: Synthetic oligonucleotide
aggugagcgccaccugug

SEQ ID NO: 27273 - RNA, 18 nt, Artificial Sequence
  Description of Artificial Sequence: Synthetic oligonucleotide
agccuaggugagcgccac

SEQ ID NO: 27274 - RNA, 18 nt, Artificial Sequence
  Description of Artificial Sequence: Synthetic oligonucleotide
gugacagccuaggugagc

SEQ ID NO: 27275 - RNA, 18 nt, Artificial Sequence
  Description of Artificial Sequence: Synthetic oligonucleotide
guccugugacagccuagg

SEQ ID NO: 27276 - RNA, 18 nt, Artificial Sequence
  Description of Artificial Sequence: Synthetic oligonucleotide
gguggguccugugacagc

SEQ ID NO: 27277 - RNA, 18 nt, Artificial Sequence
  Description of Artificial Sequence: Synthetic oligonucleotide
auggagguggguccugug

SEQ ID NO: 27278 - RNA, 18 nt, Artificial Sequence
  Description of Artificial Sequence: Synthetic oligonucleotide
cuggcauggagguggguc

SEQ ID NO: 27279 - RNA, 18 nt, Artificial Sequence
  Description of Artificial Sequence: Synthetic oligonucleotide
guugccuggcauggaggu

SEQ ID NO: 27280 - RNA, 18 nt, Artificial Sequence
  Description of Artificial Sequence: Synthetic oligonucleotide
ccucuguugccuggcaug

SEQ ID NO: 27281 - RNA, 18 nt, Artificial Sequence
  Description of Artificial Sequence: Synthetic oligonucleotide
guggcccucuguugccug

SEQ ID NO: 27282 - RNA, 18 nt, Artificial Sequence
  Description of Artificial Sequence: Synthetic oligonucleotide
guucuguggcccucuguu

SEQ ID NO: 27283 - RNA, 18 nt, Artificial Sequence
  Description of Artificial Sequence: Synthetic oligonucleotide
gggugguucuguggcccu

SEQ ID NO: 27284 - RNA, 18 nt, Artificial Sequence
  Description of Artificial Sequence: Synthetic oligonucleotide
gaccaaggagugagccgu

SEQ ID NO: 27285 - RNA, 18 nt, Artificial Sequence
  Description of Artificial Sequence: Synthetic oligonucleotide
ccccagaccaaggaguga

SEQ ID NO: 27286 - RNA, 18 nt, Artificial Sequence
  Description of Artificial Sequence: Synthetic oligonucleotide
gguggccccagaccaagg

SEQ ID NO: 27287 - RNA, 18 nt, Artificial Sequence
  Description of Artificial Sequence: Synthetic oligonucleotide
aagaagguggccccagac

SEQ ID NO: 27288 - RNA, 18 nt, Artificial Sequence
  Description of Artificial Sequence: Synthetic oligonucleotide
agggcaagaagguggccc

SEQ ID NO: 27289 - RNA, 18 nt, Artificial Sequence
  Description of Artificial Sequence: Synthetic oligonucleotide
aagaaagggcaagaaggu

SEQ ID NO: 27290 - RNA, 18 nt, Artificial Sequence
  Description of Artificial Sequence: Synthetic oligonucleotide
aaaaaaagaaagggcaag

SEQ ID NO: 27291 - RNA, 18 nt, Artificial Sequence
  Description of Artificial Sequence: Synthetic oligonucleotide
aaaaaaaaaaaagaaagg

SEQ ID NO: 27292 - RNA, 18 nt, Artificial Sequence
  Description of Artificial Sequence: Synthetic oligonucleotide
aaaaaaaaaaaaaaaaag

SEQ ID NO: 27293 - RNA, 18 nt, Artificial Sequence
  Description of Artificial Sequence: Synthetic oligonucleotide
aaaaaaaaaaaaaaaaaa

SEQ ID NO: 27294 - RNA, 18 nt, Artificial Sequence
  Description of Artificial Sequence: Synthetic oligonucleotide
ucggaaaaaaaaaaaaaa

SEQ ID NO: 27295 - RNA, 18 nt, Artificial Sequence
  Description of Artificial Sequence: Synthetic oligonucleotide
ccaucucggaaaaaaaaa

SEQ ID NO: 27296 - RNA, 18 nt, Artificial Sequence
  Description of Artificial Sequence: Synthetic oligonucleotide
agacuccaucucggaaaa

SEQ ID NO: 27297 - RNA, 18 nt, Artificial Sequence
  Description of Artificial Sequence: Synthetic oligonucleotide
gagagagacuccaucucg

SEQ ID NO: 27298 - RNA, 18 nt, Artificial Sequence
  Description of Artificial Sequence: Synthetic oligonucleotide
ugacagagagagacucca

SEQ ID NO: 27299 - RNA, 18 nt, Artificial Sequence
  Description of Artificial Sequence: Synthetic oligonucleotide
cugggugacagagagaga

SEQ ID NO: 27300 - RNA, 18 nt, Artificial Sequence
  Description of Artificial Sequence: Synthetic oligonucleotide
cccaccugggugacagag

SEQ ID NO: 27301 - RNA, 18 nt, Artificial Sequence
  Description of Artificial Sequence: Synthetic oligonucleotide
acacucccaccuggguga

SEQ ID NO: 27302 - RNA, 18 nt, Artificial Sequence
  Description of Artificial Sequence: Synthetic oligonucleotide
ccaccacacucccaccug

SEQ ID NO: 27303 - RNA, 18 nt, Artificial Sequence
  Description of Artificial Sequence: Synthetic oligonucleotide
uugugccaccacacuccc

SEQ ID NO: 27304 - RNA, 18 nt, Artificial Sequence
  Description of Artificial Sequence: Synthetic oligonucleotide
cgagauugugccaccaca

SEQ ID NO: 27305 - RNA, 18 nt, Artificial Sequence
  Description of Artificial Sequence: Synthetic oligonucleotide
ugagccgagauugugcca

SEQ ID NO: 27306 - RNA, 18 nt, Artificial Sequence
  Description of Artificial Sequence: Synthetic oligonucleotide
ugcagugagccgagauug

SEQ ID NO: 27307 - RNA, 18 nt, Artificial Sequence
  Description of Artificial Sequence: Synthetic oligonucleotide
gagguugcagugagccga

SEQ ID NO: 27308 - RNA, 18 nt, Artificial Sequence
  Description of Artificial Sequence: Synthetic oligonucleotide
agguggagguugcaguga

SEQ ID NO: 27309 - RNA, 18 nt, Artificial Sequence
  Description of Artificial Sequence: Synthetic oligonucleotide
ucaggagguggagguugc

SEQ ID NO: 27310 - RNA, 18 nt, Artificial Sequence
  Description of Artificial Sequence: Synthetic oligonucleotide
ugaacucaggagguggag

SEQ ID NO: 27311 - RNA, 18 nt, Artificial Sequence
  Description of Artificial Sequence: Synthetic oligonucleotide
uugcuugaacucaggagg

SEQ ID NO: 27312 - RNA, 18 nt, Artificial Sequence
  Description of Artificial Sequence: Synthetic oligonucleotide
gagaauugcuugaacuca

SEQ ID NO: 27313 - RNA, 18 nt, Artificial Sequence
  Description of Artificial Sequence: Synthetic oligonucleotide
ggcaggagaauugcuuga

SEQ ID NO: 27314 - RNA, 18 nt, Artificial Sequence
  Description of Artificial Sequence: Synthetic oligonucleotide
gcugaggcaggagaauug

SEQ ID NO: 27315 - RNA, 18 nt, Artificial Sequence
  Description of Artificial Sequence: Synthetic oligonucleotide
gggaggcugaggcaggag

SEQ ID NO: 27316 - RNA, 18 nt, Artificial Sequence
  Description of Artificial Sequence: Synthetic oligonucleotide
uacuugggaggcugaggc

SEQ ID NO: 27317 - RNA, 18 nt, Artificial Sequence
  Description of Artificial Sequence: Synthetic oligonucleotide
ccagcuacuugggaggcu

SEQ ID NO: 27318 - RNA, 18 nt, Artificial Sequence
  Description of Artificial Sequence: Synthetic oligonucleotide
uagucccagcuacuuggg

SEQ ID NO: 27319 - RNA, 18 nt, Artificial Sequence
  Description of Artificial Sequence: Synthetic oligonucleotide
gccuguagucccagcuac

SEQ ID NO: 27320 - RNA, 18 nt, Artificial Sequence
  Description of Artificial Sequence: Synthetic oligonucleotide
ugcaugccuguaguccca

SEQ ID NO: 27321 - RNA, 18 nt, Artificial Sequence
  Description of Artificial Sequence: Synthetic oligonucleotide
gguggugcaugccuguag

SEQ ID NO: 27322 - RNA, 18 nt, Artificial Sequence
  Description of Artificial Sequence: Synthetic oligonucleotide
agugugguggugcaugcc

SEQ ID NO: 27323 - RNA, 18 nt, Artificial Sequence
  Description of Artificial Sequence: Synthetic oligonucleotide
ggccaagugugguggugc

SEQ ID NO: 27324 - RNA, 18 nt, Artificial Sequence
  Description of Artificial Sequence: Synthetic oligonucleotide
acauuggccaaguguggu

SEQ ID NO: 27325 - RNA, 18 nt, Artificial Sequence
  Description of Artificial Sequence: Synthetic oligonucleotide
acagaacauuggccaagu

SEQ ID NO: 27326 - RNA, 18 nt, Artificial Sequence
  Description of Artificial Sequence: Synthetic oligonucleotide
aaaauacagaacauuggc

SEQ ID NO: 27327 - RNA, 18 nt, Artificial Sequence
  Description of Artificial Sequence: Synthetic oligonucleotide
uauuaaaaauacagaaca

SEQ ID NO: 27328 - RNA, 18 nt, Artificial Sequence
  Description of Artificial Sequence: Synthetic oligonucleotide
gucccuauuaaaaauaca

SEQ ID NO: 27329 - RNA, 18 nt, Artificial Sequence
  Description of Artificial Sequence: Synthetic oligonucleotide
accccgucccuauuaaaa

SEQ ID NO: 27330 - RNA, 18 nt, Artificial Sequence
  Description of Artificial Sequence: Synthetic oligonucleotide
gcaaaaccccgucccuau

SEQ ID NO: 27331 - RNA, 18 nt, Artificial Sequence
  Description of Artificial Sequence: Synthetic oligonucleotide
acauggcaaaaccccguc

SEQ ID NO: 27332 - RNA, 18 nt, Artificial Sequence
  Description of Artificial Sequence: Synthetic oligonucleotide
agcuaacauggcaaaacc

SEQ ID NO: 27333 - RNA, 18 nt, Artificial Sequence
  Description of Artificial Sequence: Synthetic oligonucleotide
agccuagcuaacauggca

SEQ ID NO: 27334 - RNA, 18 nt, Artificial Sequence
  Description of Artificial Sequence: Synthetic oligonucleotide
agaccagccuagcuaaca

SEQ ID NO: 27335 - RNA, 18 nt, Artificial Sequence
  Description of Artificial Sequence: Synthetic oligonucleotide
guuugagaccagccuagc

SEQ ID NO: 27336 - RNA, 18 nt, Artificial Sequence
  Description of Artificial Sequence: Synthetic oligonucleotide
ugugaguuugagaccagc

SEQ ID NO: 27337 - RNA, 18 nt, Artificial Sequence
  Description of Artificial Sequence: Synthetic oligonucleotide
ccaggugugaguuugaga

SEQ ID NO: 27338 - RNA, 18 nt, Artificial Sequence
  Description of Artificial Sequence: Synthetic oligonucleotide
uaaucccaggugugaguu

SEQ ID NO: 27339 - RNA, 18 nt, Artificial Sequence
  Description of Artificial Sequence: Synthetic oligonucleotide
gccuguaaucccaggugu

SEQ ID NO: 27340 - RNA, 18 nt, Artificial Sequence
  Description of Artificial Sequence: Synthetic oligonucleotide
cucaugccuguaauccca

SEQ ID NO: 27341 - RNA, 18 nt, Artificial Sequence
  Description of Artificial Sequence: Synthetic oligonucleotide
aguggcucaugccuguaa

SEQ ID NO: 27342 - RNA, 18 nt, Artificial Sequence
  Description of Artificial Sequence: Synthetic oligonucleotide
ggugcaguggcucaugcc

SEQ ID NO: 27343 - RNA, 18 nt, Artificial Sequence
  Description of Artificial Sequence: Synthetic oligonucleotide
ggcugggugcaguggcuc

SEQ ID NO: 27344 - RNA, 18 nt, Artificial Sequence
  Description of Artificial Sequence: Synthetic oligonucleotide
gggcugggugcaguggcu

SEQ ID NO: 27345 - RNA, 18 nt, Artificial Sequence
  Description of Artificial Sequence: Synthetic oligonucleotide
aagaaagggcaagaaggg

SEQ ID NO: 27346 - RNA, 18 nt, Artificial Sequence
  Description of Artificial Sequence: Synthetic oligonucleotide
gagaaaagaaagggcaag

SEQ ID NO: 27347 - RNA, 18 nt, Artificial Sequence
  Description of Artificial Sequence: Synthetic oligonucleotide
ccauggagaaaagaaagg

SEQ ID NO: 27348 - RNA, 18 nt, Artificial Sequence
  Description of Artificial Sequence: Synthetic oligonucleotide
aucagccauggagaaaag

SEQ ID NO: 27349 - RNA, 18 nt, Artificial Sequence
  Description of Artificial Sequence: Synthetic oligonucleotide
gcagcaucagccauggag

SEQ ID NO: 27350 - RNA, 18 nt, Artificial Sequence
  Description of Artificial Sequence: Synthetic oligonucleotide
ccacagcagcaucagcca

SEQ ID NO: 27351 - RNA, 18 nt, Artificial Sequence
  Description of Artificial Sequence: Synthetic oligonucleotide
gcuggccacagcagcauc

SEQ ID NO: 27352 - RNA, 18 nt, Artificial Sequence
  Description of Artificial Sequence: Synthetic oligonucleotide
cccuggcuggccacagca

SEQ ID NO: 27353 - RNA, 18 nt, Artificial Sequence
  Description of Artificial Sequence: Synthetic oligonucleotide
aagggcccuggcuggcca

SEQ ID NO: 27354 - RNA, 18 nt, Artificial Sequence
  Description of Artificial Sequence: Synthetic oligonucleotide
aucucaagggcccuggcu

SEQ ID NO: 27355 - RNA, 18 nt, Artificial Sequence
  Description of Artificial Sequence: Synthetic oligonucleotide
gaaggaucucaagggccc

SEQ ID NO: 27356 - RNA, 18 nt, Artificial Sequence
  Description of Artificial Sequence: Synthetic oligonucleotide
aacuggaaggaucucaag

SEQ ID NO: 27357 - RNA, 18 nt, Artificial Sequence
  Description of Artificial Sequence: Synthetic oligonucleotide
agccaaacuggaaggauc

SEQ ID NO: 27358 - RNA, 18 nt, Artificial Sequence
  Description of Artificial Sequence: Synthetic oligonucleotide
auaacagccaaacuggaa

SEQ ID NO: 27359 - RNA, 18 nt, Artificial Sequence
  Description of Artificial Sequence: Synthetic oligonucleotide
uuugcauaacagccaaac

SEQ ID NO: 27360 - RNA, 18 nt, Artificial Sequence
  Description of Artificial Sequence: Synthetic oligonucleotide
ccugcuuugcauaacagc

SEQ ID NO: 27361 - RNA, 18 nt, Artificial Sequence
  Description of Artificial Sequence: Synthetic oligonucleotide
aaucaccugcuuugcaua

SEQ ID NO: 27362 - RNA, 18 nt, Artificial Sequence
  Description of Artificial Sequence: Synthetic oligonucleotide
agacaaaucaccugcuuu

SEQ ID NO: 27363 - RNA, 18 nt, Artificial Sequence
  Description of Artificial Sequence: Synthetic oligonucleotide
gauuaagacaaaucaccu

SEQ ID NO: 27364 - RNA, 18 nt, Artificial Sequence
  Description of Artificial Sequence: Synthetic oligonucleotide
uaucugauuaagacaaau

SEQ ID NO: 27365 - RNA, 18 nt, Artificial Sequence
  Description of Artificial Sequence: Synthetic oligonucleotide
ucuuuuaucugauuaaga

SEQ ID NO: 27366 - RNA, 18 nt, Artificial Sequence
  Description of Artificial Sequence: Synthetic oligonucleotide
cucuaucuuuuaucugau

SEQ ID NO: 27367 - RNA, 18 nt, Artificial Sequence
  Description of Artificial Sequence: Synthetic oligonucleotide
auagccucuaucuuuuau

SEQ ID NO: 27368 - RNA, 18 nt, Artificial Sequence
  Description of Artificial Sequence: Synthetic oligonucleotide
cccccauagccucuaucu

SEQ ID NO: 27369 - RNA, 18 nt, Artificial Sequence
  Description of Artificial Sequence: Synthetic oligonucleotide
ugaggcccccauagccuc

SEQ ID NO: 27370 - RNA, 18 nt, Artificial Sequence
  Description of Artificial Sequence: Synthetic oligonucleotide
aaucuugaggcccccaua

SEQ ID NO: 27371 - RNA, 18 nt, Artificial Sequence
  Description of Artificial Sequence: Synthetic oligonucleotide
ccaaaaaucuugaggccc

SEQ ID NO: 27372 - RNA, 18 nt, Artificial Sequence
  Description of Artificial Sequence: Synthetic oligonucleotide
gcucuccaaaaaucuuga

SEQ ID NO: 27373 - RNA, 18 nt, Artificial Sequence
  Description of Artificial Sequence: Synthetic oligonucleotide
ccucugcucuccaaaaau

SEQ ID NO: 27374 - RNA, 18 nt, Artificial Sequence
  Description of Artificial Sequence: Synthetic oligonucleotide
gaccaccucugcucucca

SEQ ID NO: 27375 - RNA, 18 nt, Artificial Sequence
  Description of Artificial Sequence: Synthetic oligonucleotide
ccagagaccaccucugcu

SEQ ID NO: 27376 - RNA, 18 nt, Artificial Sequence
  Description of Artificial Sequence: Synthetic oligonucleotide
aauugccagagaccaccu

SEQ ID NO: 27377 - RNA, 18 nt, Artificial Sequence
  Description of Artificial Sequence: Synthetic oligonucleotide
gauggaauugccagagac

SEQ ID NO: 27378 - RNA, 18 nt, Artificial Sequence
  Description of Artificial Sequence: Synthetic oligonucleotide
aaccagauggaauugcca

SEQ ID NO: 27379 - RNA, 18 nt, Artificial Sequence
  Description of Artificial Sequence: Synthetic oligonucleotide
cucaaaaccagauggaau

SEQ ID NO: 27380 - RNA, 18 nt, Artificial Sequence
  Description of Artificial Sequence: Synthetic oligonucleotide
aguuucucaaaaccagau

SEQ ID NO: 27381 - RNA, 18 nt, Artificial Sequence
  Description of Artificial Sequence: Synthetic oligonucleotide
ugcuaaguuucucaaaac

SEQ ID NO: 27382 - RNA, 18 nt, Artificial Sequence
  Description of Artificial Sequence: Synthetic oligonucleotide
ugagcugcuaaguuucuc

SEQ ID NO: 27383 - RNA, 18 nt, Artificial Sequence
  Description of Artificial Sequence: Synthetic oligonucleotide
cucugugagcugcuaagu

SEQ ID NO: 27384 - RNA, 18 nt, Artificial Sequence
  Description of Artificial Sequence: Synthetic oligonucleotide
cugugcucugugagcugc

SEQ ID NO: 27385 - RNA, 18 nt, Artificial Sequence
  Description of Artificial Sequence: Synthetic oligonucleotide
gaucucugugcucuguga

SEQ ID NO: 27386 - RNA, 18 nt, Artificial Sequence
  Description of Artificial Sequence: Synthetic oligonucleotide
ggcaggaucucugugcuc

SEQ ID NO: 27387 - RNA, 18 nt, Artificial Sequence
  Description of Artificial Sequence: Synthetic oligonucleotide
aagaaggcaggaucucug

SEQ ID NO: 27388 - RNA, 18 nt, Artificial Sequence
  Description of Artificial Sequence: Synthetic oligonucleotide
guaggaagaaggcaggau

SEQ ID NO: 27389 - RNA, 18 nt, Artificial Sequence
  Description of Artificial Sequence: Synthetic oligonucleotide
ugauaguaggaagaaggc

SEQ ID NO: 27390 - RNA, 18 nt, Artificial Sequence
  Description of Artificial Sequence: Synthetic oligonucleotide
cagccugauaguaggaag

SEQ ID NO: 27391 - RNA, 18 nt, Artificial Sequence
  Description of Artificial Sequence: Synthetic oligonucleotide
uaggucagccugauagua

SEQ ID NO: 27392 - RNA, 18 nt, Artificial Sequence
  Description of Artificial Sequence: Synthetic oligonucleotide
cccauuaggucagccuga

SEQ ID NO: 27393 - RNA, 18 nt, Artificial Sequence
  Description of Artificial Sequence: Synthetic oligonucleotide
ccaaccccauuaggucag

SEQ ID NO: 27394 - RNA, 18 nt, Artificial Sequence
  Description of Artificial Sequence: Synthetic oligonucleotide
gcagcccaaccccauuag

SEQ ID NO: 27395 - RNA, 18 nt, Artificial Sequence
  Description of Artificial Sequence: Synthetic oligonucleotide
gccgagcagcccaacccc

SEQ ID NO: 27396 - RNA, 18 nt, Artificial Sequence
  Description of Artificial Sequence: Synthetic oligonucleotide
caguugccgagcagccca

SEQ ID NO: 27397 - RNA, 18 nt, Artificial Sequence
  Description of Artificial Sequence: Synthetic oligonucleotide
ccaagcaguugccgagca

SEQ ID NO: 27398 - RNA, 18 nt, Artificial Sequence
  Description of Artificial Sequence: Synthetic oligonucleotide
gugacccaagcaguugcc

SEQ ID NO: 27399 - RNA, 18 nt, Artificial Sequence
  Description of Artificial Sequence: Synthetic oligonucleotide
gcaaggugacccaagcag

SEQ ID NO: 27400 - RNA, 18 nt, Artificial Sequence
  Description of Artificial Sequence: Synthetic oligonucleotide
gggcaaggugacccaagc

SEQ ID NO: 27401 - RNA, 18 nt, Artificial Sequence
  Description of Artificial Sequence: Synthetic oligonucleotide
agggcugguuuccuuggg

SEQ ID NO: 27402 - RNA, 18 nt, Artificial Sequence
  Description of Artificial Sequence: Synthetic oligonucleotide
cacccagggcugguuucc

SEQ ID NO: 27403 - RNA, 18 nt, Artificial Sequence
  Description of Artificial Sequence: Synthetic oligonucleotide
gguggcacccagggcugg

SEQ ID NO: 27404 - RNA, 18 nt, Artificial Sequence
  Description of Artificial Sequence: Synthetic oligonucleotide
ggcuggguggcacccagg

SEQ ID NO: 27405 - RNA, 18 nt, Artificial Sequence
  Description of Artificial Sequence: Synthetic oligonucleotide
uaaguggcuggguggcac

SEQ ID NO: 27406 - RNA, 18 nt, Artificial Sequence
  Description of Artificial Sequence: Synthetic oligonucleotide
gacccuaaguggcugggu

SEQ ID NO: 27407 - RNA, 18 nt, Artificial Sequence
  Description of Artificial Sequence: Synthetic oligonucleotide
cuguagacccuaaguggc

SEQ ID NO: 27408 - RNA, 18 nt, Artificial Sequence
  Description of Artificial Sequence: Synthetic oligonucleotide
ccacccuguagacccuaa

SEQ ID NO: 27409 - RNA, 18 nt, Artificial Sequence
  Description of Artificial Sequence: Synthetic oligonucleotide
gagucccacccuguagac

SEQ ID NO: 27410 - RNA, 18 nt, Artificial Sequence
  Description of Artificial Sequence: Synthetic oligonucleotide
gucuggagucccacccug

SEQ ID NO: 27411 - RNA, 18 nt, Artificial Sequence
  Description of Artificial Sequence: Synthetic oligonucleotide
ucuaggucuggaguccca

SEQ ID NO: 27412 - RNA, 18 nt, Artificial Sequence
  Description of Artificial Sequence: Synthetic oligonucleotide
uacgcucuaggucuggag

SEQ ID NO: 27413 - RNA, 18 nt, Artificial Sequence
  Description of Artificial Sequence: Synthetic oligonucleotide
auacuuacgcucuagguc

SEQ ID NO: 27414 - RNA, 18 nt, Artificial Sequence
  Description of Artificial Sequence: Synthetic oligonucleotide
cauccauacuuacgcucu

SEQ ID NO: 27415 - RNA, 18 nt, Artificial Sequence
  Description of Artificial Sequence: Synthetic oligonucleotide
cacaacauccauacuuac

SEQ ID NO: 27416 - RNA, 18 nt, Artificial Sequence
  Description of Artificial Sequence: Synthetic oligonucleotide
agggccacaacauccaua

SEQ ID NO: 27417 - RNA, 18 nt, Artificial Sequence
  Description of Artificial Sequence: Synthetic oligonucleotide
gacacagggccacaacau

SEQ ID NO: 27418 - RNA, 18 nt, Artificial Sequence
  Description of Artificial Sequence: Synthetic oligonucleotide
aggaagacacagggccac

SEQ ID NO: 27419 - RNA, 18 nt, Artificial Sequence
  Description of Artificial Sequence: Synthetic oligonucleotide
acacuaggaagacacagg

SEQ ID NO: 27420 - RNA, 18 nt, Artificial Sequence
  Description of Artificial Sequence: Synthetic oligonucleotide
gggucacacuaggaagac

SEQ ID NO: 27421 - RNA, 18 nt, Artificial Sequence
  Description of Artificial Sequence: Synthetic oligonucleotide
uggcugggucacacuagg

SEQ ID NO: 27422 - RNA, 18 nt, Artificial Sequence
  Description of Artificial Sequence: Synthetic oligonucleotide
gcuccuggcugggucaca

SEQ ID NO: 27423 - RNA, 18 nt, Artificial Sequence
  Description of Artificial Sequence: Synthetic oligonucleotide
cuuccgcuccuggcuggg

SEQ ID NO: 27424 - RNA, 18 nt, Artificial Sequence
  Description of Artificial Sequence: Synthetic oligonucleotide
ugaagcuuccgcuccugg

SEQ ID NO: 27425 - RNA, 18 nt, Artificial Sequence
  Description of Artificial Sequence: Synthetic oligonucleotide
acgccugaagcuuccgcu

SEQ ID NO: 27426 - RNA, 18 nt, Artificial Sequence
  Description of Artificial Sequence: Synthetic oligonucleotide
uacaaacgccugaagcuu

SEQ ID NO: 27427 - RNA, 18 nt, Artificial Sequence
  Description of Artificial Sequence: Synthetic oligonucleotide
cacuuuacaaacgccuga

SEQ ID NO: 27428 - RNA, 18 nt, Artificial Sequence
  Description of Artificial Sequence: Synthetic oligonucleotide
gaccucacuuuacaaacg

SEQ ID NO: 27429 - RNA, 18 nt, Artificial Sequence
  Description of Artificial Sequence: Synthetic oligonucleotide
agccagaccucacuuuac

SEQ ID NO: 27430 - RNA, 18 nt, Artificial Sequence
  Description of Artificial Sequence: Synthetic oligonucleotide
ggcagagccagaccucac

SEQ ID NO: 27431 - RNA, 18 nt, Artificial Sequence
  Description of Artificial Sequence: Synthetic oligonucleotide
gaggaggcagagccagac

SEQ ID NO: 27432 - RNA, 18 nt, Artificial Sequence
  Description of Artificial Sequence: Synthetic oligonucleotide
aaacggaggaggcagagc

SEQ ID NO: 27433 - RNA, 18 nt, Artificial Sequence
  Description of Artificial Sequence: Synthetic oligonucleotide
aaaaaaaacggaggaggc

SEQ ID NO: 27434 - RNA, 18 nt, Artificial Sequence
  Description of Artificial Sequence: Synthetic oligonucleotide
aaaaaaaaaaaaacggag

SEQ ID NO: 27435 - RNA, 18 nt, Artificial Sequence
  Description of Artificial Sequence: Synthetic oligonucleotide
acagaaaaaaaaaaaaaa

SEQ ID NO: 27436 - RNA, 18 nt, Artificial Sequence
  Description of Artificial Sequence: Synthetic oligonucleotide
cagaaacagaaaaaaaaa

SEQ ID NO: 27437 - RNA, 18 nt, Artificial Sequence
  Description of Artificial Sequence: Synthetic oligonucleotide
agaaacagaaacagaaaa

SEQ ID NO: 27438 - RNA, 18 nt, Artificial Sequence
  Description of Artificial Sequence: Synthetic oligonucleotide
aaaacagaaacagaaaca

SEQ ID NO: 27439 - RNA, 18 nt, Artificial Sequence
  Description of Artificial Sequence: Synthetic oligonucleotide
aaaaaaaaacagaaacag

SEQ ID NO: 27440 - RNA, 18 nt, Artificial Sequence
  Description of Artificial Sequence: Synthetic oligonucleotide
ucucaaaaaaaaaacaga

SEQ ID NO: 27441 - RNA, 18 nt, Artificial Sequence
  Description of Artificial Sequence: Synthetic oligonucleotide
cuccaucucaaaaaaaaa

SEQ ID NO: 27442 - RNA, 18 nt, Artificial Sequence
  Description of Artificial Sequence: Synthetic oligonucleotide
cgagacuccaucucaaaa

SEQ ID NO: 27443 - RNA, 18 nt, Artificial Sequence
  Description of Artificial Sequence: Synthetic oligonucleotide
cagagcgagacuccaucu

SEQ ID NO: 27444 - RNA, 18 nt, Artificial Sequence
  Description of Artificial Sequence: Synthetic oligonucleotide
ggcgacagagcgagacuc

SEQ ID NO: 27445 - RNA, 18 nt, Artificial Sequence
  Description of Artificial Sequence: Synthetic oligonucleotide
gccugggcgacagagcga

SEQ ID NO: 27446 - RNA, 18 nt, Artificial Sequence
  Description of Artificial Sequence: Synthetic oligonucleotide
cuccagccugggcgacag

SEQ ID NO: 27447 - RNA, 18 nt, Artificial Sequence
  Description of Artificial Sequence: Synthetic oligonucleotide
cugcacuccagccugggc

SEQ ID NO: 27448 - RNA, 18 nt, Artificial Sequence
  Description of Artificial Sequence: Synthetic oligonucleotide
ugacacugcacuccagcc

SEQ ID NO: 27449 - RNA, 18 nt, Artificial Sequence
  Description of Artificial Sequence: Synthetic oligonucleotide
gaucgugacacugcacuc

SEQ ID NO: 27450 - RNA, 18 nt, Artificial Sequence
  Description of Artificial Sequence: Synthetic oligonucleotide
gcugagaucgugacacug

SEQ ID NO: 27451 - RNA, 18 nt, Artificial Sequence
  Description of Artificial Sequence: Synthetic oligonucleotide
agugagcugagaucguga

SEQ ID NO: 27452 - RNA, 18 nt, Artificial Sequence
  Description of Artificial Sequence: Synthetic oligonucleotide
guugcagugagcugagau

SEQ ID NO: 27453 - RNA, 18 nt, Artificial Sequence
  Description of Artificial Sequence: Synthetic oligonucleotide
cggagguugcagugagcu

SEQ ID NO: 27454 - RNA, 18 nt, Artificial Sequence
  Description of Artificial Sequence: Synthetic oligonucleotide
ggaggcggagguugcagu

SEQ ID NO: 27455 - RNA, 18 nt, Artificial Sequence
  Description of Artificial Sequence: Synthetic oligonucleotide
accugggaggcggagguu

SEQ ID NO: 27456 - RNA, 18 nt, Artificial Sequence
  Description of Artificial Sequence: Synthetic oligonucleotide
cuuguaccugggaggcgg

SEQ ID NO: 27457 - RNA, 18 nt, Artificial Sequence
  Description of Artificial Sequence: Synthetic oligonucleotide
aaucucuuguaccuggga

SEQ ID NO: 27458 - RNA, 18 nt, Artificial Sequence
  Description of Artificial Sequence: Synthetic oligonucleotide
aggagaaucucuuguacc

SEQ ID NO: 27459 - RNA, 18 nt, Artificial Sequence
  Description of Artificial Sequence: Synthetic oligonucleotide
gaggcaggagaaucucuu

SEQ ID NO: 27460 - RNA, 18 nt, Artificial Sequence
  Description of Artificial Sequence: Synthetic oligonucleotide
aggcugaggcaggagaau

SEQ ID NO: 27461 - RNA, 18 nt, Artificial Sequence
  Description of Artificial Sequence: Synthetic oligonucleotide
ucgggaggcugaggcagg

SEQ ID NO: 27462 - RNA, 18 nt, Artificial Sequence
  Description of Artificial Sequence: Synthetic oligonucleotide
gcuacucgggaggcugag

SEQ ID NO: 27463 - RNA, 18 nt, Artificial Sequence
  Description of Artificial Sequence: Synthetic oligonucleotide
ucccagcuacucgggagg

SEQ ID NO: 27464 - RNA, 18 nt, Artificial Sequence
  Description of Artificial Sequence: Synthetic oligonucleotide
uguagucccagcuacucg

SEQ ID NO: 27465 - RNA, 18 nt, Artificial Sequence
  Description of Artificial Sequence: Synthetic oligonucleotide
acgccuguagucccagcu

SEQ ID NO: 27466 - RNA, 18 nt, Artificial Sequence
  Description of Artificial Sequence: Synthetic oligonucleotide
ggcacacgccuguagucc

SEQ ID NO: 27467 - RNA, 18 nt, Artificial Sequence
  Description of Artificial Sequence: Synthetic oligonucleotide
augguggcacacgccugu

SEQ ID NO: 27468 - RNA, 18 nt, Artificial Sequence
  Description of Artificial Sequence: Synthetic oligonucleotide
caggcaugguggcacacg

SEQ ID NO: 27469 - RNA, 18 nt, Artificial Sequence
  Description of Artificial Sequence: Synthetic oligonucleotide
uuagccaggcaugguggc

SEQ ID NO: 27470 - RNA, 18 nt, Artificial Sequence
  Description of Artificial Sequence: Synthetic oligonucleotide
aaaaauuagccaggcaug

SEQ ID NO: 27471 - RNA, 18 nt, Artificial Sequence
  Description of Artificial Sequence: Synthetic oligonucleotide
aauacaaaaauuagccag

SEQ ID NO: 27472 - RNA, 18 nt, Artificial Sequence
  Description of Artificial Sequence: Synthetic oligonucleotide
cuaaaaauacaaaaauua

SEQ ID NO: 27473 - RNA, 18 nt, Artificial Sequence
  Description of Artificial Sequence: Synthetic oligonucleotide
cucuacuaaaaauacaaa

SEQ ID NO: 27474 - RNA, 18 nt, Artificial Sequence
  Description of Artificial Sequence: Synthetic oligonucleotide
cccaucucuacuaaaaau

SEQ ID NO: 27475 - RNA, 18 nt, Artificial Sequence
  Description of Artificial Sequence: Synthetic oligonucleotide
gaaaccccaucucuacua

SEQ ID NO: 27476 - RNA, 18 nt, Artificial Sequence
  Description of Artificial Sequence: Synthetic oligonucleotide
auggcgaaaccccaucuc

SEQ ID NO: 27477 - RNA, 18 nt, Artificial Sequence
  Description of Artificial Sequence: Synthetic oligonucleotide
cuaacauggcgaaacccc

SEQ ID NO: 27478 - RNA, 18 nt, Artificial Sequence
  Description of Artificial Sequence: Synthetic oligonucleotide
ucuggcuaacauggcgaa

SEQ ID NO: 27479 - RNA, 18 nt, Artificial Sequence
  Description of Artificial Sequence: Synthetic oligonucleotide
accagucuggcuaacaug

SEQ ID NO: 27480 - RNA, 18 nt, Artificial Sequence
  Description of Artificial Sequence: Synthetic oligonucleotide
ucgagaccagucuggcua

SEQ ID NO: 27481 - RNA, 18 nt, Artificial Sequence
  Description of Artificial Sequence: Synthetic oligonucleotide
ggaguucgagaccagucu

SEQ ID NO: 27482 - RNA, 18 nt, Artificial Sequence
  Description of Artificial Sequence: Synthetic oligonucleotide
ggucaggaguucgagacc

SEQ ID NO: 27483 - RNA, 18 nt, Artificial Sequence
  Description of Artificial Sequence: Synthetic oligonucleotide
ccugaggucaggaguucg

SEQ ID NO: 27484 - RNA, 18 nt, Artificial Sequence
  Description of Artificial Sequence: Synthetic oligonucleotide
gaucaccugaggucagga

SEQ ID NO: 27485 - RNA, 18 nt, Artificial Sequence
  Description of Artificial Sequence: Synthetic oligonucleotide
gggaggaucaccugaggu

SEQ ID NO: 27486 - RNA, 18 nt, Artificial Sequence
  Description of Artificial Sequence: Synthetic oligonucleotide
gggugggaggaucaccug

SEQ ID NO: 27487 - RNA, 18 nt, Artificial Sequence
  Description of Artificial Sequence: Synthetic oligonucleotide
gaacuuugggaagccggg

SEQ ID NO: 27488 - RNA, 18 nt, Artificial Sequence
  Description of Artificial Sequence: Synthetic oligonucleotide
ucccagaacuuugggaag

SEQ ID NO: 27489 - RNA, 18 nt, Artificial Sequence
  Description of Artificial Sequence: Synthetic oligonucleotide
uauaaucccagaacuuug

SEQ ID NO: 27490 - RNA, 18 nt, Artificial Sequence
  Description of Artificial Sequence: Synthetic oligonucleotide
acgccuauaaucccagaa

SEQ ID NO: 27491 - RNA, 18 nt, Artificial Sequence
  Description of Artificial Sequence: Synthetic oligonucleotide
ggcucacgccuauaaucc

SEQ ID NO: 27492 - RNA, 18 nt, Artificial Sequence
  Description of Artificial Sequence: Synthetic oligonucleotide
augguggcucacgccuau

SEQ ID NO: 27493 - RNA, 18 nt, Artificial Sequence
  Description of Artificial Sequence: Synthetic oligonucleotide
cgggcaugguggcucacg

SEQ ID NO: 27494 - RNA, 18 nt, Artificial Sequence
  Description of Artificial Sequence: Synthetic oligonucleotide
gagaccgggcaugguggc

SEQ ID NO: 27495 - RNA, 18 nt, Artificial Sequence
  Description of Artificial Sequence: Synthetic oligonucleotide
gagaagagaccgggcaug

SEQ ID NO: 27496 - RNA, 18 nt, Artificial Sequence
  Description of Artificial Sequence: Synthetic oligonucleotide
agacugagaagagaccgg

SEQ ID NO: 27497 - RNA, 18 nt, Artificial Sequence
  Description of Artificial Sequence: Synthetic oligonucleotide
cuucaagacugagaagag

SEQ ID NO: 27498 - RNA, 18 nt, Artificial Sequence
  Description of Artificial Sequence: Synthetic oligonucleotide
augggcuucaagacugag

SEQ ID NO: 27499 - RNA, 18 nt, Artificial Sequence
  Description of Artificial Sequence: Synthetic oligonucleotide
cagggaugggcuucaaga

SEQ ID NO: 27500 - RNA, 18 nt, Artificial Sequence
  Description of Artificial Sequence: Synthetic oligonucleotide
aaauccagggaugggcuu

SEQ ID NO: 27501 - RNA, 18 nt, Artificial Sequence
  Description of Artificial Sequence: Synthetic oligonucleotide
gguggaaauccagggaug

SEQ ID NO: 27502 - RNA, 18 nt, Artificial Sequence
  Description of Artificial Sequence: Synthetic oligonucleotide
cuccugguggaaauccag

SEQ ID NO: 27503 - RNA, 18 nt, Artificial Sequence
  Description of Artificial Sequence: Synthetic oligonucleotide
aguaacuccugguggaaa

SEQ ID NO: 27504 - RNA, 18 nt, Artificial Sequence
  Description of Artificial Sequence: Synthetic oligonucleotide
aggaaaguaacuccuggu

SEQ ID NO: 27505 - RNA, 18 nt, Artificial Sequence
  Description of Artificial Sequence: Synthetic oligonucleotide
ucaggaggaaaguaacuc

SEQ ID NO: 27506 - RNA, 18 nt, Artificial Sequence
  Description of Artificial Sequence: Synthetic oligonucleotide
acaggucaggaggaaagu

SEQ ID NO: 27507 - RNA, 18 nt, Artificial Sequence
  Description of Artificial Sequence: Synthetic oligonucleotide
aauuuacaggucaggagg

SEQ ID NO: 27508 - RNA, 18 nt, Artificial Sequence
  Description of Artificial Sequence: Synthetic oligonucleotide
gaacaaauuuacagguca

SEQ ID NO: 27509 - RNA, 18 nt, Artificial Sequence
  Description of Artificial Sequence: Synthetic oligonucleotide
uuaaagaacaaauuuaca

SEQ ID NO: 27510 - RNA, 18 nt, Artificial Sequence
  Description of Artificial Sequence: Synthetic oligonucleotide
cauuguuaaagaacaaau

SEQ ID NO: 27511 - RNA, 18 nt, Artificial Sequence
  Description of Artificial Sequence: Synthetic oligonucleotide
gcagccauuguuaaagaa

SEQ ID NO: 27512 - RNA, 18 nt, Artificial Sequence
  Description of Artificial Sequence: Synthetic oligonucleotide
caccugcagccauuguua

SEQ ID NO: 27513 - RNA, 18 nt, Artificial Sequence
  Description of Artificial Sequence: Synthetic oligonucleotide
gcucccaccugcagccau

SEQ ID NO: 27514 - RNA, 18 nt, Artificial Sequence
  Description of Artificial Sequence: Synthetic oligonucleotide
cauaugcucccaccugca

SEQ ID NO: 27515 - RNA, 18 nt, Artificial Sequence
  Description of Artificial Sequence: Synthetic oligonucleotide
accaccauaugcucccac

SEQ ID NO: 27516 - RNA, 18 nt, Artificial Sequence
  Description of Artificial Sequence: Synthetic oligonucleotide
uauaaaccaccauaugcu

SEQ ID NO: 27517 - RNA, 18 nt, Artificial Sequence
  Description of Artificial Sequence: Synthetic oligonucleotide
guuuuuauaaaccaccau

SEQ ID NO: 27518 - RNA, 18 nt, Artificial Sequence
  Description of Artificial Sequence: Synthetic oligonucleotide
acagcguuuuuauaaacc

SEQ ID NO: 27519 - RNA, 18 nt, Artificial Sequence
  Description of Artificial Sequence: Synthetic oligonucleotide
gcccgacagcguuuuuau

SEQ ID NO: 27520 - RNA, 18 nt, Artificial Sequence
  Description of Artificial Sequence: Synthetic oligonucleotide
acaaagcccgacagcguu

SEQ ID NO: 27521 - RNA, 18 nt, Artificial Sequence
  Description of Artificial Sequence: Synthetic oligonucleotide
aggaaacaaagcccgaca

SEQ ID NO: 27522 - RNA, 18 nt, Artificial Sequence
  Description of Artificial Sequence: Synthetic oligonucleotide
aaagaaggaaacaaagcc

SEQ ID NO: 27523 - RNA, 18 nt, Artificial Sequence
  Description of Artificial Sequence: Synthetic oligonucleotide
cagcuaaagaaggaaaca

SEQ ID NO: 27524 - RNA, 18 nt, Artificial Sequence
  Description of Artificial Sequence: Synthetic oligonucleotide
cacggcagcuaaagaagg

SEQ ID NO: 27525 - RNA, 18 nt, Artificial Sequence
  Description of Artificial Sequence: Synthetic oligonucleotide
guagacacggcagcuaaa

SEQ ID NO: 27526 - RNA, 18 nt, Artificial Sequence
  Description of Artificial Sequence: Synthetic oligonucleotide
cagaaguagacacggcag

SEQ ID NO: 27527 - RNA, 18 nt, Artificial Sequence
  Description of Artificial Sequence: Synthetic oligonucleotide
gacuucagaaguagacac

SEQ ID NO: 27528 - RNA, 18 nt, Artificial Sequence
  Description of Artificial Sequence: Synthetic oligonucleotide
ucccagacuucagaagua

SEQ ID NO: 27529 - RNA, 18 nt, Artificial Sequence
  Description of Artificial Sequence: Synthetic oligonucleotide
gcacuucccagacuucag

SEQ ID NO: 27530 - RNA, 18 nt, Artificial Sequence
  Description of Artificial Sequence: Synthetic oligonucleotide
gcuuggcacuucccagac

SEQ ID NO: 27531 - RNA, 18 nt, Artificial Sequence
  Description of Artificial Sequence: Synthetic oligonucleotide
gcguggcuuggcacuucc

SEQ ID NO: 27532 - RNA, 18 nt, Artificial Sequence
  Description of Artificial Sequence: Synthetic oligonucleotide
aggccgcguggcuuggca

SEQ ID NO: 27533 - RNA, 18 nt, Artificial Sequence
  Description of Artificial Sequence: Synthetic oligonucleotide
ccuugaggccgcguggcu

SEQ ID NO: 27534 - RNA, 18 nt, Artificial Sequence
  Description of Artificial Sequence: Synthetic oligonucleotide
agcucccuugaggccgcg

SEQ ID NO: 27535 - RNA, 18 nt, Artificial Sequence
  Description of Artificial Sequence: Synthetic oligonucleotide
cagccagcucccuugagg

SEQ ID NO: 27536 - RNA, 18 nt, Artificial Sequence
  Description of Artificial Sequence: Synthetic oligonucleotide
aacaccagccagcucccu

SEQ ID NO: 27537 - RNA, 18 nt, Artificial Sequence
  Description of Artificial Sequence: Synthetic oligonucleotide
gcucaaacaccagccagc

SEQ ID NO: 27538 - RNA, 18 nt, Artificial Sequence
  Description of Artificial Sequence: Synthetic oligonucleotide
ccacagcucaaacaccag

SEQ ID NO: 27539 - RNA, 18 nt, Artificial Sequence
  Description of Artificial Sequence: Synthetic oligonucleotide
uucugccacagcucaaac

SEQ ID NO: 27540 - RNA, 18 nt, Artificial Sequence
  Description of Artificial Sequence: Synthetic oligonucleotide
ggugcuucugccacagcu

SEQ ID NO: 27541 - RNA, 18 nt, Artificial Sequence
  Description of Artificial Sequence: Synthetic oligonucleotide
ccccaggugcuucugcca

SEQ ID NO: 27542 - RNA, 18 nt, Artificial Sequence
  Description of Artificial Sequence: Synthetic oligonucleotide
uggagccccaggugcuuc

SEQ ID NO: 27543 - RNA, 18 nt, Artificial Sequence
  Description of Artificial Sequence: Synthetic oligonucleotide
cucccuggagccccaggu

SEQ ID NO: 27544 - RNA, 18 nt, Artificial Sequence
  Description of Artificial Sequence: Synthetic oligonucleotide
gccugcucccuggagccc

SEQ ID NO: 27545 - RNA, 18 nt, Artificial Sequence
  Description of Artificial Sequence: Synthetic oligonucleotide
ucccagccugcucccugg

SEQ ID NO: 27546 - RNA, 18 nt, Artificial Sequence
  Description of Artificial Sequence: Synthetic oligonucleotide
gcaguucccagccugcuc

SEQ ID NO: 27547 - RNA, 18 nt, Artificial Sequence
  Description of Artificial Sequence: Synthetic oligonucleotide
guccugcaguucccagcc

SEQ ID NO: 27548 - RNA, 18 nt, Artificial Sequence
  Description of Artificial Sequence: Synthetic oligonucleotide
gcaagguccugcaguucc

SEQ ID NO: 27549 - RNA, 18 nt, Artificial Sequence
  Description of Artificial Sequence: Synthetic oligonucleotide
gcugagcaagguccugca

SEQ ID NO: 27550 - RNA, 18 nt, Artificial Sequence
  Description of Artificial Sequence: Synthetic oligonucleotide
uccuggcugagcaagguc

SEQ ID NO: 27551 - RNA, 18 nt, Artificial Sequence
  Description of Artificial Sequence: Synthetic oligonucleotide
agugcuccuggcugagca

SEQ ID NO: 27552 - RNA, 18 nt, Artificial Sequence
  Description of Artificial Sequence: Synthetic oligonucleotide
gggaagugcuccuggcug

SEQ ID NO: 27553 - RNA, 18 nt, Artificial Sequence
  Description of Artificial Sequence: Synthetic oligonucleotide
uuccugccucaaggaggg

SEQ ID NO: 27554 - RNA, 18 nt, Artificial Sequence
  Description of Artificial Sequence: Synthetic oligonucleotide
caguauuccugccucaag

SEQ ID NO: 27555 - RNA, 18 nt, Artificial Sequence
  Description of Artificial Sequence: Synthetic oligonucleotide
caccucaguauuccugcc

SEQ ID NO: 27556 - RNA, 18 nt, Artificial Sequence
  Description of Artificial Sequence: Synthetic oligonucleotide
ggaggcaccucaguauuc

SEQ ID NO: 27557 - RNA, 18 nt, Artificial Sequence
  Description of Artificial Sequence: Synthetic oligonucleotide
gggaggcaccucaguauu

SEQ ID NO: 27558 - RNA, 18 nt, Artificial Sequence
  Description of Artificial Sequence: Synthetic oligonucleotide
accuucuccaucuguggg

SEQ ID NO: 27559 - RNA, 18 nt, Artificial Sequence
  Description of Artificial Sequence: Synthetic oligonucleotide
ucuccaccuucuccaucu

SEQ ID NO: 27560 - RNA, 18 nt, Artificial Sequence
  Description of Artificial Sequence: Synthetic oligonucleotide
ccuccucuccaccuucuc

SEQ ID NO: 27561 - RNA, 18 nt, Artificial Sequence
  Description of Artificial Sequence: Synthetic oligonucleotide
cccauccuccucuccacc

SEQ ID NO: 27562 - RNA, 18 nt, Artificial Sequence
  Description of Artificial Sequence: Synthetic oligonucleotide
ugaggcccauccuccucu

SEQ ID NO: 27563 - RNA, 18 nt, Artificial Sequence
  Description of Artificial Sequence: Synthetic oligonucleotide
gcuccugaggcccauccu

SEQ ID NO: 27564 - RNA, 18 nt, Artificial Sequence
  Description of Artificial Sequence: Synthetic oligonucleotide
gagaugcuccugaggccc

SEQ ID NO: 27565 - RNA, 18 nt, Artificial Sequence
  Description of Artificial Sequence: Synthetic oligonucleotide
ggcuugagaugcuccuga

SEQ ID NO: 27566 - RNA, 18 nt, Artificial Sequence
  Description of Artificial Sequence: Synthetic oligonucleotide
gggcuugagaugcuccug

SEQ ID NO: 27567 - RNA, 18 nt, Artificial Sequence
  Description of Artificial Sequence: Synthetic oligonucleotide
cuuucuccugcuacuggg

SEQ ID NO: 27568 - RNA, 18 nt, Artificial Sequence
  Description of Artificial Sequence: Synthetic oligonucleotide
ucuuucuuucuccugcua

SEQ ID NO: 27569 - RNA, 18 nt, Artificial Sequence
  Description of Artificial Sequence: Synthetic oligonucleotide
cucuuucuuucuuucucc

SEQ ID NO: 27570 - RNA, 18 nt, Artificial Sequence
  Description of Artificial Sequence: Synthetic oligonucleotide
ggcaucucuuucuuucuu

SEQ ID NO: 27571 - RNA, 18 nt, Artificial Sequence
  Description of Artificial Sequence: Synthetic oligonucleotide
aaccaggcaucucuuucu

SEQ ID NO: 27572 - RNA, 18 nt, Artificial Sequence
  Description of Artificial Sequence: Synthetic oligonucleotide
gugaaaaccaggcaucuc

SEQ ID NO: 27573 - RNA, 18 nt, Artificial Sequence
  Description of Artificial Sequence: Synthetic oligonucleotide
agucugugaaaaccaggc

SEQ ID NO: 27574 - RNA, 18 nt, Artificial Sequence
  Description of Artificial Sequence: Synthetic oligonucleotide
gaaccagucugugaaaac

SEQ ID NO: 27575 - RNA, 18 nt, Artificial Sequence
  Description of Artificial Sequence: Synthetic oligonucleotide
cacaggaaccagucugug

SEQ ID NO: 27576 - RNA, 18 nt, Artificial Sequence
  Description of Artificial Sequence: Synthetic oligonucleotide
ccagccacaggaaccagu

SEQ ID NO: 27577 - RNA, 18 nt, Artificial Sequence
  Description of Artificial Sequence: Synthetic oligonucleotide
ucaucccagccacaggaa

SEQ ID NO: 27578 - RNA, 18 nt, Artificial Sequence
  Description of Artificial Sequence: Synthetic oligonucleotide
ugcagucaucccagccac

SEQ ID NO: 27579 - RNA, 18 nt, Artificial Sequence
  Description of Artificial Sequence: Synthetic oligonucleotide
aaggaugcagucauccca

SEQ ID NO: 27580 - RNA, 18 nt, Artificial Sequence
  Description of Artificial Sequence: Synthetic oligonucleotide
aaaaaaaggaugcaguca

SEQ ID NO: 27581 - RNA, 18 nt, Artificial Sequence
  Description of Artificial Sequence: Synthetic oligonucleotide
aaaaaaaaaaaaggaugc

SEQ ID NO: 27582 - RNA, 18 nt, Artificial Sequence
  Description of Artificial Sequence: Synthetic oligonucleotide
caaaaaaaaaaaaaaaag

SEQ ID NO: 27583 - RNA, 18 nt, Artificial Sequence
  Description of Artificial Sequence: Synthetic oligonucleotide
cgucucaaaaaaaaaaaa

SEQ ID NO: 27584 - RNA, 18 nt, Artificial Sequence
  Description of Artificial Sequence: Synthetic oligonucleotide
aacuccgucucaaaaaaa

SEQ ID NO: 27585 - RNA, 18 nt, Artificial Sequence
  Description of Artificial Sequence: Synthetic oligonucleotide
gcaaaaacuccgucucaa

SEQ ID NO: 27586 - RNA, 18 nt, Artificial Sequence
  Description of Artificial Sequence: Synthetic oligonucleotide
caaaggcaaaaacuccgu

SEQ ID NO: 27587 - RNA, 18 nt, Artificial Sequence
  Description of Artificial Sequence: Synthetic oligonucleotide
ggcgacaaaggcaaaaac

SEQ ID NO: 27588 - RNA, 18 nt, Artificial Sequence
  Description of Artificial Sequence: Synthetic oligonucleotide
gccugggcgacaaaggca

SEQ ID NO: 27589 - RNA, 18 nt, Artificial Sequence
  Description of Artificial Sequence: Synthetic oligonucleotide
cuccagccugggcgacaa

SEQ ID NO: 27590 - RNA, 18 nt, Artificial Sequence
  Description of Artificial Sequence: Synthetic oligonucleotide
uugcacuccagccugggc

SEQ ID NO: 27591 - RNA, 18 nt, Artificial Sequence
  Description of Artificial Sequence: Synthetic oligonucleotide
cgccauugcacuccagcc

SEQ ID NO: 27592 - RNA, 18 nt, Artificial Sequence
  Description of Artificial Sequence: Synthetic oligonucleotide
gaucacgccauugcacuc

SEQ ID NO: 27593 - RNA, 18 nt, Artificial Sequence
  Description of Artificial Sequence: Synthetic oligonucleotide
gccgagaucacgccauug

SEQ ID NO: 27594 - RNA, 18 nt, Artificial Sequence
  Description of Artificial Sequence: Synthetic oligonucleotide
ggugagccgagaucacgc

SEQ ID NO: 27595 - RNA, 18 nt, Artificial Sequence
  Description of Artificial Sequence: Synthetic oligonucleotide
guugcggugagccgagau

SEQ ID NO: 27596 - RNA, 18 nt, Artificial Sequence
  Description of Artificial Sequence: Synthetic oligonucleotide
cggagguugcggugagcc

SEQ ID NO: 27597 - RNA, 18 nt, Artificial Sequence
  Description of Artificial Sequence: Synthetic oligonucleotide
ggaggcggagguugcggu

SEQ ID NO: 27598 - RNA, 18 nt, Artificial Sequence
  Description of Artificial Sequence: Synthetic oligonucleotide
auccgggaggcggagguu

SEQ ID NO: 27599 - RNA, 18 nt, Artificial Sequence
  Description of Artificial Sequence: Synthetic oligonucleotide
cuugaauccgggaggcgg

SEQ ID NO: 27600 - RNA, 18 nt, Artificial Sequence
  Description of Artificial Sequence: Synthetic oligonucleotide
aauugcuugaauccggga

SEQ ID NO: 27601 - RNA, 18 nt, Artificial Sequence
  Description of Artificial Sequence: Synthetic oligonucleotide
aggagaauugcuugaauc

SEQ ID NO: 27602 - RNA, 18 nt, Artificial Sequence
  Description of Artificial Sequence: Synthetic oligonucleotide
gaggcaggagaauugcuu

SEQ ID NO: 27603 - RNA, 18 nt, Artificial Sequence
  Description of Artificial Sequence: Synthetic oligonucleotide
aggcugaggcaggagaau

SEQ ID NO: 27604 - RNA, 18 nt, Artificial Sequence
  Description of Artificial Sequence: Synthetic oligonucleotide
ucgggaggcugaggcagg

SEQ ID NO: 27605 - RNA, 18 nt, Artificial Sequence
  Description of Artificial Sequence: Synthetic oligonucleotide
gcuacucgggaggcugag

SEQ ID NO: 27606 - RNA, 18 nt, Artificial Sequence
  Description of Artificial Sequence: Synthetic oligonucleotide
ucccagcuacucgggagg

SEQ ID NO: 27607 - RNA, 18 nt, Artificial Sequence
  Description of Artificial Sequence: Synthetic oligonucleotide
uguaaucccagcuacucg

SEQ ID NO: 27608 - RNA, 18 nt, Artificial Sequence
  Description of Artificial Sequence: Synthetic oligonucleotide
gugccuguaaucccagcu

SEQ ID NO: 27609 - RNA, 18 nt, Artificial Sequence
  Description of Artificial Sequence: Synthetic oligonucleotide
ggugcgugccuguaaucc

SEQ ID NO: 27610 - RNA, 18 nt, Artificial Sequence
  Description of Artificial Sequence: Synthetic oligonucleotide
guggaggugcgugccugu

SEQ ID NO: 27611 - RNA, 18 nt, Artificial Sequence
  Description of Artificial Sequence: Synthetic oligonucleotide
cggacguggaggugcgug

SEQ ID NO: 27612 - RNA, 18 nt, Artificial Sequence
  Description of Artificial Sequence: Synthetic oligonucleotide
uuagccggacguggaggu

SEQ ID NO: 27613 - RNA, 18 nt, Artificial Sequence
  Description of Artificial Sequence: Synthetic oligonucleotide
caaaauuagccggacgug

SEQ ID NO: 27614 - RNA, 18 nt, Artificial Sequence
  Description of Artificial Sequence: Synthetic oligonucleotide
aaauacaaaauuagccgg

SEQ ID NO: 27615 - RNA, 18 nt, Artificial Sequence
  Description of Artificial Sequence: Synthetic oligonucleotide
acuaaaaauacaaaauua

SEQ ID NO: 27616 - RNA, 18 nt, Artificial Sequence
  Description of Artificial Sequence: Synthetic oligonucleotide
ucuccacuaaaaauacaa

SEQ ID NO: 27617 - RNA, 18 nt, Artificial Sequence
  Description of Artificial Sequence: Synthetic oligonucleotide
ccccgucuccacuaaaaa

SEQ ID NO: 27618 - RNA, 18 nt, Artificial Sequence
  Description of Artificial Sequence: Synthetic oligonucleotide
agaaaccccgucuccacu

SEQ ID NO: 27619 - RNA, 18 nt, Artificial Sequence
  Description of Artificial Sequence: Synthetic oligonucleotide
cauggagaaaccccgucu

SEQ ID NO: 27620 - RNA, 18 nt, Artificial Sequence
  Description of Artificial Sequence: Synthetic oligonucleotide
accgacauggagaaaccc

SEQ ID NO: 27621 - RNA, 18 nt, Artificial Sequence
  Description of Artificial Sequence: Synthetic oligonucleotide
gccugaccgacauggaga

SEQ ID NO: 27622 - RNA, 18 nt, Artificial Sequence
  Description of Artificial Sequence: Synthetic oligonucleotide
gaccagccugaccgacau

SEQ ID NO: 27623 - RNA, 18 nt, Artificial Sequence
  Description of Artificial Sequence: Synthetic oligonucleotide
uucgagaccagccugacc

SEQ ID NO: 27624 - RNA, 18 nt, Artificial Sequence
  Description of Artificial Sequence: Synthetic oligonucleotide
gggaguucgagaccagcc

SEQ ID NO: 27625 - RNA, 18 nt, Artificial Sequence
  Description of Artificial Sequence: Synthetic oligonucleotide
aggucgggaguucgagac

SEQ ID NO: 27626 - RNA, 18 nt, Artificial Sequence
  Description of Artificial Sequence: Synthetic oligonucleotide
accugaggucgggaguuc

SEQ ID NO: 27627 - RNA, 18 nt, Artificial Sequence
  Description of Artificial Sequence: Synthetic oligonucleotide
agaucaccugaggucggg

SEQ ID NO: 27628 - RNA, 18 nt, Artificial Sequence
  Description of Artificial Sequence: Synthetic oligonucleotide
ugggcagaucaccugagg

SEQ ID NO: 27629 - RNA, 18 nt, Artificial Sequence
  Description of Artificial Sequence: Synthetic oligonucleotide
cgaggugggcagaucacc

SEQ ID NO: 27630 - RNA, 18 nt, Artificial Sequence
  Description of Artificial Sequence: Synthetic oligonucleotide
gaggccgaggugggcaga

SEQ ID NO: 27631 - RNA, 18 nt, Artificial Sequence
  Description of Artificial Sequence: Synthetic oligonucleotide
uuugggaggccgaggugg

SEQ ID NO: 27632 - RNA, 18 nt, Artificial Sequence
  Description of Artificial Sequence: Synthetic oligonucleotide
agcacuuugggaggccga

SEQ ID NO: 27633 - RNA, 18 nt, Artificial Sequence
  Description of Artificial Sequence: Synthetic oligonucleotide
aucccagcacuuugggag

SEQ ID NO: 27634 - RNA, 18 nt, Artificial Sequence
  Description of Artificial Sequence: Synthetic oligonucleotide
cuguaaucccagcacuuu

SEQ ID NO: 27635 - RNA, 18 nt, Artificial Sequence
  Description of Artificial Sequence: Synthetic oligonucleotide
caugccuguaaucccagc

SEQ ID NO: 27636 - RNA, 18 nt, Artificial Sequence
  Description of Artificial Sequence: Synthetic oligonucleotide
uggcucaugccuguaauc

SEQ ID NO: 27637 - RNA, 18 nt, Artificial Sequence
  Description of Artificial Sequence: Synthetic oligonucleotide
cgcgguggcucaugccug

SEQ ID NO: 27638 - RNA, 18 nt, Artificial Sequence
  Description of Artificial Sequence: Synthetic oligonucleotide
ccaagcgcgguggcucau

SEQ ID NO: 27639 - RNA, 18 nt, Artificial Sequence
  Description of Artificial Sequence: Synthetic oligonucleotide
ucuggccaagcgcggugg

SEQ ID NO: 27640 - RNA, 18 nt, Artificial Sequence
  Description of Artificial Sequence: Synthetic oligonucleotide
cgcagucuggccaagcgc

SEQ ID NO: 27641 - RNA, 18 nt, Artificial Sequence
  Description of Artificial Sequence: Synthetic oligonucleotide
aaggacgcagucuggcca

SEQ ID NO: 27642 - RNA, 18 nt, Artificial Sequence
  Description of Artificial Sequence: Synthetic oligonucleotide
uuaaaaaggacgcagucu

SEQ ID NO: 27643 - RNA, 18 nt, Artificial Sequence
  Description of Artificial Sequence: Synthetic oligonucleotide
uucgcuuaaaaaggacgc

SEQ ID NO: 27644 - RNA, 18 nt, Artificial Sequence
  Description of Artificial Sequence: Synthetic oligonucleotide
aaauguucgcuuaaaaag

SEQ ID NO: 27645 - RNA, 18 nt, Artificial Sequence
  Description of Artificial Sequence: Synthetic oligonucleotide
cccuaaaauguucgcuua

SEQ ID NO: 27646 - RNA, 18 nt, Artificial Sequence
  Description of Artificial Sequence: Synthetic oligonucleotide
ccaggcccuaaaauguuc

SEQ ID NO: 27647 - RNA, 18 nt, Artificial Sequence
  Description of Artificial Sequence: Synthetic oligonucleotide
aacucccaggcccuaaaa

SEQ ID NO: 27648 - RNA, 18 nt, Artificial Sequence
  Description of Artificial Sequence: Synthetic oligonucleotide
ugacaaacucccaggccc

SEQ ID NO: 27649 - RNA, 18 nt, Artificial Sequence
  Description of Artificial Sequence: Synthetic oligonucleotide
uuacuugacaaacuccca

SEQ ID NO: 27650 - RNA, 18 nt, Artificial Sequence
  Description of Artificial Sequence: Synthetic oligonucleotide
cuuccuuacuugacaaac

SEQ ID NO: 27651 - RNA, 18 nt, Artificial Sequence
  Description of Artificial Sequence: Synthetic oligonucleotide
ugagacuuccuuacuuga

SEQ ID NO: 27652 - RNA, 18 nt, Artificial Sequence
  Description of Artificial Sequence: Synthetic oligonucleotide
gggcuugagacuuccuua

SEQ ID NO: 27653 - RNA, 18 nt, Artificial Sequence
  Description of Artificial Sequence: Synthetic oligonucleotide
ucuuugggcuugagacuu

SEQ ID NO: 27654 - RNA, 18 nt, Artificial Sequence
  Description of Artificial Sequence: Synthetic oligonucleotide
gcugcucuuugggcuuga

SEQ ID NO: 27655 - RNA, 18 nt, Artificial Sequence
  Description of Artificial Sequence: Synthetic oligonucleotide
aggacgcugcucuuuggg

SEQ ID NO: 27656 - RNA, 18 nt, Artificial Sequence
  Description of Artificial Sequence: Synthetic oligonucleotide
uggucaggacgcugcucu

SEQ ID NO: 27657 - RNA, 18 nt, Artificial Sequence
  Description of Artificial Sequence: Synthetic oligonucleotide
caccauggucaggacgcu

SEQ ID NO: 27658 - RNA, 18 nt, Artificial Sequence
  Description of Artificial Sequence: Synthetic oligonucleotide
gaaaccaccauggucagg

SEQ ID NO: 27659 - RNA, 18 nt, Artificial Sequence
  Description of Artificial Sequence: Synthetic oligonucleotide
guaaugaaaccaccaugg

SEQ ID NO: 27660 - RNA, 18 nt, Artificial Sequence
  Description of Artificial Sequence: Synthetic oligonucleotide
ggcucguaaugaaaccac

SEQ ID NO: 27661 - RNA, 18 nt, Artificial Sequence
  Description of Artificial Sequence: Synthetic oligonucleotide
agaagggcucguaaugaa

SEQ ID NO: 27662 - RNA, 18 nt, Artificial Sequence
  Description of Artificial Sequence: Synthetic oligonucleotide
ccagcagaagggcucgua

SEQ ID NO: 27663 - RNA, 18 nt, Artificial Sequence
  Description of Artificial Sequence: Synthetic oligonucleotide
gagagccagcagaagggc

SEQ ID NO: 27664 - RNA, 18 nt, Artificial Sequence
  Description of Artificial Sequence: Synthetic oligonucleotide
ugccugagagccagcaga

SEQ ID NO: 27665 - RNA, 18 nt, Artificial Sequence
  Description of Artificial Sequence: Synthetic oligonucleotide
gcuucugccugagagcca

SEQ ID NO: 27666 - RNA, 18 nt, Artificial Sequence
  Description of Artificial Sequence: Synthetic oligonucleotide
gggcuucugccugagagc

SEQ ID NO: 27667 - RNA, 18 nt, Artificial Sequence
  Description of Artificial Sequence: Synthetic oligonucleotide
uggucccggugcuguggg

SEQ ID NO: 27668 - RNA, 18 nt, Artificial Sequence
  Description of Artificial Sequence: Synthetic oligonucleotide
augaauggucccggugcu

SEQ ID NO: 27669 - RNA, 18 nt, Artificial Sequence
  Description of Artificial Sequence: Synthetic oligonucleotide
accucaugaauggucccg

SEQ ID NO: 27670 - RNA, 18 nt, Artificial Sequence
  Description of Artificial Sequence: Synthetic oligonucleotide
cagugaccucaugaaugg

SEQ ID NO: 27671 - RNA, 18 nt, Artificial Sequence
  Description of Artificial Sequence: Synthetic oligonucleotide
cugggcagugaccucaug

SEQ ID NO: 27672 - RNA, 18 nt, Artificial Sequence
  Description of Artificial Sequence: Synthetic oligonucleotide
augagcugggcagugacc

SEQ ID NO: 27673 - RNA, 18 nt, Artificial Sequence
  Description of Artificial Sequence: Synthetic oligonucleotide
acaucaugagcugggcag

SEQ ID NO: 27674 - RNA, 18 nt, Artificial Sequence
  Description of Artificial Sequence: Synthetic oligonucleotide
cacggacaucaugagcug

SEQ ID NO: 27675 - RNA, 18 nt, Artificial Sequence
  Description of Artificial Sequence: Synthetic oligonucleotide
agccucacggacaucaug

SEQ ID NO: 27676 - RNA, 18 nt, Artificial Sequence
  Description of Artificial Sequence: Synthetic oligonucleotide
aggacagccucacggaca

SEQ ID NO: 27677 - RNA, 18 nt, Artificial Sequence
  Description of Artificial Sequence: Synthetic oligonucleotide
ccaaaaggacagccucac

SEQ ID NO: 27678 - RNA, 18 nt, Artificial Sequence
  Description of Artificial Sequence: Synthetic oligonucleotide
acuggccaaaaggacagc

SEQ ID NO: 27679 - RNA, 18 nt, Artificial Sequence
  Description of Artificial Sequence: Synthetic oligonucleotide
cggcuacuggccaaaagg

SEQ ID NO: 27680 - RNA, 18 nt, Artificial Sequence
  Description of Artificial Sequence: Synthetic oligonucleotide
gcacacggcuacuggcca

SEQ ID NO: 27681 - RNA, 18 nt, Artificial Sequence
  Description of Artificial Sequence: Synthetic oligonucleotide
cagcugcacacggcuacu

SEQ ID NO: 27682 - RNA, 18 nt, Artificial Sequence
  Description of Artificial Sequence: Synthetic oligonucleotide
ccacacagcugcacacgg

SEQ ID NO: 27683 - RNA, 18 nt, Artificial Sequence
  Description of Artificial Sequence: Synthetic oligonucleotide
cugugccacacagcugca

SEQ ID NO: 27684 - RNA, 18 nt, Artificial Sequence
  Description of Artificial Sequence: Synthetic oligonucleotide
gccaucugugccacacag

SEQ ID NO: 27685 - RNA, 18 nt, Artificial Sequence
  Description of Artificial Sequence: Synthetic oligonucleotide
acgaagccaucugugcca

SEQ ID NO: 27686 - RNA, 18 nt, Artificial Sequence
  Description of Artificial Sequence: Synthetic oligonucleotide
gaugaacgaagccaucug

SEQ ID NO: 27687 - RNA, 18 nt, Artificial Sequence
  Description of Artificial Sequence: Synthetic oligonucleotide
aucaggaugaacgaagcc

SEQ ID NO: 27688 - RNA, 18 nt, Artificial Sequence
  Description of Artificial Sequence: Synthetic oligonucleotide
ccuugaucaggaugaacg

SEQ ID NO: 27689 - RNA, 18 nt, Artificial Sequence
  Description of Artificial Sequence: Synthetic oligonucleotide
gggccuugaucaggauga

SEQ ID NO: 27690 - RNA, 18 nt, Artificial Sequence
  Description of Artificial Sequence: Synthetic oligonucleotide
ugcuguggcugagguggg

SEQ ID NO: 27691 - RNA, 18 nt, Artificial Sequence
  Description of Artificial Sequence: Synthetic oligonucleotide
gggacugcuguggcugag

SEQ ID NO: 27692 - RNA, 18 nt, Artificial Sequence
  Description of Artificial Sequence: Synthetic oligonucleotide
gguggacaacacagguug

SEQ ID NO: 27693 - RNA, 18 nt, Artificial Sequence
  Description of Artificial Sequence: Synthetic oligonucleotide
aauaggguggacaacaca

SEQ ID NO: 27694 - RNA, 18 nt, Artificial Sequence
  Description of Artificial Sequence: Synthetic oligonucleotide
ugaauaauaggguggaca

SEQ ID NO: 27695 - RNA, 18 nt, Artificial Sequence
  Description of Artificial Sequence: Synthetic oligonucleotide
guacaugaauaauagggu

SEQ ID NO: 27696 - RNA, 18 nt, Artificial Sequence
  Description of Artificial Sequence: Synthetic oligonucleotide
ggcagguacaugaauaau

SEQ ID NO: 27697 - RNA, 18 nt, Artificial Sequence
  Description of Artificial Sequence: Synthetic oligonucleotide
ggccuggcagguacauga

SEQ ID NO: 27698 - RNA, 18 nt, Artificial Sequence
  Description of Artificial Sequence: Synthetic oligonucleotide
agcagggccuggcaggua

SEQ ID NO: 27699 - RNA, 18 nt, Artificial Sequence
  Description of Artificial Sequence: Synthetic oligonucleotide
uaucuagcagggccuggc

SEQ ID NO: 27700 - RNA, 18 nt, Artificial Sequence
  Description of Artificial Sequence: Synthetic oligonucleotide
ggugcuaucuagcagggc

SEQ ID NO: 27701 - RNA, 18 nt, Artificial Sequence
  Description of Artificial Sequence: Synthetic oligonucleotide
gggugcuaucuagcaggg

SEQ ID NO: 27702 - RNA, 18 nt, Artificial Sequence
  Description of Artificial Sequence: Synthetic oligonucleotide
guuauguaaugccacggg

SEQ ID NO: 27703 - RNA, 18 nt, Artificial Sequence
  Description of Artificial Sequence: Synthetic oligonucleotide
gaaguguuauguaaugcc

SEQ ID NO: 27704 - RNA, 18 nt, Artificial Sequence
  Description of Artificial Sequence: Synthetic oligonucleotide
cucaugaaguguuaugua

SEQ ID NO: 27705 - RNA, 18 nt, Artificial Sequence
  Description of Artificial Sequence: Synthetic oligonucleotide
agccacucaugaaguguu

SEQ ID NO: 27706 - RNA, 18 nt, Artificial Sequence
  Description of Artificial Sequence: Synthetic oligonucleotide
gacacagccacucaugaa

SEQ ID NO: 27707 - RNA, 18 nt, Artificial Sequence
  Description of Artificial Sequence: Synthetic oligonucleotide
uacaagacacagccacuc

SEQ ID NO: 27708 - RNA, 18 nt, Artificial Sequence
  Description of Artificial Sequence: Synthetic oligonucleotide
aaaauuacaagacacagc

SEQ ID NO: 27709 - RNA, 18 nt, Artificial Sequence
  Description of Artificial Sequence: Synthetic oligonucleotide
uccccaaaauuacaagac

SEQ ID NO: 27710 - RNA, 18 nt, Artificial Sequence
  Description of Artificial Sequence: Synthetic oligonucleotide
accuguccccaaaauuac

SEQ ID NO: 27711 - RNA, 18 nt, Artificial Sequence
  Description of Artificial Sequence: Synthetic oligonucleotide
gagaaaccuguccccaaa

SEQ ID NO: 27712 - RNA, 18 nt, Artificial Sequence
  Description of Artificial Sequence: Synthetic oligonucleotide
aaagagagaaaccugucc

SEQ ID NO: 27713 - RNA, 18 nt, Artificial Sequence
  Description of Artificial Sequence: Synthetic oligonucleotide
gagggaaagagagaaacc

SEQ ID NO: 27714 - RNA, 18 nt, Artificial Sequence
  Description of Artificial Sequence: Synthetic oligonucleotide
aaagagagggaaagagag

SEQ ID NO: 27715 - RNA, 18 nt, Artificial Sequence
  Description of Artificial Sequence: Synthetic oligonucleotide
aaaaaaaagagagggaaa

SEQ ID NO: 27716 - RNA, 18 nt, Artificial Sequence
  Description of Artificial Sequence: Synthetic oligonucleotide
uugacaaaaaaaagagag

SEQ ID NO: 27717 - RNA, 18 nt, Artificial Sequence
  Description of Artificial Sequence: Synthetic oligonucleotide
ggcuuuugacaaaaaaaa

SEQ ID NO: 27718 - RNA, 18 nt, Artificial Sequence
  Description of Artificial Sequence: Synthetic oligonucleotide
cucugggcuuuugacaaa

SEQ ID NO: 27719 - RNA, 18 nt, Artificial Sequence
  Description of Artificial Sequence: Synthetic oligonucleotide
ucagucucugggcuuuug

SEQ ID NO: 27720 - RNA, 18 nt, Artificial Sequence
  Description of Artificial Sequence: Synthetic oligonucleotide
gguugucagucucugggc

SEQ ID NO: 27721 - RNA, 18 nt, Artificial Sequence
  Description of Artificial Sequence: Synthetic oligonucleotide
cagcugguugucagucuc

SEQ ID NO: 27722 - RNA, 18 nt, Artificial Sequence
  Description of Artificial Sequence: Synthetic oligonucleotide
cacugcagcugguuguca

SEQ ID NO: 27723 - RNA, 18 nt, Artificial Sequence
  Description of Artificial Sequence: Synthetic oligonucleotide
uuagacacugcagcuggu

SEQ ID NO: 27724 - RNA, 18 nt, Artificial Sequence
  Description of Artificial Sequence: Synthetic oligonucleotide
aacacuuagacacugcag

SEQ ID NO: 27725 - RNA, 18 nt, Artificial Sequence
  Description of Artificial Sequence: Synthetic oligonucleotide
ugaggaacacuuagacac

SEQ ID NO: 27726 - RNA, 18 nt, Artificial Sequence
  Description of Artificial Sequence: Synthetic oligonucleotide
gucagugaggaacacuua

SEQ ID NO: 27727 - RNA, 18 nt, Artificial Sequence
  Description of Artificial Sequence: Synthetic oligonucleotide
acccugucagugaggaac

SEQ ID NO: 27728 - RNA, 18 nt, Artificial Sequence
  Description of Artificial Sequence: Synthetic oligonucleotide
gccccacccugucaguga

SEQ ID NO: 27729 - RNA, 18 nt, Artificial Sequence
  Description of Artificial Sequence: Synthetic oligonucleotide
gugaggccccacccuguc

SEQ ID NO: 27730 - RNA, 18 nt, Artificial Sequence
  Description of Artificial Sequence: Synthetic oligonucleotide
ggguggugaggccccacc

SEQ ID NO: 27731 - RNA, 18 nt, Artificial Sequence
  Description of Artificial Sequence: Synthetic oligonucleotide
gccaacgcugcucccucc

SEQ ID NO: 27732 - RNA, 18 nt, Artificial Sequence
  Description of Artificial Sequence: Synthetic oligonucleotide
ucccugccaacgcugcuc

SEQ ID NO: 27733 - RNA, 18 nt, Artificial Sequence
  Description of Artificial Sequence: Synthetic oligonucleotide
cugucucccugccaacgc

SEQ ID NO: 27734 - RNA, 18 nt, Artificial Sequence
  Description of Artificial Sequence: Synthetic oligonucleotide
ccaggcugucucccugcc

SEQ ID NO: 27735 - RNA, 18 nt, Artificial Sequence
  Description of Artificial Sequence: Synthetic oligonucleotide
cugggccaggcugucucc

SEQ ID NO: 27736 - RNA, 18 nt, Artificial Sequence
  Description of Artificial Sequence: Synthetic oligonucleotide
ggucacugggccaggcug

SEQ ID NO: 27737 - RNA, 18 nt, Artificial Sequence
  Description of Artificial Sequence: Synthetic oligonucleotide
cccagggucacugggcca

SEQ ID NO: 27738 - RNA, 18 nt, Artificial Sequence
  Description of Artificial Sequence: Synthetic oligonucleotide
uugggcccagggucacug

SEQ ID NO: 27739 - RNA, 18 nt, Artificial Sequence
  Description of Artificial Sequence: Synthetic oligonucleotide
cuggcuugggcccagggu

SEQ ID NO: 27740 - RNA, 18 nt, Artificial Sequence
  Description of Artificial Sequence: Synthetic oligonucleotide
gggcuggcuugggcccag

SEQ ID NO: 27741 - RNA, 18 nt, Artificial Sequence
  Description of Artificial Sequence: Synthetic oligonucleotide
ccugaaagcccuggaggg

SEQ ID NO: 27742 - RNA, 18 nt, Artificial Sequence
  Description of Artificial Sequence: Synthetic oligonucleotide
gcuucccugaaagcccug

SEQ ID NO: 27743 - RNA, 18 nt, Artificial Sequence
  Description of Artificial Sequence: Synthetic oligonucleotide
auggcgcuucccugaaag

SEQ ID NO: 27744 - RNA, 18 nt, Artificial Sequence
  Description of Artificial Sequence: Synthetic oligonucleotide
aauggauggcgcuucccu

SEQ ID NO: 27745 - RNA, 18 nt, Artificial Sequence
  Description of Artificial Sequence: Synthetic oligonucleotide
uugaaaauggauggcgcu

SEQ ID NO: 27746 - RNA, 18 nt, Artificial Sequence
  Description of Artificial Sequence: Synthetic oligonucleotide
caucuuugaaaauggaug

SEQ ID NO: 27747 - RNA, 18 nt, Artificial Sequence
  Description of Artificial Sequence: Synthetic oligonucleotide
uuugacaucuuugaaaau

SEQ ID NO: 27748 - RNA, 18 nt, Artificial Sequence
  Description of Artificial Sequence: Synthetic oligonucleotide
ugacguuugacaucuuug

SEQ ID NO: 27749 - RNA, 18 nt, Artificial Sequence
  Description of Artificial Sequence: Synthetic oligonucleotide
agaagugacguuugacau

SEQ ID NO: 27750 - RNA, 18 nt, Artificial Sequence
  Description of Artificial Sequence: Synthetic oligonucleotide
caggaagaagugacguuu

SEQ ID NO: 27751 - RNA, 18 nt, Artificial Sequence
  Description of Artificial Sequence: Synthetic oligonucleotide
cccuacaggaagaaguga

SEQ ID NO: 27752 - RNA, 18 nt, Artificial Sequence
  Description of Artificial Sequence: Synthetic oligonucleotide
ucgggcccuacaggaaga

SEQ ID NO: 27753 - RNA, 18 nt, Artificial Sequence
  Description of Artificial Sequence: Synthetic oligonucleotide
aggacucgggcccuacag

SEQ ID NO: 27754 - RNA, 18 nt, Artificial Sequence
  Description of Artificial Sequence: Synthetic oligonucleotide
gaggcaggacucgggccc

SEQ ID NO: 27755 - RNA, 18 nt, Artificial Sequence
  Description of Artificial Sequence: Synthetic oligonucleotide
gauaggaggcaggacucg

SEQ ID NO: 27756 - RNA, 18 nt, Artificial Sequence
  Description of Artificial Sequence: Synthetic oligonucleotide
gcccugauaggaggcagg

SEQ ID NO: 27757 - RNA, 18 nt, Artificial Sequence
  Description of Artificial Sequence: Synthetic oligonucleotide
aucuggcccugauaggag

SEQ ID NO: 27758 - RNA, 18 nt, Artificial Sequence
  Description of Artificial Sequence: Synthetic oligonucleotide
cuaugaucuggcccugau

SEQ ID NO: 27759 - RNA, 18 nt, Artificial Sequence
  Description of Artificial Sequence: Synthetic oligonucleotide
gccuucuaugaucuggcc

SEQ ID NO: 27760 - RNA, 18 nt, Artificial Sequence
  Description of Artificial Sequence: Synthetic oligonucleotide
aaauagccuucuaugauc

SEQ ID NO: 27761 - RNA, 18 nt, Artificial Sequence
  Description of Artificial Sequence: Synthetic oligonucleotide
auagaaaauagccuucua

SEQ ID NO: 27762 - RNA, 18 nt, Artificial Sequence
  Description of Artificial Sequence: Synthetic oligonucleotide
ccagaauagaaaauagcc

SEQ ID NO: 27763 - RNA, 18 nt, Artificial Sequence
  Description of Artificial Sequence: Synthetic oligonucleotide
guuccccagaauagaaaa

SEQ ID NO: 27764 - RNA, 18 nt, Artificial Sequence
  Description of Artificial Sequence: Synthetic oligonucleotide
uaaucguuccccagaaua

SEQ ID NO: 27765 - RNA, 18 nt, Artificial Sequence
  Description of Artificial Sequence: Synthetic oligonucleotide
aguuauaaucguucccca

SEQ ID NO: 27766 - RNA, 18 nt, Artificial Sequence
  Description of Artificial Sequence: Synthetic oligonucleotide
auuuaaguuauaaucguu

SEQ ID NO: 27767 - RNA, 18 nt, Artificial Sequence
  Description of Artificial Sequence: Synthetic oligonucleotide
caaucauuuaaguuauaa

SEQ ID NO: 27768 - RNA, 18 nt, Artificial Sequence
  Description of Artificial Sequence: Synthetic oligonucleotide
uaaaacaaucauuuaagu

SEQ ID NO: 27769 - RNA, 18 nt, Artificial Sequence
  Description of Artificial Sequence: Synthetic oligonucleotide
uuuauuaaaacaaucauu

SEQ ID NO: 27770 - RNA, 18 nt, Artificial Sequence
  Description of Artificial Sequence: Synthetic oligonucleotide
gaauuuuuauuaaaacaa

SEQ ID NO: 27771 - RNA, 18 nt, Artificial Sequence
  Description of Artificial Sequence: Synthetic oligonucleotide
gcuuagaauuuuuauuaa

SEQ ID NO: 27772 - RNA, 18 nt, Artificial Sequence
  Description of Artificial Sequence: Synthetic oligonucleotide
uuccagcuuagaauuuuu

SEQ ID NO: 27773 - RNA, 18 nt, Artificial Sequence
  Description of Artificial Sequence: Synthetic oligonucleotide
gucuucugccuugggcuu

SEQ ID NO: 27774 - RNA, 18 nt, Artificial Sequence
  Description of Artificial Sequence: Synthetic oligonucleotide
gauaggucuucugccuug

SEQ ID NO: 27775 - RNA, 18 nt, Artificial Sequence
  Description of Artificial Sequence: Synthetic oligonucleotide
augcagauaggucuucug

SEQ ID NO: 27776 - RNA, 18 nt, Artificial Sequence
  Description of Artificial Sequence: Synthetic oligonucleotide
cucaaaugcagauagguc

SEQ ID NO: 27777 - RNA, 18 nt, Artificial Sequence
  Description of Artificial Sequence: Synthetic oligonucleotide
gagggcucaaaugcagau

SEQ ID NO: 27778 - RNA, 18 nt, Artificial Sequence
  Description of Artificial Sequence: Synthetic oligonucleotide
gagaguaccugggaacaa

SEQ ID NO: 27779 - RNA, 18 nt, Artificial Sequence
  Description of Artificial Sequence: Synthetic oligonucleotide
acauagagaguaccuggg

SEQ ID NO: 27780 - RNA, 18 nt, Artificial Sequence
  Description of Artificial Sequence: Synthetic oligonucleotide
ucaccacauagagaguac

SEQ ID NO: 27781 - RNA, 18 nt, Artificial Sequence
  Description of Artificial Sequence: Synthetic oligonucleotide
caccaucaccacauagag

SEQ ID NO: 27782 - RNA, 18 nt, Artificial Sequence
  Description of Artificial Sequence: Synthetic oligonucleotide
ggcagcaccaucaccaca

SEQ ID NO: 27783 - RNA, 18 nt, Artificial Sequence
  Description of Artificial Sequence: Synthetic oligonucleotide
cagagggcagcaccauca

SEQ ID NO: 27784 - RNA, 18 nt, Artificial Sequence
  Description of Artificial Sequence: Synthetic oligonucleotide
uaucacagagggcagcac

SEQ ID NO: 27785 - RNA, 18 nt, Artificial Sequence
  Description of Artificial Sequence: Synthetic oligonucleotide
guuaguaucacagagggc

SEQ ID NO: 27786 - RNA, 18 nt, Artificial Sequence
  Description of Artificial Sequence: Synthetic oligonucleotide
cacggguuaguaucacag

SEQ ID NO: 27787 - RNA, 18 nt, Artificial Sequence
  Description of Artificial Sequence: Synthetic oligonucleotide
ucaugcacggguuaguau

SEQ ID NO: 27788 - RNA, 18 nt, Artificial Sequence
  Description of Artificial Sequence: Synthetic oligonucleotide
caagcucaugcacggguu

SEQ ID NO: 27789 - RNA, 18 nt, Artificial Sequence
  Description of Artificial Sequence: Synthetic oligonucleotide
acaggcaagcucaugcac

SEQ ID NO: 27790 - RNA, 18 nt, Artificial Sequence
  Description of Artificial Sequence: Synthetic oligonucleotide
cagagacaggcaagcuca

SEQ ID NO: 27791 - RNA, 18 nt, Artificial Sequence
  Description of Artificial Sequence: Synthetic oligonucleotide
gaggacagagacaggcaa

SEQ ID NO: 27792 - RNA, 18 nt, Artificial Sequence
  Description of Artificial Sequence: Synthetic oligonucleotide
ggcccgaggacagagaca

SEQ ID NO: 27793 - RNA, 18 nt, Artificial Sequence
  Description of Artificial Sequence: Synthetic oligonucleotide
aguguggcccgaggacag

SEQ ID NO: 27794 - RNA, 18 nt, Artificial Sequence
  Description of Artificial Sequence: Synthetic oligonucleotide
ggcucaguguggcccgag

SEQ ID NO: 27795 - RNA, 18 nt, Artificial Sequence
  Description of Artificial Sequence: Synthetic oligonucleotide
guaagggcucaguguggc

SEQ ID NO: 27796 - RNA, 18 nt, Artificial Sequence
  Description of Artificial Sequence: Synthetic oligonucleotide
cccucguaagggcucagu

SEQ ID NO: 27797 - RNA, 18 nt, Artificial Sequence
  Description of Artificial Sequence: Synthetic oligonucleotide
accugcccucguaagggc

SEQ ID NO: 27798 - RNA, 18 nt, Artificial Sequence
  Description of Artificial Sequence: Synthetic oligonucleotide
gcaccaccugcccucgua

SEQ ID NO: 27799 - RNA, 18 nt, Artificial Sequence
  Description of Artificial Sequence: Synthetic oligonucleotide
cccaggcaccaccugccc

SEQ ID NO: 27800 - RNA, 18 nt, Artificial Sequence
  Description of Artificial Sequence: Synthetic oligonucleotide
caguacccaggcaccacc

SEQ ID NO: 27801 - RNA, 18 nt, Artificial Sequence
  Description of Artificial Sequence: Synthetic oligonucleotide
gcggccaguacccaggca

SEQ ID NO: 27802 - RNA, 18 nt, Artificial Sequence
  Description of Artificial Sequence: Synthetic oligonucleotide
augcugcggccaguaccc

SEQ ID NO: 27803 - RNA, 18 nt, Artificial Sequence
  Description of Artificial Sequence: Synthetic oligonucleotide
aaagcaugcugcggccag

SEQ ID NO: 27804 - RNA, 18 nt, Artificial Sequence
  Description of Artificial Sequence: Synthetic oligonucleotide
gacucaaagcaugcugcg

SEQ ID NO: 27805 - RNA, 18 nt, Artificial Sequence
  Description of Artificial Sequence: Synthetic oligonucleotide
uuuuagacucaaagcaug

SEQ ID NO: 27806 - RNA, 18 nt, Artificial Sequence
  Description of Artificial Sequence: Synthetic oligonucleotide
ccuacuuuuagacucaaa

SEQ ID NO: 27807 - RNA, 18 nt, Artificial Sequence
  Description of Artificial Sequence: Synthetic oligonucleotide
gggugccuacuuuuagac

SEQ ID NO: 27808 - RNA, 18 nt, Artificial Sequence
  Description of Artificial Sequence: Synthetic oligonucleotide
agggugggugccuacuuu

SEQ ID NO: 27809 - RNA, 18 nt, Artificial Sequence
  Description of Artificial Sequence: Synthetic oligonucleotide
uucacagggugggugccu

SEQ ID NO: 27810 - RNA, 18 nt, Artificial Sequence
  Description of Artificial Sequence: Synthetic oligonucleotide
cuggcuucacaggguggg

SEQ ID NO: 27811 - RNA, 18 nt, Artificial Sequence
  Description of Artificial Sequence: Synthetic oligonucleotide
cuggucuggcuucacagg

SEQ ID NO: 27812 - RNA, 18 nt, Artificial Sequence
  Description of Artificial Sequence: Synthetic oligonucleotide
ggaggcuggucuggcuuc

SEQ ID NO: 27813 - RNA, 18 nt, Artificial Sequence
  Description of Artificial Sequence: Synthetic oligonucleotide
gcccuggaggcuggucug

SEQ ID NO: 27814 - RNA, 18 nt, Artificial Sequence
  Description of Artificial Sequence: Synthetic oligonucleotide
gggcccuggaggcugguc

SEQ ID NO: 27815 - RNA, 18 nt, Artificial Sequence
  Description of Artificial Sequence: Synthetic oligonucleotide
acgaggcagucuucuggg

SEQ ID NO: 27816 - RNA, 18 nt, Artificial Sequence
  Description of Artificial Sequence: Synthetic oligonucleotide
ucggaacgaggcagucuu

SEQ ID NO: 27817 - RNA, 18 nt, Artificial Sequence
  Description of Artificial Sequence: Synthetic oligonucleotide
gcucuucggaacgaggca

SEQ ID NO: 27818 - RNA, 18 nt, Artificial Sequence
  Description of Artificial Sequence: Synthetic oligonucleotide
gacaugcucuucggaacg

SEQ ID NO: 27819 - RNA, 18 nt, Artificial Sequence
  Description of Artificial Sequence: Synthetic oligonucleotide
cccaugacaugcucuucg

SEQ ID NO: 27820 - RNA, 18 nt, Artificial Sequence
  Description of Artificial Sequence: Synthetic oligonucleotide
acagccccaugacaugcu

SEQ ID NO: 27821 - RNA, 18 nt, Artificial Sequence
  Description of Artificial Sequence: Synthetic oligonucleotide
guccuacagccccaugac

SEQ ID NO: 27822 - RNA, 18 nt, Artificial Sequence
  Description of Artificial Sequence: Synthetic oligonucleotide
ggcugguccuacagcccc

SEQ ID NO: 27823 - RNA, 18 nt, Artificial Sequence
  Description of Artificial Sequence: Synthetic oligonucleotide
agaauggcugguccuaca

SEQ ID NO: 27824 - RNA, 18 nt, Artificial Sequence
  Description of Artificial Sequence: Synthetic oligonucleotide
ugggaagaauggcugguc

SEQ ID NO: 27825 - RNA, 18 nt, Artificial Sequence
  Description of Artificial Sequence: Synthetic oligonucleotide
cgagaugggaagaauggc

SEQ ID NO: 27826 - RNA, 18 nt, Artificial Sequence
  Description of Artificial Sequence: Synthetic oligonucleotide
ugacccgagaugggaaga

SEQ ID NO: 27827 - RNA, 18 nt, Artificial Sequence
  Description of Artificial Sequence: Synthetic oligonucleotide
aacaaugacccgagaugg

SEQ ID NO: 27828 - RNA, 18 nt, Artificial Sequence
  Description of Artificial Sequence: Synthetic oligonucleotide
agcccaacaaugacccga

SEQ ID NO: 27829 - RNA, 18 nt, Artificial Sequence
  Description of Artificial Sequence: Synthetic oligonucleotide
uccccagcccaacaauga

SEQ ID NO: 27830 - RNA, 18 nt, Artificial Sequence
  Description of Artificial Sequence: Synthetic oligonucleotide
aaccuuccccagcccaac

SEQ ID NO: 27831 - RNA, 18 nt, Artificial Sequence
  Description of Artificial Sequence: Synthetic oligonucleotide
gccauaaccuuccccagc

SEQ ID NO: 27832 - RNA, 18 nt, Artificial Sequence
  Description of Artificial Sequence: Synthetic oligonucleotide
aagaagccauaaccuucc

SEQ ID NO: 27833 - RNA, 18 nt, Artificial Sequence
  Description of Artificial Sequence: Synthetic oligonucleotide
uggacaagaagccauaac

SEQ ID NO: 27834 - RNA, 18 nt, Artificial Sequence
  Description of Artificial Sequence: Synthetic oligonucleotide
cugacuggacaagaagcc

SEQ ID NO: 27835 - RNA, 18 nt, Artificial Sequence
  Description of Artificial Sequence: Synthetic oligonucleotide
cacaccugacuggacaag

SEQ ID NO: 27836 - RNA, 18 nt, Artificial Sequence
  Description of Artificial Sequence: Synthetic oligonucleotide
uuagacacaccugacugg

SEQ ID NO: 27837 - RNA, 18 nt, Artificial Sequence
  Description of Artificial Sequence: Synthetic oligonucleotide
gacuuuuagacacaccug

SEQ ID NO: 27838 - RNA, 18 nt, Artificial Sequence
  Description of Artificial Sequence: Synthetic oligonucleotide
caaaggacuuuuagacac

SEQ ID NO: 27839 - RNA, 18 nt, Artificial Sequence
  Description of Artificial Sequence: Synthetic oligonucleotide
caagacaaaggacuuuua

SEQ ID NO: 27840 - RNA, 18 nt, Artificial Sequence
  Description of Artificial Sequence: Synthetic oligonucleotide
gccaccaagacaaaggac

SEQ ID NO: 27841 - RNA, 18 nt, Artificial Sequence
  Description of Artificial Sequence: Synthetic oligonucleotide
aguaugccaccaagacaa

SEQ ID NO: 27842 - RNA, 18 nt, Artificial Sequence
  Description of Artificial Sequence: Synthetic oligonucleotide
cuaggaguaugccaccaa

SEQ ID NO: 27843 - RNA, 18 nt, Artificial Sequence
  Description of Artificial Sequence: Synthetic oligonucleotide
ccaugcuaggaguaugcc

SEQ ID NO: 27844 - RNA, 18 nt, Artificial Sequence
  Description of Artificial Sequence: Synthetic oligonucleotide
cauuuccaugcuaggagu

SEQ ID NO: 27845 - RNA, 18 nt, Artificial Sequence
  Description of Artificial Sequence: Synthetic oligonucleotide
gaccccauuuccaugcua

SEQ ID NO: 27846 - RNA, 18 nt, Artificial Sequence
  Description of Artificial Sequence: Synthetic oligonucleotide
agauugaccccauuucca

SEQ ID NO: 27847 - RNA, 18 nt, Artificial Sequence
  Description of Artificial Sequence: Synthetic oligonucleotide
ugcccagauugaccccau

SEQ ID NO: 27848 - RNA, 18 nt, Artificial Sequence
  Description of Artificial Sequence: Synthetic oligonucleotide
caaagugcccagauugac

SEQ ID NO: 27849 - RNA, 18 nt, Artificial Sequence
  Description of Artificial Sequence: Synthetic oligonucleotide
gucuccaaagugcccaga

SEQ ID NO: 27850 - RNA, 18 nt, Artificial Sequence
  Description of Artificial Sequence: Synthetic oligonucleotide
caccagucuccaaagugc

SEQ ID NO: 27851 - RNA, 18 nt, Artificial Sequence
  Description of Artificial Sequence: Synthetic oligonucleotide
aaacacaccagucuccaa

SEQ ID NO: 27852 - RNA, 18 nt, Artificial Sequence
  Description of Artificial Sequence: Synthetic oligonucleotide
gaguuaaacacaccaguc

SEQ ID NO: 27853 - RNA, 18 nt, Artificial Sequence
  Description of Artificial Sequence: Synthetic oligonucleotide
aucuugaguuaaacacac

SEQ ID NO: 27854 - RNA, 18 nt, Artificial Sequence
  Description of Artificial Sequence: Synthetic oligonucleotide
ucuugaucuugaguuaaa

SEQ ID NO: 27855 - RNA, 18 nt, Artificial Sequence
  Description of Artificial Sequence: Synthetic oligonucleotide
aaaggucuugaucuugag

SEQ ID NO: 27856 - RNA, 18 nt, Artificial Sequence
  Description of Artificial Sequence: Synthetic oligonucleotide
gcauaaaaggucuugauc

SEQ ID NO: 27857 - RNA, 18 nt, Artificial Sequence
  Description of Artificial Sequence: Synthetic oligonucleotide
ucaacgcauaaaaggucu

SEQ ID NO: 27858 - RNA, 18 nt, Artificial Sequence
  Description of Artificial Sequence: Synthetic oligonucleotide
ggcugucaacgcauaaaa

SEQ ID NO: 27859 - RNA, 18 nt, Artificial Sequence
  Description of Artificial Sequence: Synthetic oligonucleotide
ugagaggcugucaacgca

SEQ ID NO: 27860 - RNA, 18 nt, Artificial Sequence
  Description of Artificial Sequence: Synthetic oligonucleotide
ggucuugagaggcuguca

SEQ ID NO: 27861 - RNA, 18 nt, Artificial Sequence
  Description of Artificial Sequence: Synthetic oligonucleotide
ccaugggucuugagaggc

SEQ ID NO: 27862 - RNA, 18 nt, Artificial Sequence
  Description of Artificial Sequence: Synthetic oligonucleotide
ugugaccaugggucuuga

SEQ ID NO: 27863 - RNA, 18 nt, Artificial Sequence
  Description of Artificial Sequence: Synthetic oligonucleotide
ccaggugugaccaugggu

SEQ ID NO: 27864 - RNA, 18 nt, Artificial Sequence
  Description of Artificial Sequence: Synthetic oligonucleotide
agcugccaggugugacca

SEQ ID NO: 27865 - RNA, 18 nt, Artificial Sequence
  Description of Artificial Sequence: Synthetic oligonucleotide
ccagaagcugccaggugu

SEQ ID NO: 27866 - RNA, 18 nt, Artificial Sequence
  Description of Artificial Sequence: Synthetic oligonucleotide
cacuaccagaagcugcca

SEQ ID NO: 27867 - RNA, 18 nt, Artificial Sequence
  Description of Artificial Sequence: Synthetic oligonucleotide
ugccccacuaccagaagc

SEQ ID NO: 27868 - RNA, 18 nt, Artificial Sequence
  Description of Artificial Sequence: Synthetic oligonucleotide
ccuuuugccccacuacca

SEQ ID NO: 27869 - RNA, 18 nt, Artificial Sequence
  Description of Artificial Sequence: Synthetic oligonucleotide
gcaacccuuuugccccac

SEQ ID NO: 27870 - RNA, 18 nt, Artificial Sequence
  Description of Artificial Sequence: Synthetic oligonucleotide
cacaagcaacccuuuugc

SEQ ID NO: 27871 - RNA, 18 nt, Artificial Sequence
  Description of Artificial Sequence: Synthetic oligonucleotide
gccagcacaagcaacccu

SEQ ID NO: 27872 - RNA, 18 nt, Artificial Sequence
  Description of Artificial Sequence: Synthetic oligonucleotide
aaugagccagcacaagca

SEQ ID NO: 27873 - RNA, 18 nt, Artificial Sequence
  Description of Artificial Sequence: Synthetic oligonucleotide
aggaaaaugagccagcac

SEQ ID NO: 27874 - RNA, 18 nt, Artificial Sequence
  Description of Artificial Sequence: Synthetic oligonucleotide
ucuaaaggaaaaugagcc

SEQ ID NO: 27875 - RNA, 18 nt, Artificial Sequence
  Description of Artificial Sequence: Synthetic oligonucleotide
aaagcucuaaaggaaaau

SEQ ID NO: 27876 - RNA, 18 nt, Artificial Sequence
  Description of Artificial Sequence: Synthetic oligonucleotide
uuaccccuucuacuccug

SEQ ID NO: 27877 - RNA, 18 nt, Artificial Sequence
  Description of Artificial Sequence: Synthetic oligonucleotide
agaguuuaccccuucuac

SEQ ID NO: 27878 - RNA, 18 nt, Artificial Sequence
  Description of Artificial Sequence: Synthetic oligonucleotide
gaggaagaguuuaccccu

SEQ ID NO: 27879 - RNA, 18 nt, Artificial Sequence
  Description of Artificial Sequence: Synthetic oligonucleotide
cagaugaggaagaguuua

SEQ ID NO: 27880 - RNA, 18 nt, Artificial Sequence
  Description of Artificial Sequence: Synthetic oligonucleotide
uguggcagaugaggaaga

SEQ ID NO: 27881 - RNA, 18 nt, Artificial Sequence
  Description of Artificial Sequence: Synthetic oligonucleotide
aggccuguggcagaugag

SEQ ID NO: 27882 - RNA, 18 nt, Artificial Sequence
  Description of Artificial Sequence: Synthetic oligonucleotide
aaggcaggccuguggcag

SEQ ID NO: 27883 - RNA, 18 nt, Artificial Sequence
  Description of Artificial Sequence: Synthetic oligonucleotide
gaggcaaggcaggccugu

SEQ ID NO: 27884 - RNA, 18 nt, Artificial Sequence
  Description of Artificial Sequence: Synthetic oligonucleotide
ggccugaggcaaggcagg

SEQ ID NO: 27885 - RNA, 18 nt, Artificial Sequence
  Description of Artificial Sequence: Synthetic oligonucleotide
gacguggccugaggcaag

SEQ ID NO: 27886 - RNA, 18 nt, Artificial Sequence
  Description of Artificial Sequence: Synthetic oligonucleotide
aaggugacguggccugag

SEQ ID NO: 27887 - RNA, 18 nt, Artificial Sequence
  Description of Artificial Sequence: Synthetic oligonucleotide
ccuggcaacauggcuggg

SEQ ID NO: 27888 - RNA, 18 nt, Artificial Sequence
  Description of Artificial Sequence: Synthetic oligonucleotide
caugcccuggcaacaugg

SEQ ID NO: 27889 - RNA, 18 nt, Artificial Sequence
  Description of Artificial Sequence: Synthetic oligonucleotide
guccucaugcccuggcaa

SEQ ID NO: 27890 - RNA, 18 nt, Artificial Sequence
  Description of Artificial Sequence: Synthetic oligonucleotide
ucuuaguccucaugcccu

SEQ ID NO: 27891 - RNA, 18 nt, Artificial Sequence
  Description of Artificial Sequence: Synthetic oligonucleotide
aagcaucuuaguccucau

SEQ ID NO: 27892 - RNA, 18 nt, Artificial Sequence
  Description of Artificial Sequence: Synthetic oligonucleotide
agggcaagcaucuuaguc

SEQ ID NO: 27893 - RNA, 18 nt, Artificial Sequence
  Description of Artificial Sequence: Synthetic oligonucleotide
uuggcagggcaagcaucu

SEQ ID NO: 27894 - RNA, 18 nt, Artificial Sequence
  Description of Artificial Sequence: Synthetic oligonucleotide
cgggcuuggcagggcaag

SEQ ID NO: 27895 - RNA, 18 nt, Artificial Sequence
  Description of Artificial Sequence: Synthetic oligonucleotide
cccuccgggcuuggcagg

SEQ ID NO: 27896 - RNA, 18 nt, Artificial Sequence
  Description of Artificial Sequence: Synthetic oligonucleotide
ucauccccuccgggcuug

SEQ ID NO: 27897 - RNA, 18 nt, Artificial Sequence
  Description of Artificial Sequence: Synthetic oligonucleotide
gcugcucauccccuccgg

SEQ ID NO: 27898 - RNA, 18 nt, Artificial Sequence
  Description of Artificial Sequence: Synthetic oligonucleotide
cugaggcugcucaucccc

SEQ ID NO: 27899 - RNA, 18 nt, Artificial Sequence
  Description of Artificial Sequence: Synthetic oligonucleotide
accagcugaggcugcuca

SEQ ID NO: 27900 - RNA, 18 nt, Artificial Sequence
  Description of Artificial Sequence: Synthetic oligonucleotide
gcggcaccagcugaggcu

SEQ ID NO: 27901 - RNA, 18 nt, Artificial Sequence
  Description of Artificial Sequence: Synthetic oligonucleotide
cuguggcggcaccagcug

SEQ ID NO: 27902 - RNA, 18 nt, Artificial Sequence
  Description of Artificial Sequence: Synthetic oligonucleotide
gcugucuguggcggcacc

SEQ ID NO: 27903 - RNA, 18 nt, Artificial Sequence
  Description of Artificial Sequence: Synthetic oligonucleotide
ggugugcugucuguggcg

SEQ ID NO: 27904 - RNA, 18 nt, Artificial Sequence
  Description of Artificial Sequence: Synthetic oligonucleotide
ucuguggugugcugucug

SEQ ID NO: 27905 - RNA, 18 nt, Artificial Sequence
  Description of Artificial Sequence: Synthetic oligonucleotide
ccaccucuguggugugcu

SEQ ID NO: 27906 - RNA, 18 nt, Artificial Sequence
  Description of Artificial Sequence: Synthetic oligonucleotide
cugagccaccucuguggu

SEQ ID NO: 27907 - RNA, 18 nt, Artificial Sequence
  Description of Artificial Sequence: Synthetic oligonucleotide
ggucccugagccaccucu

SEQ ID NO: 27908 - RNA, 18 nt, Artificial Sequence
  Description of Artificial Sequence: Synthetic oligonucleotide
accaaggucccugagcca

SEQ ID NO: 27909 - RNA, 18 nt, Artificial Sequence
  Description of Artificial Sequence: Synthetic oligonucleotide
caucuaccaaggucccug

SEQ ID NO: 27910 - RNA, 18 nt, Artificial Sequence
  Description of Artificial Sequence: Synthetic oligonucleotide
auucccaucuaccaaggu

SEQ ID NO: 27911 - RNA, 18 nt, Artificial Sequence
  Description of Artificial Sequence: Synthetic oligonucleotide
cucacauucccaucuacc

SEQ ID NO: 27912 - RNA, 18 nt, Artificial Sequence
  Description of Artificial Sequence: Synthetic oligonucleotide
agauucucacauucccau

SEQ ID NO: 27913 - RNA, 18 nt, Artificial Sequence
  Description of Artificial Sequence: Synthetic oligonucleotide
uuaauagauucucacauu

SEQ ID NO: 27914 - RNA, 18 nt, Artificial Sequence
  Description of Artificial Sequence: Synthetic oligonucleotide
cuauuuuaauagauucuc

SEQ ID NO: 27915 - RNA, 18 nt, Artificial Sequence
  Description of Artificial Sequence: Synthetic oligonucleotide
ccugccuauuuuaauaga

SEQ ID NO: 27916 - RNA, 18 nt, Artificial Sequence
  Description of Artificial Sequence: Synthetic oligonucleotide
agaucccugccuauuuua

SEQ ID NO: 27917 - RNA, 18 nt, Artificial Sequence
  Description of Artificial Sequence: Synthetic oligonucleotide
accggagaucccugccua

SEQ ID NO: 27918 - RNA, 18 nt, Artificial Sequence
  Description of Artificial Sequence: Synthetic oligonucleotide
agaggaccggagaucccu

SEQ ID NO: 27919 - RNA, 18 nt, Artificial Sequence
  Description of Artificial Sequence: Synthetic oligonucleotide
uugacagaggaccggaga

SEQ ID NO: 27920 - RNA, 18 nt, Artificial Sequence
  Description of Artificial Sequence: Synthetic oligonucleotide
gccucuugacagaggacc

SEQ ID NO: 27921 - RNA, 18 nt, Artificial Sequence
  Description of Artificial Sequence: Synthetic oligonucleotide
gcauugccucuugacaga

SEQ ID NO: 27922 - RNA, 18 nt, Artificial Sequence
  Description of Artificial Sequence: Synthetic oligonucleotide
cgucagcauugccucuug

SEQ ID NO: 27923 - RNA, 18 nt, Artificial Sequence
  Description of Artificial Sequence: Synthetic oligonucleotide
aaagccgucagcauugcc

SEQ ID NO: 27924 - RNA, 18 nt, Artificial Sequence
  Description of Artificial Sequence: Synthetic oligonucleotide
aggaaaaagccgucagca

SEQ ID NO: 27925 - RNA, 18 nt, Artificial Sequence
  Description of Artificial Sequence: Synthetic oligonucleotide
ccagcaggaaaaagccgu

SEQ ID NO: 27926 - RNA, 18 nt, Artificial Sequence
  Description of Artificial Sequence: Synthetic oligonucleotide
gcacgccagcaggaaaaa

SEQ ID NO: 27927 - RNA, 18 nt, Artificial Sequence
  Description of Artificial Sequence: Synthetic oligonucleotide
cagaggcacgccagcagg

SEQ ID NO: 27928 - RNA, 18 nt, Artificial Sequence
  Description of Artificial Sequence: Synthetic oligonucleotide
gugggcagaggcacgcca

SEQ ID NO: 27929 - RNA, 18 nt, Artificial Sequence
  Description of Artificial Sequence: Synthetic oligonucleotide
ggcuggugggcagaggca

SEQ ID NO: 27930 - RNA, 18 nt, Artificial Sequence
  Description of Artificial Sequence: Synthetic oligonucleotide
gggaaggcuggugggcag

SEQ ID NO: 27931 - RNA, 18 nt, Artificial Sequence
  Description of Artificial Sequence: Synthetic oligonucleotide
aaugaggaugugcaaggg

SEQ ID NO: 27932 - RNA, 18 nt, Artificial Sequence
  Description of Artificial Sequence: Synthetic oligonucleotide
acaaaugaggaugugcaa

SEQ ID NO: 27933 - RNA, 18 nt, Artificial Sequence
  Description of Artificial Sequence: Synthetic oligonucleotide
aggugacaaaugaggaug

SEQ ID NO: 27934 - RNA, 18 nt, Artificial Sequence
  Description of Artificial Sequence: Synthetic oligonucleotide
uuaggaggugacaaauga

SEQ ID NO: 27935 - RNA, 18 nt, Artificial Sequence
  Description of Artificial Sequence: Synthetic oligonucleotide
ucaaauuaggaggugaca

SEQ ID NO: 27936 - RNA, 18 nt, Artificial Sequence
  Description of Artificial Sequence: Synthetic oligonucleotide
auaauucaaauuaggagg

SEQ ID NO: 27937 - RNA, 18 nt, Artificial Sequence
  Description of Artificial Sequence: Synthetic oligonucleotide
gcccaauaauucaaauua

SEQ ID NO: 27938 - RNA, 18 nt, Artificial Sequence
  Description of Artificial Sequence: Synthetic oligonucleotide
gauuugcccaauaauuca

SEQ ID NO: 27939 - RNA, 18 nt, Artificial Sequence
  Description of Artificial Sequence: Synthetic oligonucleotide
ggccagauuugcccaaua

SEQ ID NO: 27940 - RNA, 18 nt, Artificial Sequence
  Description of Artificial Sequence: Synthetic oligonucleotide
uaagcggccagauuugcc

SEQ ID NO: 27941 - RNA, 18 nt, Artificial Sequence
  Description of Artificial Sequence: Synthetic oligonucleotide
ccaaauaagcggccagau

SEQ ID NO: 27942 - RNA, 18 nt, Artificial Sequence
  Description of Artificial Sequence: Synthetic oligonucleotide
cagucccaaauaagcggc

SEQ ID NO: 27943 - RNA, 18 nt, Artificial Sequence
  Description of Artificial Sequence: Synthetic oligonucleotide
gcugucagucccaaauaa

SEQ ID NO: 27944 - RNA, 18 nt, Artificial Sequence
  Description of Artificial Sequence: Synthetic oligonucleotide
aguuggcugucaguccca

SEQ ID NO: 27945 - RNA, 18 nt, Artificial Sequence
  Description of Artificial Sequence: Synthetic oligonucleotide
caagaaguuggcugucag

SEQ ID NO: 27946 - RNA, 18 nt, Artificial Sequence
  Description of Artificial Sequence: Synthetic oligonucleotide
augcucaagaaguuggcu

SEQ ID NO: 27947 - RNA, 18 nt, Artificial Sequence
  Description of Artificial Sequence: Synthetic oligonucleotide
aauagaugcucaagaagu

SEQ ID NO: 27948 - RNA, 18 nt, Artificial Sequence
  Description of Artificial Sequence: Synthetic oligonucleotide
guucaaauagaugcucaa

SEQ ID NO: 27949 - RNA, 18 nt, Artificial Sequence
  Description of Artificial Sequence: Synthetic oligonucleotide
aggcuguucaaauagaug

SEQ ID NO: 27950 - RNA, 18 nt, Artificial Sequence
  Description of Artificial Sequence: Synthetic oligonucleotide
agggaaggcuguucaaau

SEQ ID NO: 27951 - RNA, 18 nt, Artificial Sequence
  Description of Artificial Sequence: Synthetic oligonucleotide
gcgaaagggaaggcuguu

SEQ ID NO: 27952 - RNA, 18 nt, Artificial Sequence
  Description of Artificial Sequence: Synthetic oligonucleotide
ugggagcgaaagggaagg

SEQ ID NO: 27953 - RNA, 18 nt, Artificial Sequence
  Description of Artificial Sequence: Synthetic oligonucleotide
guggcugggagcgaaagg

SEQ ID NO: 27954 - RNA, 18 nt, Artificial Sequence
  Description of Artificial Sequence: Synthetic oligonucleotide
caaagguggcugggagcg

SEQ ID NO: 27955 - RNA, 18 nt, Artificial Sequence
  Description of Artificial Sequence: Synthetic oligonucleotide
caccucaaagguggcugg

SEQ ID NO: 27956 - RNA, 18 nt, Artificial Sequence
  Description of Artificial Sequence: Synthetic oligonucleotide
ggacucaccucaaaggug

SEQ ID NO: 27957 - RNA, 18 nt, Artificial Sequence
  Description of Artificial Sequence: Synthetic oligonucleotide
cacuuggacucaccucaa

SEQ ID NO: 27958 - RNA, 18 nt, Artificial Sequence
  Description of Artificial Sequence: Synthetic oligonucleotide
ccugccacuuggacucac

SEQ ID NO: 27959 - RNA, 18 nt, Artificial Sequence
  Description of Artificial Sequence: Synthetic oligonucleotide
ccuguccugccacuugga

SEQ ID NO: 27960 - RNA, 18 nt, Artificial Sequence
  Description of Artificial Sequence: Synthetic oligonucleotide
aggguccuguccugccac

SEQ ID NO: 27961 - RNA, 18 nt, Artificial Sequence
  Description of Artificial Sequence: Synthetic oligonucleotide
cacacaggguccuguccu

SEQ ID NO: 27962 - RNA, 18 nt, Artificial Sequence
  Description of Artificial Sequence: Synthetic oligonucleotide
ucugucacacaggguccu

SEQ ID NO: 27963 - RNA, 18 nt, Artificial Sequence
  Description of Artificial Sequence: Synthetic oligonucleotide
uccgcucugucacacagg

SEQ ID NO: 27964 - RNA, 18 nt, Artificial Sequence
  Description of Artificial Sequence: Synthetic oligonucleotide
agaccuccgcucugucac

SEQ ID NO: 27965 - RNA, 18 nt, Artificial Sequence
  Description of Artificial Sequence: Synthetic oligonucleotide
gcacaagaccuccgcucu

SEQ ID NO: 27966 - RNA, 18 nt, Artificial Sequence
  Description of Artificial Sequence: Synthetic oligonucleotide
agagggcacaagaccucc

SEQ ID NO: 27967 - RNA, 18 nt, Artificial Sequence
  Description of Artificial Sequence: Synthetic oligonucleotide
agcugagagggcacaaga

SEQ ID NO: 27968 - RNA, 18 nt, Artificial Sequence
  Description of Artificial Sequence: Synthetic oligonucleotide
gaagaagcugagagggca

SEQ ID NO: 27969 - RNA, 18 nt, Artificial Sequence
  Description of Artificial Sequence: Synthetic oligonucleotide
uggcgcucugcaagguga

SEQ ID NO: 27970 - RNA, 18 nt, Artificial Sequence
  Description of Artificial Sequence: Synthetic oligonucleotide
ggacuuggcgcucugcaa

SEQ ID NO: 27971 - RNA, 18 nt, Artificial Sequence
  Description of Artificial Sequence: Synthetic oligonucleotide
acucgggacuuggcgcuc

SEQ ID NO: 27972 - RNA, 18 nt, Artificial Sequence
  Description of Artificial Sequence: Synthetic oligonucleotide
aggccacucgggacuugg

SEQ ID NO: 27973 - RNA, 18 nt, Artificial Sequence
  Description of Artificial Sequence: Synthetic oligonucleotide
aaagaaggccacucggga

SEQ ID NO: 27974 - RNA, 18 nt, Artificial Sequence
  Description of Artificial Sequence: Synthetic oligonucleotide
ucuucaaagaaggccacu

SEQ ID NO: 27975 - RNA, 18 nt, Artificial Sequence
  Description of Artificial Sequence: Synthetic oligonucleotide
agagcucuucaaagaagg

SEQ ID NO: 27976 - RNA, 18 nt, Artificial Sequence
  Description of Artificial Sequence: Synthetic oligonucleotide
cugcuagagcucuucaaa

SEQ ID NO: 27977 - RNA, 18 nt, Artificial Sequence
  Description of Artificial Sequence: Synthetic oligonucleotide
gucaccugcuagagcucu

SEQ ID NO: 27978 - RNA, 18 nt, Artificial Sequence
  Description of Artificial Sequence: Synthetic oligonucleotide
gcugggucaccugcuaga

SEQ ID NO: 27979 - RNA, 18 nt, Artificial Sequence
  Description of Artificial Sequence: Synthetic oligonucleotide
ggguggcugggucaccug

SEQ ID NO: 27980 - RNA, 18 nt, Artificial Sequence
  Description of Artificial Sequence: Synthetic oligonucleotide
aggagaaguggcaggucc

SEQ ID NO: 27981 - RNA, 18 nt, Artificial Sequence
  Description of Artificial Sequence: Synthetic oligonucleotide
guagcaggagaaguggca

SEQ ID NO: 27982 - RNA, 18 nt, Artificial Sequence
  Description of Artificial Sequence: Synthetic oligonucleotide
ucccgguagcaggagaag

SEQ ID NO: 27983 - RNA, 18 nt, Artificial Sequence
  Description of Artificial Sequence: Synthetic oligonucleotide
cgcggucccgguagcagg

SEQ ID NO: 27984 - RNA, 18 nt, Artificial Sequence
  Description of Artificial Sequence: Synthetic oligonucleotide
caucccgcggucccggua

SEQ ID NO: 27985 - RNA, 18 nt, Artificial Sequence
  Description of Artificial Sequence: Synthetic oligonucleotide
ugguccaucccgcggucc

SEQ ID NO: 27986 - RNA, 18 nt, Artificial Sequence
  Description of Artificial Sequence: Synthetic oligonucleotide
auaucugguccaucccgc

SEQ ID NO: 27987 - RNA, 18 nt, Artificial Sequence
  Description of Artificial Sequence: Synthetic oligonucleotide
ucuugauaucugguccau

SEQ ID NO: 27988 - RNA, 18 nt, Artificial Sequence
  Description of Artificial Sequence: Synthetic oligonucleotide
ggcucucuugauaucugg

SEQ ID NO: 27989 - RNA, 18 nt, Artificial Sequence
  Description of Artificial Sequence: Synthetic oligonucleotide
uggauggcucucuugaua

SEQ ID NO: 27990 - RNA, 18 nt, Artificial Sequence
  Description of Artificial Sequence: Synthetic oligonucleotide
cccuauggauggcucucu

SEQ ID NO: 27991 - RNA, 18 nt, Artificial Sequence
  Description of Artificial Sequence: Synthetic oligonucleotide
cagcucccuauggauggc

SEQ ID NO: 27992 - RNA, 18 nt, Artificial Sequence
  Description of Artificial Sequence: Synthetic oligonucleotide
ccagccagcucccuaugg

SEQ ID NO: 27993 - RNA, 18 nt, Artificial Sequence
  Description of Artificial Sequence: Synthetic oligonucleotide
aacccccagccagcuccc

SEQ ID NO: 27994 - RNA, 18 nt, Artificial Sequence
  Description of Artificial Sequence: Synthetic oligonucleotide
acggaaacccccagccag

SEQ ID NO: 27995 - RNA, 18 nt, Artificial Sequence
  Description of Artificial Sequence: Synthetic oligonucleotide
cucccacggaaaccccca

SEQ ID NO: 27996 - RNA, 18 nt, Artificial Sequence
  Description of Artificial Sequence: Synthetic oligonucleotide
uggagcucccacggaaac

SEQ ID NO: 27997 - RNA, 18 nt, Artificial Sequence
  Description of Artificial Sequence: Synthetic oligonucleotide
aguucuggagcucccacg

SEQ ID NO: 27998 - RNA, 18 nt, Artificial Sequence
  Description of Artificial Sequence: Synthetic oligonucleotide
gggaaaguucuggagcuc

SEQ ID NO: 27999 - RNA, 18 nt, Artificial Sequence
  Description of Artificial Sequence: Synthetic oligonucleotide
cugggcucuucacucagc

SEQ ID NO: 28000 - RNA, 18 nt, Artificial Sequence
  Description of Artificial Sequence: Synthetic oligonucleotide
gggcugggcucuucacuc

SEQ ID NO: 28001 - RNA, 18 nt, Artificial Sequence
  Description of Artificial Sequence: Synthetic oligonucleotide
caauugcacauaagaggg

SEQ ID NO: 28002 - RNA, 18 nt, Artificial Sequence
  Description of Artificial Sequence: Synthetic oligonucleotide
caaggcaauugcacauaa

SEQ ID NO: 28003 - RNA, 18 nt, Artificial Sequence
  Description of Artificial Sequence: Synthetic oligonucleotide
uaguucaaggcaauugca

SEQ ID NO: 28004 - RNA, 18 nt, Artificial Sequence
  Description of Artificial Sequence: Synthetic oligonucleotide
ggucguaguucaaggcaa

SEQ ID NO: 28005 - RNA, 18 nt, Artificial Sequence
  Description of Artificial Sequence: Synthetic oligonucleotide
uacagggucguaguucaa

SEQ ID NO: 28006 - RNA, 18 nt, Artificial Sequence
  Description of Artificial Sequence: Synthetic oligonucleotide
aucucuacagggucguag

SEQ ID NO: 28007 - RNA, 18 nt, Artificial Sequence
  Description of Artificial Sequence: Synthetic oligonucleotide
gagaaaucucuacagggu

SEQ ID NO: 28008 - RNA, 18 nt, Artificial Sequence
  Description of Artificial Sequence: Synthetic oligonucleotide
caugagagaaaucucuac

SEQ ID NO: 28009 - RNA, 18 nt, Artificial Sequence
  Description of Artificial Sequence: Synthetic oligonucleotide
aacgccaugagagaaauc

SEQ ID NO: 28010 - RNA, 18 nt, Artificial Sequence
  Description of Artificial Sequence: Synthetic oligonucleotide
acuagaacgccaugagag

SEQ ID NO: 28011 - RNA, 18 nt, Artificial Sequence
  Description of Artificial Sequence: Synthetic oligonucleotide
agagaacuagaacgccau

SEQ ID NO: 28012 - RNA, 18 nt, Artificial Sequence
  Description of Artificial Sequence: Synthetic oligonucleotide
aggucagagaacuagaac

SEQ ID NO: 28013 - RNA, 18 nt, Artificial Sequence
  Description of Artificial Sequence: Synthetic oligonucleotide
gacucaggucagagaacu

SEQ ID NO: 28014 - RNA, 18 nt, Artificial Sequence
  Description of Artificial Sequence: Synthetic oligonucleotide
acaaagacucaggucaga

SEQ ID NO: 28015 - RNA, 18 nt, Artificial Sequence
  Description of Artificial Sequence: Synthetic oligonucleotide
uuaaaacaaagacucagg

SEQ ID NO: 28016 - RNA, 18 nt, Artificial Sequence
  Description of Artificial Sequence: Synthetic oligonucleotide
acuucuuaaaacaaagac

SEQ ID NO: 28017 - RNA, 18 nt, Artificial Sequence
  Description of Artificial Sequence: Synthetic oligonucleotide
caaauacuucuuaaaaca

SEQ ID NO: 28018 - RNA, 18 nt, Artificial Sequence
  Description of Artificial Sequence: Synthetic oligonucleotide
gaagacaaauacuucuua

SEQ ID NO: 28019 - RNA, 18 nt, Artificial Sequence
  Description of Artificial Sequence: Synthetic oligonucleotide
caaaggaagacaaauacu

SEQ ID NO: 28020 - RNA, 18 nt, Artificial Sequence
  Description of Artificial Sequence: Synthetic oligonucleotide
uuagacaaaggaagacaa

SEQ ID NO: 28021 - RNA, 18 nt, Artificial Sequence
  Description of Artificial Sequence: Synthetic oligonucleotide
ccacauuagacaaaggaa

SEQ ID NO: 28022 - RNA, 18 nt, Artificial Sequence
  Description of Artificial Sequence: Synthetic oligonucleotide
gaaucccacauuagacaa

SEQ ID NO: 28023 - RNA, 18 nt, Artificial Sequence
  Description of Artificial Sequence: Synthetic oligonucleotide
gucaggaaucccacauua

SEQ ID NO: 28024 - RNA, 18 nt, Artificial Sequence
  Description of Artificial Sequence: Synthetic oligonucleotide
agggagucaggaauccca

SEQ ID NO: 28025 - RNA, 18 nt, Artificial Sequence
  Description of Artificial Sequence: Synthetic oligonucleotide
gacgaagggagucaggaa

SEQ ID NO: 28026 - RNA, 18 nt, Artificial Sequence
  Description of Artificial Sequence: Synthetic oligonucleotide
ccuuggacgaagggaguc

SEQ ID NO: 28027 - RNA, 18 nt, Artificial Sequence
  Description of Artificial Sequence: Synthetic oligonucleotide
cggugccuuggacgaagg

SEQ ID NO: 28028 - RNA, 18 nt, Artificial Sequence
  Description of Artificial Sequence: Synthetic oligonucleotide
cacaccggugccuuggac

SEQ ID NO: 28029 - RNA, 18 nt, Artificial Sequence
  Description of Artificial Sequence: Synthetic oligonucleotide
acacacacaccggugccu

SEQ ID NO: 28030 - RNA, 18 nt, Artificial Sequence
  Description of Artificial Sequence: Synthetic oligonucleotide
aagacacacacacaccgg

SEQ ID NO: 28031 - RNA, 18 nt, Artificial Sequence
  Description of Artificial Sequence: Synthetic oligonucleotide
agugcaagacacacacac

SEQ ID NO: 28032 - RNA, 18 nt, Artificial Sequence
  Description of Artificial Sequence: Synthetic oligonucleotide
ucuggagugcaagacaca

SEQ ID NO: 28033 - RNA, 18 nt, Artificial Sequence
  Description of Artificial Sequence: Synthetic oligonucleotide
ucagcucuggagugcaag

SEQ ID NO: 28034 - RNA, 18 nt, Artificial Sequence
  Description of Artificial Sequence: Synthetic oligonucleotide
ggaggucagcucuggagu

SEQ ID NO: 28035 - RNA, 18 nt, Artificial Sequence
  Description of Artificial Sequence: Synthetic oligonucleotide
gcgguggaggucagcucu

SEQ ID NO: 28036 - RNA, 18 nt, Artificial Sequence
  Description of Artificial Sequence: Synthetic oligonucleotide
gcugggcgguggagguca

SEQ ID NO: 28037 - RNA, 18 nt, Artificial Sequence
  Description of Artificial Sequence: Synthetic oligonucleotide
cccaggcugggcggugga

SEQ ID NO: 28038 - RNA, 18 nt, Artificial Sequence
  Description of Artificial Sequence: Synthetic oligonucleotide
gacuucccaggcugggcg

SEQ ID NO: 28039 - RNA, 18 nt, Artificial Sequence
  Description of Artificial Sequence: Synthetic oligonucleotide
acaaugacuucccaggcu

SEQ ID NO: 28040 - RNA, 18 nt, Artificial Sequence
  Description of Artificial Sequence: Synthetic oligonucleotide
ucccuacaaugacuuccc

SEQ ID NO: 28041 - RNA, 18 nt, Artificial Sequence
  Description of Artificial Sequence: Synthetic oligonucleotide
cucacucccuacaaugac

SEQ ID NO: 28042 - RNA, 18 nt, Artificial Sequence
  Description of Artificial Sequence: Synthetic oligonucleotide
agugucucacucccuaca

SEQ ID NO: 28043 - RNA, 18 nt, Artificial Sequence
  Description of Artificial Sequence: Synthetic oligonucleotide
gcuucagugucucacucc

SEQ ID NO: 28044 - RNA, 18 nt, Artificial Sequence
  Description of Artificial Sequence: Synthetic oligonucleotide
ucagggcuucagugucuc

SEQ ID NO: 28045 - RNA, 18 nt, Artificial Sequence
  Description of Artificial Sequence: Synthetic oligonucleotide
gcuucucagggcuucagu

SEQ ID NO: 28046 - RNA, 18 nt, Artificial Sequence
  Description of Artificial Sequence: Synthetic oligonucleotide
cacuggcuucucagggcu

SEQ ID NO: 28047 - RNA, 18 nt, Artificial Sequence
  Description of Artificial Sequence: Synthetic oligonucleotide
gauggcacuggcuucuca

SEQ ID NO: 28048 - RNA, 18 nt, Artificial Sequence
  Description of Artificial Sequence: Synthetic oligonucleotide
gggaugauggcacuggcu

SEQ ID NO: 28049 - RNA, 18 nt, Artificial Sequence
  Description of Artificial Sequence: Synthetic oligonucleotide
auguuccggaacccuggg

SEQ ID NO: 28050 - RNA, 18 nt, Artificial Sequence
  Description of Artificial Sequence: Synthetic oligonucleotide
aaugaauguuccggaacc

SEQ ID NO: 28051 - RNA, 18 nt, Artificial Sequence
  Description of Artificial Sequence: Synthetic oligonucleotide
gggaaugaauguuccgga

SEQ ID NO: 28052 - RNA, 18 nt, Artificial Sequence
  Description of Artificial Sequence: Synthetic oligonucleotide
cagguccucaccgguggg

SEQ ID NO: 28053 - RNA, 18 nt, Artificial Sequence
  Description of Artificial Sequence: Synthetic oligonucleotide
caugccagguccucaccg

SEQ ID NO: 28054 - RNA, 18 nt, Artificial Sequence
  Description of Artificial Sequence: Synthetic oligonucleotide
cgcugcaugccagguccu

SEQ ID NO: 28055 - RNA, 18 nt, Artificial Sequence
  Description of Artificial Sequence: Synthetic oligonucleotide
ugcuucgcugcaugccag

SEQ ID NO: 28056 - RNA, 18 nt, Artificial Sequence
  Description of Artificial Sequence: Synthetic oligonucleotide
ugggcugcuucgcugcau

SEQ ID NO: 28057 - RNA, 18 nt, Artificial Sequence
  Description of Artificial Sequence: Synthetic oligonucleotide
cgggcugggcugcuucgc

SEQ ID NO: 28058 - RNA, 18 nt, Artificial Sequence
  Description of Artificial Sequence: Synthetic oligonucleotide
uccgccgggcugggcugc

SEQ ID NO: 28059 - RNA, 18 nt, Artificial Sequence
  Description of Artificial Sequence: Synthetic oligonucleotide
ugggauccgccgggcugg

SEQ ID NO: 28060 - RNA, 18 nt, Artificial Sequence
  Description of Artificial Sequence: Synthetic oligonucleotide
uggccugggauccgccgg

SEQ ID NO: 28061 - RNA, 18 nt, Artificial Sequence
  Description of Artificial Sequence: Synthetic oligonucleotide
cgugcuggccugggaucc

SEQ ID NO: 28062 - RNA, 18 nt, Artificial Sequence
  Description of Artificial Sequence: Synthetic oligonucleotide
gcaggcgugcuggccugg

SEQ ID NO: 28063 - RNA, 18 nt, Artificial Sequence
  Description of Artificial Sequence: Synthetic oligonucleotide
agccggcaggcgugcugg

SEQ ID NO: 28064 - RNA, 18 nt, Artificial Sequence
  Description of Artificial Sequence: Synthetic oligonucleotide
ugagaagccggcaggcgu

SEQ ID NO: 28065 - RNA, 18 nt, Artificial Sequence
  Description of Artificial Sequence: Synthetic oligonucleotide
gacgaugagaagccggca

SEQ ID NO: 28066 - RNA, 18 nt, Artificial Sequence
  Description of Artificial Sequence: Synthetic oligonucleotide
ucccugacgaugagaagc

SEQ ID NO: 28067 - RNA, 18 nt, Artificial Sequence
  Description of Artificial Sequence: Synthetic oligonucleotide
cgggcucccugacgauga

SEQ ID NO: 28068 - RNA, 18 nt, Artificial Sequence
  Description of Artificial Sequence: Synthetic oligonucleotide
cugggcgggcucccugac

SEQ ID NO: 28069 - RNA, 18 nt, Artificial Sequence
  Description of Artificial Sequence: Synthetic oligonucleotide
gagcucugggcgggcucc

SEQ ID NO: 28070 - RNA, 18 nt, Artificial Sequence
  Description of Artificial Sequence: Synthetic oligonucleotide
gucacgagcucugggcgg

SEQ ID NO: 28071 - RNA, 18 nt, Artificial Sequence
  Description of Artificial Sequence: Synthetic oligonucleotide
ugcucgucacgagcucug

SEQ ID NO: 28072 - RNA, 18 nt, Artificial Sequence
  Description of Artificial Sequence: Synthetic oligonucleotide
gcacuugcucgucacgag

SEQ ID NO: 28073 - RNA, 18 nt, Artificial Sequence
  Description of Artificial Sequence: Synthetic oligonucleotide
acccagcacuugcucguc

SEQ ID NO: 28074 - RNA, 18 nt, Artificial Sequence
  Description of Artificial Sequence: Synthetic oligonucleotide
gggacccagcacuugcuc

SEQ ID NO: 28075 - RNA, 18 nt, Artificial Sequence
  Description of Artificial Sequence: Synthetic oligonucleotide
ccagagcgccgccucggg

SEQ ID NO: 28076 - RNA, 18 nt, Artificial Sequence
  Description of Artificial Sequence: Synthetic oligonucleotide
gccagccagagcgccgcc

SEQ ID NO: 28077 - RNA, 18 nt, Artificial Sequence
  Description of Artificial Sequence: Synthetic oligonucleotide
cagcugccagccagagcg

SEQ ID NO: 28078 - RNA, 18 nt, Artificial Sequence
  Description of Artificial Sequence: Synthetic oligonucleotide
cccaccagcugccagcca

SEQ ID NO: 28079 - RNA, 18 nt, Artificial Sequence
  Description of Artificial Sequence: Synthetic oligonucleotide
uauuccccaccagcugcc

SEQ ID NO: 28080 - RNA, 18 nt, Artificial Sequence
  Description of Artificial Sequence: Synthetic oligonucleotide
cugccuauuccccaccag

SEQ ID NO: 28081 - RNA, 18 nt, Artificial Sequence
  Description of Artificial Sequence: Synthetic oligonucleotide
cugcccugccuauucccc

SEQ ID NO: 28082 - RNA, 18 nt, Artificial Sequence
  Description of Artificial Sequence: Synthetic oligonucleotide
cacagcugcccugccuau

SEQ ID NO: 28083 - RNA, 18 nt, Artificial Sequence
  Description of Artificial Sequence: Synthetic oligonucleotide
ccagccacagcugcccug

SEQ ID NO: 28084 - RNA, 18 nt, Artificial Sequence
  Description of Artificial Sequence: Synthetic oligonucleotide
ucuccccagccacagcug

SEQ ID NO: 28085 - RNA, 18 nt, Artificial Sequence
  Description of Artificial Sequence: Synthetic oligonucleotide
aagucucuccccagccac

SEQ ID NO: 28086 - RNA, 18 nt, Artificial Sequence
  Description of Artificial Sequence: Synthetic oligonucleotide
gccuaaagucucucccca

SEQ ID NO: 28087 - RNA, 18 nt, Artificial Sequence
  Description of Artificial Sequence: Synthetic oligonucleotide
cuucugccuaaagucucu

SEQ ID NO: 28088 - RNA, 18 nt, Artificial Sequence
  Description of Artificial Sequence: Synthetic oligonucleotide
cacagcuucugccuaaag

SEQ ID NO: 28089 - RNA, 18 nt, Artificial Sequence
  Description of Artificial Sequence: Synthetic oligonucleotide
ugcaucacagcuucugcc

SEQ ID NO: 28090 - RNA, 18 nt, Artificial Sequence
  Description of Artificial Sequence: Synthetic oligonucleotide
cagccugcaucacagcuu

SEQ ID NO: 28091 - RNA, 18 nt, Artificial Sequence
  Description of Artificial Sequence: Synthetic oligonucleotide
gcagucagccugcaucac

SEQ ID NO: 28092 - RNA, 18 nt, Artificial Sequence
  Description of Artificial Sequence: Synthetic oligonucleotide
ggcuggcagucagccugc

SEQ ID NO: 28093 - RNA, 18 nt, Artificial Sequence
  Description of Artificial Sequence: Synthetic oligonucleotide
cccucggcuggcagucag

SEQ ID NO: 28094 - RNA, 18 nt, Artificial Sequence
  Description of Artificial Sequence: Synthetic oligonucleotide
ccagccccucggcuggca

SEQ ID NO: 28095 - RNA, 18 nt, Artificial Sequence
  Description of Artificial Sequence: Synthetic oligonucleotide
acuacccagccccucggc

SEQ ID NO: 28096 - RNA, 18 nt, Artificial Sequence
  Description of Artificial Sequence: Synthetic oligonucleotide
acggcacuacccagcccc

SEQ ID NO: 28097 - RNA, 18 nt, Artificial Sequence
  Description of Artificial Sequence: Synthetic oligonucleotide
cccgcacggcacuaccca

SEQ ID NO: 28098 - RNA, 18 nt, Artificial Sequence
  Description of Artificial Sequence: Synthetic oligonucleotide
cagcucccgcacggcacu

SEQ ID NO: 28099 - RNA, 18 nt, Artificial Sequence
  Description of Artificial Sequence: Synthetic oligonucleotide
accaucagcucccgcacg

SEQ ID NO: 28100 - RNA, 18 nt, Artificial Sequence
  Description of Artificial Sequence: Synthetic oligonucleotide
ccuguaccaucagcuccc

SEQ ID NO: 28101 - RNA, 18 nt, Artificial Sequence
  Description of Artificial Sequence: Synthetic oligonucleotide
agugcccuguaccaucag

SEQ ID NO: 28102 - RNA, 18 nt, Artificial Sequence
  Description of Artificial Sequence: Synthetic oligonucleotide
cagcgagugcccuguacc

SEQ ID NO: 28103 - RNA, 18 nt, Artificial Sequence
  Description of Artificial Sequence: Synthetic oligonucleotide
gggacagcgagugcccug

SEQ ID NO: 28104 - RNA, 18 nt, Artificial Sequence
  Description of Artificial Sequence: Synthetic oligonucleotide
ucuaggguggccggaggg

SEQ ID NO: 28105 - RNA, 18 nt, Artificial Sequence
  Description of Artificial Sequence: Synthetic oligonucleotide
ccuggucuaggguggccg

SEQ ID NO: 28106 - RNA, 18 nt, Artificial Sequence
  Description of Artificial Sequence: Synthetic oligonucleotide
cggacccuggucuagggu

SEQ ID NO: 28107 - RNA, 18 nt, Artificial Sequence
  Description of Artificial Sequence: Synthetic oligonucleotide
ccucucggacccuggucu

SEQ ID NO: 28108 - RNA, 18 nt, Artificial Sequence
  Description of Artificial Sequence: Synthetic oligonucleotide
gccugccucucggacccu

SEQ ID NO: 28109 - RNA, 18 nt, Artificial Sequence
  Description of Artificial Sequence: Synthetic oligonucleotide
cuccugccugccucucgg

SEQ ID NO: 28110 - RNA, 18 nt, Artificial Sequence
  Description of Artificial Sequence: Synthetic oligonucleotide
aguggcuccugccugccu

SEQ ID NO: 28111 - RNA, 18 nt, Artificial Sequence
  Description of Artificial Sequence: Synthetic oligonucleotide
acaugaguggcuccugcc

SEQ ID NO: 28112 - RNA, 18 nt, Artificial Sequence
  Description of Artificial Sequence: Synthetic oligonucleotide
ggaagacaugaguggcuc

SEQ ID NO: 28113 - RNA, 18 nt, Artificial Sequence
  Description of Artificial Sequence: Synthetic oligonucleotide
gggaagacaugaguggcu

SEQ ID NO: 28114 - RNA, 18 nt, Artificial Sequence
  Description of Artificial Sequence: Synthetic oligonucleotide
ugggcgucgggcaauggg

SEQ ID NO: 28115 - RNA, 18 nt, Artificial Sequence
  Description of Artificial Sequence: Synthetic oligonucleotide
gucuaugggcgucgggca

SEQ ID NO: 28116 - RNA, 18 nt, Artificial Sequence
  Description of Artificial Sequence: Synthetic oligonucleotide
ggagcgucuaugggcguc

SEQ ID NO: 28117 - RNA, 18 nt, Artificial Sequence
  Description of Artificial Sequence: Synthetic oligonucleotide
aggaaggagcgucuaugg

SEQ ID NO: 28118 - RNA, 18 nt, Artificial Sequence
  Description of Artificial Sequence: Synthetic oligonucleotide
cacacaggaaggagcguc

SEQ ID NO: 28119 - RNA, 18 nt, Artificial Sequence
  Description of Artificial Sequence: Synthetic oligonucleotide
agccccacacaggaagga

SEQ ID NO: 28120 - RNA, 18 nt, Artificial Sequence
  Description of Artificial Sequence: Synthetic oligonucleotide
accccagccccacacagg

SEQ ID NO: 28121 - RNA, 18 nt, Artificial Sequence
  Description of Artificial Sequence: Synthetic oligonucleotide
ggaguaccccagccccac

SEQ ID NO: 28122 - RNA, 18 nt, Artificial Sequence
  Description of Artificial Sequence: Synthetic oligonucleotide
accagggaguaccccagc

SEQ ID NO: 28123 - RNA, 18 nt, Artificial Sequence
  Description of Artificial Sequence: Synthetic oligonucleotide
guacgaccagggaguacc

SEQ ID NO: 28124 - RNA, 18 nt, Artificial Sequence
  Description of Artificial Sequence: Synthetic oligonucleotide
cugcaguacgaccaggga

SEQ ID NO: 28125 - RNA, 18 nt, Artificial Sequence
  Description of Artificial Sequence: Synthetic oligonucleotide
gcugacugcaguacgacc

SEQ ID NO: 28126 - RNA, 18 nt, Artificial Sequence
  Description of Artificial Sequence: Synthetic oligonucleotide
cgggugcugacugcagua

SEQ ID NO: 28127 - RNA, 18 nt, Artificial Sequence
  Description of Artificial Sequence: Synthetic oligonucleotide
gguuacgggugcugacug

SEQ ID NO: 28128 - RNA, 18 nt, Artificial Sequence
  Description of Artificial Sequence: Synthetic oligonucleotide
agccggguuacgggugcu

SEQ ID NO: 28129 - RNA, 18 nt, Artificial Sequence
  Description of Artificial Sequence: Synthetic oligonucleotide
gucauagccggguuacgg

SEQ ID NO: 28130 - RNA, 18 nt, Artificial Sequence
  Description of Artificial Sequence: Synthetic oligonucleotide
cccuggucauagccgggu

SEQ ID NO: 28131 - RNA, 18 nt, Artificial Sequence
  Description of Artificial Sequence: Synthetic oligonucleotide
cagaucccuggucauagc

SEQ ID NO: 28132 - RNA, 18 nt, Artificial Sequence
  Description of Artificial Sequence: Synthetic oligonucleotide
gcuuacagaucccugguc

SEQ ID NO: 28133 - RNA, 18 nt, Artificial Sequence
  Description of Artificial Sequence: Synthetic oligonucleotide
acagggcuuacagauccc

SEQ ID NO: 28134 - RNA, 18 nt, Artificial Sequence
  Description of Artificial Sequence: Synthetic oligonucleotide
gagccacagggcuuacag

SEQ ID NO: 28135 - RNA, 18 nt, Artificial Sequence
  Description of Artificial Sequence: Synthetic oligonucleotide
cuguggagccacagggcu

SEQ ID NO: 28136 - RNA, 18 nt, Artificial Sequence
  Description of Artificial Sequence: Synthetic oligonucleotide
agcaccuguggagccaca

SEQ ID NO: 28137 - RNA, 18 nt, Artificial Sequence
  Description of Artificial Sequence: Synthetic oligonucleotide
gaagcagcaccuguggag

SEQ ID NO: 28138 - RNA, 18 nt, Artificial Sequence
  Description of Artificial Sequence: Synthetic oligonucleotide
agugagaagcagcaccug

SEQ ID NO: 28139 - RNA, 18 nt, Artificial Sequence
  Description of Artificial Sequence: Synthetic oligonucleotide
gggccagugagaagcagc

SEQ ID NO: 28140 - RNA, 18 nt, Artificial Sequence
  Description of Artificial Sequence: Synthetic oligonucleotide
agucugggccagugagaa

SEQ ID NO: 28141 - RNA, 18 nt, Artificial Sequence
  Description of Artificial Sequence: Synthetic oligonucleotide
cucagagucugggccagu

SEQ ID NO: 28142 - RNA, 18 nt, Artificial Sequence
  Description of Artificial Sequence: Synthetic oligonucleotide
uggagcucagagucuggg

SEQ ID NO: 28143 - RNA, 18 nt, Artificial Sequence
  Description of Artificial Sequence: Synthetic oligonucleotide
gccgguggagcucagagu

SEQ ID NO: 28144 - RNA, 18 nt, Artificial Sequence
  Description of Artificial Sequence: Synthetic oligonucleotide
acugggccgguggagcuc

SEQ ID NO: 28145 - RNA, 18 nt, Artificial Sequence
  Description of Artificial Sequence: Synthetic oligonucleotide
ugcagacugggccggugg

SEQ ID NO: 28146 - RNA, 18 nt, Artificial Sequence
  Description of Artificial Sequence: Synthetic oligonucleotide
ggccgugcagacugggcc

SEQ ID NO: 28147 - RNA, 18 nt, Artificial Sequence
  Description of Artificial Sequence: Synthetic oligonucleotide
agaugggccgugcagacu

SEQ ID NO: 28148 - RNA, 18 nt, Artificial Sequence
  Description of Artificial Sequence: Synthetic oligonucleotide
gaagcagaugggccgugc

SEQ ID NO: 28149 - RNA, 18 nt, Artificial Sequence
  Description of Artificial Sequence: Synthetic oligonucleotide
aaggugaagcagaugggc

SEQ ID NO: 28150 - RNA, 18 nt, Artificial Sequence
  Description of Artificial Sequence: Synthetic oligonucleotide
gagggaaggugaagcaga

SEQ ID NO: 28151 - RNA, 18 nt, Artificial Sequence
  Description of Artificial Sequence: Synthetic oligonucleotide
gcugggagggaaggugaa

SEQ ID NO: 28152 - RNA, 18 nt, Artificial Sequence
  Description of Artificial Sequence: Synthetic oligonucleotide
acguggcugggagggaag

SEQ ID NO: 28153 - RNA, 18 nt, Artificial Sequence
  Description of Artificial Sequence: Synthetic oligonucleotide
cuggcacguggcugggag

SEQ ID NO: 28154 - RNA, 18 nt, Artificial Sequence
  Description of Artificial Sequence: Synthetic oligonucleotide
ggccacuggcacguggcu

SEQ ID NO: 28155 - RNA, 18 nt, Artificial Sequence
  Description of Artificial Sequence: Synthetic oligonucleotide
gcuguggccacuggcacg

SEQ ID NO: 28156 - RNA, 18 nt, Artificial Sequence
  Description of Artificial Sequence: Synthetic oligonucleotide
agugggcuguggccacug

SEQ ID NO: 28157 - RNA, 18 nt, Artificial Sequence
  Description of Artificial Sequence: Synthetic oligonucleotide
ugggaagugggcuguggc

SEQ ID NO: 28158 - RNA, 18 nt, Artificial Sequence
  Description of Artificial Sequence: Synthetic oligonucleotide
uggguugggaagugggcu

SEQ ID NO: 28159 - RNA, 18 nt, Artificial Sequence
  Description of Artificial Sequence: Synthetic oligonucleotide
aacaguggguugggaagu

SEQ ID NO: 28160 - RNA, 18 nt, Artificial Sequence
  Description of Artificial Sequence: Synthetic oligonucleotide
gguacaacaguggguugg

SEQ ID NO: 28161 - RNA, 18 nt, Artificial Sequence
  Description of Artificial Sequence: Synthetic oligonucleotide
gccuggguacaacagugg

SEQ ID NO: 28162 - RNA, 18 nt, Artificial Sequence
  Description of Artificial Sequence: Synthetic oligonucleotide
gugaggccuggguacaac

SEQ ID NO: 28163 - RNA, 18 nt, Artificial Sequence
  Description of Artificial Sequence: Synthetic oligonucleotide
gcaaagugaggccugggu

SEQ ID NO: 28164 - RNA, 18 nt, Artificial Sequence
  Description of Artificial Sequence: Synthetic oligonucleotide
caacagcaaagugaggcc

SEQ ID NO: 28165 - RNA, 18 nt, Artificial Sequence
  Description of Artificial Sequence: Synthetic oligonucleotide
aagggcaacagcaaagug

SEQ ID NO: 28166 - RNA, 18 nt, Artificial Sequence
  Description of Artificial Sequence: Synthetic oligonucleotide
gggacaagggcaacagca

SEQ ID NO: 28167 - RNA, 18 nt, Artificial Sequence
  Description of Artificial Sequence: Synthetic oligonucleotide
gaagagggacaagggcaa

SEQ ID NO: 28168 - RNA, 18 nt, Artificial Sequence
  Description of Artificial Sequence: Synthetic oligonucleotide
ggcccgaagagggacaag

SEQ ID NO: 28169 - RNA, 18 nt, Artificial Sequence
  Description of Artificial Sequence: Synthetic oligonucleotide
uucagggcccgaagaggg

SEQ ID NO: 28170 - RNA, 18 nt, Artificial Sequence
  Description of Artificial Sequence: Synthetic oligonucleotide
gaaaauucagggcccgaa

SEQ ID NO: 28171 - RNA, 18 nt, Artificial Sequence
  Description of Artificial Sequence: Synthetic oligonucleotide
gaacagaaaauucagggc

SEQ ID NO: 28172 - RNA, 18 nt, Artificial Sequence
  Description of Artificial Sequence: Synthetic oligonucleotide
ccagggaacagaaaauuc

SEQ ID NO: 28173 - RNA, 18 nt, Artificial Sequence
  Description of Artificial Sequence: Synthetic oligonucleotide
ggcccccagggaacagaa

SEQ ID NO: 28174 - RNA, 18 nt, Artificial Sequence
  Description of Artificial Sequence: Synthetic oligonucleotide
uggcuggcccccagggaa

SEQ ID NO: 28175 - RNA, 18 nt, Artificial Sequence
  Description of Artificial Sequence: Synthetic oligonucleotide
ggcccuggcuggccccca

SEQ ID NO: 28176 - RNA, 18 nt, Artificial Sequence
  Description of Artificial Sequence: Synthetic oligonucleotide
caaagggcccuggcuggc

SEQ ID NO: 28177 - RNA, 18 nt, Artificial Sequence
  Description of Artificial Sequence: Synthetic oligonucleotide
gggcacaaagggcccugg

SEQ ID NO: 28178 - RNA, 18 nt, Artificial Sequence
  Description of Artificial Sequence: Synthetic oligonucleotide
caucaggccugugcuggg

SEQ ID NO: 28179 - RNA, 18 nt, Artificial Sequence
  Description of Artificial Sequence: Synthetic oligonucleotide
accugcaucaggccugug

SEQ ID NO: 28180 - RNA, 18 nt, Artificial Sequence
  Description of Artificial Sequence: Synthetic oligonucleotide
uggacaccugcaucaggc

SEQ ID NO: 28181 - RNA, 18 nt, Artificial Sequence
  Description of Artificial Sequence: Synthetic oligonucleotide
gugaguggacaccugcau

SEQ ID NO: 28182 - RNA, 18 nt, Artificial Sequence
  Description of Artificial Sequence: Synthetic oligonucleotide
caccugugaguggacacc

SEQ ID NO: 28183 - RNA, 18 nt, Artificial Sequence
  Description of Artificial Sequence: Synthetic oligonucleotide
agcgccaccugugagugg

SEQ ID NO: 28184 - RNA, 18 nt, Artificial Sequence
  Description of Artificial Sequence: Synthetic oligonucleotide
aggugagcgccaccugug

SEQ ID NO: 28185 - RNA, 18 nt, Artificial Sequence
  Description of Artificial Sequence: Synthetic oligonucleotide
agccuaggugagcgccac

SEQ ID NO: 28186 - RNA, 18 nt, Artificial Sequence
  Description of Artificial Sequence: Synthetic oligonucleotide
gugacagccuaggugagc

SEQ ID NO: 28187 - RNA, 18 nt, Artificial Sequence
  Description of Artificial Sequence: Synthetic oligonucleotide
guccugugacagccuagg

SEQ ID NO: 28188 - RNA, 18 nt, Artificial Sequence
  Description of Artificial Sequence: Synthetic oligonucleotide
gguggguccugugacagc

SEQ ID NO: 28189 - RNA, 18 nt, Artificial Sequence
  Description of Artificial Sequence: Synthetic oligonucleotide
auggagguggguccugug

SEQ ID NO: 28190 - RNA, 18 nt, Artificial Sequence
  Description of Artificial Sequence: Synthetic oligonucleotide
cuggcauggagguggguc

SEQ ID NO: 28191 - RNA, 18 nt, Artificial Sequence
  Description of Artificial Sequence: Synthetic oligonucleotide
guugccuggcauggaggu

SEQ ID NO: 28192 - RNA, 18 nt, Artificial Sequence
  Description of Artificial Sequence: Synthetic oligonucleotide
ccucuguugccuggcaug

SEQ ID NO: 28193 - RNA, 18 nt, Artificial Sequence
  Description of Artificial Sequence: Synthetic oligonucleotide
guggcccucuguugccug

SEQ ID NO: 28194 - RNA, 18 nt, Artificial Sequence
  Description of Artificial Sequence: Synthetic oligonucleotide
guucuguggcccucuguu

SEQ ID NO: 28195 - RNA, 18 nt, Artificial Sequence
  Description of Artificial Sequence: Synthetic oligonucleotide
gggugguucuguggcccu

SEQ ID NO: 28196 - RNA, 18 nt, Artificial Sequence
  Description of Artificial Sequence: Synthetic oligonucleotide
gaccaaggagugagccgu

SEQ ID NO: 28197 - RNA, 18 nt, Artificial Sequence
  Description of Artificial Sequence: Synthetic oligonucleotide
ccccagaccaaggaguga

SEQ ID NO: 28198 - RNA, 18 nt, Artificial Sequence
  Description of Artificial Sequence: Synthetic oligonucleotide
gguggccccagaccaagg

SEQ ID NO: 28199 - RNA, 18 nt, Artificial Sequence
  Description of Artificial Sequence: Synthetic oligonucleotide
aagaagguggccccagac

SEQ ID NO: 28200 - RNA, 18 nt, Artificial Sequence
  Description of Artificial Sequence: Synthetic oligonucleotide
agggcaagaagguggccc

SEQ ID NO: 28201 - RNA, 18 nt, Artificial Sequence
  Description of Artificial Sequence: Synthetic oligonucleotide
aagaaagggcaagaaggu

SEQ ID NO: 28202 - RNA, 18 nt, Artificial Sequence
  Description of Artificial Sequence: Synthetic oligonucleotide
aaaaaaagaaagggcaag

SEQ ID NO: 28203 - RNA, 18 nt, Artificial Sequence
  Description of Artificial Sequence: Synthetic oligonucleotide
aaaaaaaaaaaagaaagg

SEQ ID NO: 28204 - RNA, 18 nt, Artificial Sequence
  Description of Artificial Sequence: Synthetic oligonucleotide
aaaaaaaaaaaaaaaaag

SEQ ID NO: 28205 - RNA, 18 nt, Artificial Sequence
  Description of Artificial Sequence: Synthetic oligonucleotide
aaaaaaaaaaaaaaaaaa

SEQ ID NO: 28206 - RNA, 18 nt, Artificial Sequence
  Description of Artificial Sequence: Synthetic oligonucleotide
ucggaaaaaaaaaaaaaa

SEQ ID NO: 28207 - RNA, 18 nt, Artificial Sequence
  Description of Artificial Sequence: Synthetic oligonucleotide
ccaucucggaaaaaaaaa

SEQ ID NO: 28208 - RNA, 18 nt, Artificial Sequence
  Description of Artificial Sequence: Synthetic oligonucleotide
agacuccaucucggaaaa

SEQ ID NO: 28209 - RNA, 18 nt, Artificial Sequence
  Description of Artificial Sequence: Synthetic oligonucleotide
gagagagacuccaucucg

SEQ ID NO: 28210 - RNA, 18 nt, Artificial Sequence
  Description of Artificial Sequence: Synthetic oligonucleotide
ugacagagagagacucca

SEQ ID NO: 28211 - RNA, 18 nt, Artificial Sequence
  Description of Artificial Sequence: Synthetic oligonucleotide
cugggugacagagagaga

SEQ ID NO: 28212 - RNA, 18 nt, Artificial Sequence
  Description of Artificial Sequence: Synthetic oligonucleotide
cccaccugggugacagag

SEQ ID NO: 28213 - RNA, 18 nt, Artificial Sequence
  Description of Artificial Sequence: Synthetic oligonucleotide
acacucccaccuggguga

SEQ ID NO: 28214 - RNA, 18 nt, Artificial Sequence
  Description of Artificial Sequence: Synthetic oligonucleotide
ccaccacacucccaccug

SEQ ID NO: 28215 - RNA, 18 nt, Artificial Sequence
  Description of Artificial Sequence: Synthetic oligonucleotide
uugugccaccacacuccc

SEQ ID NO: 28216 - RNA, 18 nt, Artificial Sequence
  Description of Artificial Sequence: Synthetic oligonucleotide
cgagauugugccaccaca

SEQ ID NO: 28217 - RNA, 18 nt, Artificial Sequence
  Description of Artificial Sequence: Synthetic oligonucleotide
ugagccgagauugugcca

SEQ ID NO: 28218 - RNA, 18 nt, Artificial Sequence
  Description of Artificial Sequence: Synthetic oligonucleotide
ugcagugagccgagauug

SEQ ID NO: 28219 - RNA, 18 nt, Artificial Sequence
  Description of Artificial Sequence: Synthetic oligonucleotide
gagguugcagugagccga

SEQ ID NO: 28220 - RNA, 18 nt, Artificial Sequence
  Description of Artificial Sequence: Synthetic oligonucleotide
agguggagguugcaguga

SEQ ID NO: 28221 - RNA, 18 nt, Artificial Sequence
  Description of Artificial Sequence: Synthetic oligonucleotide
ucaggagguggagguugc

SEQ ID NO: 28222 - RNA, 18 nt, Artificial Sequence
  Description of Artificial Sequence: Synthetic oligonucleotide
ugaacucaggagguggag

SEQ ID NO: 28223 - RNA, 18 nt, Artificial Sequence
  Description of Artificial Sequence: Synthetic oligonucleotide
uugcuugaacucaggagg

SEQ ID NO: 28224 - RNA, 18 nt, Artificial Sequence
  Description of Artificial Sequence: Synthetic oligonucleotide
gagaauugcuugaacuca

SEQ ID NO: 28225 - RNA, 18 nt, Artificial Sequence
  Description of Artificial Sequence: Synthetic oligonucleotide
ggcaggagaauugcuuga

SEQ ID NO: 28226 - RNA, 18 nt, Artificial Sequence
  Description of Artificial Sequence: Synthetic oligonucleotide
gcugaggcaggagaauug

SEQ ID NO: 28227 - RNA, 18 nt, Artificial Sequence
  Description of Artificial Sequence: Synthetic oligonucleotide
gggaggcugaggcaggag

SEQ ID NO: 28228 - RNA, 18 nt, Artificial Sequence
  Description of Artificial Sequence: Synthetic oligonucleotide
uacuugggaggcugaggc

SEQ ID NO: 28229 - RNA, 18 nt, Artificial Sequence
  Description of Artificial Sequence: Synthetic oligonucleotide
ccagcuacuugggaggcu

SEQ ID NO: 28230 - RNA, 18 nt, Artificial Sequence
  Description of Artificial Sequence: Synthetic oligonucleotide
uagucccagcuacuuggg

SEQ ID NO: 28231 - RNA, 18 nt, Artificial Sequence
  Description of Artificial Sequence: Synthetic oligonucleotide
gccuguagucccagcuac

SEQ ID NO: 28232 - RNA, 18 nt, Artificial Sequence
  Description of Artificial Sequence: Synthetic oligonucleotide
ugcaugccuguaguccca

SEQ ID NO: 28233 - RNA, 18 nt, Artificial Sequence
  Description of Artificial Sequence: Synthetic oligonucleotide
gguggugcaugccuguag

SEQ ID NO: 28234 - RNA, 18 nt, Artificial Sequence
  Description of Artificial Sequence: Synthetic oligonucleotide
agugugguggugcaugcc

SEQ ID NO: 28235 - RNA, 18 nt, Artificial Sequence
  Description of Artificial Sequence: Synthetic oligonucleotide
ggccaagugugguggugc

SEQ ID NO: 28236 - RNA, 18 nt, Artificial Sequence
  Description of Artificial Sequence: Synthetic oligonucleotide
acauuggccaaguguggu

SEQ ID NO: 28237 - RNA, 18 nt, Artificial Sequence
  Description of Artificial Sequence: Synthetic oligonucleotide
acagaacauuggccaagu

SEQ ID NO: 28238 - RNA, 18 nt, Artificial Sequence
  Description of Artificial Sequence: Synthetic oligonucleotide
aaaauacagaacauuggc

SEQ ID NO: 28239 - RNA, 18 nt, Artificial Sequence
  Description of Artificial Sequence: Synthetic oligonucleotide
uauuaaaaauacagaaca

SEQ ID NO: 28240 - RNA, 18 nt, Artificial Sequence
  Description of Artificial Sequence: Synthetic oligonucleotide
gucccuauuaaaaauaca

SEQ ID NO: 28241 - RNA, 18 nt, Artificial Sequence
  Description of Artificial Sequence: Synthetic oligonucleotide
accccgucccuauuaaaa

SEQ ID NO: 28242 - RNA, 18 nt, Artificial Sequence
  Description of Artificial Sequence: Synthetic oligonucleotide
gcaaaaccccgucccuau

SEQ ID NO: 28243 - RNA, 18 nt, Artificial Sequence
  Description of Artificial Sequence: Synthetic oligonucleotide
acauggcaaaaccccguc

SEQ ID NO: 28244 - RNA, 18 nt, Artificial Sequence
  Description of Artificial Sequence: Synthetic oligonucleotide
agcuaacauggcaaaacc

SEQ ID NO: 28245 - RNA, 18 nt, Artificial Sequence
  Description of Artificial Sequence: Synthetic oligonucleotide
agccuagcuaacauggca

SEQ ID NO: 28246 - RNA, 18 nt, Artificial Sequence
  Description of Artificial Sequence: Synthetic oligonucleotide
agaccagccuagcuaaca

SEQ ID NO: 28247 - RNA, 18 nt, Artificial Sequence
  Description of Artificial Sequence: Synthetic oligonucleotide
guuugagaccagccuagc

SEQ ID NO: 28248 - RNA, 18 nt, Artificial Sequence
  Description of Artificial Sequence: Synthetic oligonucleotide
ugugaguuugagaccagc

SEQ ID NO: 28249 - RNA, 18 nt, Artificial Sequence
  Description of Artificial Sequence: Synthetic oligonucleotide
ccaggugugaguuugaga

SEQ ID NO: 28250 - RNA, 18 nt, Artificial Sequence
  Description of Artificial Sequence: Synthetic oligonucleotide
uaaucccaggugugaguu

SEQ ID NO: 28251 - RNA, 18 nt, Artificial Sequence
  Description of Artificial Sequence: Synthetic oligonucleotide
gccuguaaucccaggugu

SEQ ID NO: 28252 - RNA, 18 nt, Artificial Sequence
  Description of Artificial Sequence: Synthetic oligonucleotide
cucaugccuguaauccca

SEQ ID NO: 28253 - RNA, 18 nt, Artificial Sequence
  Description of Artificial Sequence: Synthetic oligonucleotide
aguggcucaugccuguaa

SEQ ID NO: 28254 - RNA, 18 nt, Artificial Sequence
  Description of Artificial Sequence: Synthetic oligonucleotide
ggugcaguggcucaugcc

SEQ ID NO: 28255 - RNA, 18 nt, Artificial Sequence
  Description of Artificial Sequence: Synthetic oligonucleotide
ggcugggugcaguggcuc

SEQ ID NO: 28256 - RNA, 18 nt, Artificial Sequence
  Description of Artificial Sequence: Synthetic oligonucleotide
gggcugggugcaguggcu

SEQ ID NO: 28257 - RNA, 18 nt, Artificial Sequence
  Description of Artificial Sequence: Synthetic oligonucleotide
aagaaagggcaagaaggg

SEQ ID NO: 28258 - RNA, 18 nt, Artificial Sequence
  Description of Artificial Sequence: Synthetic oligonucleotide
gagaaaagaaagggcaag

SEQ ID NO: 28259 - RNA, 18 nt, Artificial Sequence
  Description of Artificial Sequence: Synthetic oligonucleotide
ccauggagaaaagaaagg

SEQ ID NO: 28260 - RNA, 18 nt, Artificial Sequence
  Description of Artificial Sequence: Synthetic oligonucleotide
aucagccauggagaaaag

SEQ ID NO: 28261 - RNA, 18 nt, Artificial Sequence
  Description of Artificial Sequence: Synthetic oligonucleotide
gcagcaucagccauggag

SEQ ID NO: 28262 - RNA, 18 nt, Artificial Sequence
  Description of Artificial Sequence: Synthetic oligonucleotide
ccacagcagcaucagcca

SEQ ID NO: 28263 - RNA, 18 nt, Artificial Sequence
  Description of Artificial Sequence: Synthetic oligonucleotide
gcuggccacagcagcauc

SEQ ID NO: 28264 - RNA, 18 nt, Artificial Sequence
  Description of Artificial Sequence: Synthetic oligonucleotide
cccuggcuggccacagca

SEQ ID NO: 28265 - RNA, 18 nt, Artificial Sequence
  Description of Artificial Sequence: Synthetic oligonucleotide
aagggcccuggcuggcca

SEQ ID NO: 28266 - RNA, 18 nt, Artificial Sequence
  Description of Artificial Sequence: Synthetic oligonucleotide
aucucaagggcccuggcu

SEQ ID NO: 28267 - RNA, 18 nt, Artificial Sequence
  Description of Artificial Sequence: Synthetic oligonucleotide
gaaggaucucaagggccc

SEQ ID NO: 28268 - RNA, 18 nt, Artificial Sequence
  Description of Artificial Sequence: Synthetic oligonucleotide
aacuggaaggaucucaag

SEQ ID NO: 28269 - RNA, 18 nt, Artificial Sequence
  Description of Artificial Sequence: Synthetic oligonucleotide
agccaaacuggaaggauc

SEQ ID NO: 28270 - RNA, 18 nt, Artificial Sequence
  Description of Artificial Sequence: Synthetic oligonucleotide
auaacagccaaacuggaa

SEQ ID NO: 28271 - RNA, 18 nt, Artificial Sequence
  Description of Artificial Sequence: Synthetic oligonucleotide
uuugcauaacagccaaac

SEQ ID NO: 28272 - RNA, 18 nt, Artificial Sequence
  Description of Artificial Sequence: Synthetic oligonucleotide
ccugcuuugcauaacagc

SEQ ID NO: 28273 - RNA, 18 nt, Artificial Sequence
  Description of Artificial Sequence: Synthetic oligonucleotide
aaucaccugcuuugcaua

SEQ ID NO: 28274 - RNA, 18 nt, Artificial Sequence
  Description of Artificial Sequence: Synthetic oligonucleotide
agacaaaucaccugcuuu

SEQ ID NO: 28275 - RNA, 18 nt, Artificial Sequence
  Description of Artificial Sequence: Synthetic oligonucleotide
gauuaagacaaaucaccu

SEQ ID NO: 28276 - RNA, 18 nt, Artificial Sequence
  Description of Artificial Sequence: Synthetic oligonucleotide
uaucugauuaagacaaau

SEQ ID NO: 28277 - RNA, 18 nt, Artificial Sequence
  Description of Artificial Sequence: Synthetic oligonucleotide
ucuuuuaucugauuaaga

SEQ ID NO: 28278 - RNA, 18 nt, Artificial Sequence
  Description of Artificial Sequence: Synthetic oligonucleotide
cucuaucuuuuaucugau

SEQ ID NO: 28279 - RNA, 18 nt, Artificial Sequence
  Description of Artificial Sequence: Synthetic oligonucleotide
auagccucuaucuuuuau

SEQ ID NO: 28280 - RNA, 18 nt, Artificial Sequence
  Description of Artificial Sequence: Synthetic oligonucleotide
cccccauagccucuaucu

SEQ ID NO: 28281 - RNA, 18 nt, Artificial Sequence
  Description of Artificial Sequence: Synthetic oligonucleotide
ugaggcccccauagccuc

SEQ ID NO: 28282 - RNA, 18 nt, Artificial Sequence
  Description of Artificial Sequence: Synthetic oligonucleotide
aaucuugaggcccccaua

SEQ ID NO: 28283 - RNA, 18 nt, Artificial Sequence
  Description of Artificial Sequence: Synthetic oligonucleotide
ccaaaaaucuugaggccc

SEQ ID NO: 28284 - RNA, 18 nt, Artificial Sequence
  Description of Artificial Sequence: Synthetic oligonucleotide
gcucuccaaaaaucuuga

SEQ ID NO: 28285 - RNA, 18 nt, Artificial Sequence
  Description of Artificial Sequence: Synthetic oligonucleotide
ccucugcucuccaaaaau

SEQ ID NO: 28286 - RNA, 18 nt, Artificial Sequence
  Description of Artificial Sequence: Synthetic oligonucleotide
gaccaccucugcucucca

SEQ ID NO: 28287 - RNA, 18 nt, Artificial Sequence
  Description of Artificial Sequence: Synthetic oligonucleotide
ccagagaccaccucugcu

SEQ ID NO: 28288 - RNA, 18 nt, Artificial Sequence
  Description of Artificial Sequence: Synthetic oligonucleotide
aauugccagagaccaccu

SEQ ID NO: 28289 - RNA, 18 nt, Artificial Sequence
  Description of Artificial Sequence: Synthetic oligonucleotide
gauggaauugccagagac

SEQ ID NO: 28290 - RNA, 18 nt, Artificial Sequence
  Description of Artificial Sequence: Synthetic oligonucleotide
aaccagauggaauugcca

SEQ ID NO: 28291 - RNA, 18 nt, Artificial Sequence
  Description of Artificial Sequence: Synthetic oligonucleotide
cucaaaaccagauggaau

SEQ ID NO: 28292 - RNA, 18 nt, Artificial Sequence
  Description of Artificial Sequence: Synthetic oligonucleotide
aguuucucaaaaccagau

SEQ ID NO: 28293 - RNA, 18 nt, Artificial Sequence
  Description of Artificial Sequence: Synthetic oligonucleotide
ugcuaaguuucucaaaac

SEQ ID NO: 28294 - RNA, 18 nt, Artificial Sequence
  Description of Artificial Sequence: Synthetic oligonucleotide
ugagcugcuaaguuucuc

SEQ ID NO: 28295 - RNA, 18 nt, Artificial Sequence
  Description of Artificial Sequence: Synthetic oligonucleotide
cucugugagcugcuaagu

SEQ ID NO: 28296 - RNA, 18 nt, Artificial Sequence
  Description of Artificial Sequence: Synthetic oligonucleotide
cugugcucugugagcugc

SEQ ID NO: 28297 - RNA, 18 nt, Artificial Sequence
  Description of Artificial Sequence: Synthetic oligonucleotide
gaucucugugcucuguga

SEQ ID NO: 28298 - RNA, 18 nt, Artificial Sequence
  Description of Artificial Sequence: Synthetic oligonucleotide
ggcaggaucucugugcuc

SEQ ID NO: 28299 - RNA, 18 nt, Artificial Sequence
  Description of Artificial Sequence: Synthetic oligonucleotide
aagaaggcaggaucucug

SEQ ID NO: 28300 - RNA, 18 nt, Artificial Sequence
  Description of Artificial Sequence: Synthetic oligonucleotide
guaggaagaaggcaggau

SEQ ID NO: 28301 - RNA, 18 nt, Artificial Sequence
  Description of Artificial Sequence: Synthetic oligonucleotide
ugauaguaggaagaaggc

SEQ ID NO: 28302 - RNA, 18 nt, Artificial Sequence
  Description of Artificial Sequence: Synthetic oligonucleotide
cagccugauaguaggaag

SEQ ID NO: 28303 - RNA, 18 nt, Artificial Sequence
  Description of Artificial Sequence: Synthetic oligonucleotide
uaggucagccugauagua

SEQ ID NO: 28304 - RNA, 18 nt, Artificial Sequence
  Description of Artificial Sequence: Synthetic oligonucleotide
cccauuaggucagccuga

SEQ ID NO: 28305 - RNA, 18 nt, Artificial Sequence
  Description of Artificial Sequence: Synthetic oligonucleotide
ccaaccccauuaggucag

SEQ ID NO: 28306 - RNA, 18 nt, Artificial Sequence
  Description of Artificial Sequence: Synthetic oligonucleotide
gcagcccaaccccauuag

SEQ ID NO: 28307 - RNA, 18 nt, Artificial Sequence
  Description of Artificial Sequence: Synthetic oligonucleotide
gccgagcagcccaacccc

SEQ ID NO: 28308 - RNA, 18 nt, Artificial Sequence
  Description of Artificial Sequence: Synthetic oligonucleotide
caguugccgagcagccca

SEQ ID NO: 28309 - RNA, 18 nt, Artificial Sequence
  Description of Artificial Sequence: Synthetic oligonucleotide
ccaagcaguugccgagca

SEQ ID NO: 28310 - RNA, 18 nt, Artificial Sequence
  Description of Artificial Sequence: Synthetic oligonucleotide
gugacccaagcaguugcc

SEQ ID NO: 28311 - RNA, 18 nt, Artificial Sequence
  Description of Artificial Sequence: Synthetic oligonucleotide
gcaaggugacccaagcag

SEQ ID NO: 28312 - RNA, 18 nt, Artificial Sequence
  Description of Artificial Sequence: Synthetic oligonucleotide
gggcaaggugacccaagc

SEQ ID NO: 28313 - RNA, 18 nt, Artificial Sequence
  Description of Artificial Sequence: Synthetic oligonucleotide
agggcugguuuccuuggg

SEQ ID NO: 28314 - RNA, 18 nt, Artificial Sequence
  Description of Artificial Sequence: Synthetic oligonucleotide
cacccagggcugguuucc

SEQ ID NO: 28315 - RNA, 18 nt, Artificial Sequence
  Description of Artificial Sequence: Synthetic oligonucleotide
gguggcacccagggcugg

SEQ ID NO: 28316 - RNA, 18 nt, Artificial Sequence
  Description of Artificial Sequence: Synthetic oligonucleotide
ggcuggguggcacccagg

SEQ ID NO: 28317 - RNA, 18 nt, Artificial Sequence
  Description of Artificial Sequence: Synthetic oligonucleotide
uaaguggcuggguggcac

SEQ ID NO: 28318 - RNA, 18 nt, Artificial Sequence
  Description of Artificial Sequence: Synthetic oligonucleotide
gacccuaaguggcugggu

SEQ ID NO: 28319 - RNA, 18 nt, Artificial Sequence
  Description of Artificial Sequence: Synthetic oligonucleotide
cuguagacccuaaguggc

SEQ ID NO: 28320 - RNA, 18 nt, Artificial Sequence
  Description of Artificial Sequence: Synthetic oligonucleotide
ccacccuguagacccuaa

SEQ ID NO: 28321 - RNA, 18 nt, Artificial Sequence
  Description of Artificial Sequence: Synthetic oligonucleotide
gagucccacccuguagac

SEQ ID NO: 28322 - RNA, 18 nt, Artificial Sequence
  Description of Artificial Sequence: Synthetic oligonucleotide
gucuggagucccacccug

SEQ ID NO: 28323 - RNA, 18 nt, Artificial Sequence
  Description of Artificial Sequence: Synthetic oligonucleotide
ucuaggucuggaguccca

SEQ ID NO: 28324 - RNA, 18 nt, Artificial Sequence
  Description of Artificial Sequence: Synthetic oligonucleotide
uacgcucuaggucuggag

SEQ ID NO: 28325 - RNA, 18 nt, Artificial Sequence
  Description of Artificial Sequence: Synthetic oligonucleotide
auacuuacgcucuagguc

SEQ ID NO: 28326 - RNA, 18 nt, Artificial Sequence
  Description of Artificial Sequence: Synthetic oligonucleotide
cauccauacuuacgcucu

SEQ ID NO: 28327 - RNA, 18 nt, Artificial Sequence
  Description of Artificial Sequence: Synthetic oligonucleotide
cacaacauccauacuuac

SEQ ID NO: 28328 - RNA, 18 nt, Artificial Sequence
  Description of Artificial Sequence: Synthetic oligonucleotide
agggccacaacauccaua

SEQ ID NO: 28329 - RNA, 18 nt, Artificial Sequence
  Description of Artificial Sequence: Synthetic oligonucleotide
gacacagggccacaacau

SEQ ID NO: 28330 - RNA, 18 nt, Artificial Sequence
  Description of Artificial Sequence: Synthetic oligonucleotide
aggaagacacagggccac

SEQ ID NO: 28331 - RNA, 18 nt, Artificial Sequence
  Description of Artificial Sequence: Synthetic oligonucleotide
acacuaggaagacacagg

SEQ ID NO: 28332 - RNA, 18 nt, Artificial Sequence
  Description of Artificial Sequence: Synthetic oligonucleotide
gggucacacuaggaagac

SEQ ID NO: 28333 - RNA, 18 nt, Artificial Sequence
  Description of Artificial Sequence: Synthetic oligonucleotide
uggcugggucacacuagg

SEQ ID NO: 28334 - RNA, 18 nt, Artificial Sequence
  Description of Artificial Sequence: Synthetic oligonucleotide
gcuccuggcugggucaca

SEQ ID NO: 28335 - RNA, 18 nt, Artificial Sequence
  Description of Artificial Sequence: Synthetic oligonucleotide
cuuccgcuccuggcuggg

SEQ ID NO: 28336 - RNA, 18 nt, Artificial Sequence
  Description of Artificial Sequence: Synthetic oligonucleotide
ugaagcuuccgcuccugg

SEQ ID NO: 28337 - RNA, 18 nt, Artificial Sequence
  Description of Artificial Sequence: Synthetic oligonucleotide
acgccugaagcuuccgcu

SEQ ID NO: 28338 - RNA, 18 nt, Artificial Sequence
  Description of Artificial Sequence: Synthetic oligonucleotide
uacaaacgccugaagcuu

SEQ ID NO: 28339 - RNA, 18 nt, Artificial Sequence
  Description of Artificial Sequence: Synthetic oligonucleotide
cacuuuacaaacgccuga

SEQ ID NO: 28340 - RNA, 18 nt, Artificial Sequence
  Description of Artificial Sequence: Synthetic oligonucleotide
gaccucacuuuacaaacg

SEQ ID NO: 28341 - RNA, 18 nt, Artificial Sequence
  Description of Artificial Sequence: Synthetic oligonucleotide
agccagaccucacuuuac

SEQ ID NO: 28342 - RNA, 18 nt, Artificial Sequence
  Description of Artificial Sequence: Synthetic oligonucleotide
ggcagagccagaccucac

SEQ ID NO: 28343 - RNA, 18 nt, Artificial Sequence
  Description of Artificial Sequence: Synthetic oligonucleotide
gaggaggcagagccagac

SEQ ID NO: 28344 - RNA, 18 nt, Artificial Sequence
  Description of Artificial Sequence: Synthetic oligonucleotide
aaacggaggaggcagagc

SEQ ID NO: 28345 - RNA, 18 nt, Artificial Sequence
  Description of Artificial Sequence: Synthetic oligonucleotide
aaaaaaaacggaggaggc

SEQ ID NO: 28346 - RNA, 18 nt, Artificial Sequence
  Description of Artificial Sequence: Synthetic oligonucleotide
aaaaaaaaaaaaacggag

SEQ ID NO: 28347 - RNA, 18 nt, Artificial Sequence
  Description of Artificial Sequence: Synthetic oligonucleotide
acagaaaaaaaaaaaaaa

SEQ ID NO: 28348 - RNA, 18 nt, Artificial Sequence
  Description of Artificial Sequence: Synthetic oligonucleotide
cagaaacagaaaaaaaaa

SEQ ID NO: 28349 - RNA, 18 nt, Artificial Sequence
  Description of Artificial Sequence: Synthetic oligonucleotide
agaaacagaaacagaaaa

SEQ ID NO: 28350 - RNA, 18 nt, Artificial Sequence
  Description of Artificial Sequence: Synthetic oligonucleotide
aaaacagaaacagaaaca

SEQ ID NO: 28351 - RNA, 18 nt, Artificial Sequence
  Description of Artificial Sequence: Synthetic oligonucleotide
aaaaaaaaacagaaacag

SEQ ID NO: 28352 - RNA, 18 nt, Artificial Sequence
  Description of Artificial Sequence: Synthetic oligonucleotide
ucucaaaaaaaaaacaga

SEQ ID NO: 28353 - RNA, 18 nt, Artificial Sequence
  Description of Artificial Sequence: Synthetic oligonucleotide
cuccaucucaaaaaaaaa

SEQ ID NO: 28354 - RNA, 18 nt, Artificial Sequence
  Description of Artificial Sequence: Synthetic oligonucleotide
cgagacuccaucucaaaa

SEQ ID NO: 28355 - RNA, 18 nt, Artificial Sequence
  Description of Artificial Sequence: Synthetic oligonucleotide
cagagcgagacuccaucu

SEQ ID NO: 28356 - RNA, 18 nt, Artificial Sequence
  Description of Artificial Sequence: Synthetic oligonucleotide
ggcgacagagcgagacuc

SEQ ID NO: 28357 - RNA, 18 nt, Artificial Sequence
  Description of Artificial Sequence: Synthetic oligonucleotide
gccugggcgacagagcga

SEQ ID NO: 28358 - RNA, 18 nt, Artificial Sequence
  Description of Artificial Sequence: Synthetic oligonucleotide
cuccagccugggcgacag

SEQ ID NO: 28359 - RNA, 18 nt, Artificial Sequence
  Description of Artificial Sequence: Synthetic oligonucleotide
cugcacuccagccugggc

SEQ ID NO: 28360 - RNA, 18 nt, Artificial Sequence
  Description of Artificial Sequence: Synthetic oligonucleotide
ugacacugcacuccagcc

SEQ ID NO: 28361 - RNA, 18 nt, Artificial Sequence
  Description of Artificial Sequence: Synthetic oligonucleotide
gaucgugacacugcacuc

SEQ ID NO: 28362 - RNA, 18 nt, Artificial Sequence
  Description of Artificial Sequence: Synthetic oligonucleotide
gcugagaucgugacacug

SEQ ID NO: 28363 - RNA, 18 nt, Artificial Sequence
  Description of Artificial Sequence: Synthetic oligonucleotide
agugagcugagaucguga

SEQ ID NO: 28364 - RNA, 18 nt, Artificial Sequence
  Description of Artificial Sequence: Synthetic oligonucleotide
guugcagugagcugagau

SEQ ID NO: 28365 - RNA, 18 nt, Artificial Sequence
  Description of Artificial Sequence: Synthetic oligonucleotide
cggagguugcagugagcu

SEQ ID NO: 28366 - RNA, 18 nt, Artificial Sequence
  Description of Artificial Sequence: Synthetic oligonucleotide
ggaggcggagguugcagu

SEQ ID NO: 28367 - RNA, 18 nt, Artificial Sequence
  Description of Artificial Sequence: Synthetic oligonucleotide
accugggaggcggagguu

SEQ ID NO: 28368 - RNA, 18 nt, Artificial Sequence
  Description of Artificial Sequence: Synthetic oligonucleotide
cuuguaccugggaggcgg

SEQ ID NO: 28369 - RNA, 18 nt, Artificial Sequence
  Description of Artificial Sequence: Synthetic oligonucleotide
aaucucuuguaccuggga

SEQ ID NO: 28370 - RNA, 18 nt, Artificial Sequence
  Description of Artificial Sequence: Synthetic oligonucleotide
aggagaaucucuuguacc

SEQ ID NO: 28371 - RNA, 18 nt, Artificial Sequence
  Description of Artificial Sequence: Synthetic oligonucleotide
gaggcaggagaaucucuu

SEQ ID NO: 28372 - RNA, 18 nt, Artificial Sequence
  Description of Artificial Sequence: Synthetic oligonucleotide
aggcugaggcaggagaau

SEQ ID NO: 28373 - RNA, 18 nt, Artificial Sequence
  Description of Artificial Sequence: Synthetic oligonucleotide
ucgggaggcugaggcagg

SEQ ID NO: 28374 - RNA, 18 nt, Artificial Sequence
  Description of Artificial Sequence: Synthetic oligonucleotide
gcuacucgggaggcugag

SEQ ID NO: 28375 - RNA, 18 nt, Artificial Sequence
  Description of Artificial Sequence: Synthetic oligonucleotide
ucccagcuacucgggagg

SEQ ID NO: 28376 - RNA, 18 nt, Artificial Sequence
  Description of Artificial Sequence: Synthetic oligonucleotide
uguagucccagcuacucg

SEQ ID NO: 28377 - RNA, 18 nt, Artificial Sequence
  Description of Artificial Sequence: Synthetic oligonucleotide
acgccuguagucccagcu

SEQ ID NO: 28378 - RNA, 18 nt, Artificial Sequence
  Description of Artificial Sequence: Synthetic oligonucleotide
ggcacacgccuguagucc

SEQ ID NO: 28379 - RNA, 18 nt, Artificial Sequence
  Description of Artificial Sequence: Synthetic oligonucleotide
augguggcacacgccugu

SEQ ID NO: 28380 - RNA, 18 nt, Artificial Sequence
  Description of Artificial Sequence: Synthetic oligonucleotide
caggcaugguggcacacg

SEQ ID NO: 28381 - RNA, 18 nt, Artificial Sequence
  Description of Artificial Sequence: Synthetic oligonucleotide
uuagccaggcaugguggc

SEQ ID NO: 28382 - RNA, 18 nt, Artificial Sequence
  Description of Artificial Sequence: Synthetic oligonucleotide
aaaaauuagccaggcaug

SEQ ID NO: 28383 - RNA, 18 nt, Artificial Sequence
  Description of Artificial Sequence: Synthetic oligonucleotide
aauacaaaaauuagccag

SEQ ID NO: 28384 - RNA, 18 nt, Artificial Sequence
  Description of Artificial Sequence: Synthetic oligonucleotide
cuaaaaauacaaaaauua

SEQ ID NO: 28385 - RNA, 18 nt, Artificial Sequence
  Description of Artificial Sequence: Synthetic oligonucleotide
cucuacuaaaaauacaaa

SEQ ID NO: 28386 - RNA, 18 nt, Artificial Sequence
  Description of Artificial Sequence: Synthetic oligonucleotide
cccaucucuacuaaaaau

SEQ ID NO: 28387 - RNA, 18 nt, Artificial Sequence
  Description of Artificial Sequence: Synthetic oligonucleotide
gaaaccccaucucuacua

SEQ ID NO: 28388 - RNA, 18 nt, Artificial Sequence
  Description of Artificial Sequence: Synthetic oligonucleotide
auggcgaaaccccaucuc

SEQ ID NO: 28389 - RNA, 18 nt, Artificial Sequence
  Description of Artificial Sequence: Synthetic oligonucleotide
cuaacauggcgaaacccc

SEQ ID NO: 28390 - RNA, 18 nt, Artificial Sequence
  Description of Artificial Sequence: Synthetic oligonucleotide
ucuggcuaacauggcgaa

SEQ ID NO: 28391 - RNA, 18 nt, Artificial Sequence
  Description of Artificial Sequence: Synthetic oligonucleotide
accagucuggcuaacaug

SEQ ID NO: 28392 - RNA, 18 nt, Artificial Sequence
  Description of Artificial Sequence: Synthetic oligonucleotide
ucgagaccagucuggcua

SEQ ID NO: 28393 - RNA, 18 nt, Artificial Sequence
  Description of Artificial Sequence: Synthetic oligonucleotide
ggaguucgagaccagucu

SEQ ID NO: 28394 - RNA, 18 nt, Artificial Sequence
  Description of Artificial Sequence: Synthetic oligonucleotide
ggucaggaguucgagacc

SEQ ID NO: 28395 - RNA, 18 nt, Artificial Sequence
  Description of Artificial Sequence: Synthetic oligonucleotide
ccugaggucaggaguucg

SEQ ID NO: 28396 - RNA, 18 nt, Artificial Sequence
  Description of Artificial Sequence: Synthetic oligonucleotide
gaucaccugaggucagga

SEQ ID NO: 28397 - RNA, 18 nt, Artificial Sequence
  Description of Artificial Sequence: Synthetic oligonucleotide
gggaggaucaccugaggu

SEQ ID NO: 28398 - RNA, 18 nt, Artificial Sequence
  Description of Artificial Sequence: Synthetic oligonucleotide
gggugggaggaucaccug

SEQ ID NO: 28399 - RNA, 18 nt, Artificial Sequence
  Description of Artificial Sequence: Synthetic oligonucleotide
gaacuuugggaagccggg

SEQ ID NO: 28400 - RNA, 18 nt, Artificial Sequence
  Description of Artificial Sequence: Synthetic oligonucleotide
ucccagaacuuugggaag

SEQ ID NO: 28401 - RNA, 18 nt, Artificial Sequence
  Description of Artificial Sequence: Synthetic oligonucleotide
uauaaucccagaacuuug

SEQ ID NO: 28402 - RNA, 18 nt, Artificial Sequence
  Description of Artificial Sequence: Synthetic oligonucleotide
acgccuauaaucccagaa

SEQ ID NO: 28403 - RNA, 18 nt, Artificial Sequence
  Description of Artificial Sequence: Synthetic oligonucleotide
ggcucacgccuauaaucc

SEQ ID NO: 28404 - RNA, 18 nt, Artificial Sequence
  Description of Artificial Sequence: Synthetic oligonucleotide
augguggcucacgccuau

SEQ ID NO: 28405 - RNA, 18 nt, Artificial Sequence
  Description of Artificial Sequence: Synthetic oligonucleotide
cgggcaugguggcucacg

SEQ ID NO: 28406 - RNA, 18 nt, Artificial Sequence
  Description of Artificial Sequence: Synthetic oligonucleotide
gagaccgggcaugguggc

SEQ ID NO: 28407 - RNA, 18 nt, Artificial Sequence
  Description of Artificial Sequence: Synthetic oligonucleotide
gagaagagaccgggcaug

SEQ ID NO: 28408 - RNA, 18 nt, Artificial Sequence
  Description of Artificial Sequence: Synthetic oligonucleotide
agacugagaagagaccgg

SEQ ID NO: 28409 - RNA, 18 nt, Artificial Sequence
  Description of Artificial Sequence: Synthetic oligonucleotide
cuucaagacugagaagag

SEQ ID NO: 28410 - RNA, 18 nt, Artificial Sequence
  Description of Artificial Sequence: Synthetic oligonucleotide
augggcuucaagacugag

SEQ ID NO: 28411 - RNA, 18 nt, Artificial Sequence
  Description of Artificial Sequence: Synthetic oligonucleotide
cagggaugggcuucaaga

SEQ ID NO: 28412 - RNA, 18 nt, Artificial Sequence
  Description of Artificial Sequence: Synthetic oligonucleotide
aaauccagggaugggcuu

SEQ ID NO: 28413 - RNA, 18 nt, Artificial Sequence
  Description of Artificial Sequence: Synthetic oligonucleotide
gguggaaauccagggaug

SEQ ID NO: 28414 - RNA, 18 nt, Artificial Sequence
  Description of Artificial Sequence: Synthetic oligonucleotide
cuccugguggaaauccag

SEQ ID NO: 28415 - RNA, 18 nt, Artificial Sequence
  Description of Artificial Sequence: Synthetic oligonucleotide
aguaacuccugguggaaa

SEQ ID NO: 28416 - RNA, 18 nt, Artificial Sequence
  Description of Artificial Sequence: Synthetic oligonucleotide
aggaaaguaacuccuggu

SEQ ID NO: 28417 - RNA, 18 nt, Artificial Sequence
  Description of Artificial Sequence: Synthetic oligonucleotide
ucaggaggaaaguaacuc

SEQ ID NO: 28418 - RNA, 18 nt, Artificial Sequence
  Description of Artificial Sequence: Synthetic oligonucleotide
acaggucaggaggaaagu

SEQ ID NO: 28419 - RNA, 18 nt, Artificial Sequence
  Description of Artificial Sequence: Synthetic oligonucleotide
aauuuacaggucaggagg

SEQ ID NO: 28420 - RNA, 18 nt, Artificial Sequence
  Description of Artificial Sequence: Synthetic oligonucleotide
gaacaaauuuacagguca

SEQ ID NO: 28421 - RNA, 18 nt, Artificial Sequence
  Description of Artificial Sequence: Synthetic oligonucleotide
uuaaagaacaaauuuaca

SEQ ID NO: 28422 - RNA, 18 nt, Artificial Sequence
  Description of Artificial Sequence: Synthetic oligonucleotide
cauuguuaaagaacaaau

SEQ ID NO: 28423 - RNA, 18 nt, Artificial Sequence
  Description of Artificial Sequence: Synthetic oligonucleotide
gcagccauuguuaaagaa

SEQ ID NO: 28424 - RNA, 18 nt, Artificial Sequence
  Description of Artificial Sequence: Synthetic oligonucleotide
caccugcagccauuguua

SEQ ID NO: 28425 - RNA, 18 nt, Artificial Sequence
  Description of Artificial Sequence: Synthetic oligonucleotide
gcucccaccugcagccau

SEQ ID NO: 28426 - RNA, 18 nt, Artificial Sequence
  Description of Artificial Sequence: Synthetic oligonucleotide
cauaugcucccaccugca

SEQ ID NO: 28427 - RNA, 18 nt, Artificial Sequence
  Description of Artificial Sequence: Synthetic oligonucleotide
accaccauaugcucccac

SEQ ID NO: 28428 - RNA, 18 nt, Artificial Sequence
  Description of Artificial Sequence: Synthetic oligonucleotide
uauaaaccaccauaugcu

SEQ ID NO: 28429 - RNA, 18 nt, Artificial Sequence
  Description of Artificial Sequence: Synthetic oligonucleotide
guuuuuauaaaccaccau

SEQ ID NO: 28430 - RNA, 18 nt, Artificial Sequence
  Description of Artificial Sequence: Synthetic oligonucleotide
acagcguuuuuauaaacc

SEQ ID NO: 28431 - RNA, 18 nt, Artificial Sequence
  Description of Artificial Sequence: Synthetic oligonucleotide
gcccgacagcguuuuuau

SEQ ID NO: 28432 - RNA, 18 nt, Artificial Sequence
  Description of Artificial Sequence: Synthetic oligonucleotide
acaaagcccgacagcguu

SEQ ID NO: 28433 - RNA, 18 nt, Artificial Sequence
  Description of Artificial Sequence: Synthetic oligonucleotide
aggaaacaaagcccgaca

SEQ ID NO: 28434 - RNA, 18 nt, Artificial Sequence
  Description of Artificial Sequence: Synthetic oligonucleotide
aaagaaggaaacaaagcc

SEQ ID NO: 28435 - RNA, 18 nt, Artificial Sequence
  Description of Artificial Sequence: Synthetic oligonucleotide
cagcuaaagaaggaaaca

SEQ ID NO: 28436 - RNA, 18 nt, Artificial Sequence
  Description of Artificial Sequence: Synthetic oligonucleotide
cacggcagcuaaagaagg

SEQ ID NO: 28437 - RNA, 18 nt, Artificial Sequence
  Description of Artificial Sequence: Synthetic oligonucleotide
guagacacggcagcuaaa

SEQ ID NO: 28438 - RNA, 18 nt, Artificial Sequence
  Description of Artificial Sequence: Synthetic oligonucleotide
cagaaguagacacggcag

SEQ ID NO: 28439 - RNA, 18 nt, Artificial Sequence
  Description of Artificial Sequence: Synthetic oligonucleotide
gacuucagaaguagacac

SEQ ID NO: 28440 - RNA, 18 nt, Artificial Sequence
  Description of Artificial Sequence: Synthetic oligonucleotide
ucccagacuucagaagua

SEQ ID NO: 28441 - RNA, 18 nt, Artificial Sequence
  Description of Artificial Sequence: Synthetic oligonucleotide
gcacuucccagacuucag

SEQ ID NO: 28442 - RNA, 18 nt, Artificial Sequence
  Description of Artificial Sequence: Synthetic oligonucleotide
gcuuggcacuucccagac

SEQ ID NO: 28443 - RNA, 18 nt, Artificial Sequence
  Description of Artificial Sequence: Synthetic oligonucleotide
gcguggcuuggcacuucc

SEQ ID NO: 28444 - RNA, 18 nt, Artificial Sequence
  Description of Artificial Sequence: Synthetic oligonucleotide
aggccgcguggcuuggca

SEQ ID NO: 28445 - RNA, 18 nt, Artificial Sequence
  Description of Artificial Sequence: Synthetic oligonucleotide
ccuugaggccgcguggcu

SEQ ID NO: 28446 - RNA, 18 nt, Artificial Sequence
  Description of Artificial Sequence: Synthetic oligonucleotide
agcucccuugaggccgcg

SEQ ID NO: 28447 - RNA, 18 nt, Artificial Sequence
  Description of Artificial Sequence: Synthetic oligonucleotide
cagccagcucccuugagg

SEQ ID NO: 28448 - RNA, 18 nt, Artificial Sequence
  Description of Artificial Sequence: Synthetic oligonucleotide
aacaccagccagcucccu

SEQ ID NO: 28449 - RNA, 18 nt, Artificial Sequence
  Description of Artificial Sequence: Synthetic oligonucleotide
gcucaaacaccagccagc

SEQ ID NO: 28450 - RNA, 18 nt, Artificial Sequence
  Description of Artificial Sequence: Synthetic oligonucleotide
ccacagcucaaacaccag

SEQ ID NO: 28451 - RNA, 18 nt, Artificial Sequence
  Description of Artificial Sequence: Synthetic oligonucleotide
uucugccacagcucaaac

SEQ ID NO: 28452 - RNA, 18 nt, Artificial Sequence
  Description of Artificial Sequence: Synthetic oligonucleotide
ggugcuucugccacagcu

SEQ ID NO: 28453 - RNA, 18 nt, Artificial Sequence
  Description of Artificial Sequence: Synthetic oligonucleotide
ccccaggugcuucugcca

SEQ ID NO: 28454 - RNA, 18 nt, Artificial Sequence
  Description of Artificial Sequence: Synthetic oligonucleotide
uggagccccaggugcuuc

SEQ ID NO: 28455 - RNA, 18 nt, Artificial Sequence
  Description of Artificial Sequence: Synthetic oligonucleotide
cucccuggagccccaggu

SEQ ID NO: 28456 - RNA, 18 nt, Artificial Sequence
  Description of Artificial Sequence: Synthetic oligonucleotide
gccugcucccuggagccc

SEQ ID NO: 28457 - RNA, 18 nt, Artificial Sequence
  Description of Artificial Sequence: Synthetic oligonucleotide
ucccagccugcucccugg

SEQ ID NO: 28458 - RNA, 18 nt, Artificial Sequence
  Description of Artificial Sequence: Synthetic oligonucleotide
gcaguucccagccugcuc

SEQ ID NO: 28459 - RNA, 18 nt, Artificial Sequence
  Description of Artificial Sequence: Synthetic oligonucleotide
guccugcaguucccagcc

SEQ ID NO: 28460 - RNA, 18 nt, Artificial Sequence
  Description of Artificial Sequence: Synthetic oligonucleotide
gcaagguccugcaguucc

SEQ ID NO: 28461 - RNA, 18 nt, Artificial Sequence
  Description of Artificial Sequence: Synthetic oligonucleotide
gcugagcaagguccugca

SEQ ID NO: 28462 - RNA, 18 nt, Artificial Sequence
  Description of Artificial Sequence: Synthetic oligonucleotide
uccuggcugagcaagguc

SEQ ID NO: 28463 - RNA, 18 nt, Artificial Sequence
  Description of Artificial Sequence: Synthetic oligonucleotide
agugcuccuggcugagca

SEQ ID NO: 28464 - RNA, 18 nt, Artificial Sequence
  Description of Artificial Sequence: Synthetic oligonucleotide
gggaagugcuccuggcug

SEQ ID NO: 28465 - RNA, 18 nt, Artificial Sequence
  Description of Artificial Sequence: Synthetic oligonucleotide
uuccugccucaaggaggg

SEQ ID NO: 28466 - RNA, 18 nt, Artificial Sequence
  Description of Artificial Sequence: Synthetic oligonucleotide
caguauuccugccucaag

SEQ ID NO: 28467 - RNA, 18 nt, Artificial Sequence
  Description of Artificial Sequence: Synthetic oligonucleotide
caccucaguauuccugcc

SEQ ID NO: 28468 - RNA, 18 nt, Artificial Sequence
  Description of Artificial Sequence: Synthetic oligonucleotide
ggaggcaccucaguauuc

SEQ ID NO: 28469 - RNA, 18 nt, Artificial Sequence
  Description of Artificial Sequence: Synthetic oligonucleotide
gggaggcaccucaguauu

SEQ ID NO: 28470 - RNA, 18 nt, Artificial Sequence
  Description of Artificial Sequence: Synthetic oligonucleotide
accuucuccaucuguggg

SEQ ID NO: 28471 - RNA, 18 nt, Artificial Sequence
  Description of Artificial Sequence: Synthetic oligonucleotide
ucuccaccuucuccaucu

SEQ ID NO: 28472 - RNA, 18 nt, Artificial Sequence
  Description of Artificial Sequence: Synthetic oligonucleotide
ccuccucuccaccuucuc

SEQ ID NO: 28473 - RNA, 18 nt, Artificial Sequence
  Description of Artificial Sequence: Synthetic oligonucleotide
cccauccuccucuccacc

SEQ ID NO: 28474 - RNA, 18 nt, Artificial Sequence
  Description of Artificial Sequence: Synthetic oligonucleotide
ugaggcccauccuccucu

SEQ ID NO: 28475 - RNA, 18 nt, Artificial Sequence
  Description of Artificial Sequence: Synthetic oligonucleotide
gcuccugaggcccauccu

SEQ ID NO: 28476 - RNA, 18 nt, Artificial Sequence
  Description of Artificial Sequence: Synthetic oligonucleotide
gagaugcuccugaggccc

SEQ ID NO: 28477 - RNA, 18 nt, Artificial Sequence
  Description of Artificial Sequence: Synthetic oligonucleotide
ggcuugagaugcuccuga

SEQ ID NO: 28478 - RNA, 18 nt, Artificial Sequence
  Description of Artificial Sequence: Synthetic oligonucleotide
gggcuugagaugcuccug

SEQ ID NO: 28479 - RNA, 18 nt, Artificial Sequence
  Description of Artificial Sequence: Synthetic oligonucleotide
cuuucuccugcuacuggg

SEQ ID NO: 28480 - RNA, 18 nt, Artificial Sequence
  Description of Artificial Sequence: Synthetic oligonucleotide
ucuuucuuucuccugcua

SEQ ID NO: 28481 - RNA, 18 nt, Artificial Sequence
  Description of Artificial Sequence: Synthetic oligonucleotide
cucuuucuuucuuucucc

SEQ ID NO: 28482 - RNA, 18 nt, Artificial Sequence
  Description of Artificial Sequence: Synthetic oligonucleotide
ggcaucucuuucuuucuu

SEQ ID NO: 28483 - RNA, 18 nt, Artificial Sequence
  Description of Artificial Sequence: Synthetic oligonucleotide
aaccaggcaucucuuucu

SEQ ID NO: 28484 - RNA, 18 nt, Artificial Sequence
  Description of Artificial Sequence: Synthetic oligonucleotide
gugaaaaccaggcaucuc

SEQ ID NO: 28485 - RNA, 18 nt, Artificial Sequence
  Description of Artificial Sequence: Synthetic oligonucleotide
agucugugaaaaccaggc

SEQ ID NO: 28486 - RNA, 18 nt, Artificial Sequence
  Description of Artificial Sequence: Synthetic oligonucleotide
gaaccagucugugaaaac

SEQ ID NO: 28487 - RNA, 18 nt, Artificial Sequence
  Description of Artificial Sequence: Synthetic oligonucleotide
cacaggaaccagucugug

SEQ ID NO: 28488 - RNA, 18 nt, Artificial Sequence
  Description of Artificial Sequence: Synthetic oligonucleotide
ccagccacaggaaccagu

SEQ ID NO: 28489 - RNA, 18 nt, Artificial Sequence
  Description of Artificial Sequence: Synthetic oligonucleotide
ucaucccagccacaggaa

SEQ ID NO: 28490 - RNA, 18 nt, Artificial Sequence
  Description of Artificial Sequence: Synthetic oligonucleotide
ugcagucaucccagccac

SEQ ID NO: 28491 - RNA, 18 nt, Artificial Sequence
  Description of Artificial Sequence: Synthetic oligonucleotide
aaggaugcagucauccca

SEQ ID NO: 28492 - RNA, 18 nt, Artificial Sequence
  Description of Artificial Sequence: Synthetic oligonucleotide
aaaaaaaggaugcaguca

SEQ ID NO: 28493 - RNA, 18 nt, Artificial Sequence
  Description of Artificial Sequence: Synthetic oligonucleotide
aaaaaaaaaaaaggaugc

SEQ ID NO: 28494 - RNA, 18 nt, Artificial Sequence
  Description of Artificial Sequence: Synthetic oligonucleotide
caaaaaaaaaaaaaaaag

SEQ ID NO: 28495 - RNA, 18 nt, Artificial Sequence
  Description of Artificial Sequence: Synthetic oligonucleotide
cgucucaaaaaaaaaaaa

SEQ ID NO: 28496 - RNA, 18 nt, Artificial Sequence
  Description of Artificial Sequence: Synthetic oligonucleotide
aacuccgucucaaaaaaa

SEQ ID NO: 28497 - RNA, 18 nt, Artificial Sequence
  Description of Artificial Sequence: Synthetic oligonucleotide
gcaaaaacuccgucucaa

SEQ ID NO: 28498 - RNA, 18 nt, Artificial Sequence
  Description of Artificial Sequence: Synthetic oligonucleotide
caaaggcaaaaacuccgu

SEQ ID NO: 28499 - RNA, 18 nt, Artificial Sequence
  Description of Artificial Sequence: Synthetic oligonucleotide
ggcgacaaaggcaaaaac

SEQ ID NO: 28500 - RNA, 18 nt, Artificial Sequence
  Description of Artificial Sequence: Synthetic oligonucleotide
gccugggcgacaaaggca

SEQ ID NO: 28501 - RNA, 18 nt, Artificial Sequence
  Description of Artificial Sequence: Synthetic oligonucleotide
cuccagccugggcgacaa

SEQ ID NO: 28502 - RNA, 18 nt, Artificial Sequence
  Description of Artificial Sequence: Synthetic oligonucleotide
uugcacuccagccugggc

SEQ ID NO: 28503 - RNA, 18 nt, Artificial Sequence
  Description of Artificial Sequence: Synthetic oligonucleotide
cgccauugcacuccagcc

SEQ ID NO: 28504 - RNA, 18 nt, Artificial Sequence
  Description of Artificial Sequence: Synthetic oligonucleotide
gaucacgccauugcacuc

SEQ ID NO: 28505 - RNA, 18 nt, Artificial Sequence
  Description of Artificial Sequence: Synthetic oligonucleotide
gccgagaucacgccauug

SEQ ID NO: 28506 - RNA, 18 nt, Artificial Sequence
  Description of Artificial Sequence: Synthetic oligonucleotide
ggugagccgagaucacgc

SEQ ID NO: 28507 - RNA, 18 nt, Artificial Sequence
  Description of Artificial Sequence: Synthetic oligonucleotide
guugcggugagccgagau

SEQ ID NO: 28508 - RNA, 18 nt, Artificial Sequence
  Description of Artificial Sequence: Synthetic oligonucleotide
cggagguugcggugagcc

SEQ ID NO: 28509 - RNA, 18 nt, Artificial Sequence
  Description of Artificial Sequence: Synthetic oligonucleotide
ggaggcggagguugcggu

SEQ ID NO: 28510 - RNA, 18 nt, Artificial Sequence
  Description of Artificial Sequence: Synthetic oligonucleotide
auccgggaggcggagguu

SEQ ID NO: 28511 - RNA, 18 nt, Artificial Sequence
  Description of Artificial Sequence: Synthetic oligonucleotide
cuugaauccgggaggcgg

SEQ ID NO: 28512 - RNA, 18 nt, Artificial Sequence
  Description of Artificial Sequence: Synthetic oligonucleotide
aauugcuugaauccggga

SEQ ID NO: 28513 - RNA, 18 nt, Artificial Sequence
  Description of Artificial Sequence: Synthetic oligonucleotide
aggagaauugcuugaauc

SEQ ID NO: 28514 - RNA, 18 nt, Artificial Sequence
  Description of Artificial Sequence: Synthetic oligonucleotide
gaggcaggagaauugcuu

SEQ ID NO: 28515 - RNA, 18 nt, Artificial Sequence
  Description of Artificial Sequence: Synthetic oligonucleotide
aggcugaggcaggagaau

SEQ ID NO: 28516 - RNA, 18 nt, Artificial Sequence
  Description of Artificial Sequence: Synthetic oligonucleotide
ucgggaggcugaggcagg

SEQ ID NO: 28517 - RNA, 18 nt, Artificial Sequence
  Description of Artificial Sequence: Synthetic oligonucleotide
gcuacucgggaggcugag

SEQ ID NO: 28518 - RNA, 18 nt, Artificial Sequence
  Description of Artificial Sequence: Synthetic oligonucleotide
ucccagcuacucgggagg

SEQ ID NO: 28519 - RNA, 18 nt, Artificial Sequence
  Description of Artificial Sequence: Synthetic oligonucleotide
uguaaucccagcuacucg

SEQ ID NO: 28520 - RNA, 18 nt, Artificial Sequence
  Description of Artificial Sequence: Synthetic oligonucleotide
gugccuguaaucccagcu

SEQ ID NO: 28521 - RNA, 18 nt, Artificial Sequence
  Description of Artificial Sequence: Synthetic oligonucleotide
ggugcgugccuguaaucc

SEQ ID NO: 28522 - RNA, 18 nt, Artificial Sequence
  Description of Artificial Sequence: Synthetic oligonucleotide
guggaggugcgugccugu

SEQ ID NO: 28523 - RNA, 18 nt, Artificial Sequence
  Description of Artificial Sequence: Synthetic oligonucleotide
cggacguggaggugcgug

SEQ ID NO: 28524 - RNA, 18 nt, Artificial Sequence
  Description of Artificial Sequence: Synthetic oligonucleotide
uuagccggacguggaggu

SEQ ID NO: 28525 - RNA, 18 nt, Artificial Sequence
  Description of Artificial Sequence: Synthetic oligonucleotide
caaaauuagccggacgug

SEQ ID NO: 28526 - RNA, 18 nt, Artificial Sequence
  Description of Artificial Sequence: Synthetic oligonucleotide
aaauacaaaauuagccgg

SEQ ID NO: 28527 - RNA, 18 nt, Artificial Sequence
  Description of Artificial Sequence: Synthetic oligonucleotide
acuaaaaauacaaaauua

SEQ ID NO: 28528 - RNA, 18 nt, Artificial Sequence
  Description of Artificial Sequence: Synthetic oligonucleotide
ucuccacuaaaaauacaa

SEQ ID NO: 28529 - RNA, 18 nt, Artificial Sequence
  Description of Artificial Sequence: Synthetic oligonucleotide
ccccgucuccacuaaaaa

SEQ ID NO: 28530 - RNA, 18 nt, Artificial Sequence
  Description of Artificial Sequence: Synthetic oligonucleotide
agaaaccccgucuccacu

SEQ ID NO: 28531 - RNA, 18 nt, Artificial Sequence
  Description of Artificial Sequence: Synthetic oligonucleotide
cauggagaaaccccgucu

SEQ ID NO: 28532 - RNA, 18 nt, Artificial Sequence
  Description of Artificial Sequence: Synthetic oligonucleotide
accgacauggagaaaccc

SEQ ID NO: 28533 - RNA, 18 nt, Artificial Sequence
  Description of Artificial Sequence: Synthetic oligonucleotide
gccugaccgacauggaga

SEQ ID NO: 28534 - RNA, 18 nt, Artificial Sequence
  Description of Artificial Sequence: Synthetic oligonucleotide
gaccagccugaccgacau

SEQ ID NO: 28535 - RNA, 18 nt, Artificial Sequence
  Description of Artificial Sequence: Synthetic oligonucleotide
uucgagaccagccugacc

SEQ ID NO: 28536 - RNA, 18 nt, Artificial Sequence
  Description of Artificial Sequence: Synthetic oligonucleotide
gggaguucgagaccagcc

SEQ ID NO: 28537 - RNA, 18 nt, Artificial Sequence
  Description of Artificial Sequence: Synthetic oligonucleotide
aggucgggaguucgagac

SEQ ID NO: 28538 - RNA, 18 nt, Artificial Sequence
  Description of Artificial Sequence: Synthetic oligonucleotide
accugaggucgggaguuc

SEQ ID NO: 28539 - RNA, 18 nt, Artificial Sequence
  Description of Artificial Sequence: Synthetic oligonucleotide
agaucaccugaggucggg

SEQ ID NO: 28540 - RNA, 18 nt, Artificial Sequence
  Description of Artificial Sequence: Synthetic oligonucleotide
ugggcagaucaccugagg

SEQ ID NO: 28541 - RNA, 18 nt, Artificial Sequence
  Description of Artificial Sequence: Synthetic oligonucleotide
cgaggugggcagaucacc

SEQ ID NO: 28542 - RNA, 18 nt, Artificial Sequence
  Description of Artificial Sequence: Synthetic oligonucleotide
gaggccgaggugggcaga

SEQ ID NO: 28543 - RNA, 18 nt, Artificial Sequence
  Description of Artificial Sequence: Synthetic oligonucleotide
uuugggaggccgaggugg

SEQ ID NO: 28544 - RNA, 18 nt, Artificial Sequence
  Description of Artificial Sequence: Synthetic oligonucleotide
agcacuuugggaggccga

SEQ ID NO: 28545 - RNA, 18 nt, Artificial Sequence
  Description of Artificial Sequence: Synthetic oligonucleotide
aucccagcacuuugggag

SEQ ID NO: 28546 - RNA, 18 nt, Artificial Sequence
  Description of Artificial Sequence: Synthetic oligonucleotide
cuguaaucccagcacuuu

SEQ ID NO: 28547 - RNA, 18 nt, Artificial Sequence
  Description of Artificial Sequence: Synthetic oligonucleotide
caugccuguaaucccagc

SEQ ID NO: 28548 - RNA, 18 nt, Artificial Sequence
  Description of Artificial Sequence: Synthetic oligonucleotide
uggcucaugccuguaauc

SEQ ID NO: 28549 - RNA, 18 nt, Artificial Sequence
  Description of Artificial Sequence: Synthetic oligonucleotide
cgcgguggcucaugccug

SEQ ID NO: 28550 - RNA, 18 nt, Artificial Sequence
  Description of Artificial Sequence: Synthetic oligonucleotide
ccaagcgcgguggcucau

SEQ ID NO: 28551 - RNA, 18 nt, Artificial Sequence
  Description of Artificial Sequence: Synthetic oligonucleotide
ucuggccaagcgcggugg

SEQ ID NO: 28552 - RNA, 18 nt, Artificial Sequence
  Description of Artificial Sequence: Synthetic oligonucleotide
cgcagucuggccaagcgc

SEQ ID NO: 28553 - RNA, 18 nt, Artificial Sequence
  Description of Artificial Sequence: Synthetic oligonucleotide
aaggacgcagucuggcca

SEQ ID NO: 28554 - RNA, 18 nt, Artificial Sequence
  Description of Artificial Sequence: Synthetic oligonucleotide
uuaaaaaggacgcagucu

SEQ ID NO: 28555 - RNA, 18 nt, Artificial Sequence
  Description of Artificial Sequence: Synthetic oligonucleotide
uucgcuuaaaaaggacgc

SEQ ID NO: 28556 - RNA, 18 nt, Artificial Sequence
  Description of Artificial Sequence: Synthetic oligonucleotide
aaauguucgcuuaaaaag

SEQ ID NO: 28557 - RNA, 18 nt, Artificial Sequence
  Description of Artificial Sequence: Synthetic oligonucleotide
cccuaaaauguucgcuua

SEQ ID NO: 28558 - RNA, 18 nt, Artificial Sequence
  Description of Artificial Sequence: Synthetic oligonucleotide
ccaggcccuaaaauguuc

SEQ ID NO: 28559 - RNA, 18 nt, Artificial Sequence
  Description of Artificial Sequence: Synthetic oligonucleotide
aacucccaggcccuaaaa

SEQ ID NO: 28560 - RNA, 18 nt, Artificial Sequence
  Description of Artificial Sequence: Synthetic oligonucleotide
ugacaaacucccaggccc

SEQ ID NO: 28561 - RNA, 18 nt, Artificial Sequence
  Description of Artificial Sequence: Synthetic oligonucleotide
uuacuugacaaacuccca

SEQ ID NO: 28562 - RNA, 18 nt, Artificial Sequence
  Description of Artificial Sequence: Synthetic oligonucleotide
cuuccuuacuugacaaac

SEQ ID NO: 28563 - RNA, 18 nt, Artificial Sequence
  Description of Artificial Sequence: Synthetic oligonucleotide
ugagacuuccuuacuuga

SEQ ID NO: 28564 - RNA, 18 nt, Artificial Sequence
  Description of Artificial Sequence: Synthetic oligonucleotide
gggcuugagacuuccuua

SEQ ID NO: 28565 - RNA, 18 nt, Artificial Sequence
  Description of Artificial Sequence: Synthetic oligonucleotide
ucuuugggcuugagacuu

SEQ ID NO: 28566 - RNA, 18 nt, Artificial Sequence
  Description of Artificial Sequence: Synthetic oligonucleotide
gcugcucuuugggcuuga

SEQ ID NO: 28567 - RNA, 18 nt, Artificial Sequence
  Description of Artificial Sequence: Synthetic oligonucleotide
aggacgcugcucuuuggg

SEQ ID NO: 28568 - RNA, 18 nt, Artificial Sequence
  Description of Artificial Sequence: Synthetic oligonucleotide
uggucaggacgcugcucu

SEQ ID NO: 28569 - RNA, 18 nt, Artificial Sequence
  Description of Artificial Sequence: Synthetic oligonucleotide
caccauggucaggacgcu

SEQ ID NO: 28570 - RNA, 18 nt, Artificial Sequence
  Description of Artificial Sequence: Synthetic oligonucleotide
gaaaccaccauggucagg

SEQ ID NO: 28571 - RNA, 18 nt, Artificial Sequence
  Description of Artificial Sequence: Synthetic oligonucleotide
guaaugaaaccaccaugg

SEQ ID NO: 28572 - RNA, 18 nt, Artificial Sequence
  Description of Artificial Sequence: Synthetic oligonucleotide
ggcucguaaugaaaccac

SEQ ID NO: 28573 - RNA, 18 nt, Artificial Sequence
  Description of Artificial Sequence: Synthetic oligonucleotide
agaagggcucguaaugaa

SEQ ID NO: 28574 - RNA, 18 nt, Artificial Sequence
  Description of Artificial Sequence: Synthetic oligonucleotide
ccagcagaagggcucgua

SEQ ID NO: 28575 - RNA, 18 nt, Artificial Sequence
  Description of Artificial Sequence: Synthetic oligonucleotide
gagagccagcagaagggc

SEQ ID NO: 28576 - RNA, 18 nt, Artificial Sequence
  Description of Artificial Sequence: Synthetic oligonucleotide
ugccugagagccagcaga

SEQ ID NO: 28577 - RNA, 18 nt, Artificial Sequence
  Description of Artificial Sequence: Synthetic oligonucleotide
gcuucugccugagagcca

SEQ ID NO: 28578 - RNA, 18 nt, Artificial Sequence
  Description of Artificial Sequence: Synthetic oligonucleotide
gggcuucugccugagagc

SEQ ID NO: 28579 - RNA, 18 nt, Artificial Sequence
  Description of Artificial Sequence: Synthetic oligonucleotide
uggucccggugcuguggg

SEQ ID NO: 28580 - RNA, 18 nt, Artificial Sequence
  Description of Artificial Sequence: Synthetic oligonucleotide
augaauggucccggugcu

SEQ ID NO: 28581 - RNA, 18 nt, Artificial Sequence
  Description of Artificial Sequence: Synthetic oligonucleotide
accucaugaauggucccg

SEQ ID NO: 28582 - RNA, 18 nt, Artificial Sequence
  Description of Artificial Sequence: Synthetic oligonucleotide
cagugaccucaugaaugg

SEQ ID NO: 28583 - RNA, 18 nt, Artificial Sequence
  Description of Artificial Sequence: Synthetic oligonucleotide
cugggcagugaccucaug

SEQ ID NO: 28584 - RNA, 18 nt, Artificial Sequence
  Description of Artificial Sequence: Synthetic oligonucleotide
augagcugggcagugacc

SEQ ID NO: 28585 - RNA, 18 nt, Artificial Sequence
  Description of Artificial Sequence: Synthetic oligonucleotide
acaucaugagcugggcag

SEQ ID NO: 28586 - RNA, 18 nt, Artificial Sequence
  Description of Artificial Sequence: Synthetic oligonucleotide
cacggacaucaugagcug

SEQ ID NO: 28587 - RNA, 18 nt, Artificial Sequence
  Description of Artificial Sequence: Synthetic oligonucleotide
agccucacggacaucaug

SEQ ID NO: 28588 - RNA, 18 nt, Artificial Sequence
  Description of Artificial Sequence: Synthetic oligonucleotide
aggacagccucacggaca

SEQ ID NO: 28589 - RNA, 18 nt, Artificial Sequence
  Description of Artificial Sequence: Synthetic oligonucleotide
ccaaaaggacagccucac

SEQ ID NO: 28590 - RNA, 18 nt, Artificial Sequence
  Description of Artificial Sequence: Synthetic oligonucleotide
acuggccaaaaggacagc

SEQ ID NO: 28591 - RNA, 18 nt, Artificial Sequence
  Description of Artificial Sequence: Synthetic oligonucleotide
cggcuacuggccaaaagg

SEQ ID NO: 28592 - RNA, 18 nt, Artificial Sequence
  Description of Artificial Sequence: Synthetic oligonucleotide
gcacacggcuacuggcca

SEQ ID NO: 28593 - RNA, 18 nt, Artificial Sequence
  Description of Artificial Sequence: Synthetic oligonucleotide
cagcugcacacggcuacu

SEQ ID NO: 28594 - RNA, 18 nt, Artificial Sequence
  Description of Artificial Sequence: Synthetic oligonucleotide
ccacacagcugcacacgg

SEQ ID NO: 28595 - RNA, 18 nt, Artificial Sequence
  Description of Artificial Sequence: Synthetic oligonucleotide
cugugccacacagcugca

SEQ ID NO: 28596 - RNA, 18 nt, Artificial Sequence
  Description of Artificial Sequence: Synthetic oligonucleotide
gccaucugugccacacag

SEQ ID NO: 28597 - RNA, 18 nt, Artificial Sequence
  Description of Artificial Sequence: Synthetic oligonucleotide
acgaagccaucugugcca

SEQ ID NO: 28598 - RNA, 18 nt, Artificial Sequence
  Description of Artificial Sequence: Synthetic oligonucleotide
gaugaacgaagccaucug

SEQ ID NO: 28599 - RNA, 18 nt, Artificial Sequence
  Description of Artificial Sequence: Synthetic oligonucleotide
aucaggaugaacgaagcc

SEQ ID NO: 28600 - RNA, 18 nt, Artificial Sequence
  Description of Artificial Sequence: Synthetic oligonucleotide
ccuugaucaggaugaacg

SEQ ID NO: 28601 - RNA, 18 nt, Artificial Sequence
  Description of Artificial Sequence: Synthetic oligonucleotide
gggccuugaucaggauga

SEQ ID NO: 28602 - RNA, 18 nt, Artificial Sequence
  Description of Artificial Sequence: Synthetic oligonucleotide
ugcuguggcugagguggg

SEQ ID NO: 28603 - RNA, 18 nt, Artificial Sequence
  Description of Artificial Sequence: Synthetic oligonucleotide
gggacugcuguggcugag

SEQ ID NO: 28604 - RNA, 18 nt, Artificial Sequence
  Description of Artificial Sequence: Synthetic oligonucleotide
gguggacaacacagguug

SEQ ID NO: 28605 - RNA, 18 nt, Artificial Sequence
  Description of Artificial Sequence: Synthetic oligonucleotide
aauaggguggacaacaca

SEQ ID NO: 28606 - RNA, 18 nt, Artificial Sequence
  Description of Artificial Sequence: Synthetic oligonucleotide
ugaauaauaggguggaca

SEQ ID NO: 28607 - RNA, 18 nt, Artificial Sequence
  Description of Artificial Sequence: Synthetic oligonucleotide
guacaugaauaauagggu

SEQ ID NO: 28608 - RNA, 18 nt, Artificial Sequence
  Description of Artificial Sequence: Synthetic oligonucleotide
ggcagguacaugaauaau

SEQ ID NO: 28609 - RNA, 18 nt, Artificial Sequence
  Description of Artificial Sequence: Synthetic oligonucleotide
ggccuggcagguacauga

SEQ ID NO: 28610 - RNA, 18 nt, Artificial Sequence
  Description of Artificial Sequence: Synthetic oligonucleotide
agcagggccuggcaggua

SEQ ID NO: 28611 - RNA, 18 nt, Artificial Sequence
  Description of Artificial Sequence: Synthetic oligonucleotide
uaucuagcagggccuggc

SEQ ID NO: 28612 - RNA, 18 nt, Artificial Sequence
  Description of Artificial Sequence: Synthetic oligonucleotide
ggugcuaucuagcagggc

SEQ ID NO: 28613 - RNA, 18 nt, Artificial Sequence
  Description of Artificial Sequence: Synthetic oligonucleotide
gggugcuaucuagcaggg

SEQ ID NO: 28614 - RNA, 18 nt, Artificial Sequence
  Description of Artificial Sequence: Synthetic oligonucleotide
guuauguaaugccacggg

SEQ ID NO: 28615 - RNA, 18 nt, Artificial Sequence
  Description of Artificial Sequence: Synthetic oligonucleotide
gaaguguuauguaaugcc

SEQ ID NO: 28616 - RNA, 18 nt, Artificial Sequence
  Description of Artificial Sequence: Synthetic oligonucleotide
cucaugaaguguuaugua

SEQ ID NO: 28617 - RNA, 18 nt, Artificial Sequence
  Description of Artificial Sequence: Synthetic oligonucleotide
agccacucaugaaguguu

SEQ ID NO: 28618 - RNA, 18 nt, Artificial Sequence
  Description of Artificial Sequence: Synthetic oligonucleotide
gacacagccacucaugaa

SEQ ID NO: 28619 - RNA, 18 nt, Artificial Sequence
  Description of Artificial Sequence: Synthetic oligonucleotide
uacaagacacagccacuc

SEQ ID NO: 28620 - RNA, 18 nt, Artificial Sequence
  Description of Artificial Sequence: Synthetic oligonucleotide
aaaauuacaagacacagc

SEQ ID NO: 28621 - RNA, 18 nt, Artificial Sequence
  Description of Artificial Sequence: Synthetic oligonucleotide
uccccaaaauuacaagac

SEQ ID NO: 28622 - RNA, 18 nt, Artificial Sequence
  Description of Artificial Sequence: Synthetic oligonucleotide
accuguccccaaaauuac

SEQ ID NO: 28623 - RNA, 18 nt, Artificial Sequence
  Description of Artificial Sequence: Synthetic oligonucleotide
gagaaaccuguccccaaa

SEQ ID NO: 28624 - RNA, 18 nt, Artificial Sequence
  Description of Artificial Sequence: Synthetic oligonucleotide
aaagagagaaaccugucc

SEQ ID NO: 28625 - RNA, 18 nt, Artificial Sequence
  Description of Artificial Sequence: Synthetic oligonucleotide
gagggaaagagagaaacc

SEQ ID NO: 28626 - RNA, 18 nt, Artificial Sequence
  Description of Artificial Sequence: Synthetic oligonucleotide
aaagagagggaaagagag

SEQ ID NO: 28627 - RNA, 18 nt, Artificial Sequence
  Description of Artificial Sequence: Synthetic oligonucleotide
aaaaaaaagagagggaaa

SEQ ID NO: 28628 - RNA, 18 nt, Artificial Sequence
  Description of Artificial Sequence: Synthetic oligonucleotide
uugacaaaaaaaagagag

SEQ ID NO: 28629 - RNA, 18 nt, Artificial Sequence
  Description of Artificial Sequence: Synthetic oligonucleotide
ggcuuuugacaaaaaaaa

SEQ ID NO: 28630 - RNA, 18 nt, Artificial Sequence
  Description of Artificial Sequence: Synthetic oligonucleotide
cucugggcuuuugacaaa

SEQ ID NO: 28631 - RNA, 18 nt, Artificial Sequence
  Description of Artificial Sequence: Synthetic oligonucleotide
ucagucucugggcuuuug

SEQ ID NO: 28632 - RNA, 18 nt, Artificial Sequence
  Description of Artificial Sequence: Synthetic oligonucleotide
gguugucagucucugggc

SEQ ID NO: 28633 - RNA, 18 nt, Artificial Sequence
  Description of Artificial Sequence: Synthetic oligonucleotide
cagcugguugucagucuc

SEQ ID NO: 28634 - RNA, 18 nt, Artificial Sequence
  Description of Artificial Sequence: Synthetic oligonucleotide
cacugcagcugguuguca

SEQ ID NO: 28635 - RNA, 18 nt, Artificial Sequence
  Description of Artificial Sequence: Synthetic oligonucleotide
uuagacacugcagcuggu

SEQ ID NO: 28636 - RNA, 18 nt, Artificial Sequence
  Description of Artificial Sequence: Synthetic oligonucleotide
aacacuuagacacugcag

SEQ ID NO: 28637 - RNA, 18 nt, Artificial Sequence
  Description of Artificial Sequence: Synthetic oligonucleotide
ugaggaacacuuagacac

SEQ ID NO: 28638 - RNA, 18 nt, Artificial Sequence
  Description of Artificial Sequence: Synthetic oligonucleotide
gucagugaggaacacuua

SEQ ID NO: 28639 - RNA, 18 nt, Artificial Sequence
  Description of Artificial Sequence: Synthetic oligonucleotide
acccugucagugaggaac

SEQ ID NO: 28640 - RNA, 18 nt, Artificial Sequence
  Description of Artificial Sequence: Synthetic oligonucleotide
gccccacccugucaguga

SEQ ID NO: 28641 - RNA, 18 nt, Artificial Sequence
  Description of Artificial Sequence: Synthetic oligonucleotide
gugaggccccacccuguc

SEQ ID NO: 28642 - RNA, 18 nt, Artificial Sequence
  Description of Artificial Sequence: Synthetic oligonucleotide
ggguggugaggccccacc

SEQ ID NO: 28643 - RNA, 18 nt, Artificial Sequence
  Description of Artificial Sequence: Synthetic oligonucleotide
gccaacgcugcucccucc

SEQ ID NO: 28644 - RNA, 18 nt, Artificial Sequence
  Description of Artificial Sequence: Synthetic oligonucleotide
ucccugccaacgcugcuc

SEQ ID NO: 28645 - RNA, 18 nt, Artificial Sequence
  Description of Artificial Sequence: Synthetic oligonucleotide
cugucucccugccaacgc

SEQ ID NO: 28646 - RNA, 18 nt, Artificial Sequence
  Description of Artificial Sequence: Synthetic oligonucleotide
ccaggcugucucccugcc

SEQ ID NO: 28647 - RNA, 18 nt, Artificial Sequence
  Description of Artificial Sequence: Synthetic oligonucleotide
cugggccaggcugucucc

SEQ ID NO: 28648 - RNA, 18 nt, Artificial Sequence
  Description of Artificial Sequence: Synthetic oligonucleotide
ggucacugggccaggcug

SEQ ID NO: 28649 - RNA, 18 nt, Artificial Sequence
  Description of Artificial Sequence: Synthetic oligonucleotide
cccagggucacugggcca

SEQ ID NO: 28650 - RNA, 18 nt, Artificial Sequence
  Description of Artificial Sequence: Synthetic oligonucleotide
uugggcccagggucacug

SEQ ID NO: 28651 - RNA, 18 nt, Artificial Sequence
  Description of Artificial Sequence: Synthetic oligonucleotide
cuggcuugggcccagggu

SEQ ID NO: 28652 - RNA, 18 nt, Artificial Sequence
  Description of Artificial Sequence: Synthetic oligonucleotide
gggcuggcuugggcccag

SEQ ID NO: 28653 - RNA, 18 nt, Artificial Sequence
  Description of Artificial Sequence: Synthetic oligonucleotide
ccugaaagcccuggaggg

SEQ ID NO: 28654 - RNA, 18 nt, Artificial Sequence
  Description of Artificial Sequence: Synthetic oligonucleotide
gcuucccugaaagcccug

SEQ ID NO: 28655 - RNA, 18 nt, Artificial Sequence
  Description of Artificial Sequence: Synthetic oligonucleotide
auggcgcuucccugaaag

SEQ ID NO: 28656 - RNA, 18 nt, Artificial Sequence
  Description of Artificial Sequence: Synthetic oligonucleotide
aauggauggcgcuucccu

SEQ ID NO: 28657 - RNA, 18 nt, Artificial Sequence
  Description of Artificial Sequence: Synthetic oligonucleotide
uugaaaauggauggcgcu

SEQ ID NO: 28658 - RNA, 18 nt, Artificial Sequence
  Description of Artificial Sequence: Synthetic oligonucleotide
caucuuugaaaauggaug

SEQ ID NO: 28659 - RNA, 18 nt, Artificial Sequence
  Description of Artificial Sequence: Synthetic oligonucleotide
uuugacaucuuugaaaau

SEQ ID NO: 28660 - RNA, 18 nt, Artificial Sequence
  Description of Artificial Sequence: Synthetic oligonucleotide
ugacguuugacaucuuug

SEQ ID NO: 28661 - RNA, 18 nt, Artificial Sequence
  Description of Artificial Sequence: Synthetic oligonucleotide
agaagugacguuugacau

SEQ ID NO: 28662 - RNA, 18 nt, Artificial Sequence
  Description of Artificial Sequence: Synthetic oligonucleotide
caggaagaagugacguuu

SEQ ID NO: 28663 - RNA, 18 nt, Artificial Sequence
  Description of Artificial Sequence: Synthetic oligonucleotide
cccuacaggaagaaguga

SEQ ID NO: 28664 - RNA, 18 nt, Artificial Sequence
  Description of Artificial Sequence: Synthetic oligonucleotide
ucgggcccuacaggaaga

SEQ ID NO: 28665 - RNA, 18 nt, Artificial Sequence
  Description of Artificial Sequence: Synthetic oligonucleotide
aggacucgggcccuacag

SEQ ID NO: 28666 - RNA, 18 nt, Artificial Sequence
  Description of Artificial Sequence: Synthetic oligonucleotide
gaggcaggacucgggccc

SEQ ID NO: 28667 - RNA, 18 nt, Artificial Sequence
  Description of Artificial Sequence: Synthetic oligonucleotide
gauaggaggcaggacucg

SEQ ID NO: 28668 - RNA, 18 nt, Artificial Sequence
  Description of Artificial Sequence: Synthetic oligonucleotide
gcccugauaggaggcagg

SEQ ID NO: 28669 - RNA, 18 nt, Artificial Sequence
  Description of Artificial Sequence: Synthetic oligonucleotide
aucuggcccugauaggag

SEQ ID NO: 28670 - RNA, 18 nt, Artificial Sequence
  Description of Artificial Sequence: Synthetic oligonucleotide
cuaugaucuggcccugau

SEQ ID NO: 28671 - RNA, 18 nt, Artificial Sequence
  Description of Artificial Sequence: Synthetic oligonucleotide
gccuucuaugaucuggcc

SEQ ID NO: 28672 - RNA, 18 nt, Artificial Sequence
  Description of Artificial Sequence: Synthetic oligonucleotide
aaauagccuucuaugauc

SEQ ID NO: 28673 - RNA, 18 nt, Artificial Sequence
  Description of Artificial Sequence: Synthetic oligonucleotide
auagaaaauagccuucua

SEQ ID NO: 28674 - RNA, 18 nt, Artificial Sequence
  Description of Artificial Sequence: Synthetic oligonucleotide
ccagaauagaaaauagcc

SEQ ID NO: 28675 - RNA, 18 nt, Artificial Sequence
  Description of Artificial Sequence: Synthetic oligonucleotide
guuccccagaauagaaaa

SEQ ID NO: 28676 - RNA, 18 nt, Artificial Sequence
  Description of Artificial Sequence: Synthetic oligonucleotide
uaaucguuccccagaaua

SEQ ID NO: 28677 - RNA, 18 nt, Artificial Sequence
  Description of Artificial Sequence: Synthetic oligonucleotide
aguuauaaucguucccca

SEQ ID NO: 28678 - RNA, 18 nt, Artificial Sequence
  Description of Artificial Sequence: Synthetic oligonucleotide
auuuaaguuauaaucguu

SEQ ID NO: 28679 - RNA, 18 nt, Artificial Sequence
  Description of Artificial Sequence: Synthetic oligonucleotide
caaucauuuaaguuauaa

SEQ ID NO: 28680 - RNA, 18 nt, Artificial Sequence
  Description of Artificial Sequence: Synthetic oligonucleotide
uaaaacaaucauuuaagu

SEQ ID NO: 28681 - RNA, 18 nt, Artificial Sequence
  Description of Artificial Sequence: Synthetic oligonucleotide
uuuauuaaaacaaucauu

SEQ ID NO: 28682 - RNA, 18 nt, Artificial Sequence
  Description of Artificial Sequence: Synthetic oligonucleotide
gaauuuuuauuaaaacaa

SEQ ID NO: 28683 - RNA, 18 nt, Artificial Sequence
  Description of Artificial Sequence: Synthetic oligonucleotide
gcuuagaauuuuuauuaa

SEQ ID NO: 28684 - RNA, 18 nt, Artificial Sequence
  Description of Artificial Sequence: Synthetic oligonucleotide
uuccagcuuagaauuuuu

SEQ ID NO: 28685 - RNA, 18 nt, Artificial Sequence
  Description of Artificial Sequence: Synthetic oligonucleotide
ucuuuuccauguauucca

SEQ ID NO: 28686 - RNA, 18 nt, Artificial Sequence
  Description of Artificial Sequence: Synthetic oligonucleotide
cuugcucuuuuccaugua

SEQ ID NO: 28687 - RNA, 18 nt, Artificial Sequence
  Description of Artificial Sequence: Synthetic oligonucleotide
agaugcuugcucuuuucc

SEQ ID NO: 28688 - RNA, 18 nt, Artificial Sequence
  Description of Artificial Sequence: Synthetic oligonucleotide
ccugcagaugcuugcucu

SEQ ID NO: 28689 - RNA, 18 nt, Artificial Sequence
  Description of Artificial Sequence: Synthetic oligonucleotide
cugcuccugcagaugcuu

SEQ ID NO: 28690 - RNA, 18 nt, Artificial Sequence
  Description of Artificial Sequence: Synthetic oligonucleotide
uugagcugcuccugcaga

SEQ ID NO: 28691 - RNA, 18 nt, Artificial Sequence
  Description of Artificial Sequence: Synthetic oligonucleotide
guucauugagcugcuccu

SEQ ID NO: 28692 - RNA, 18 nt, Artificial Sequence
  Description of Artificial Sequence: Synthetic oligonucleotide
cuugaguucauugagcug

SEQ ID NO: 28693 - RNA, 18 nt, Artificial Sequence
  Description of Artificial Sequence: Synthetic oligonucleotide
ucugucuugaguucauug

SEQ ID NO: 28694 - RNA, 18 nt, Artificial Sequence
  Description of Artificial Sequence: Synthetic oligonucleotide
cgauuucugucuugaguu

SEQ ID NO: 28695 - RNA, 18 nt, Artificial Sequence
  Description of Artificial Sequence: Synthetic oligonucleotide
ggccucgauuucugucuu

SEQ ID NO: 28696 - RNA, 18 nt, Artificial Sequence
  Description of Artificial Sequence: Synthetic oligonucleotide
uucaaggccucgauuucu

SEQ ID NO: 28697 - RNA, 18 nt, Artificial Sequence
  Description of Artificial Sequence: Synthetic oligonucleotide
ucaguuucaaggccucga

SEQ ID NO: 28698 - RNA, 18 nt, Artificial Sequence
  Description of Artificial Sequence: Synthetic oligonucleotide
cucuuucaguuucaaggc

SEQ ID NO: 28699 - RNA, 18 nt, Artificial Sequence
  Description of Artificial Sequence: Synthetic oligonucleotide
ucccucucuuucaguuuc

SEQ ID NO: 28700 - RNA, 18 nt, Artificial Sequence
  Description of Artificial Sequence: Synthetic oligonucleotide
cugucucccucucuuuca

SEQ ID NO: 28701 - RNA, 18 nt, Artificial Sequence
  Description of Artificial Sequence: Synthetic oligonucleotide
cagagcugucucccucuc

SEQ ID NO: 28702 - RNA, 18 nt, Artificial Sequence
  Description of Artificial Sequence: Synthetic oligonucleotide
auauccagagcugucucc

SEQ ID NO: 28703 - RNA, 18 nt, Artificial Sequence
  Description of Artificial Sequence: Synthetic oligonucleotide
gcagaauauccagagcug

SEQ ID NO: 28704 - RNA, 18 nt, Artificial Sequence
  Description of Artificial Sequence: Synthetic oligonucleotide
auugugcagaauauccag

SEQ ID NO: 28705 - RNA, 18 nt, Artificial Sequence
  Description of Artificial Sequence: Synthetic oligonucleotide
uucucauugugcagaaua

SEQ ID NO: 28706 - RNA, 18 nt, Artificial Sequence
  Description of Artificial Sequence: Synthetic oligonucleotide
cggaguucucauugugca

SEQ ID NO: 28707 - RNA, 18 nt, Artificial Sequence
  Description of Artificial Sequence: Synthetic oligonucleotide
ccugucggaguucucauu

SEQ ID NO: 28708 - RNA, 18 nt, Artificial Sequence
  Description of Artificial Sequence: Synthetic oligonucleotide
ccaccccugucggaguuc

SEQ ID NO: 28709 - RNA, 18 nt, Artificial Sequence
  Description of Artificial Sequence: Synthetic oligonucleotide
ugcugccaccccugucgg

SEQ ID NO: 28710 - RNA, 18 nt, Artificial Sequence
  Description of Artificial Sequence: Synthetic oligonucleotide
cuugcugcugccaccccu

SEQ ID NO: 28711 - RNA, 18 nt, Artificial Sequence
  Description of Artificial Sequence: Synthetic oligonucleotide
uugugcuugcugcugcca

SEQ ID NO: 28712 - RNA, 18 nt, Artificial Sequence
  Description of Artificial Sequence: Synthetic oligonucleotide
ugguauugugcuugcugc

SEQ ID NO: 28713 - RNA, 18 nt, Artificial Sequence
  Description of Artificial Sequence: Synthetic oligonucleotide
uuuaaugguauugugcuu

SEQ ID NO: 28714 - RNA, 18 nt, Artificial Sequence
  Description of Artificial Sequence: Synthetic oligonucleotide
uacaagaaagagacccug

SEQ ID NO: 28715 - RNA, 18 nt, Artificial Sequence
  Description of Artificial Sequence: Synthetic oligonucleotide
caaaauacaagaaagaga

SEQ ID NO: 28716 - RNA, 18 nt, Artificial Sequence
  Description of Artificial Sequence: Synthetic oligonucleotide
aucagcaaaauacaagaa

SEQ ID NO: 28717 - RNA, 18 nt, Artificial Sequence
  Description of Artificial Sequence: Synthetic oligonucleotide
uccugaucagcaaaauac

SEQ ID NO: 28718 - RNA, 18 nt, Artificial Sequence
  Description of Artificial Sequence: Synthetic oligonucleotide
gaugguccugaucagcaa

SEQ ID NO: 28719 - RNA, 18 nt, Artificial Sequence
  Description of Artificial Sequence: Synthetic oligonucleotide
uuaaugaugguccugauc

SEQ ID NO: 28720 - RNA, 18 nt, Artificial Sequence
  Description of Artificial Sequence: Synthetic oligonucleotide
uuucauuaaugauggucc

SEQ ID NO: 28721 - RNA, 18 nt, Artificial Sequence
  Description of Artificial Sequence: Synthetic oligonucleotide
gcacauuucauuaaugau

SEQ ID NO: 28722 - RNA, 18 nt, Artificial Sequence
  Description of Artificial Sequence: Synthetic oligonucleotide
caaccgcacauuucauua

SEQ ID NO: 28723 - RNA, 18 nt, Artificial Sequence
  Description of Artificial Sequence: Synthetic oligonucleotide
gaugccaaccgcacauuu

SEQ ID NO: 28724 - RNA, 18 nt, Artificial Sequence
  Description of Artificial Sequence: Synthetic oligonucleotide
aaccagaugccaaccgca

SEQ ID NO: 28725 - RNA, 18 nt, Artificial Sequence
  Description of Artificial Sequence: Synthetic oligonucleotide
gaggaaaccagaugccaa

SEQ ID NO: 28726 - RNA, 18 nt, Artificial Sequence
  Description of Artificial Sequence: Synthetic oligonucleotide
cuacugaggaaaccagau

SEQ ID NO: 28727 - RNA, 18 nt, Artificial Sequence
  Description of Artificial Sequence: Synthetic oligonucleotide
cuuggcuacugaggaaac

SEQ ID NO: 28728 - RNA, 18 nt, Artificial Sequence
  Description of Artificial Sequence: Synthetic oligonucleotide
agugacuuggcuacugag

SEQ ID NO: 28729 - RNA, 18 nt, Artificial Sequence
  Description of Artificial Sequence: Synthetic oligonucleotide
agucuagugacuuggcua

SEQ ID NO: 28730 - RNA, 18 nt, Artificial Sequence
  Description of Artificial Sequence: Synthetic oligonucleotide
ccaauagucuagugacuu

SEQ ID NO: 28731 - RNA, 18 nt, Artificial Sequence
  Description of Artificial Sequence: Synthetic oligonucleotide
agaugccaauagucuagu

SEQ ID NO: 28732 - RNA, 18 nt, Artificial Sequence
  Description of Artificial Sequence: Synthetic oligonucleotide
acaaaagaugccaauagu

SEQ ID NO: 28733 - RNA, 18 nt, Artificial Sequence
  Description of Artificial Sequence: Synthetic oligonucleotide
uacauacaaaagaugcca

SEQ ID NO: 28734 - RNA, 18 nt, Artificial Sequence
  Description of Artificial Sequence: Synthetic oligonucleotide
cuaaguacauacaaaaga

SEQ ID NO: 28735 - RNA, 18 nt, Artificial Sequence
  Description of Artificial Sequence: Synthetic oligonucleotide
cucaacuaaguacauaca

SEQ ID NO: 28736 - RNA, 18 nt, Artificial Sequence
  Description of Artificial Sequence: Synthetic oligonucleotide
auuuccucaacuaaguac

SEQ ID NO: 28737 - RNA, 18 nt, Artificial Sequence
  Description of Artificial Sequence: Synthetic oligonucleotide
aaaaaauuuccucaacua

SEQ ID NO: 28738 - RNA, 18 nt, Artificial Sequence
  Description of Artificial Sequence: Synthetic oligonucleotide
aaguuaaaaaauuuccuc

SEQ ID NO: 28739 - RNA, 18 nt, Artificial Sequence
  Description of Artificial Sequence: Synthetic oligonucleotide
ggcauaaguuaaaaaauu

SEQ ID NO: 28740 - RNA, 18 nt, Artificial Sequence
  Description of Artificial Sequence: Synthetic oligonucleotide
uuucuggcauaaguuaaa

SEQ ID NO: 28741 - RNA, 18 nt, Artificial Sequence
  Description of Artificial Sequence: Synthetic oligonucleotide
uucccuuucuggcauaag

SEQ ID NO: 28742 - RNA, 18 nt, Artificial Sequence
  Description of Artificial Sequence: Synthetic oligonucleotide
uuaaauucccuuucuggc

SEQ ID NO: 28743 - RNA, 18 nt, Artificial Sequence
  Description of Artificial Sequence: Synthetic oligonucleotide
gcagauuaaauucccuuu

SEQ ID NO: 28744 - RNA, 18 nt, Artificial Sequence
  Description of Artificial Sequence: Synthetic oligonucleotide
cauuggcagauuaaauuc

SEQ ID NO: 28745 - RNA, 18 nt, Artificial Sequence
  Description of Artificial Sequence: Synthetic oligonucleotide
auagucauuggcagauua

SEQ ID NO: 28746 - RNA, 18 nt, Artificial Sequence
  Description of Artificial Sequence: Synthetic oligonucleotide
gguucauagucauuggca

SEQ ID NO: 28747 - RNA, 18 nt, Artificial Sequence
  Description of Artificial Sequence: Synthetic oligonucleotide
caauggguucauagucau

SEQ ID NO: 28748 - RNA, 18 nt, Artificial Sequence
  Description of Artificial Sequence: Synthetic oligonucleotide
ccagccaauggguucaua

SEQ ID NO: 28749 - RNA, 18 nt, Artificial Sequence
  Description of Artificial Sequence: Synthetic oligonucleotide
uccauccagccaaugggu

SEQ ID NO: 28750 - RNA, 18 nt, Artificial Sequence
  Description of Artificial Sequence: Synthetic oligonucleotide
caacuuccauccagccaa

SEQ ID NO: 28751 - RNA, 18 nt, Artificial Sequence
  Description of Artificial Sequence: Synthetic oligonucleotide
aagcucaacuuccaucca

SEQ ID NO: 28752 - RNA, 18 nt, Artificial Sequence
  Description of Artificial Sequence: Synthetic oligonucleotide
aacacaagcucaacuucc

SEQ ID NO: 28753 - RNA, 18 nt, Artificial Sequence
  Description of Artificial Sequence: Synthetic oligonucleotide
cuuuuaacacaagcucaa

SEQ ID NO: 28754 - RNA, 18 nt, Artificial Sequence
  Description of Artificial Sequence: Synthetic oligonucleotide
cagagcuuuuaacacaag

SEQ ID NO: 28755 - RNA, 18 nt, Artificial Sequence
  Description of Artificial Sequence: Synthetic oligonucleotide
uacaucagagcuuuuaac

SEQ ID NO: 28756 - RNA, 18 nt, Artificial Sequence
  Description of Artificial Sequence: Synthetic oligonucleotide
uucauuacaucagagcuu

SEQ ID NO: 28757 - RNA, 18 nt, Artificial Sequence
  Description of Artificial Sequence: Synthetic oligonucleotide
ggguucauuacaucagag

SEQ ID NO: 28758 - RNA, 18 nt, Artificial Sequence
  Description of Artificial Sequence: Synthetic oligonucleotide
auccacccuguaacaggg

SEQ ID NO: 28759 - RNA, 18 nt, Artificial Sequence
  Description of Artificial Sequence: Synthetic oligonucleotide
ucaaaauccacccuguaa

SEQ ID NO: 28760 - RNA, 18 nt, Artificial Sequence
  Description of Artificial Sequence: Synthetic oligonucleotide
agggcucaaaauccaccc

SEQ ID NO: 28761 - RNA, 18 nt, Artificial Sequence
  Description of Artificial Sequence: Synthetic oligonucleotide
aaaugagggcucaaaauc

SEQ ID NO: 28762 - RNA, 18 nt, Artificial Sequence
  Description of Artificial Sequence: Synthetic oligonucleotide
cugcuaaaugagggcuca

SEQ ID NO: 28763 - RNA, 18 nt, Artificial Sequence
  Description of Artificial Sequence: Synthetic oligonucleotide
cuuuacugcuaaaugagg

SEQ ID NO: 28764 - RNA, 18 nt, Artificial Sequence
  Description of Artificial Sequence: Synthetic oligonucleotide
uuaugcuuuacugcuaaa

SEQ ID NO: 28765 - RNA, 18 nt, Artificial Sequence
  Description of Artificial Sequence: Synthetic oligonucleotide
gggcauuaugcuuuacug

SEQ ID NO: 28766 - RNA, 18 nt, Artificial Sequence
  Description of Artificial Sequence: Synthetic oligonucleotide
uaaaagggcauuaugcuu

SEQ ID NO: 28767 - RNA, 18 nt, Artificial Sequence
  Description of Artificial Sequence: Synthetic oligonucleotide
uggcuuaaaagggcauua

SEQ ID NO: 28768 - RNA, 18 nt, Artificial Sequence
  Description of Artificial Sequence: Synthetic oligonucleotide
ccccuuggcuuaaaaggg

SEQ ID NO: 28769 - RNA, 18 nt, Artificial Sequence
  Description of Artificial Sequence: Synthetic oligonucleotide
uaacaccccuuggcuuaa

SEQ ID NO: 28770 - RNA, 18 nt, Artificial Sequence
  Description of Artificial Sequence: Synthetic oligonucleotide
ggguauaacaccccuugg

SEQ ID NO: 28771 - RNA, 18 nt, Artificial Sequence
  Description of Artificial Sequence: Synthetic oligonucleotide
ucccuggguauaacaccc

SEQ ID NO: 28772 - RNA, 18 nt, Artificial Sequence
  Description of Artificial Sequence: Synthetic oligonucleotide
gcagcucccuggguauaa

SEQ ID NO: 28773 - RNA, 18 nt, Artificial Sequence
  Description of Artificial Sequence: Synthetic oligonucleotide
guaaggcagcucccuggg

SEQ ID NO: 28774 - RNA, 18 nt, Artificial Sequence
  Description of Artificial Sequence: Synthetic oligonucleotide
auaaaguaaggcagcucc

SEQ ID NO: 28775 - RNA, 18 nt, Artificial Sequence
  Description of Artificial Sequence: Synthetic oligonucleotide
uucucauaaaguaaggca

SEQ ID NO: 28776 - RNA, 18 nt, Artificial Sequence
  Description of Artificial Sequence: Synthetic oligonucleotide
cugcuuucucauaaagua

SEQ ID NO: 28777 - RNA, 18 nt, Artificial Sequence
  Description of Artificial Sequence: Synthetic oligonucleotide
ucauucugcuuucucaua

SEQ ID NO: 28778 - RNA, 18 nt, Artificial Sequence
  Description of Artificial Sequence: Synthetic oligonucleotide
ccauuucauucugcuuuc

SEQ ID NO: 28779 - RNA, 18 nt, Artificial Sequence
  Description of Artificial Sequence: Synthetic oligonucleotide
agccuccauuucauucug

SEQ ID NO: 28780 - RNA, 18 nt, Artificial Sequence
  Description of Artificial Sequence: Synthetic oligonucleotide
ucaauagccuccauuuca

SEQ ID NO: 28781 - RNA, 18 nt, Artificial Sequence
  Description of Artificial Sequence: Synthetic oligonucleotide
cauucucaauagccucca

SEQ ID NO: 28782 - RNA, 18 nt, Artificial Sequence
  Description of Artificial Sequence: Synthetic oligonucleotide
aaguccauucucaauagc

SEQ ID NO: 28783 - RNA, 18 nt, Artificial Sequence
  Description of Artificial Sequence: Synthetic oligonucleotide
agggaaaguccauucuca

SEQ ID NO: 28784 - RNA, 18 nt, Artificial Sequence
  Description of Artificial Sequence: Synthetic oligonucleotide
acuagagggaaaguccau

SEQ ID NO: 28785 - RNA, 18 nt, Artificial Sequence
  Description of Artificial Sequence: Synthetic oligonucleotide
acaagacuagagggaaag

SEQ ID NO: 28786 - RNA, 18 nt, Artificial Sequence
  Description of Artificial Sequence: Synthetic oligonucleotide
acaccacaagacuagagg

SEQ ID NO: 28787 - RNA, 18 nt, Artificial Sequence
  Description of Artificial Sequence: Synthetic oligonucleotide
uaaagacaccacaagacu

SEQ ID NO: 28788 - RNA, 18 nt, Artificial Sequence
  Description of Artificial Sequence: Synthetic oligonucleotide
ccacuuaaagacaccaca

SEQ ID NO: 28789 - RNA, 18 nt, Artificial Sequence
  Description of Artificial Sequence: Synthetic oligonucleotide
ccuugccacuuaaagaca

SEQ ID NO: 28790 - RNA, 18 nt, Artificial Sequence
  Description of Artificial Sequence: Synthetic oligonucleotide
auaguccuugccacuuaa

SEQ ID NO: 28791 - RNA, 18 nt, Artificial Sequence
  Description of Artificial Sequence: Synthetic oligonucleotide
guuuuauaguccuugcca

SEQ ID NO: 28792 - RNA, 18 nt, Artificial Sequence
  Description of Artificial Sequence: Synthetic oligonucleotide
guuugguuuuauaguccu

SEQ ID NO: 28793 - RNA, 18 nt, Artificial Sequence
  Description of Artificial Sequence: Synthetic oligonucleotide
auucaguuugguuuuaua

SEQ ID NO: 28794 - RNA, 18 nt, Artificial Sequence
  Description of Artificial Sequence: Synthetic oligonucleotide
uaaaaauucaguuugguu

SEQ ID NO: 28795 - RNA, 18 nt, Artificial Sequence
  Description of Artificial Sequence: Synthetic oligonucleotide
aaaguuaaaaauucaguu

SEQ ID NO: 28796 - RNA, 18 nt, Artificial Sequence
  Description of Artificial Sequence: Synthetic oligonucleotide
ugaaaaaaguuaaaaauu

SEQ ID NO: 28797 - RNA, 18 nt, Artificial Sequence
  Description of Artificial Sequence: Synthetic oligonucleotide
aaguaugaaaaaaguuaa

SEQ ID NO: 28798 - RNA, 18 nt, Artificial Sequence
  Description of Artificial Sequence: Synthetic oligonucleotide
cuuuuaaguaugaaaaaa

SEQ ID NO: 28799 - RNA, 18 nt, Artificial Sequence
  Description of Artificial Sequence: Synthetic oligonucleotide
acuuccuuuuaaguauga

SEQ ID NO: 28800 - RNA, 18 nt, Artificial Sequence
  Description of Artificial Sequence: Synthetic oligonucleotide
uagacacuuccuuuuaag

SEQ ID NO: 28801 - RNA, 18 nt, Artificial Sequence
  Description of Artificial Sequence: Synthetic oligonucleotide
uuuccuagacacuuccuu

SEQ ID NO: 28802 - RNA, 18 nt, Artificial Sequence
  Description of Artificial Sequence: Synthetic oligonucleotide
gguucuuuccuagacacu

SEQ ID NO: 28803 - RNA, 18 nt, Artificial Sequence
  Description of Artificial Sequence: Synthetic oligonucleotide
aaagagguucuuuccuag

SEQ ID NO: 28804 - RNA, 18 nt, Artificial Sequence
  Description of Artificial Sequence: Synthetic oligonucleotide
aaaacaaagagguucuuu

SEQ ID NO: 28805 - RNA, 18 nt, Artificial Sequence
  Description of Artificial Sequence: Synthetic oligonucleotide
cuuuuaaaacaaagaggu

SEQ ID NO: 28806 - RNA, 18 nt, Artificial Sequence
  Description of Artificial Sequence: Synthetic oligonucleotide
cuucucuuuuaaaacaaa

SEQ ID NO: 28807 - RNA, 18 nt, Artificial Sequence
  Description of Artificial Sequence: Synthetic oligonucleotide
aaagucuucucuuuuaaa

SEQ ID NO: 28808 - RNA, 18 nt, Artificial Sequence
  Description of Artificial Sequence: Synthetic oligonucleotide
guaauaaagucuucucuu

SEQ ID NO: 28809 - RNA, 18 nt, Artificial Sequence
  Description of Artificial Sequence: Synthetic oligonucleotide
gcaaaguaauaaagucuu

SEQ ID NO: 28810 - RNA, 18 nt, Artificial Sequence
  Description of Artificial Sequence: Synthetic oligonucleotide
cauuugcaaaguaauaaa

SEQ ID NO: 28811 - RNA, 18 nt, Artificial Sequence
  Description of Artificial Sequence: Synthetic oligonucleotide
gaaaccauuugcaaagua

SEQ ID NO: 28812 - RNA, 18 nt, Artificial Sequence
  Description of Artificial Sequence: Synthetic oligonucleotide
uuaccccuucuacuccug

SEQ ID NO: 28813 - RNA, 18 nt, Artificial Sequence
  Description of Artificial Sequence: Synthetic oligonucleotide
agaguuuaccccuucuac

SEQ ID NO: 28814 - RNA, 18 nt, Artificial Sequence
  Description of Artificial Sequence: Synthetic oligonucleotide
gaggaagaguuuaccccu

SEQ ID NO: 28815 - RNA, 18 nt, Artificial Sequence
  Description of Artificial Sequence: Synthetic oligonucleotide
cagaugaggaagaguuua

SEQ ID NO: 28816 - RNA, 18 nt, Artificial Sequence
  Description of Artificial Sequence: Synthetic oligonucleotide
uguggcagaugaggaaga

SEQ ID NO: 28817 - RNA, 18 nt, Artificial Sequence
  Description of Artificial Sequence: Synthetic oligonucleotide
aggccuguggcagaugag

SEQ ID NO: 28818 - RNA, 18 nt, Artificial Sequence
  Description of Artificial Sequence: Synthetic oligonucleotide
aaggcaggccuguggcag

SEQ ID NO: 28819 - RNA, 18 nt, Artificial Sequence
  Description of Artificial Sequence: Synthetic oligonucleotide
gaggcaaggcaggccugu

SEQ ID NO: 28820 - RNA, 18 nt, Artificial Sequence
  Description of Artificial Sequence: Synthetic oligonucleotide
ggccugaggcaaggcagg

SEQ ID NO: 28821 - RNA, 18 nt, Artificial Sequence
  Description of Artificial Sequence: Synthetic oligonucleotide
gacguggccugaggcaag

SEQ ID NO: 28822 - RNA, 18 nt, Artificial Sequence
  Description of Artificial Sequence: Synthetic oligonucleotide
aaggugacguggccugag

SEQ ID NO: 28823 - RNA, 18 nt, Artificial Sequence
  Description of Artificial Sequence: Synthetic oligonucleotide
ccuggcaacauggcuggg

SEQ ID NO: 28824 - RNA, 18 nt, Artificial Sequence
  Description of Artificial Sequence: Synthetic oligonucleotide
caugcccuggcaacaugg

SEQ ID NO: 28825 - RNA, 18 nt, Artificial Sequence
  Description of Artificial Sequence: Synthetic oligonucleotide
guccucaugcccuggcaa

SEQ ID NO: 28826 - RNA, 18 nt, Artificial Sequence
  Description of Artificial Sequence: Synthetic oligonucleotide
ucuuaguccucaugcccu

SEQ ID NO: 28827 - RNA, 18 nt, Artificial Sequence
  Description of Artificial Sequence: Synthetic oligonucleotide
aagcaucuuaguccucau

SEQ ID NO: 28828 - RNA, 18 nt, Artificial Sequence
  Description of Artificial Sequence: Synthetic oligonucleotide
agggcaagcaucuuaguc

SEQ ID NO: 28829 - RNA, 18 nt, Artificial Sequence
  Description of Artificial Sequence: Synthetic oligonucleotide
uuggcagggcaagcaucu

SEQ ID NO: 28830 - RNA, 18 nt, Artificial Sequence
  Description of Artificial Sequence: Synthetic oligonucleotide
cgggcuuggcagggcaag

SEQ ID NO: 28831 - RNA, 18 nt, Artificial Sequence
  Description of Artificial Sequence: Synthetic oligonucleotide
cccuccgggcuuggcagg

SEQ ID NO: 28832 - RNA, 18 nt, Artificial Sequence
  Description of Artificial Sequence: Synthetic oligonucleotide
ucauccccuccgggcuug

SEQ ID NO: 28833 - RNA, 18 nt, Artificial Sequence
  Description of Artificial Sequence: Synthetic oligonucleotide
gcugcucauccccuccgg

SEQ ID NO: 28834 - RNA, 18 nt, Artificial Sequence
  Description of Artificial Sequence: Synthetic oligonucleotide
cugaggcugcucaucccc

SEQ ID NO: 28835 - RNA, 18 nt, Artificial Sequence
  Description of Artificial Sequence: Synthetic oligonucleotide
accagcugaggcugcuca

SEQ ID NO: 28836 - RNA, 18 nt, Artificial Sequence
  Description of Artificial Sequence: Synthetic oligonucleotide
gcggcaccagcugaggcu

SEQ ID NO: 28837 - RNA, 18 nt, Artificial Sequence
  Description of Artificial Sequence: Synthetic oligonucleotide
cuguggcggcaccagcug

SEQ ID NO: 28838 - RNA, 18 nt, Artificial Sequence
  Description of Artificial Sequence: Synthetic oligonucleotide
gcugucuguggcggcacc

SEQ ID NO: 28839 - RNA, 18 nt, Artificial Sequence
  Description of Artificial Sequence: Synthetic oligonucleotide
ggugugcugucuguggcg

SEQ ID NO: 28840 - RNA, 18 nt, Artificial Sequence
  Description of Artificial Sequence: Synthetic oligonucleotide
ucuguggugugcugucug

SEQ ID NO: 28841 - RNA, 18 nt, Artificial Sequence
  Description of Artificial Sequence: Synthetic oligonucleotide
ccaccucuguggugugcu

SEQ ID NO: 28842 - RNA, 18 nt, Artificial Sequence
  Description of Artificial Sequence: Synthetic oligonucleotide
cugagccaccucuguggu

SEQ ID NO: 28843 - RNA, 18 nt, Artificial Sequence
  Description of Artificial Sequence: Synthetic oligonucleotide
ggucccugagccaccucu

SEQ ID NO: 28844 - RNA, 18 nt, Artificial Sequence
  Description of Artificial Sequence: Synthetic oligonucleotide
accaaggucccugagcca

SEQ ID NO: 28845 - RNA, 18 nt, Artificial Sequence
  Description of Artificial Sequence: Synthetic oligonucleotide
caucuaccaaggucccug

SEQ ID NO: 28846 - RNA, 18 nt, Artificial Sequence
  Description of Artificial Sequence: Synthetic oligonucleotide
auucccaucuaccaaggu

SEQ ID NO: 28847 - RNA, 18 nt, Artificial Sequence
  Description of Artificial Sequence: Synthetic oligonucleotide
cucacauucccaucuacc

SEQ ID NO: 28848 - RNA, 18 nt, Artificial Sequence
  Description of Artificial Sequence: Synthetic oligonucleotide
agauucucacauucccau

SEQ ID NO: 28849 - RNA, 18 nt, Artificial Sequence
  Description of Artificial Sequence: Synthetic oligonucleotide
uuaauagauucucacauu

SEQ ID NO: 28850 - RNA, 18 nt, Artificial Sequence
  Description of Artificial Sequence: Synthetic oligonucleotide
cuauuuuaauagauucuc

SEQ ID NO: 28851 - RNA, 18 nt, Artificial Sequence
  Description of Artificial Sequence: Synthetic oligonucleotide
ccugccuauuuuaauaga

SEQ ID NO: 28852 - RNA, 18 nt, Artificial Sequence
  Description of Artificial Sequence: Synthetic oligonucleotide
agaucccugccuauuuua

SEQ ID NO: 28853 - RNA, 18 nt, Artificial Sequence
  Description of Artificial Sequence: Synthetic oligonucleotide
accggagaucccugccua

SEQ ID NO: 28854 - RNA, 18 nt, Artificial Sequence
  Description of Artificial Sequence: Synthetic oligonucleotide
agaggaccggagaucccu

SEQ ID NO: 28855 - RNA, 18 nt, Artificial Sequence
  Description of Artificial Sequence: Synthetic oligonucleotide
uugacagaggaccggaga

SEQ ID NO: 28856 - RNA, 18 nt, Artificial Sequence
  Description of Artificial Sequence: Synthetic oligonucleotide
gccucuugacagaggacc

SEQ ID NO: 28857 - RNA, 18 nt, Artificial Sequence
  Description of Artificial Sequence: Synthetic oligonucleotide
gcauugccucuugacaga

SEQ ID NO: 28858 - RNA, 18 nt, Artificial Sequence
  Description of Artificial Sequence: Synthetic oligonucleotide
cgucagcauugccucuug

SEQ ID NO: 28859 - RNA, 18 nt, Artificial Sequence
  Description of Artificial Sequence: Synthetic oligonucleotide
aaagccgucagcauugcc

SEQ ID NO: 28860 - RNA, 18 nt, Artificial Sequence
  Description of Artificial Sequence: Synthetic oligonucleotide
aggaaaaagccgucagca

SEQ ID NO: 28861 - RNA, 18 nt, Artificial Sequence
  Description of Artificial Sequence: Synthetic oligonucleotide
ccagcaggaaaaagccgu

SEQ ID NO: 28862 - RNA, 18 nt, Artificial Sequence
  Description of Artificial Sequence: Synthetic oligonucleotide
gcacgccagcaggaaaaa

SEQ ID NO: 28863 - RNA, 18 nt, Artificial Sequence
  Description of Artificial Sequence: Synthetic oligonucleotide
cagaggcacgccagcagg

SEQ ID NO: 28864 - RNA, 18 nt, Artificial Sequence
  Description of Artificial Sequence: Synthetic oligonucleotide
gugggcagaggcacgcca

SEQ ID NO: 28865 - RNA, 18 nt, Artificial Sequence
  Description of Artificial Sequence: Synthetic oligonucleotide
ggcuggugggcagaggca

SEQ ID NO: 28866 - RNA, 18 nt, Artificial Sequence
  Description of Artificial Sequence: Synthetic oligonucleotide
gggaaggcuggugggcag

SEQ ID NO: 28867 - RNA, 18 nt, Artificial Sequence
  Description of Artificial Sequence: Synthetic oligonucleotide
aaugaggaugugcaaggg

SEQ ID NO: 28868 - RNA, 18 nt, Artificial Sequence
  Description of Artificial Sequence: Synthetic oligonucleotide
acaaaugaggaugugcaa

SEQ ID NO: 28869 - RNA, 18 nt, Artificial Sequence
  Description of Artificial Sequence: Synthetic oligonucleotide
aggugacaaaugaggaug

SEQ ID NO: 28870 - RNA, 18 nt, Artificial Sequence
  Description of Artificial Sequence: Synthetic oligonucleotide
uuaggaggugacaaauga

SEQ ID NO: 28871 - RNA, 18 nt, Artificial Sequence
  Description of Artificial Sequence: Synthetic oligonucleotide
ucaaauuaggaggugaca

SEQ ID NO: 28872 - RNA, 18 nt, Artificial Sequence
  Description of Artificial Sequence: Synthetic oligonucleotide
auaauucaaauuaggagg

SEQ ID NO: 28873 - RNA, 18 nt, Artificial Sequence
  Description of Artificial Sequence: Synthetic oligonucleotide
gcccaauaauucaaauua

SEQ ID NO: 28874 - RNA, 18 nt, Artificial Sequence
  Description of Artificial Sequence: Synthetic oligonucleotide
gauuugcccaauaauuca

SEQ ID NO: 28875 - RNA, 18 nt, Artificial Sequence
  Description of Artificial Sequence: Synthetic oligonucleotide
ggccagauuugcccaaua

SEQ ID NO: 28876 - RNA, 18 nt, Artificial Sequence
  Description of Artificial Sequence: Synthetic oligonucleotide
uaagcggccagauuugcc

SEQ ID NO: 28877 - RNA, 18 nt, Artificial Sequence
  Description of Artificial Sequence: Synthetic oligonucleotide
ccaaauaagcggccagau

SEQ ID NO: 28878 - RNA, 18 nt, Artificial Sequence
  Description of Artificial Sequence: Synthetic oligonucleotide
cagucccaaauaagcggc

SEQ ID NO: 28879 - RNA, 18 nt, Artificial Sequence
  Description of Artificial Sequence: Synthetic oligonucleotide
gcugucagucccaaauaa

SEQ ID NO: 28880 - RNA, 18 nt, Artificial Sequence
  Description of Artificial Sequence: Synthetic oligonucleotide
aguuggcugucaguccca

SEQ ID NO: 28881 - RNA, 18 nt, Artificial Sequence
  Description of Artificial Sequence: Synthetic oligonucleotide
caagaaguuggcugucag

SEQ ID NO: 28882 - RNA, 18 nt, Artificial Sequence
  Description of Artificial Sequence: Synthetic oligonucleotide
augcucaagaaguuggcu

SEQ ID NO: 28883 - RNA, 18 nt, Artificial Sequence
  Description of Artificial Sequence: Synthetic oligonucleotide
aauagaugcucaagaagu

SEQ ID NO: 28884 - RNA, 18 nt, Artificial Sequence
  Description of Artificial Sequence: Synthetic oligonucleotide
guucaaauagaugcucaa

SEQ ID NO: 28885 - RNA, 18 nt, Artificial Sequence
  Description of Artificial Sequence: Synthetic oligonucleotide
aggcuguucaaauagaug

SEQ ID NO: 28886 - RNA, 18 nt, Artificial Sequence
  Description of Artificial Sequence: Synthetic oligonucleotide
agggaaggcuguucaaau

SEQ ID NO: 28887 - RNA, 18 nt, Artificial Sequence
  Description of Artificial Sequence: Synthetic oligonucleotide
gcgaaagggaaggcuguu

SEQ ID NO: 28888 - RNA, 18 nt, Artificial Sequence
  Description of Artificial Sequence: Synthetic oligonucleotide
ugggagcgaaagggaagg

SEQ ID NO: 28889 - RNA, 18 nt, Artificial Sequence
  Description of Artificial Sequence: Synthetic oligonucleotide
guggcugggagcgaaagg

SEQ ID NO: 28890 - RNA, 18 nt, Artificial Sequence
  Description of Artificial Sequence: Synthetic oligonucleotide
caaagguggcugggagcg

SEQ ID NO: 28891 - RNA, 18 nt, Artificial Sequence
  Description of Artificial Sequence: Synthetic oligonucleotide
caccucaaagguggcugg

SEQ ID NO: 28892 - RNA, 18 nt, Artificial Sequence
  Description of Artificial Sequence: Synthetic oligonucleotide
ggacucaccucaaaggug

SEQ ID NO: 28893 - RNA, 18 nt, Artificial Sequence
  Description of Artificial Sequence: Synthetic oligonucleotide
cacuuggacucaccucaa

SEQ ID NO: 28894 - RNA, 18 nt, Artificial Sequence
  Description of Artificial Sequence: Synthetic oligonucleotide
ccugccacuuggacucac

SEQ ID NO: 28895 - RNA, 18 nt, Artificial Sequence
  Description of Artificial Sequence: Synthetic oligonucleotide
ccuguccugccacuugga

SEQ ID NO: 28896 - RNA, 18 nt, Artificial Sequence
  Description of Artificial Sequence: Synthetic oligonucleotide
aggguccuguccugccac

SEQ ID NO: 28897 - RNA, 18 nt, Artificial Sequence
  Description of Artificial Sequence: Synthetic oligonucleotide
cacacaggguccuguccu

SEQ ID NO: 28898 - RNA, 18 nt, Artificial Sequence
  Description of Artificial Sequence: Synthetic oligonucleotide
ucugucacacaggguccu

SEQ ID NO: 28899 - RNA, 18 nt, Artificial Sequence
  Description of Artificial Sequence: Synthetic oligonucleotide
uccgcucugucacacagg

SEQ ID NO: 28900 - RNA, 18 nt, Artificial Sequence
  Description of Artificial Sequence: Synthetic oligonucleotide
agaccuccgcucugucac

SEQ ID NO: 28901 - RNA, 18 nt, Artificial Sequence
  Description of Artificial Sequence: Synthetic oligonucleotide
gcacaagaccuccgcucu

SEQ ID NO: 28902 - RNA, 18 nt, Artificial Sequence
  Description of Artificial Sequence: Synthetic oligonucleotide
agagggcacaagaccucc

SEQ ID NO: 28903 - RNA, 18 nt, Artificial Sequence
  Description of Artificial Sequence: Synthetic oligonucleotide
agcugagagggcacaaga

SEQ ID NO: 28904 - RNA, 18 nt, Artificial Sequence
  Description of Artificial Sequence: Synthetic oligonucleotide
gaagaagcugagagggca

SEQ ID NO: 28905 - RNA, 18 nt, Artificial Sequence
  Description of Artificial Sequence: Synthetic oligonucleotide
uggcgcucugcaagguga

SEQ ID NO: 28906 - RNA, 18 nt, Artificial Sequence
  Description of Artificial Sequence: Synthetic oligonucleotide
ggacuuggcgcucugcaa

SEQ ID NO: 28907 - RNA, 18 nt, Artificial Sequence
  Description of Artificial Sequence: Synthetic oligonucleotide
acucgggacuuggcgcuc

SEQ ID NO: 28908 - RNA, 18 nt, Artificial Sequence
  Description of Artificial Sequence: Synthetic oligonucleotide
aggccacucgggacuugg

SEQ ID NO: 28909 - RNA, 18 nt, Artificial Sequence
  Description of Artificial Sequence: Synthetic oligonucleotide
aaagaaggccacucggga

SEQ ID NO: 28910 - RNA, 18 nt, Artificial Sequence
  Description of Artificial Sequence: Synthetic oligonucleotide
ucuucaaagaaggccacu

SEQ ID NO: 28911 - RNA, 18 nt, Artificial Sequence
  Description of Artificial Sequence: Synthetic oligonucleotide
agagcucuucaaagaagg

SEQ ID NO: 28912 - RNA, 18 nt, Artificial Sequence
  Description of Artificial Sequence: Synthetic oligonucleotide
cugcuagagcucuucaaa

SEQ ID NO: 28913 - RNA, 18 nt, Artificial Sequence
  Description of Artificial Sequence: Synthetic oligonucleotide
gucaccugcuagagcucu

SEQ ID NO: 28914 - RNA, 18 nt, Artificial Sequence
  Description of Artificial Sequence: Synthetic oligonucleotide
gcugggucaccugcuaga

SEQ ID NO: 28915 - RNA, 18 nt, Artificial Sequence
  Description of Artificial Sequence: Synthetic oligonucleotide
ggguggcugggucaccug

SEQ ID NO: 28916 - RNA, 18 nt, Artificial Sequence
  Description of Artificial Sequence: Synthetic oligonucleotide
aggagaaguggcaggucc

SEQ ID NO: 28917 - RNA, 18 nt, Artificial Sequence
  Description of Artificial Sequence: Synthetic oligonucleotide
guagcaggagaaguggca

SEQ ID NO: 28918 - RNA, 18 nt, Artificial Sequence
  Description of Artificial Sequence: Synthetic oligonucleotide
ucccgguagcaggagaag

SEQ ID NO: 28919 - RNA, 18 nt, Artificial Sequence
  Description of Artificial Sequence: Synthetic oligonucleotide
cgcggucccgguagcagg

SEQ ID NO: 28920 - RNA, 18 nt, Artificial Sequence
  Description of Artificial Sequence: Synthetic oligonucleotide
caucccgcggucccggua

SEQ ID NO: 28921 - RNA, 18 nt, Artificial Sequence
  Description of Artificial Sequence: Synthetic oligonucleotide
ugguccaucccgcggucc

SEQ ID NO: 28922 - RNA, 18 nt, Artificial Sequence
  Description of Artificial Sequence: Synthetic oligonucleotide
auaucugguccaucccgc

SEQ ID NO: 28923 - RNA, 18 nt, Artificial Sequence
  Description of Artificial Sequence: Synthetic oligonucleotide
ucuugauaucugguccau

SEQ ID NO: 28924 - RNA, 18 nt, Artificial Sequence
  Description of Artificial Sequence: Synthetic oligonucleotide
ggcucucuugauaucugg

SEQ ID NO: 28925 - RNA, 18 nt, Artificial Sequence
  Description of Artificial Sequence: Synthetic oligonucleotide
uggauggcucucuugaua

SEQ ID NO: 28926 - RNA, 18 nt, Artificial Sequence
  Description of Artificial Sequence: Synthetic oligonucleotide
cccuauggauggcucucu

SEQ ID NO: 28927 - RNA, 18 nt, Artificial Sequence
  Description of Artificial Sequence: Synthetic oligonucleotide
cagcucccuauggauggc

SEQ ID NO: 28928 - RNA, 18 nt, Artificial Sequence
  Description of Artificial Sequence: Synthetic oligonucleotide
ccagccagcucccuaugg

SEQ ID NO: 28929 - RNA, 18 nt, Artificial Sequence
  Description of Artificial Sequence: Synthetic oligonucleotide
aacccccagccagcuccc

SEQ ID NO: 28930 - RNA, 18 nt, Artificial Sequence
  Description of Artificial Sequence: Synthetic oligonucleotide
acggaaacccccagccag

SEQ ID NO: 28931 - RNA, 18 nt, Artificial Sequence
  Description of Artificial Sequence: Synthetic oligonucleotide
cucccacggaaaccccca

SEQ ID NO: 28932 - RNA, 18 nt, Artificial Sequence
  Description of Artificial Sequence: Synthetic oligonucleotide
uggagcucccacggaaac

SEQ ID NO: 28933 - RNA, 18 nt, Artificial Sequence
  Description of Artificial Sequence: Synthetic oligonucleotide
aguucuggagcucccacg

SEQ ID NO: 28934 - RNA, 18 nt, Artificial Sequence
  Description of Artificial Sequence: Synthetic oligonucleotide
gggaaaguucuggagcuc

SEQ ID NO: 28935 - RNA, 18 nt, Artificial Sequence
  Description of Artificial Sequence: Synthetic oligonucleotide
cugggcucuucacucagc

SEQ ID NO: 28936 - RNA, 18 nt, Artificial Sequence
  Description of Artificial Sequence: Synthetic oligonucleotide
gggcugggcucuucacuc

SEQ ID NO: 28937 - RNA, 18 nt, Artificial Sequence
  Description of Artificial Sequence: Synthetic oligonucleotide
caauugcacauaagaggg

SEQ ID NO: 28938 - RNA, 18 nt, Artificial Sequence
  Description of Artificial Sequence: Synthetic oligonucleotide
caaggcaauugcacauaa

SEQ ID NO: 28939 - RNA, 18 nt, Artificial Sequence
  Description of Artificial Sequence: Synthetic oligonucleotide
uaguucaaggcaauugca

SEQ ID NO: 28940 - RNA, 18 nt, Artificial Sequence
  Description of Artificial Sequence: Synthetic oligonucleotide
ggucguaguucaaggcaa

SEQ ID NO: 28941 - RNA, 18 nt, Artificial Sequence
  Description of Artificial Sequence: Synthetic oligonucleotide
uacagggucguaguucaa

SEQ ID NO: 28942 - RNA, 18 nt, Artificial Sequence
  Description of Artificial Sequence: Synthetic oligonucleotide
aucucuacagggucguag

SEQ ID NO: 28943 - RNA, 18 nt, Artificial Sequence
  Description of Artificial Sequence: Synthetic oligonucleotide
gagaaaucucuacagggu

SEQ ID NO: 28944 - RNA, 18 nt, Artificial Sequence
  Description of Artificial Sequence: Synthetic oligonucleotide
caugagagaaaucucuac

SEQ ID NO: 28945 - RNA, 18 nt, Artificial Sequence
  Description of Artificial Sequence: Synthetic oligonucleotide
aacgccaugagagaaauc

SEQ ID NO: 28946 - RNA, 18 nt, Artificial Sequence
  Description of Artificial Sequence: Synthetic oligonucleotide
acuagaacgccaugagag

SEQ ID NO: 28947 - RNA, 18 nt, Artificial Sequence
  Description of Artificial Sequence: Synthetic oligonucleotide
agagaacuagaacgccau

SEQ ID NO: 28948 - RNA, 18 nt, Artificial Sequence
  Description of Artificial Sequence: Synthetic oligonucleotide
aggucagagaacuagaac

SEQ ID NO: 28949 - RNA, 18 nt, Artificial Sequence
  Description of Artificial Sequence: Synthetic oligonucleotide
gacucaggucagagaacu

SEQ ID NO: 28950 - RNA, 18 nt, Artificial Sequence
  Description of Artificial Sequence: Synthetic oligonucleotide
acaaagacucaggucaga

SEQ ID NO: 28951 - RNA, 18 nt, Artificial Sequence
  Description of Artificial Sequence: Synthetic oligonucleotide
uuaaaacaaagacucagg

SEQ ID NO: 28952 - RNA, 18 nt, Artificial Sequence
  Description of Artificial Sequence: Synthetic oligonucleotide
acuucuuaaaacaaagac

SEQ ID NO: 28953 - RNA, 18 nt, Artificial Sequence
  Description of Artificial Sequence: Synthetic oligonucleotide
caaauacuucuuaaaaca

SEQ ID NO: 28954 - RNA, 18 nt, Artificial Sequence
  Description of Artificial Sequence: Synthetic oligonucleotide
gaagacaaauacuucuua

SEQ ID NO: 28955 - RNA, 18 nt, Artificial Sequence
  Description of Artificial Sequence: Synthetic oligonucleotide
caaaggaagacaaauacu

SEQ ID NO: 28956 - RNA, 18 nt, Artificial Sequence
  Description of Artificial Sequence: Synthetic oligonucleotide
uuagacaaaggaagacaa

SEQ ID NO: 28957 - RNA, 18 nt, Artificial Sequence
  Description of Artificial Sequence: Synthetic oligonucleotide
ccacauuagacaaaggaa

SEQ ID NO: 28958 - RNA, 18 nt, Artificial Sequence
  Description of Artificial Sequence: Synthetic oligonucleotide
gaaucccacauuagacaa

SEQ ID NO: 28959 - RNA, 18 nt, Artificial Sequence
  Description of Artificial Sequence: Synthetic oligonucleotide
gucaggaaucccacauua

SEQ ID NO: 28960 - RNA, 18 nt, Artificial Sequence
  Description of Artificial Sequence: Synthetic oligonucleotide
agggagucaggaauccca

SEQ ID NO: 28961 - RNA, 18 nt, Artificial Sequence
  Description of Artificial Sequence: Synthetic oligonucleotide
gacgaagggagucaggaa

SEQ ID NO: 28962 - RNA, 18 nt, Artificial Sequence
  Description of Artificial Sequence: Synthetic oligonucleotide
ccuuggacgaagggaguc

SEQ ID NO: 28963 - RNA, 18 nt, Artificial Sequence
  Description of Artificial Sequence: Synthetic oligonucleotide
cggugccuuggacgaagg

SEQ ID NO: 28964 - RNA, 18 nt, Artificial Sequence
  Description of Artificial Sequence: Synthetic oligonucleotide
cacaccggugccuuggac

SEQ ID NO: 28965 - RNA, 18 nt, Artificial Sequence
  Description of Artificial Sequence: Synthetic oligonucleotide
acacacacaccggugccu

SEQ ID NO: 28966 - RNA, 18 nt, Artificial Sequence
  Description of Artificial Sequence: Synthetic oligonucleotide
aagacacacacacaccgg

SEQ ID NO: 28967 - RNA, 18 nt, Artificial Sequence
  Description of Artificial Sequence: Synthetic oligonucleotide
agugcaagacacacacac

SEQ ID NO: 28968 - RNA, 18 nt, Artificial Sequence
  Description of Artificial Sequence: Synthetic oligonucleotide
ucuggagugcaagacaca

SEQ ID NO: 28969 - RNA, 18 nt, Artificial Sequence
  Description of Artificial Sequence: Synthetic oligonucleotide
ucagcucuggagugcaag

SEQ ID NO: 28970 - RNA, 18 nt, Artificial Sequence
  Description of Artificial Sequence: Synthetic oligonucleotide
ggaggucagcucuggagu

SEQ ID NO: 28971 - RNA, 18 nt, Artificial Sequence
  Description of Artificial Sequence: Synthetic oligonucleotide
gcgguggaggucagcucu

SEQ ID NO: 28972 - RNA, 18 nt, Artificial Sequence
  Description of Artificial Sequence: Synthetic oligonucleotide
gcugggcgguggagguca

SEQ ID NO: 28973 - RNA, 18 nt, Artificial Sequence
  Description of Artificial Sequence: Synthetic oligonucleotide
cccaggcugggcggugga

SEQ ID NO: 28974 - RNA, 18 nt, Artificial Sequence
  Description of Artificial Sequence: Synthetic oligonucleotide
gacuucccaggcugggcg

SEQ ID NO: 28975 - RNA, 18 nt, Artificial Sequence
  Description of Artificial Sequence: Synthetic oligonucleotide
acaaugacuucccaggcu

SEQ ID NO: 28976 - RNA, 18 nt, Artificial Sequence
  Description of Artificial Sequence: Synthetic oligonucleotide
ucccuacaaugacuuccc

SEQ ID NO: 28977 - RNA, 18 nt, Artificial Sequence
  Description of Artificial Sequence: Synthetic oligonucleotide
cucacucccuacaaugac

SEQ ID NO: 28978 - RNA, 18 nt, Artificial Sequence
  Description of Artificial Sequence: Synthetic oligonucleotide
agugucucacucccuaca

SEQ ID NO: 28979 - RNA, 18 nt, Artificial Sequence
  Description of Artificial Sequence: Synthetic oligonucleotide
gcuucagugucucacucc

SEQ ID NO: 28980 - RNA, 18 nt, Artificial Sequence
  Description of Artificial Sequence: Synthetic oligonucleotide
ucagggcuucagugucuc

SEQ ID NO: 28981 - RNA, 18 nt, Artificial Sequence
  Description of Artificial Sequence: Synthetic oligonucleotide
gcuucucagggcuucagu

SEQ ID NO: 28982 - RNA, 18 nt, Artificial Sequence
  Description of Artificial Sequence: Synthetic oligonucleotide
cacuggcuucucagggcu

SEQ ID NO: 28983 - RNA, 18 nt, Artificial Sequence
  Description of Artificial Sequence: Synthetic oligonucleotide
gauggcacuggcuucuca

SEQ ID NO: 28984 - RNA, 18 nt, Artificial Sequence
  Description of Artificial Sequence: Synthetic oligonucleotide
gggaugauggcacuggcu

SEQ ID NO: 28985 - RNA, 18 nt, Artificial Sequence
  Description of Artificial Sequence: Synthetic oligonucleotide
auguuccggaacccuggg

SEQ ID NO: 28986 - RNA, 18 nt, Artificial Sequence
  Description of Artificial Sequence: Synthetic oligonucleotide
aaugaauguuccggaacc

SEQ ID NO: 28987 - RNA, 18 nt, Artificial Sequence
  Description of Artificial Sequence: Synthetic oligonucleotide
gggaaugaauguuccgga

SEQ ID NO: 28988 - RNA, 18 nt, Artificial Sequence
  Description of Artificial Sequence: Synthetic oligonucleotide
cagguccucaccgguggg

SEQ ID NO: 28989 - RNA, 18 nt, Artificial Sequence
  Description of Artificial Sequence: Synthetic oligonucleotide
caugccagguccucaccg

SEQ ID NO: 28990 - RNA, 18 nt, Artificial Sequence
  Description of Artificial Sequence: Synthetic oligonucleotide
cgcugcaugccagguccu

SEQ ID NO: 28991 - RNA, 18 nt, Artificial Sequence
  Description of Artificial Sequence: Synthetic oligonucleotide
ugcuucgcugcaugccag

SEQ ID NO: 28992 - RNA, 18 nt, Artificial Sequence
  Description of Artificial Sequence: Synthetic oligonucleotide
ugggcugcuucgcugcau

SEQ ID NO: 28993 - RNA, 18 nt, Artificial Sequence
  Description of Artificial Sequence: Synthetic oligonucleotide
cgggcugggcugcuucgc

SEQ ID NO: 28994 - RNA, 18 nt, Artificial Sequence
  Description of Artificial Sequence: Synthetic oligonucleotide
uccgccgggcugggcugc

SEQ ID NO: 28995 - RNA, 18 nt, Artificial Sequence
  Description of Artificial Sequence: Synthetic oligonucleotide
ugggauccgccgggcugg

SEQ ID NO: 28996 - RNA, 18 nt, Artificial Sequence
  Description of Artificial Sequence: Synthetic oligonucleotide
uggccugggauccgccgg

SEQ ID NO: 28997 - RNA, 18 nt, Artificial Sequence
  Description of Artificial Sequence: Synthetic oligonucleotide
cgugcuggccugggaucc

SEQ ID NO: 28998 - RNA, 18 nt, Artificial Sequence
  Description of Artificial Sequence: Synthetic oligonucleotide
gcaggcgugcuggccugg

SEQ ID NO: 28999 - RNA, 18 nt, Artificial Sequence
  Description of Artificial Sequence: Synthetic oligonucleotide
agccggcaggcgugcugg

SEQ ID NO: 29000 - RNA, 18 nt, Artificial Sequence
  Description of Artificial Sequence: Synthetic oligonucleotide
ugagaagccggcaggcgu

SEQ ID NO: 29001 - RNA, 18 nt, Artificial Sequence
  Description of Artificial Sequence: Synthetic oligonucleotide
gacgaugagaagccggca

SEQ ID NO: 29002 - RNA, 18 nt, Artificial Sequence
  Description of Artificial Sequence: Synthetic oligonucleotide
ucccugacgaugagaagc

SEQ ID NO: 29003 - RNA, 18 nt, Artificial Sequence
  Description of Artificial Sequence: Synthetic oligonucleotide
cgggcucccugacgauga

SEQ ID NO: 29004 - RNA, 18 nt, Artificial Sequence
  Description of Artificial Sequence: Synthetic oligonucleotide
cugggcgggcucccugac

SEQ ID NO: 29005 - RNA, 18 nt, Artificial Sequence
  Description of Artificial Sequence: Synthetic oligonucleotide
gagcucugggcgggcucc

SEQ ID NO: 29006 - RNA, 18 nt, Artificial Sequence
  Description of Artificial Sequence: Synthetic oligonucleotide
gucacgagcucugggcgg

SEQ ID NO: 29007 - RNA, 18 nt, Artificial Sequence
  Description of Artificial Sequence: Synthetic oligonucleotide
ugcucgucacgagcucug

SEQ ID NO: 29008 - RNA, 18 nt, Artificial Sequence
  Description of Artificial Sequence: Synthetic oligonucleotide
gcacuugcucgucacgag

SEQ ID NO: 29009 - RNA, 18 nt, Artificial Sequence
  Description of Artificial Sequence: Synthetic oligonucleotide
acccagcacuugcucguc

SEQ ID NO: 29010 - RNA, 18 nt, Artificial Sequence
  Description of Artificial Sequence: Synthetic oligonucleotide
gggacccagcacuugcuc

SEQ ID NO: 29011 - RNA, 18 nt, Artificial Sequence
  Description of Artificial Sequence: Synthetic oligonucleotide
ccagagcgccgccucggg

SEQ ID NO: 29012 - RNA, 18 nt, Artificial Sequence
  Description of Artificial Sequence: Synthetic oligonucleotide
gccagccagagcgccgcc

SEQ ID NO: 29013 - RNA, 18 nt, Artificial Sequence
  Description of Artificial Sequence: Synthetic oligonucleotide
cagcugccagccagagcg

SEQ ID NO: 29014 - RNA, 18 nt, Artificial Sequence
  Description of Artificial Sequence: Synthetic oligonucleotide
cccaccagcugccagcca

SEQ ID NO: 29015 - RNA, 18 nt, Artificial Sequence
  Description of Artificial Sequence: Synthetic oligonucleotide
uauuccccaccagcugcc

SEQ ID NO: 29016 - RNA, 18 nt, Artificial Sequence
  Description of Artificial Sequence: Synthetic oligonucleotide
cugccuauuccccaccag

SEQ ID NO: 29017 - RNA, 18 nt, Artificial Sequence
  Description of Artificial Sequence: Synthetic oligonucleotide
cugcccugccuauucccc

SEQ ID NO: 29018 - RNA, 18 nt, Artificial Sequence
  Description of Artificial Sequence: Synthetic oligonucleotide
cacagcugcccugccuau

SEQ ID NO: 29019 - RNA, 18 nt, Artificial Sequence
  Description of Artificial Sequence: Synthetic oligonucleotide
ccagccacagcugcccug

SEQ ID NO: 29020 - RNA, 18 nt, Artificial Sequence
  Description of Artificial Sequence: Synthetic oligonucleotide
ucuccccagccacagcug

SEQ ID NO: 29021 - RNA, 18 nt, Artificial Sequence
  Description of Artificial Sequence: Synthetic oligonucleotide
aagucucuccccagccac

SEQ ID NO: 29022 - RNA, 18 nt, Artificial Sequence
  Description of Artificial Sequence: Synthetic oligonucleotide
gccuaaagucucucccca

SEQ ID NO: 29023 - RNA, 18 nt, Artificial Sequence
  Description of Artificial Sequence: Synthetic oligonucleotide
cuucugccuaaagucucu

SEQ ID NO: 29024 - RNA, 18 nt, Artificial Sequence
  Description of Artificial Sequence: Synthetic oligonucleotide
cacagcuucugccuaaag

SEQ ID NO: 29025 - RNA, 18 nt, Artificial Sequence
  Description of Artificial Sequence: Synthetic oligonucleotide
ugcaucacagcuucugcc

SEQ ID NO: 29026 - RNA, 18 nt, Artificial Sequence
  Description of Artificial Sequence: Synthetic oligonucleotide
cagccugcaucacagcuu

SEQ ID NO: 29027 - RNA, 18 nt, Artificial Sequence
  Description of Artificial Sequence: Synthetic oligonucleotide
gcagucagccugcaucac

SEQ ID NO: 29028 - RNA, 18 nt, Artificial Sequence
  Description of Artificial Sequence: Synthetic oligonucleotide
ggcuggcagucagccugc

SEQ ID NO: 29029 - RNA, 18 nt, Artificial Sequence
  Description of Artificial Sequence: Synthetic oligonucleotide
cccucggcuggcagucag

SEQ ID NO: 29030 - RNA, 18 nt, Artificial Sequence
  Description of Artificial Sequence: Synthetic oligonucleotide
ccagccccucggcuggca

SEQ ID NO: 29031 - RNA, 18 nt, Artificial Sequence
  Description of Artificial Sequence: Synthetic oligonucleotide
acuacccagccccucggc

SEQ ID NO: 29032 - RNA, 18 nt, Artificial Sequence
  Description of Artificial Sequence: Synthetic oligonucleotide
acggcacuacccagcccc

SEQ ID NO: 29033 - RNA, 18 nt, Artificial Sequence
  Description of Artificial Sequence: Synthetic oligonucleotide
cccgcacggcacuaccca

SEQ ID NO: 29034 - RNA, 18 nt, Artificial Sequence
  Description of Artificial Sequence: Synthetic oligonucleotide
cagcucccgcacggcacu

SEQ ID NO: 29035 - RNA, 18 nt, Artificial Sequence
  Description of Artificial Sequence: Synthetic oligonucleotide
accaucagcucccgcacg

SEQ ID NO: 29036 - RNA, 18 nt, Artificial Sequence
  Description of Artificial Sequence: Synthetic oligonucleotide
ccuguaccaucagcuccc

SEQ ID NO: 29037 - RNA, 18 nt, Artificial Sequence
  Description of Artificial Sequence: Synthetic oligonucleotide
agugcccuguaccaucag

SEQ ID NO: 29038 - RNA, 18 nt, Artificial Sequence
  Description of Artificial Sequence: Synthetic oligonucleotide
cagcgagugcccuguacc

SEQ ID NO: 29039 - RNA, 18 nt, Artificial Sequence
  Description of Artificial Sequence: Synthetic oligonucleotide
gggacagcgagugcccug

SEQ ID NO: 29040 - RNA, 18 nt, Artificial Sequence
  Description of Artificial Sequence: Synthetic oligonucleotide
ucuaggguggccggaggg

SEQ ID NO: 29041 - RNA, 18 nt, Artificial Sequence
  Description of Artificial Sequence: Synthetic oligonucleotide
ccuggucuaggguggccg

SEQ ID NO: 29042 - RNA, 18 nt, Artificial Sequence
  Description of Artificial Sequence: Synthetic oligonucleotide
cggacccuggucuagggu

SEQ ID NO: 29043 - RNA, 18 nt, Artificial Sequence
  Description of Artificial Sequence: Synthetic oligonucleotide
ccucucggacccuggucu

SEQ ID NO: 29044 - RNA, 18 nt, Artificial Sequence
  Description of Artificial Sequence: Synthetic oligonucleotide
gccugccucucggacccu

SEQ ID NO: 29045 - RNA, 18 nt, Artificial Sequence
  Description of Artificial Sequence: Synthetic oligonucleotide
cuccugccugccucucgg

SEQ ID NO: 29046 - RNA, 18 nt, Artificial Sequence
  Description of Artificial Sequence: Synthetic oligonucleotide
aguggcuccugccugccu

SEQ ID NO: 29047 - RNA, 18 nt, Artificial Sequence
  Description of Artificial Sequence: Synthetic oligonucleotide
acaugaguggcuccugcc

SEQ ID NO: 29048 - RNA, 18 nt, Artificial Sequence
  Description of Artificial Sequence: Synthetic oligonucleotide
ggaagacaugaguggcuc

SEQ ID NO: 29049 - RNA, 18 nt, Artificial Sequence
  Description of Artificial Sequence: Synthetic oligonucleotide
gggaagacaugaguggcu

SEQ ID NO: 29050 - RNA, 18 nt, Artificial Sequence
  Description of Artificial Sequence: Synthetic oligonucleotide
ugggcgucgggcaauggg

SEQ ID NO: 29051 - RNA, 18 nt, Artificial Sequence
  Description of Artificial Sequence: Synthetic oligonucleotide
gucuaugggcgucgggca

SEQ ID NO: 29052 - RNA, 18 nt, Artificial Sequence
  Description of Artificial Sequence: Synthetic oligonucleotide
ggagcgucuaugggcguc

SEQ ID NO: 29053 - RNA, 18 nt, Artificial Sequence
  Description of Artificial Sequence: Synthetic oligonucleotide
aggaaggagcgucuaugg

SEQ ID NO: 29054 - RNA, 18 nt, Artificial Sequence
  Description of Artificial Sequence: Synthetic oligonucleotide
cacacaggaaggagcguc

SEQ ID NO: 29055 - RNA, 18 nt, Artificial Sequence
  Description of Artificial Sequence: Synthetic oligonucleotide
agccccacacaggaagga

SEQ ID NO: 29056 - RNA, 18 nt, Artificial Sequence
  Description of Artificial Sequence: Synthetic oligonucleotide
accccagccccacacagg

SEQ ID NO: 29057 - RNA, 18 nt, Artificial Sequence
  Description of Artificial Sequence: Synthetic oligonucleotide
ggaguaccccagccccac

SEQ ID NO: 29058 - RNA, 18 nt, Artificial Sequence
  Description of Artificial Sequence: Synthetic oligonucleotide
accagggaguaccccagc

SEQ ID NO: 29059 - RNA, 18 nt, Artificial Sequence
  Description of Artificial Sequence: Synthetic oligonucleotide
guacgaccagggaguacc

SEQ ID NO: 29060 - RNA, 18 nt, Artificial Sequence
  Description of Artificial Sequence: Synthetic oligonucleotide
cugcaguacgaccaggga

SEQ ID NO: 29061 - RNA, 18 nt, Artificial Sequence
  Description of Artificial Sequence: Synthetic oligonucleotide
gcugacugcaguacgacc

SEQ ID NO: 29062 - RNA, 18 nt, Artificial Sequence
  Description of Artificial Sequence: Synthetic oligonucleotide
cgggugcugacugcagua

SEQ ID NO: 29063 - RNA, 18 nt, Artificial Sequence
  Description of Artificial Sequence: Synthetic oligonucleotide
gguuacgggugcugacug

SEQ ID NO: 29064 - RNA, 18 nt, Artificial Sequence
  Description of Artificial Sequence: Synthetic oligonucleotide
agccggguuacgggugcu

SEQ ID NO: 29065 - RNA, 18 nt, Artificial Sequence
  Description of Artificial Sequence: Synthetic oligonucleotide
gucauagccggguuacgg

SEQ ID NO: 29066 - RNA, 18 nt, Artificial Sequence
  Description of Artificial Sequence: Synthetic oligonucleotide
cccuggucauagccgggu

SEQ ID NO: 29067 - RNA, 18 nt, Artificial Sequence
  Description of Artificial Sequence: Synthetic oligonucleotide
cagaucccuggucauagc

SEQ ID NO: 29068 - RNA, 18 nt, Artificial Sequence
  Description of Artificial Sequence: Synthetic oligonucleotide
gcuuacagaucccugguc

SEQ ID NO: 29069 - RNA, 18 nt, Artificial Sequence
  Description of Artificial Sequence: Synthetic oligonucleotide
acagggcuuacagauccc

SEQ ID NO: 29070 - RNA, 18 nt, Artificial Sequence
  Description of Artificial Sequence: Synthetic oligonucleotide
gagccacagggcuuacag

SEQ ID NO: 29071 - RNA, 18 nt, Artificial Sequence
  Description of Artificial Sequence: Synthetic oligonucleotide
cuguggagccacagggcu

SEQ ID NO: 29072 - RNA, 18 nt, Artificial Sequence
  Description of Artificial Sequence: Synthetic oligonucleotide
agcaccuguggagccaca

SEQ ID NO: 29073 - RNA, 18 nt, Artificial Sequence
  Description of Artificial Sequence: Synthetic oligonucleotide
gaagcagcaccuguggag

SEQ ID NO: 29074 - RNA, 18 nt, Artificial Sequence
  Description of Artificial Sequence: Synthetic oligonucleotide
agugagaagcagcaccug

SEQ ID NO: 29075 - RNA, 18 nt, Artificial Sequence
  Description of Artificial Sequence: Synthetic oligonucleotide
gggccagugagaagcagc

SEQ ID NO: 29076 - RNA, 18 nt, Artificial Sequence
  Description of Artificial Sequence: Synthetic oligonucleotide
agucugggccagugagaa

SEQ ID NO: 29077 - RNA, 18 nt, Artificial Sequence
  Description of Artificial Sequence: Synthetic oligonucleotide
cucagagucugggccagu

SEQ ID NO: 29078 - RNA, 18 nt, Artificial Sequence
  Description of Artificial Sequence: Synthetic oligonucleotide
uggagcucagagucuggg

SEQ ID NO: 29079 - RNA, 18 nt, Artificial Sequence
  Description of Artificial Sequence: Synthetic oligonucleotide
gccgguggagcucagagu

SEQ ID NO: 29080 - RNA, 18 nt, Artificial Sequence
  Description of Artificial Sequence: Synthetic oligonucleotide
acugggccgguggagcuc

SEQ ID NO: 29081 - RNA, 18 nt, Artificial Sequence
  Description of Artificial Sequence: Synthetic oligonucleotide
ugcagacugggccggugg

SEQ ID NO: 29082 - RNA, 18 nt, Artificial Sequence
  Description of Artificial Sequence: Synthetic oligonucleotide
ggccgugcagacugggcc

SEQ ID NO: 29083 - RNA, 18 nt, Artificial Sequence
  Description of Artificial Sequence: Synthetic oligonucleotide
agaugggccgugcagacu

SEQ ID NO: 29084 - RNA, 18 nt, Artificial Sequence
  Description of Artificial Sequence: Synthetic oligonucleotide
gaagcagaugggccgugc

SEQ ID NO: 29085 - RNA, 18 nt, Artificial Sequence
  Description of Artificial Sequence: Synthetic oligonucleotide
aaggugaagcagaugggc

SEQ ID NO: 29086 - RNA, 18 nt, Artificial Sequence
  Description of Artificial Sequence: Synthetic oligonucleotide
gagggaaggugaagcaga

SEQ ID NO: 29087 - RNA, 18 nt, Artificial Sequence
  Description of Artificial Sequence: Synthetic oligonucleotide
gcugggagggaaggugaa

SEQ ID NO: 29088 - RNA, 18 nt, Artificial Sequence
  Description of Artificial Sequence: Synthetic oligonucleotide
acguggcugggagggaag

SEQ ID NO: 29089 - RNA, 18 nt, Artificial Sequence
  Description of Artificial Sequence: Synthetic oligonucleotide
cuggcacguggcugggag

SEQ ID NO: 29090 - RNA, 18 nt, Artificial Sequence
  Description of Artificial Sequence: Synthetic oligonucleotide
ggccacuggcacguggcu

SEQ ID NO: 29091 - RNA, 18 nt, Artificial Sequence
  Description of Artificial Sequence: Synthetic oligonucleotide
gcuguggccacuggcacg

SEQ ID NO: 29092 - RNA, 18 nt, Artificial Sequence
  Description of Artificial Sequence: Synthetic oligonucleotide
agugggcuguggccacug

SEQ ID NO: 29093 - RNA, 18 nt, Artificial Sequence
  Description of Artificial Sequence: Synthetic oligonucleotide
ugggaagugggcuguggc

SEQ ID NO: 29094 - RNA, 18 nt, Artificial Sequence
  Description of Artificial Sequence: Synthetic oligonucleotide
uggguugggaagugggcu

SEQ ID NO: 29095 - RNA, 18 nt, Artificial Sequence
  Description of Artificial Sequence: Synthetic oligonucleotide
aacaguggguugggaagu

SEQ ID NO: 29096 - RNA, 18 nt, Artificial Sequence
  Description of Artificial Sequence: Synthetic oligonucleotide
gguacaacaguggguugg

SEQ ID NO: 29097 - RNA, 18 nt, Artificial Sequence
  Description of Artificial Sequence: Synthetic oligonucleotide
gccuggguacaacagugg

SEQ ID NO: 29098 - RNA, 18 nt, Artificial Sequence
  Description of Artificial Sequence: Synthetic oligonucleotide
gugaggccuggguacaac

SEQ ID NO: 29099 - RNA, 18 nt, Artificial Sequence
  Description of Artificial Sequence: Synthetic oligonucleotide
gcaaagugaggccugggu

SEQ ID NO: 29100 - RNA, 18 nt, Artificial Sequence
  Description of Artificial Sequence: Synthetic oligonucleotide
caacagcaaagugaggcc

SEQ ID NO: 29101 - RNA, 18 nt, Artificial Sequence
  Description of Artificial Sequence: Synthetic oligonucleotide
aagggcaacagcaaagug

SEQ ID NO: 29102 - RNA, 18 nt, Artificial Sequence
  Description of Artificial Sequence: Synthetic oligonucleotide
gggacaagggcaacagca

SEQ ID NO: 29103 - RNA, 18 nt, Artificial Sequence
  Description of Artificial Sequence: Synthetic oligonucleotide
gaagagggacaagggcaa

SEQ ID NO: 29104 - RNA, 18 nt, Artificial Sequence
  Description of Artificial Sequence: Synthetic oligonucleotide
ggcccgaagagggacaag

SEQ ID NO: 29105 - RNA, 18 nt, Artificial Sequence
  Description of Artificial Sequence: Synthetic oligonucleotide
uucagggcccgaagaggg

SEQ ID NO: 29106 - RNA, 18 nt, Artificial Sequence
  Description of Artificial Sequence: Synthetic oligonucleotide
gaaaauucagggcccgaa

SEQ ID NO: 29107 - RNA, 18 nt, Artificial Sequence
  Description of Artificial Sequence: Synthetic oligonucleotide
gaacagaaaauucagggc

SEQ ID NO: 29108 - RNA, 18 nt, Artificial Sequence
  Description of Artificial Sequence: Synthetic oligonucleotide
ccagggaacagaaaauuc

SEQ ID NO: 29109 - RNA, 18 nt, Artificial Sequence
  Description of Artificial Sequence: Synthetic oligonucleotide
ggcccccagggaacagaa

SEQ ID NO: 29110 - RNA, 18 nt, Artificial Sequence
  Description of Artificial Sequence: Synthetic oligonucleotide
uggcuggcccccagggaa

SEQ ID NO: 29111 - RNA, 18 nt, Artificial Sequence
  Description of Artificial Sequence: Synthetic oligonucleotide
ggcccuggcuggccccca

SEQ ID NO: 29112 - RNA, 18 nt, Artificial Sequence
  Description of Artificial Sequence: Synthetic oligonucleotide
caaagggcccuggcuggc

SEQ ID NO: 29113 - RNA, 18 nt, Artificial Sequence
  Description of Artificial Sequence: Synthetic oligonucleotide
gggcacaaagggcccugg

SEQ ID NO: 29114 - RNA, 18 nt, Artificial Sequence
  Description of Artificial Sequence: Synthetic oligonucleotide
caucaggccugugcuggg

SEQ ID NO: 29115 - RNA, 18 nt, Artificial Sequence
  Description of Artificial Sequence: Synthetic oligonucleotide
accugcaucaggccugug

SEQ ID NO: 29116 - RNA, 18 nt, Artificial Sequence
  Description of Artificial Sequence: Synthetic oligonucleotide
uggacaccugcaucaggc

SEQ ID NO: 29117 - RNA, 18 nt, Artificial Sequence
  Description of Artificial Sequence: Synthetic oligonucleotide
gugaguggacaccugcau

SEQ ID NO: 29118 - RNA, 18 nt, Artificial Sequence
  Description of Artificial Sequence: Synthetic oligonucleotide
caccugugaguggacacc

SEQ ID NO: 29119 - RNA, 18 nt, Artificial Sequence
  Description of Artificial Sequence: Synthetic oligonucleotide
agcgccaccugugagugg

SEQ ID NO: 29120 - RNA, 18 nt, Artificial Sequence
  Description of Artificial Sequence: Synthetic oligonucleotide
aggugagcgccaccugug

SEQ ID NO: 29121 - RNA, 18 nt, Artificial Sequence
  Description of Artificial Sequence: Synthetic oligonucleotide
agccuaggugagcgccac

SEQ ID NO: 29122 - RNA, 18 nt, Artificial Sequence
  Description of Artificial Sequence: Synthetic oligonucleotide
gugacagccuaggugagc

SEQ ID NO: 29123 - RNA, 18 nt, Artificial Sequence
  Description of Artificial Sequence: Synthetic oligonucleotide
guccugugacagccuagg

SEQ ID NO: 29124 - RNA, 18 nt, Artificial Sequence
  Description of Artificial Sequence: Synthetic oligonucleotide
gguggguccugugacagc

SEQ ID NO: 29125 - RNA, 18 nt, Artificial Sequence
  Description of Artificial Sequence: Synthetic oligonucleotide
auggagguggguccugug

SEQ ID NO: 29126 - RNA, 18 nt, Artificial Sequence
  Description of Artificial Sequence: Synthetic oligonucleotide
cuggcauggagguggguc

SEQ ID NO: 29127 - RNA, 18 nt, Artificial Sequence
  Description of Artificial Sequence: Synthetic oligonucleotide
guugccuggcauggaggu

SEQ ID NO: 29128 - RNA, 18 nt, Artificial Sequence
  Description of Artificial Sequence: Synthetic oligonucleotide
ccucuguugccuggcaug

SEQ ID NO: 29129 - RNA, 18 nt, Artificial Sequence
  Description of Artificial Sequence: Synthetic oligonucleotide
guggcccucuguugccug

SEQ ID NO: 29130 - RNA, 18 nt, Artificial Sequence
  Description of Artificial Sequence: Synthetic oligonucleotide
guucuguggcccucuguu

SEQ ID NO: 29131 - RNA, 18 nt, Artificial Sequence
  Description of Artificial Sequence: Synthetic oligonucleotide
gggugguucuguggcccu

SEQ ID NO: 29132 - RNA, 18 nt, Artificial Sequence
  Description of Artificial Sequence: Synthetic oligonucleotide
gaccaaggagugagccgu

SEQ ID NO: 29133 - RNA, 18 nt, Artificial Sequence
  Description of Artificial Sequence: Synthetic oligonucleotide
ccccagaccaaggaguga

SEQ ID NO: 29134 - RNA, 18 nt, Artificial Sequence
  Description of Artificial Sequence: Synthetic oligonucleotide
gguggccccagaccaagg

SEQ ID NO: 29135 - RNA, 18 nt, Artificial Sequence
  Description of Artificial Sequence: Synthetic oligonucleotide
aagaagguggccccagac

SEQ ID NO: 29136 - RNA, 18 nt, Artificial Sequence
  Description of Artificial Sequence: Synthetic oligonucleotide
agggcaagaagguggccc

SEQ ID NO: 29137 - RNA, 18 nt, Artificial Sequence
  Description of Artificial Sequence: Synthetic oligonucleotide
aagaaagggcaagaaggu

SEQ ID NO: 29138 - RNA, 18 nt, Artificial Sequence
  Description of Artificial Sequence: Synthetic oligonucleotide
aaaaaaagaaagggcaag

SEQ ID NO: 29139 - RNA, 18 nt, Artificial Sequence
  Description of Artificial Sequence: Synthetic oligonucleotide
aaaaaaaaaaaagaaagg

SEQ ID NO: 29140 - RNA, 18 nt, Artificial Sequence
  Description of Artificial Sequence: Synthetic oligonucleotide
aaaaaaaaaaaaaaaaag

SEQ ID NO: 29141 - RNA, 18 nt, Artificial Sequence
  Description of Artificial Sequence: Synthetic oligonucleotide
aaaaaaaaaaaaaaaaaa

SEQ ID NO: 29142 - RNA, 18 nt, Artificial Sequence
  Description of Artificial Sequence: Synthetic oligonucleotide
ucggaaaaaaaaaaaaaa

SEQ ID NO: 29143 - RNA, 18 nt, Artificial Sequence
  Description of Artificial Sequence: Synthetic oligonucleotide
ccaucucggaaaaaaaaa

SEQ ID NO: 29144 - RNA, 18 nt, Artificial Sequence
  Description of Artificial Sequence: Synthetic oligonucleotide
agacuccaucucggaaaa

SEQ ID NO: 29145 - RNA, 18 nt, Artificial Sequence
  Description of Artificial Sequence: Synthetic oligonucleotide
gagagagacuccaucucg

SEQ ID NO: 29146 - RNA, 18 nt, Artificial Sequence
  Description of Artificial Sequence: Synthetic oligonucleotide
ugacagagagagacucca

SEQ ID NO: 29147 - RNA, 18 nt, Artificial Sequence
  Description of Artificial Sequence: Synthetic oligonucleotide
cugggugacagagagaga

SEQ ID NO: 29148 - RNA, 18 nt, Artificial Sequence
  Description of Artificial Sequence: Synthetic oligonucleotide
cccaccugggugacagag

SEQ ID NO: 29149 - RNA, 18 nt, Artificial Sequence
  Description of Artificial Sequence: Synthetic oligonucleotide
acacucccaccuggguga

SEQ ID NO: 29150 - RNA, 18 nt, Artificial Sequence
  Description of Artificial Sequence: Synthetic oligonucleotide
ccaccacacucccaccug

SEQ ID NO: 29151 - RNA, 18 nt, Artificial Sequence
  Description of Artificial Sequence: Synthetic oligonucleotide
uugugccaccacacuccc

SEQ ID NO: 29152 - RNA, 18 nt, Artificial Sequence
  Description of Artificial Sequence: Synthetic oligonucleotide
cgagauugugccaccaca

SEQ ID NO: 29153 - RNA, 18 nt, Artificial Sequence
  Description of Artificial Sequence: Synthetic oligonucleotide
ugagccgagauugugcca

SEQ ID NO: 29154 - RNA, 18 nt, Artificial Sequence
  Description of Artificial Sequence: Synthetic oligonucleotide
ugcagugagccgagauug

SEQ ID NO: 29155 - RNA, 18 nt, Artificial Sequence
  Description of Artificial Sequence: Synthetic oligonucleotide
gagguugcagugagccga

SEQ ID NO: 29156 - RNA, 18 nt, Artificial Sequence
  Description of Artificial Sequence: Synthetic oligonucleotide
agguggagguugcaguga

SEQ ID NO: 29157 - RNA, 18 nt, Artificial Sequence
  Description of Artificial Sequence: Synthetic oligonucleotide
ucaggagguggagguugc

SEQ ID NO: 29158 - RNA, 18 nt, Artificial Sequence
  Description of Artificial Sequence: Synthetic oligonucleotide
ugaacucaggagguggag

SEQ ID NO: 29159 - RNA, 18 nt, Artificial Sequence
  Description of Artificial Sequence: Synthetic oligonucleotide
uugcuugaacucaggagg

SEQ ID NO: 29160 - RNA, 18 nt, Artificial Sequence
  Description of Artificial Sequence: Synthetic oligonucleotide
gagaauugcuugaacuca

SEQ ID NO: 29161 - RNA, 18 nt, Artificial Sequence
  Description of Artificial Sequence: Synthetic oligonucleotide
ggcaggagaauugcuuga

SEQ ID NO: 29162 - RNA, 18 nt, Artificial Sequence
  Description of Artificial Sequence: Synthetic oligonucleotide
gcugaggcaggagaauug

SEQ ID NO: 29163 - RNA, 18 nt, Artificial Sequence
  Description of Artificial Sequence: Synthetic oligonucleotide
gggaggcugaggcaggag

SEQ ID NO: 29164 - RNA, 18 nt, Artificial Sequence
  Description of Artificial Sequence: Synthetic oligonucleotide
uacuugggaggcugaggc

SEQ ID NO: 29165 - RNA, 18 nt, Artificial Sequence
  Description of Artificial Sequence: Synthetic oligonucleotide
ccagcuacuugggaggcu

SEQ ID NO: 29166 - RNA, 18 nt, Artificial Sequence
  Description of Artificial Sequence: Synthetic oligonucleotide
uagucccagcuacuuggg

SEQ ID NO: 29167 - RNA, 18 nt, Artificial Sequence
  Description of Artificial Sequence: Synthetic oligonucleotide
gccuguagucccagcuac

SEQ ID NO: 29168 - RNA, 18 nt, Artificial Sequence
  Description of Artificial Sequence: Synthetic oligonucleotide
ugcaugccuguaguccca

SEQ ID NO: 29169 - RNA, 18 nt, Artificial Sequence
  Description of Artificial Sequence: Synthetic oligonucleotide
gguggugcaugccuguag

SEQ ID NO: 29170 - RNA, 18 nt, Artificial Sequence
  Description of Artificial Sequence: Synthetic oligonucleotide
agugugguggugcaugcc

SEQ ID NO: 29171 - RNA, 18 nt, Artificial Sequence
  Description of Artificial Sequence: Synthetic oligonucleotide
ggccaagugugguggugc

SEQ ID NO: 29172 - RNA, 18 nt, Artificial Sequence
  Description of Artificial Sequence: Synthetic oligonucleotide
acauuggccaaguguggu

SEQ ID NO: 29173 - RNA, 18 nt, Artificial Sequence
  Description of Artificial Sequence: Synthetic oligonucleotide
acagaacauuggccaagu

SEQ ID NO: 29174 - RNA, 18 nt, Artificial Sequence
  Description of Artificial Sequence: Synthetic oligonucleotide
aaaauacagaacauuggc

SEQ ID NO: 29175 - RNA, 18 nt, Artificial Sequence
  Description of Artificial Sequence: Synthetic oligonucleotide
uauuaaaaauacagaaca

SEQ ID NO: 29176 - RNA, 18 nt, Artificial Sequence
  Description of Artificial Sequence: Synthetic oligonucleotide
gucccuauuaaaaauaca

SEQ ID NO: 29177 - RNA, 18 nt, Artificial Sequence
  Description of Artificial Sequence: Synthetic oligonucleotide
accccgucccuauuaaaa

SEQ ID NO: 29178 - RNA, 18 nt, Artificial Sequence
  Description of Artificial Sequence: Synthetic oligonucleotide
gcaaaaccccgucccuau

SEQ ID NO: 29179 - RNA, 18 nt, Artificial Sequence
  Description of Artificial Sequence: Synthetic oligonucleotide
acauggcaaaaccccguc

SEQ ID NO: 29180 - RNA, 18 nt, Artificial Sequence
  Description of Artificial Sequence: Synthetic oligonucleotide
agcuaacauggcaaaacc

SEQ ID NO: 29181 - RNA, 18 nt, Artificial Sequence
  Description of Artificial Sequence: Synthetic oligonucleotide
agccuagcuaacauggca

SEQ ID NO: 29182 - RNA, 18 nt, Artificial Sequence
  Description of Artificial Sequence: Synthetic oligonucleotide
agaccagccuagcuaaca

SEQ ID NO: 29183 - RNA, 18 nt, Artificial Sequence
  Description of Artificial Sequence: Synthetic oligonucleotide
guuugagaccagccuagc

SEQ ID NO: 29184 - RNA, 18 nt, Artificial Sequence
  Description of Artificial Sequence: Synthetic oligonucleotide
ugugaguuugagaccagc

SEQ ID NO: 29185 - RNA, 18 nt, Artificial Sequence
  Description of Artificial Sequence: Synthetic oligonucleotide
ccaggugugaguuugaga

SEQ ID NO: 29186 - RNA, 18 nt, Artificial Sequence
  Description of Artificial Sequence: Synthetic oligonucleotide
uaaucccaggugugaguu

SEQ ID NO: 29187 - RNA, 18 nt, Artificial Sequence
  Description of Artificial Sequence: Synthetic oligonucleotide
gccuguaaucccaggugu

SEQ ID NO: 29188 - RNA, 18 nt, Artificial Sequence
  Description of Artificial Sequence: Synthetic oligonucleotide
cucaugccuguaauccca

SEQ ID NO: 29189 - RNA, 18 nt, Artificial Sequence
  Description of Artificial Sequence: Synthetic oligonucleotide
aguggcucaugccuguaa

SEQ ID NO: 29190 - RNA, 18 nt, Artificial Sequence
  Description of Artificial Sequence: Synthetic oligonucleotide
ggugcaguggcucaugcc

SEQ ID NO: 29191 - RNA, 18 nt, Artificial Sequence
  Description of Artificial Sequence: Synthetic oligonucleotide
ggcugggugcaguggcuc

SEQ ID NO: 29192 - RNA, 18 nt, Artificial Sequence
  Description of Artificial Sequence: Synthetic oligonucleotide
gggcugggugcaguggcu

SEQ ID NO: 29193 - RNA, 18 nt, Artificial Sequence
  Description of Artificial Sequence: Synthetic oligonucleotide
aagaaagggcaagaaggg

SEQ ID NO: 29194 - RNA, 18 nt, Artificial Sequence
  Description of Artificial Sequence: Synthetic oligonucleotide
gagaaaagaaagggcaag

SEQ ID NO: 29195 - RNA, 18 nt, Artificial Sequence
  Description of Artificial Sequence: Synthetic oligonucleotide
ccauggagaaaagaaagg

SEQ ID NO: 29196 - RNA, 18 nt, Artificial Sequence
  Description of Artificial Sequence: Synthetic oligonucleotide
aucagccauggagaaaag

SEQ ID NO: 29197 - RNA, 18 nt, Artificial Sequence
  Description of Artificial Sequence: Synthetic oligonucleotide
gcagcaucagccauggag

SEQ ID NO: 29198 - RNA, 18 nt, Artificial Sequence
  Description of Artificial Sequence: Synthetic oligonucleotide
ccacagcagcaucagcca

SEQ ID NO: 29199 - RNA, 18 nt, Artificial Sequence
  Description of Artificial Sequence: Synthetic oligonucleotide
gcuggccacagcagcauc

SEQ ID NO: 29200 - RNA, 18 nt, Artificial Sequence
  Description of Artificial Sequence: Synthetic oligonucleotide
cccuggcuggccacagca

SEQ ID NO: 29201 - RNA, 18 nt, Artificial Sequence
  Description of Artificial Sequence: Synthetic oligonucleotide
aagggcccuggcuggcca

SEQ ID NO: 29202 - RNA, 18 nt, Artificial Sequence
  Description of Artificial Sequence: Synthetic oligonucleotide
aucucaagggcccuggcu

SEQ ID NO: 29203 - RNA, 18 nt, Artificial Sequence
  Description of Artificial Sequence: Synthetic oligonucleotide
gaaggaucucaagggccc

SEQ ID NO: 29204 - RNA, 18 nt, Artificial Sequence
  Description of Artificial Sequence: Synthetic oligonucleotide
aacuggaaggaucucaag

SEQ ID NO: 29205 - RNA, 18 nt, Artificial Sequence
  Description of Artificial Sequence: Synthetic oligonucleotide
agccaaacuggaaggauc

SEQ ID NO: 29206 - RNA, 18 nt, Artificial Sequence
  Description of Artificial Sequence: Synthetic oligonucleotide
auaacagccaaacuggaa

SEQ ID NO: 29207 - RNA, 18 nt, Artificial Sequence
  Description of Artificial Sequence: Synthetic oligonucleotide
uuugcauaacagccaaac

SEQ ID NO: 29208 - RNA, 18 nt, Artificial Sequence
  Description of Artificial Sequence: Synthetic oligonucleotide
ccugcuuugcauaacagc

SEQ ID NO: 29209 - RNA, 18 nt, Artificial Sequence
  Description of Artificial Sequence: Synthetic oligonucleotide
aaucaccugcuuugcaua

SEQ ID NO: 29210 - RNA, 18 nt, Artificial Sequence
  Description of Artificial Sequence: Synthetic oligonucleotide
agacaaaucaccugcuuu

SEQ ID NO: 29211 - RNA, 18 nt, Artificial Sequence
  Description of Artificial Sequence: Synthetic oligonucleotide
gauuaagacaaaucaccu

SEQ ID NO: 29212 - RNA, 18 nt, Artificial Sequence
  Description of Artificial Sequence: Synthetic oligonucleotide
uaucugauuaagacaaau

SEQ ID NO: 29213 - RNA, 18 nt, Artificial Sequence
  Description of Artificial Sequence: Synthetic oligonucleotide
ucuuuuaucugauuaaga

SEQ ID NO: 29214 - RNA, 18 nt, Artificial Sequence
  Description of Artificial Sequence: Synthetic oligonucleotide
cucuaucuuuuaucugau

SEQ ID NO: 29215 - RNA, 18 nt, Artificial Sequence
  Description of Artificial Sequence: Synthetic oligonucleotide
auagccucuaucuuuuau

SEQ ID NO: 29216 - RNA, 18 nt, Artificial Sequence
  Description of Artificial Sequence: Synthetic oligonucleotide
cccccauagccucuaucu

SEQ ID NO: 29217 - RNA, 18 nt, Artificial Sequence
  Description of Artificial Sequence: Synthetic oligonucleotide
ugaggcccccauagccuc

SEQ ID NO: 29218 - RNA, 18 nt, Artificial Sequence
  Description of Artificial Sequence: Synthetic oligonucleotide
aaucuugaggcccccaua

SEQ ID NO: 29219 - RNA, 18 nt, Artificial Sequence
  Description of Artificial Sequence: Synthetic oligonucleotide
ccaaaaaucuugaggccc

SEQ ID NO: 29220 - RNA, 18 nt, Artificial Sequence
  Description of Artificial Sequence: Synthetic oligonucleotide
gcucuccaaaaaucuuga

SEQ ID NO: 29221 - RNA, 18 nt, Artificial Sequence
  Description of Artificial Sequence: Synthetic oligonucleotide
ccucugcucuccaaaaau

SEQ ID NO: 29222 - RNA, 18 nt, Artificial Sequence
  Description of Artificial Sequence: Synthetic oligonucleotide
gaccaccucugcucucca

SEQ ID NO: 29223 - RNA, 18 nt, Artificial Sequence
  Description of Artificial Sequence: Synthetic oligonucleotide
ccagagaccaccucugcu

SEQ ID NO: 29224 - RNA, 18 nt, Artificial Sequence
  Description of Artificial Sequence: Synthetic oligonucleotide
aauugccagagaccaccu

SEQ ID NO: 29225 - RNA, 18 nt, Artificial Sequence
  Description of Artificial Sequence: Synthetic oligonucleotide
gauggaauugccagagac

SEQ ID NO: 29226 - RNA, 18 nt, Artificial Sequence
  Description of Artificial Sequence: Synthetic oligonucleotide
aaccagauggaauugcca

SEQ ID NO: 29227 - RNA, 18 nt, Artificial Sequence
  Description of Artificial Sequence: Synthetic oligonucleotide
cucaaaaccagauggaau

SEQ ID NO: 29228 - RNA, 18 nt, Artificial Sequence
  Description of Artificial Sequence: Synthetic oligonucleotide
aguuucucaaaaccagau

SEQ ID NO: 29229 - RNA, 18 nt, Artificial Sequence
  Description of Artificial Sequence: Synthetic oligonucleotide
ugcuaaguuucucaaaac

SEQ ID NO: 29230 - RNA, 18 nt, Artificial Sequence
  Description of Artificial Sequence: Synthetic oligonucleotide
ugagcugcuaaguuucuc

SEQ ID NO: 29231 - RNA, 18 nt, Artificial Sequence
  Description of Artificial Sequence: Synthetic oligonucleotide
cucugugagcugcuaagu

SEQ ID NO: 29232 - RNA, 18 nt, Artificial Sequence
  Description of Artificial Sequence: Synthetic oligonucleotide
cugugcucugugagcugc

SEQ ID NO: 29233 - RNA, 18 nt, Artificial Sequence
  Description of Artificial Sequence: Synthetic oligonucleotide
gaucucugugcucuguga

SEQ ID NO: 29234 - RNA, 18 nt, Artificial Sequence
  Description of Artificial Sequence: Synthetic oligonucleotide
ggcaggaucucugugcuc

SEQ ID NO: 29235 - RNA, 18 nt, Artificial Sequence
  Description of Artificial Sequence: Synthetic oligonucleotide
aagaaggcaggaucucug

SEQ ID NO: 29236 - RNA, 18 nt, Artificial Sequence
  Description of Artificial Sequence: Synthetic oligonucleotide
guaggaagaaggcaggau

SEQ ID NO: 29237 - RNA, 18 nt, Artificial Sequence
  Description of Artificial Sequence: Synthetic oligonucleotide
ugauaguaggaagaaggc

SEQ ID NO: 29238 - RNA, 18 nt, Artificial Sequence
  Description of Artificial Sequence: Synthetic oligonucleotide
cagccugauaguaggaag

SEQ ID NO: 29239 - RNA, 18 nt, Artificial Sequence
  Description of Artificial Sequence: Synthetic oligonucleotide
uaggucagccugauagua

SEQ ID NO: 29240 - RNA, 18 nt, Artificial Sequence
  Description of Artificial Sequence: Synthetic oligonucleotide
cccauuaggucagccuga

SEQ ID NO: 29241 - RNA, 18 nt, Artificial Sequence
  Description of Artificial Sequence: Synthetic oligonucleotide
ccaaccccauuaggucag

SEQ ID NO: 29242 - RNA, 18 nt, Artificial Sequence
  Description of Artificial Sequence: Synthetic oligonucleotide
gcagcccaaccccauuag

SEQ ID NO: 29243 - RNA, 18 nt, Artificial Sequence
  Description of Artificial Sequence: Synthetic oligonucleotide
gccgagcagcccaacccc

SEQ ID NO: 29244 - RNA, 18 nt, Artificial Sequence
  Description of Artificial Sequence: Synthetic oligonucleotide
caguugccgagcagccca

SEQ ID NO: 29245 - RNA, 18 nt, Artificial Sequence
  Description of Artificial Sequence: Synthetic oligonucleotide
ccaagcaguugccgagca

SEQ ID NO: 29246 - RNA, 18 nt, Artificial Sequence
  Description of Artificial Sequence: Synthetic oligonucleotide
gugacccaagcaguugcc

SEQ ID NO: 29247 - RNA, 18 nt, Artificial Sequence
  Description of Artificial Sequence: Synthetic oligonucleotide
gcaaggugacccaagcag

SEQ ID NO: 29248 - RNA, 18 nt, Artificial Sequence
  Description of Artificial Sequence: Synthetic oligonucleotide
gggcaaggugacccaagc

SEQ ID NO: 29249 - RNA, 18 nt, Artificial Sequence
  Description of Artificial Sequence: Synthetic oligonucleotide
agggcugguuuccuuggg

SEQ ID NO: 29250 - RNA, 18 nt, Artificial Sequence
  Description of Artificial Sequence: Synthetic oligonucleotide
cacccagggcugguuucc

SEQ ID NO: 29251 - RNA, 18 nt, Artificial Sequence
  Description of Artificial Sequence: Synthetic oligonucleotide
gguggcacccagggcugg

SEQ ID NO: 29252 - RNA, 18 nt, Artificial Sequence
  Description of Artificial Sequence: Synthetic oligonucleotide
ggcuggguggcacccagg

SEQ ID NO: 29253 - RNA, 18 nt, Artificial Sequence
  Description of Artificial Sequence: Synthetic oligonucleotide
uaaguggcuggguggcac

SEQ ID NO: 29254 - RNA, 18 nt, Artificial Sequence
  Description of Artificial Sequence: Synthetic oligonucleotide
gacccuaaguggcugggu

SEQ ID NO: 29255 - RNA, 18 nt, Artificial Sequence
  Description of Artificial Sequence: Synthetic oligonucleotide
cuguagacccuaaguggc

SEQ ID NO: 29256 - RNA, 18 nt, Artificial Sequence
  Description of Artificial Sequence: Synthetic oligonucleotide
ccacccuguagacccuaa

SEQ ID NO: 29257 - RNA, 18 nt, Artificial Sequence
  Description of Artificial Sequence: Synthetic oligonucleotide
gagucccacccuguagac

SEQ ID NO: 29258 - RNA, 18 nt, Artificial Sequence
  Description of Artificial Sequence: Synthetic oligonucleotide
gucuggagucccacccug

SEQ ID NO: 29259 - RNA, 18 nt, Artificial Sequence
  Description of Artificial Sequence: Synthetic oligonucleotide
ucuaggucuggaguccca

SEQ ID NO: 29260 - RNA, 18 nt, Artificial Sequence
  Description of Artificial Sequence: Synthetic oligonucleotide
uacgcucuaggucuggag

SEQ ID NO: 29261 - RNA, 18 nt, Artificial Sequence
  Description of Artificial Sequence: Synthetic oligonucleotide
auacuuacgcucuagguc

SEQ ID NO: 29262 - RNA, 18 nt, Artificial Sequence
  Description of Artificial Sequence: Synthetic oligonucleotide
cauccauacuuacgcucu

SEQ ID NO: 29263 - RNA, 18 nt, Artificial Sequence
  Description of Artificial Sequence: Synthetic oligonucleotide
cacaacauccauacuuac

SEQ ID NO: 29264 - RNA, 18 nt, Artificial Sequence
  Description of Artificial Sequence: Synthetic oligonucleotide
agggccacaacauccaua

SEQ ID NO: 29265 - RNA, 18 nt, Artificial Sequence
  Description of Artificial Sequence: Synthetic oligonucleotide
gacacagggccacaacau

SEQ ID NO: 29266 - RNA, 18 nt, Artificial Sequence
  Description of Artificial Sequence: Synthetic oligonucleotide
aggaagacacagggccac

SEQ ID NO: 29267 - RNA, 18 nt, Artificial Sequence
  Description of Artificial Sequence: Synthetic oligonucleotide
acacuaggaagacacagg

SEQ ID NO: 29268 - RNA, 18 nt, Artificial Sequence
  Description of Artificial Sequence: Synthetic oligonucleotide
gggucacacuaggaagac

SEQ ID NO: 29269 - RNA, 18 nt, Artificial Sequence
  Description of Artificial Sequence: Synthetic oligonucleotide
uggcugggucacacuagg

SEQ ID NO: 29270 - RNA, 18 nt, Artificial Sequence
  Description of Artificial Sequence: Synthetic oligonucleotide
gcuccuggcugggucaca

SEQ ID NO: 29271 - RNA, 18 nt, Artificial Sequence
  Description of Artificial Sequence: Synthetic oligonucleotide
cuuccgcuccuggcuggg

SEQ ID NO: 29272 - RNA, 18 nt, Artificial Sequence
  Description of Artificial Sequence: Synthetic oligonucleotide
ugaagcuuccgcuccugg

SEQ ID NO: 29273 - RNA, 18 nt, Artificial Sequence
  Description of Artificial Sequence: Synthetic oligonucleotide
acgccugaagcuuccgcu

SEQ ID NO: 29274 - RNA, 18 nt, Artificial Sequence
  Description of Artificial Sequence: Synthetic oligonucleotide
uacaaacgccugaagcuu

SEQ ID NO: 29275 - RNA, 18 nt, Artificial Sequence
  Description of Artificial Sequence: Synthetic oligonucleotide
cacuuuacaaacgccuga

SEQ ID NO: 29276 - RNA, 18 nt, Artificial Sequence
  Description of Artificial Sequence: Synthetic oligonucleotide
gaccucacuuuacaaacg

SEQ ID NO: 29277 - RNA, 18 nt, Artificial Sequence
  Description of Artificial Sequence: Synthetic oligonucleotide
agccagaccucacuuuac

SEQ ID NO: 29278 - RNA, 18 nt, Artificial Sequence
  Description of Artificial Sequence: Synthetic oligonucleotide
ggcagagccagaccucac

SEQ ID NO: 29279 - RNA, 18 nt, Artificial Sequence
  Description of Artificial Sequence: Synthetic oligonucleotide
gaggaggcagagccagac

SEQ ID NO: 29280 - RNA, 18 nt, Artificial Sequence
  Description of Artificial Sequence: Synthetic oligonucleotide
aaacggaggaggcagagc

SEQ ID NO: 29281 - RNA, 18 nt, Artificial Sequence
  Description of Artificial Sequence: Synthetic oligonucleotide
aaaaaaaacggaggaggc

SEQ ID NO: 29282 - RNA, 18 nt, Artificial Sequence
  Description of Artificial Sequence: Synthetic oligonucleotide
aaaaaaaaaaaaacggag

SEQ ID NO: 29283 - RNA, 18 nt, Artificial Sequence
  Description of Artificial Sequence: Synthetic oligonucleotide
acagaaaaaaaaaaaaaa

SEQ ID NO: 29284 - RNA, 18 nt, Artificial Sequence
  Description of Artificial Sequence: Synthetic oligonucleotide
cagaaacagaaaaaaaaa

SEQ ID NO: 29285 - RNA, 18 nt, Artificial Sequence
  Description of Artificial Sequence: Synthetic oligonucleotide
agaaacagaaacagaaaa

SEQ ID NO: 29286 - RNA, 18 nt, Artificial Sequence
  Description of Artificial Sequence: Synthetic oligonucleotide
aaaacagaaacagaaaca

SEQ ID NO: 29287 - RNA, 18 nt, Artificial Sequence
  Description of Artificial Sequence: Synthetic oligonucleotide
aaaaaaaaacagaaacag

SEQ ID NO: 29288 - RNA, 18 nt, Artificial Sequence
  Description of Artificial Sequence: Synthetic oligonucleotide
ucucaaaaaaaaaacaga

SEQ ID NO: 29289 - RNA, 18 nt, Artificial Sequence
  Description of Artificial Sequence: Synthetic oligonucleotide
cuccaucucaaaaaaaaa

SEQ ID NO: 29290 - RNA, 18 nt, Artificial Sequence
  Description of Artificial Sequence: Synthetic oligonucleotide
cgagacuccaucucaaaa

SEQ ID NO: 29291 - RNA, 18 nt, Artificial Sequence
  Description of Artificial Sequence: Synthetic oligonucleotide
cagagcgagacuccaucu

SEQ ID NO: 29292 - RNA, 18 nt, Artificial Sequence
  Description of Artificial Sequence: Synthetic oligonucleotide
ggcgacagagcgagacuc

SEQ ID NO: 29293 - RNA, 18 nt, Artificial Sequence
  Description of Artificial Sequence: Synthetic oligonucleotide
gccugggcgacagagcga

SEQ ID NO: 29294 - RNA, 18 nt, Artificial Sequence
  Description of Artificial Sequence: Synthetic oligonucleotide
cuccagccugggcgacag

SEQ ID NO: 29295 - RNA, 18 nt, Artificial Sequence
  Description of Artificial Sequence: Synthetic oligonucleotide
cugcacuccagccugggc

SEQ ID NO: 29296 - RNA, 18 nt, Artificial Sequence
  Description of Artificial Sequence: Synthetic oligonucleotide
ugacacugcacuccagcc

SEQ ID NO: 29297 - RNA, 18 nt, Artificial Sequence
  Description of Artificial Sequence: Synthetic oligonucleotide
gaucgugacacugcacuc

SEQ ID NO: 29298 - RNA, 18 nt, Artificial Sequence
  Description of Artificial Sequence: Synthetic oligonucleotide
gcugagaucgugacacug

SEQ ID NO: 29299 - RNA, 18 nt, Artificial Sequence
  Description of Artificial Sequence: Synthetic oligonucleotide
agugagcugagaucguga

SEQ ID NO: 29300 - RNA, 18 nt, Artificial Sequence
  Description of Artificial Sequence: Synthetic oligonucleotide
guugcagugagcugagau

SEQ ID NO: 29301 - RNA, 18 nt, Artificial Sequence
  Description of Artificial Sequence: Synthetic oligonucleotide
cggagguugcagugagcu

SEQ ID NO: 29302 - RNA, 18 nt, Artificial Sequence
  Description of Artificial Sequence: Synthetic oligonucleotide
ggaggcggagguugcagu

SEQ ID NO: 29303 - RNA, 18 nt, Artificial Sequence
  Description of Artificial Sequence: Synthetic oligonucleotide
accugggaggcggagguu

SEQ ID NO: 29304 - RNA, 18 nt, Artificial Sequence
  Description of Artificial Sequence: Synthetic oligonucleotide
cuuguaccugggaggcgg

SEQ ID NO: 29305 - RNA, 18 nt, Artificial Sequence
  Description of Artificial Sequence: Synthetic oligonucleotide
aaucucuuguaccuggga

SEQ ID NO: 29306 - RNA, 18 nt, Artificial Sequence
  Description of Artificial Sequence: Synthetic oligonucleotide
aggagaaucucuuguacc

SEQ ID NO: 29307 - RNA, 18 nt, Artificial Sequence
  Description of Artificial Sequence: Synthetic oligonucleotide
gaggcaggagaaucucuu

SEQ ID NO: 29308 - RNA, 18 nt, Artificial Sequence
  Description of Artificial Sequence: Synthetic oligonucleotide
aggcugaggcaggagaau

SEQ ID NO: 29309 - RNA, 18 nt, Artificial Sequence
  Description of Artificial Sequence: Synthetic oligonucleotide
ucgggaggcugaggcagg

SEQ ID NO: 29310 - RNA, 18 nt, Artificial Sequence
  Description of Artificial Sequence: Synthetic oligonucleotide
gcuacucgggaggcugag

SEQ ID NO: 29311 - RNA, 18 nt, Artificial Sequence
  Description of Artificial Sequence: Synthetic oligonucleotide
ucccagcuacucgggagg

SEQ ID NO: 29312 - RNA, 18 nt, Artificial Sequence
  Description of Artificial Sequence: Synthetic oligonucleotide
uguagucccagcuacucg

SEQ ID NO: 29313 - RNA, 18 nt, Artificial Sequence
  Description of Artificial Sequence: Synthetic oligonucleotide
acgccuguagucccagcu

SEQ ID NO: 29314 - RNA, 18 nt, Artificial Sequence
  Description of Artificial Sequence: Synthetic oligonucleotide
ggcacacgccuguagucc

SEQ ID NO: 29315 - RNA, 18 nt, Artificial Sequence
  Description of Artificial Sequence: Synthetic oligonucleotide
augguggcacacgccugu

SEQ ID NO: 29316 - RNA, 18 nt, Artificial Sequence
  Description of Artificial Sequence: Synthetic oligonucleotide
caggcaugguggcacacg

SEQ ID NO: 29317 - RNA, 18 nt, Artificial Sequence
  Description of Artificial Sequence: Synthetic oligonucleotide
uuagccaggcaugguggc

SEQ ID NO: 29318 - RNA, 18 nt, Artificial Sequence
  Description of Artificial Sequence: Synthetic oligonucleotide
aaaaauuagccaggcaug

SEQ ID NO: 29319 - RNA, 18 nt, Artificial Sequence
  Description of Artificial Sequence: Synthetic oligonucleotide
aauacaaaaauuagccag

SEQ ID NO: 29320 - RNA, 18 nt, Artificial Sequence
  Description of Artificial Sequence: Synthetic oligonucleotide
cuaaaaauacaaaaauua

SEQ ID NO: 29321 - RNA, 18 nt, Artificial Sequence
  Description of Artificial Sequence: Synthetic oligonucleotide
cucuacuaaaaauacaaa

SEQ ID NO: 29322 - RNA, 18 nt, Artificial Sequence
  Description of Artificial Sequence: Synthetic oligonucleotide
cccaucucuacuaaaaau

SEQ ID NO: 29323 - RNA, 18 nt, Artificial Sequence
  Description of Artificial Sequence: Synthetic oligonucleotide
gaaaccccaucucuacua

SEQ ID NO: 29324 - RNA, 18 nt, Artificial Sequence
  Description of Artificial Sequence: Synthetic oligonucleotide
auggcgaaaccccaucuc

SEQ ID NO: 29325 - RNA, 18 nt, Artificial Sequence
  Description of Artificial Sequence: Synthetic oligonucleotide
cuaacauggcgaaacccc

SEQ ID NO: 29326 - RNA, 18 nt, Artificial Sequence
  Description of Artificial Sequence: Synthetic oligonucleotide
ucuggcuaacauggcgaa

SEQ ID NO: 29327 - RNA, 18 nt, Artificial Sequence
  Description of Artificial Sequence: Synthetic oligonucleotide
accagucuggcuaacaug

SEQ ID NO: 29328 - RNA, 18 nt, Artificial Sequence
  Description of Artificial Sequence: Synthetic oligonucleotide
ucgagaccagucuggcua

SEQ ID NO: 29329 - RNA, 18 nt, Artificial Sequence
  Description of Artificial Sequence: Synthetic oligonucleotide
ggaguucgagaccagucu

SEQ ID NO: 29330 - RNA, 18 nt, Artificial Sequence
  Description of Artificial Sequence: Synthetic oligonucleotide
ggucaggaguucgagacc

SEQ ID NO: 29331 - RNA, 18 nt, Artificial Sequence
  Description of Artificial Sequence: Synthetic oligonucleotide
ccugaggucaggaguucg

SEQ ID NO: 29332 - RNA, 18 nt, Artificial Sequence
  Description of Artificial Sequence: Synthetic oligonucleotide
gaucaccugaggucagga

SEQ ID NO: 29333 - RNA, 18 nt, Artificial Sequence
  Description of Artificial Sequence: Synthetic oligonucleotide
gggaggaucaccugaggu

SEQ ID NO: 29334 - RNA, 18 nt, Artificial Sequence
  Description of Artificial Sequence: Synthetic oligonucleotide
gggugggaggaucaccug

SEQ ID NO: 29335 - RNA, 18 nt, Artificial Sequence
  Description of Artificial Sequence: Synthetic oligonucleotide
gaacuuugggaagccggg

SEQ ID NO: 29336 - RNA, 18 nt, Artificial Sequence
  Description of Artificial Sequence: Synthetic oligonucleotide
ucccagaacuuugggaag

SEQ ID NO: 29337 - RNA, 18 nt, Artificial Sequence
  Description of Artificial Sequence: Synthetic oligonucleotide
uauaaucccagaacuuug

SEQ ID NO: 29338 - RNA, 18 nt, Artificial Sequence
  Description of Artificial Sequence: Synthetic oligonucleotide
acgccuauaaucccagaa

SEQ ID NO: 29339 - RNA, 18 nt, Artificial Sequence
  Description of Artificial Sequence: Synthetic oligonucleotide
ggcucacgccuauaaucc

SEQ ID NO: 29340 - RNA, 18 nt, Artificial Sequence
  Description of Artificial Sequence: Synthetic oligonucleotide
augguggcucacgccuau

SEQ ID NO: 29341 - RNA, 18 nt, Artificial Sequence
  Description of Artificial Sequence: Synthetic oligonucleotide
cgggcaugguggcucacg

SEQ ID NO: 29342 - RNA, 18 nt, Artificial Sequence
  Description of Artificial Sequence: Synthetic oligonucleotide
gagaccgggcaugguggc

SEQ ID NO: 29343 - RNA, 18 nt, Artificial Sequence
  Description of Artificial Sequence: Synthetic oligonucleotide
gagaagagaccgggcaug

SEQ ID NO: 29344 - RNA, 18 nt, Artificial Sequence
  Description of Artificial Sequence: Synthetic oligonucleotide
agacugagaagagaccgg

SEQ ID NO: 29345 - RNA, 18 nt, Artificial Sequence
  Description of Artificial Sequence: Synthetic oligonucleotide
cuucaagacugagaagag

SEQ ID NO: 29346 - RNA, 18 nt, Artificial Sequence
  Description of Artificial Sequence: Synthetic oligonucleotide
augggcuucaagacugag

SEQ ID NO: 29347 - RNA, 18 nt, Artificial Sequence
  Description of Artificial Sequence: Synthetic oligonucleotide
cagggaugggcuucaaga

SEQ ID NO: 29348 - RNA, 18 nt, Artificial Sequence
  Description of Artificial Sequence: Synthetic oligonucleotide
aaauccagggaugggcuu

SEQ ID NO: 29349 - RNA, 18 nt, Artificial Sequence
  Description of Artificial Sequence: Synthetic oligonucleotide
gguggaaauccagggaug

SEQ ID NO: 29350 - RNA, 18 nt, Artificial Sequence
  Description of Artificial Sequence: Synthetic oligonucleotide
cuccugguggaaauccag

SEQ ID NO: 29351 - RNA, 18 nt, Artificial Sequence
  Description of Artificial Sequence: Synthetic oligonucleotide
aguaacuccugguggaaa

SEQ ID NO: 29352 - RNA, 18 nt, Artificial Sequence
  Description of Artificial Sequence: Synthetic oligonucleotide
aggaaaguaacuccuggu

SEQ ID NO: 29353 - RNA, 18 nt, Artificial Sequence
  Description of Artificial Sequence: Synthetic oligonucleotide
ucaggaggaaaguaacuc

SEQ ID NO: 29354 - RNA, 18 nt, Artificial Sequence
  Description of Artificial Sequence: Synthetic oligonucleotide
acaggucaggaggaaagu

SEQ ID NO: 29355 - RNA, 18 nt, Artificial Sequence
  Description of Artificial Sequence: Synthetic oligonucleotide
aauuuacaggucaggagg

SEQ ID NO: 29356 - RNA, 18 nt, Artificial Sequence
  Description of Artificial Sequence: Synthetic oligonucleotide
gaacaaauuuacagguca

SEQ ID NO: 29357 - RNA, 18 nt, Artificial Sequence
  Description of Artificial Sequence: Synthetic oligonucleotide
uuaaagaacaaauuuaca

SEQ ID NO: 29358 - RNA, 18 nt, Artificial Sequence
  Description of Artificial Sequence: Synthetic oligonucleotide
cauuguuaaagaacaaau

SEQ ID NO: 29359 - RNA, 18 nt, Artificial Sequence
  Description of Artificial Sequence: Synthetic oligonucleotide
gcagccauuguuaaagaa

SEQ ID NO: 29360 - RNA, 18 nt, Artificial Sequence
  Description of Artificial Sequence: Synthetic oligonucleotide
caccugcagccauuguua

SEQ ID NO: 29361 - RNA, 18 nt, Artificial Sequence
  Description of Artificial Sequence: Synthetic oligonucleotide
gcucccaccugcagccau

SEQ ID NO: 29362 - RNA, 18 nt, Artificial Sequence
  Description of Artificial Sequence: Synthetic oligonucleotide
cauaugcucccaccugca

SEQ ID NO: 29363 - RNA, 18 nt, Artificial Sequence
  Description of Artificial Sequence: Synthetic oligonucleotide
accaccauaugcucccac

SEQ ID NO: 29364 - RNA, 18 nt, Artificial Sequence
  Description of Artificial Sequence: Synthetic oligonucleotide
uauaaaccaccauaugcu

SEQ ID NO: 29365 - RNA, 18 nt, Artificial Sequence
  Description of Artificial Sequence: Synthetic oligonucleotide
guuuuuauaaaccaccau

SEQ ID NO: 29366 - RNA, 18 nt, Artificial Sequence
  Description of Artificial Sequence: Synthetic oligonucleotide
acagcguuuuuauaaacc

SEQ ID NO: 29367 - RNA, 18 nt, Artificial Sequence
  Description of Artificial Sequence: Synthetic oligonucleotide
gcccgacagcguuuuuau

SEQ ID NO: 29368 - RNA, 18 nt, Artificial Sequence
  Description of Artificial Sequence: Synthetic oligonucleotide
acaaagcccgacagcguu

SEQ ID NO: 29369 - RNA, 18 nt, Artificial Sequence
  Description of Artificial Sequence: Synthetic oligonucleotide
aggaaacaaagcccgaca

SEQ ID NO: 29370 - RNA, 18 nt, Artificial Sequence
  Description of Artificial Sequence: Synthetic oligonucleotide
aaagaaggaaacaaagcc

SEQ ID NO: 29371 - RNA, 18 nt, Artificial Sequence
  Description of Artificial Sequence: Synthetic oligonucleotide
cagcuaaagaaggaaaca

SEQ ID NO: 29372 - RNA, 18 nt, Artificial Sequence
  Description of Artificial Sequence: Synthetic oligonucleotide
cacggcagcuaaagaagg

SEQ ID NO: 29373 - RNA, 18 nt, Artificial Sequence
  Description of Artificial Sequence: Synthetic oligonucleotide
guagacacggcagcuaaa

SEQ ID NO: 29374 - RNA, 18 nt, Artificial Sequence
  Description of Artificial Sequence: Synthetic oligonucleotide
cagaaguagacacggcag

SEQ ID NO: 29375 - RNA, 18 nt, Artificial Sequence
  Description of Artificial Sequence: Synthetic oligonucleotide
gacuucagaaguagacac

SEQ ID NO: 29376 - RNA, 18 nt, Artificial Sequence
  Description of Artificial Sequence: Synthetic oligonucleotide
ucccagacuucagaagua

SEQ ID NO: 29377 - RNA, 18 nt, Artificial Sequence
  Description of Artificial Sequence: Synthetic oligonucleotide
gcacuucccagacuucag

SEQ ID NO: 29378 - RNA, 18 nt, Artificial Sequence
  Description of Artificial Sequence: Synthetic oligonucleotide
gcuuggcacuucccagac

SEQ ID NO: 29379 - RNA, 18 nt, Artificial Sequence
  Description of Artificial Sequence: Synthetic oligonucleotide
gcguggcuuggcacuucc

SEQ ID NO: 29380 - RNA, 18 nt, Artificial Sequence
  Description of Artificial Sequence: Synthetic oligonucleotide
aggccgcguggcuuggca

SEQ ID NO: 29381 - RNA, 18 nt, Artificial Sequence
  Description of Artificial Sequence: Synthetic oligonucleotide
ccuugaggccgcguggcu

SEQ ID NO: 29382 - RNA, 18 nt, Artificial Sequence
  Description of Artificial Sequence: Synthetic oligonucleotide
agcucccuugaggccgcg

SEQ ID NO: 29383 - RNA, 18 nt, Artificial Sequence
  Description of Artificial Sequence: Synthetic oligonucleotide
cagccagcucccuugagg

SEQ ID NO: 29384 - RNA, 18 nt, Artificial Sequence
  Description of Artificial Sequence: Synthetic oligonucleotide
aacaccagccagcucccu

SEQ ID NO: 29385 - RNA, 18 nt, Artificial Sequence
  Description of Artificial Sequence: Synthetic oligonucleotide
gcucaaacaccagccagc

SEQ ID NO: 29386 - RNA, 18 nt, Artificial Sequence
  Description of Artificial Sequence: Synthetic oligonucleotide
ccacagcucaaacaccag

SEQ ID NO: 29387 - RNA, 18 nt, Artificial Sequence
  Description of Artificial Sequence: Synthetic oligonucleotide
uucugccacagcucaaac

SEQ ID NO: 29388 - RNA, 18 nt, Artificial Sequence
  Description of Artificial Sequence: Synthetic oligonucleotide
ggugcuucugccacagcu

SEQ ID NO: 29389 - RNA, 18 nt, Artificial Sequence
  Description of Artificial Sequence: Synthetic oligonucleotide
ccccaggugcuucugcca

SEQ ID NO: 29390 - RNA, 18 nt, Artificial Sequence
  Description of Artificial Sequence: Synthetic oligonucleotide
uggagccccaggugcuuc

SEQ ID NO: 29391 - RNA, 18 nt, Artificial Sequence
  Description of Artificial Sequence: Synthetic oligonucleotide
cucccuggagccccaggu

SEQ ID NO: 29392 - RNA, 18 nt, Artificial Sequence
  Description of Artificial Sequence: Synthetic oligonucleotide
gccugcucccuggagccc

SEQ ID NO: 29393 - RNA, 18 nt, Artificial Sequence
  Description of Artificial Sequence: Synthetic oligonucleotide
ucccagccugcucccugg

SEQ ID NO: 29394 - RNA, 18 nt, Artificial Sequence
  Description of Artificial Sequence: Synthetic oligonucleotide
gcaguucccagccugcuc

SEQ ID NO: 29395 - RNA, 18 nt, Artificial Sequence
  Description of Artificial Sequence: Synthetic oligonucleotide
guccugcaguucccagcc

SEQ ID NO: 29396 - RNA, 18 nt, Artificial Sequence
  Description of Artificial Sequence: Synthetic oligonucleotide
gcaagguccugcaguucc

SEQ ID NO: 29397 - RNA, 18 nt, Artificial Sequence
  Description of Artificial Sequence: Synthetic oligonucleotide
gcugagcaagguccugca

SEQ ID NO: 29398 - RNA, 18 nt, Artificial Sequence
  Description of Artificial Sequence: Synthetic oligonucleotide
uccuggcugagcaagguc

SEQ ID NO: 29399 - RNA, 18 nt, Artificial Sequence
  Description of Artificial Sequence: Synthetic oligonucleotide
agugcuccuggcugagca

SEQ ID NO: 29400 - RNA, 18 nt, Artificial Sequence
  Description of Artificial Sequence: Synthetic oligonucleotide
gggaagugcuccuggcug

SEQ ID NO: 29401 - RNA, 18 nt, Artificial Sequence
  Description of Artificial Sequence: Synthetic oligonucleotide
uuccugccucaaggaggg

SEQ ID NO: 29402 - RNA, 18 nt, Artificial Sequence
  Description of Artificial Sequence: Synthetic oligonucleotide
caguauuccugccucaag

SEQ ID NO: 29403 - RNA, 18 nt, Artificial Sequence
  Description of Artificial Sequence: Synthetic oligonucleotide
caccucaguauuccugcc

SEQ ID NO: 29404 - RNA, 18 nt, Artificial Sequence
  Description of Artificial Sequence: Synthetic oligonucleotide
ggaggcaccucaguauuc

SEQ ID NO: 29405 - RNA, 18 nt, Artificial Sequence
  Description of Artificial Sequence: Synthetic oligonucleotide
gggaggcaccucaguauu

SEQ ID NO: 29406 - RNA, 18 nt, Artificial Sequence
  Description of Artificial Sequence: Synthetic oligonucleotide
accuucuccaucuguggg

SEQ ID NO: 29407 - RNA, 18 nt, Artificial Sequence
  Description of Artificial Sequence: Synthetic oligonucleotide
ucuccaccuucuccaucu

SEQ ID NO: 29408 - RNA, 18 nt, Artificial Sequence
  Description of Artificial Sequence: Synthetic oligonucleotide
ccuccucuccaccuucuc

SEQ ID NO: 29409 - RNA, 18 nt, Artificial Sequence
  Description of Artificial Sequence: Synthetic oligonucleotide
cccauccuccucuccacc

SEQ ID NO: 29410 - RNA, 18 nt, Artificial Sequence
  Description of Artificial Sequence: Synthetic oligonucleotide
ugaggcccauccuccucu

SEQ ID NO: 29411 - RNA, 18 nt, Artificial Sequence
  Description of Artificial Sequence: Synthetic oligonucleotide
gcuccugaggcccauccu

SEQ ID NO: 29412 - RNA, 18 nt, Artificial Sequence
  Description of Artificial Sequence: Synthetic oligonucleotide
gagaugcuccugaggccc

SEQ ID NO: 29413 - RNA, 18 nt, Artificial Sequence
  Description of Artificial Sequence: Synthetic oligonucleotide
ggcuugagaugcuccuga

SEQ ID NO: 29414 - RNA, 18 nt, Artificial Sequence
  Description of Artificial Sequence: Synthetic oligonucleotide
gggcuugagaugcuccug

SEQ ID NO: 29415 - RNA, 18 nt, Artificial Sequence
  Description of Artificial Sequence: Synthetic oligonucleotide
cuuucuccugcuacuggg

SEQ ID NO: 29416 - RNA, 18 nt, Artificial Sequence
  Description of Artificial Sequence: Synthetic oligonucleotide
ucuuucuuucuccugcua

SEQ ID NO: 29417 - RNA, 18 nt, Artificial Sequence
  Description of Artificial Sequence: Synthetic oligonucleotide
cucuuucuuucuuucucc

SEQ ID NO: 29418 - RNA, 18 nt, Artificial Sequence
  Description of Artificial Sequence: Synthetic oligonucleotide
ggcaucucuuucuuucuu

SEQ ID NO: 29419 - RNA, 18 nt, Artificial Sequence
  Description of Artificial Sequence: Synthetic oligonucleotide
aaccaggcaucucuuucu

SEQ ID NO: 29420 - RNA, 18 nt, Artificial Sequence
  Description of Artificial Sequence: Synthetic oligonucleotide
gugaaaaccaggcaucuc

SEQ ID NO: 29421 - RNA, 18 nt, Artificial Sequence
  Description of Artificial Sequence: Synthetic oligonucleotide
agucugugaaaaccaggc

SEQ ID NO: 29422 - RNA, 18 nt, Artificial Sequence
  Description of Artificial Sequence: Synthetic oligonucleotide
gaaccagucugugaaaac

SEQ ID NO: 29423 - RNA, 18 nt, Artificial Sequence
  Description of Artificial Sequence: Synthetic oligonucleotide
cacaggaaccagucugug

SEQ ID NO: 29424 - RNA, 18 nt, Artificial Sequence
  Description of Artificial Sequence: Synthetic oligonucleotide
ccagccacaggaaccagu

SEQ ID NO: 29425 - RNA, 18 nt, Artificial Sequence
  Description of Artificial Sequence: Synthetic oligonucleotide
ucaucccagccacaggaa

SEQ ID NO: 29426 - RNA, 18 nt, Artificial Sequence
  Description of Artificial Sequence: Synthetic oligonucleotide
ugcagucaucccagccac

SEQ ID NO: 29427 - RNA, 18 nt, Artificial Sequence
  Description of Artificial Sequence: Synthetic oligonucleotide
aaggaugcagucauccca

SEQ ID NO: 29428 - RNA, 18 nt, Artificial Sequence
  Description of Artificial Sequence: Synthetic oligonucleotide
aaaaaaaggaugcaguca

SEQ ID NO: 29429 - RNA, 18 nt, Artificial Sequence
  Description of Artificial Sequence: Synthetic oligonucleotide
aaaaaaaaaaaaggaugc

SEQ ID NO: 29430 - RNA, 18 nt, Artificial Sequence
  Description of Artificial Sequence: Synthetic oligonucleotide
caaaaaaaaaaaaaaaag

SEQ ID NO: 29431 - RNA, 18 nt, Artificial Sequence
  Description of Artificial Sequence: Synthetic oligonucleotide
cgucucaaaaaaaaaaaa

SEQ ID NO: 29432 - RNA, 18 nt, Artificial Sequence
  Description of Artificial Sequence: Synthetic oligonucleotide
aacuccgucucaaaaaaa

SEQ ID NO: 29433 - RNA, 18 nt, Artificial Sequence
  Description of Artificial Sequence: Synthetic oligonucleotide
gcaaaaacuccgucucaa

SEQ ID NO: 29434 - RNA, 18 nt, Artificial Sequence
  Description of Artificial Sequence: Synthetic oligonucleotide
caaaggcaaaaacuccgu

SEQ ID NO: 29435 - RNA, 18 nt, Artificial Sequence
  Description of Artificial Sequence: Synthetic oligonucleotide
ggcgacaaaggcaaaaac

SEQ ID NO: 29436 - RNA, 18 nt, Artificial Sequence
  Description of Artificial Sequence: Synthetic oligonucleotide
gccugggcgacaaaggca

SEQ ID NO: 29437 - RNA, 18 nt, Artificial Sequence
  Description of Artificial Sequence: Synthetic oligonucleotide
cuccagccugggcgacaa

SEQ ID NO: 29438 - RNA, 18 nt, Artificial Sequence
  Description of Artificial Sequence: Synthetic oligonucleotide
uugcacuccagccugggc

SEQ ID NO: 29439 - RNA, 18 nt, Artificial Sequence
  Description of Artificial Sequence: Synthetic oligonucleotide
cgccauugcacuccagcc

SEQ ID NO: 29440 - RNA, 18 nt, Artificial Sequence
  Description of Artificial Sequence: Synthetic oligonucleotide
gaucacgccauugcacuc

SEQ ID NO: 29441 - RNA, 18 nt, Artificial Sequence
  Description of Artificial Sequence: Synthetic oligonucleotide
gccgagaucacgccauug

SEQ ID NO: 29442 - RNA, 18 nt, Artificial Sequence
  Description of Artificial Sequence: Synthetic oligonucleotide
ggugagccgagaucacgc

SEQ ID NO: 29443 - RNA, 18 nt, Artificial Sequence
  Description of Artificial Sequence: Synthetic oligonucleotide
guugcggugagccgagau

SEQ ID NO: 29444 - RNA, 18 nt, Artificial Sequence
  Description of Artificial Sequence: Synthetic oligonucleotide
cggagguugcggugagcc

SEQ ID NO: 29445 - RNA, 18 nt, Artificial Sequence
  Description of Artificial Sequence: Synthetic oligonucleotide
ggaggcggagguugcggu

SEQ ID NO: 29446 - RNA, 18 nt, Artificial Sequence
  Description of Artificial Sequence: Synthetic oligonucleotide
auccgggaggcggagguu

SEQ ID NO: 29447 - RNA, 18 nt, Artificial Sequence
  Description of Artificial Sequence: Synthetic oligonucleotide
cuugaauccgggaggcgg

SEQ ID NO: 29448 - RNA, 18 nt, Artificial Sequence
  Description of Artificial Sequence: Synthetic oligonucleotide
aauugcuugaauccggga

SEQ ID NO: 29449 - RNA, 18 nt, Artificial Sequence
  Description of Artificial Sequence: Synthetic oligonucleotide
aggagaauugcuugaauc

SEQ ID NO: 29450 - RNA, 18 nt, Artificial Sequence
  Description of Artificial Sequence: Synthetic oligonucleotide
gaggcaggagaauugcuu

SEQ ID NO: 29451 - RNA, 18 nt, Artificial Sequence
  Description of Artificial Sequence: Synthetic oligonucleotide
aggcugaggcaggagaau

SEQ ID NO: 29452 - RNA, 18 nt, Artificial Sequence
  Description of Artificial Sequence: Synthetic oligonucleotide
ucgggaggcugaggcagg

SEQ ID NO: 29453 - RNA, 18 nt, Artificial Sequence
  Description of Artificial Sequence: Synthetic oligonucleotide
gcuacucgggaggcugag

SEQ ID NO: 29454 - RNA, 18 nt, Artificial Sequence
  Description of Artificial Sequence: Synthetic oligonucleotide
ucccagcuacucgggagg

SEQ ID NO: 29455 - RNA, 18 nt, Artificial Sequence
  Description of Artificial Sequence: Synthetic oligonucleotide
uguaaucccagcuacucg

SEQ ID NO: 29456 - RNA, 18 nt, Artificial Sequence
  Description of Artificial Sequence: Synthetic oligonucleotide
gugccuguaaucccagcu

SEQ ID NO: 29457 - RNA, 18 nt, Artificial Sequence
  Description of Artificial Sequence: Synthetic oligonucleotide
ggugcgugccuguaaucc

SEQ ID NO: 29458 - RNA, 18 nt, Artificial Sequence
  Description of Artificial Sequence: Synthetic oligonucleotide
guggaggugcgugccugu

SEQ ID NO: 29459 - RNA, 18 nt, Artificial Sequence
  Description of Artificial Sequence: Synthetic oligonucleotide
cggacguggaggugcgug

SEQ ID NO: 29460 - RNA, 18 nt, Artificial Sequence
  Description of Artificial Sequence: Synthetic oligonucleotide
uuagccggacguggaggu

SEQ ID NO: 29461 - RNA, 18 nt, Artificial Sequence
  Description of Artificial Sequence: Synthetic oligonucleotide
caaaauuagccggacgug

SEQ ID NO: 29462 - RNA, 18 nt, Artificial Sequence
  Description of Artificial Sequence: Synthetic oligonucleotide
aaauacaaaauuagccgg

SEQ ID NO: 29463 - RNA, 18 nt, Artificial Sequence
  Description of Artificial Sequence: Synthetic oligonucleotide
acuaaaaauacaaaauua

SEQ ID NO: 29464 - RNA, 18 nt, Artificial Sequence
  Description of Artificial Sequence: Synthetic oligonucleotide
ucuccacuaaaaauacaa

SEQ ID NO: 29465 - RNA, 18 nt, Artificial Sequence
  Description of Artificial Sequence: Synthetic oligonucleotide
ccccgucuccacuaaaaa

SEQ ID NO: 29466 - RNA, 18 nt, Artificial Sequence
  Description of Artificial Sequence: Synthetic oligonucleotide
agaaaccccgucuccacu

SEQ ID NO: 29467 - RNA, 18 nt, Artificial Sequence
  Description of Artificial Sequence: Synthetic oligonucleotide
cauggagaaaccccgucu

SEQ ID NO: 29468 - RNA, 18 nt, Artificial Sequence
  Description of Artificial Sequence: Synthetic oligonucleotide
accgacauggagaaaccc

SEQ ID NO: 29469 - RNA, 18 nt, Artificial Sequence
  Description of Artificial Sequence: Synthetic oligonucleotide
gccugaccgacauggaga

SEQ ID NO: 29470 - RNA, 18 nt, Artificial Sequence
  Description of Artificial Sequence: Synthetic oligonucleotide
gaccagccugaccgacau

SEQ ID NO: 29471 - RNA, 18 nt, Artificial Sequence
  Description of Artificial Sequence: Synthetic oligonucleotide
uucgagaccagccugacc

SEQ ID NO: 29472 - RNA, 18 nt, Artificial Sequence
  Description of Artificial Sequence: Synthetic oligonucleotide
gggaguucgagaccagcc

SEQ ID NO: 29473 - RNA, 18 nt, Artificial Sequence
  Description of Artificial Sequence: Synthetic oligonucleotide
aggucgggaguucgagac

SEQ ID NO: 29474 - RNA, 18 nt, Artificial Sequence
  Description of Artificial Sequence: Synthetic oligonucleotide
accugaggucgggaguuc

SEQ ID NO: 29475 - RNA, 18 nt, Artificial Sequence
  Description of Artificial Sequence: Synthetic oligonucleotide
agaucaccugaggucggg

SEQ ID NO: 29476 - RNA, 18 nt, Artificial Sequence
  Description of Artificial Sequence: Synthetic oligonucleotide
ugggcagaucaccugagg

SEQ ID NO: 29477 - RNA, 18 nt, Artificial Sequence
  Description of Artificial Sequence: Synthetic oligonucleotide
cgaggugggcagaucacc

SEQ ID NO: 29478 - RNA, 18 nt, Artificial Sequence
  Description of Artificial Sequence: Synthetic oligonucleotide
gaggccgaggugggcaga

SEQ ID NO: 29479 - RNA, 18 nt, Artificial Sequence
  Description of Artificial Sequence: Synthetic oligonucleotide
uuugggaggccgaggugg

SEQ ID NO: 29480 - RNA, 18 nt, Artificial Sequence
  Description of Artificial Sequence: Synthetic oligonucleotide
agcacuuugggaggccga

SEQ ID NO: 29481 - RNA, 18 nt, Artificial Sequence
  Description of Artificial Sequence: Synthetic oligonucleotide
aucccagcacuuugggag

SEQ ID NO: 29482 - RNA, 18 nt, Artificial Sequence
  Description of Artificial Sequence: Synthetic oligonucleotide
cuguaaucccagcacuuu

SEQ ID NO: 29483 - RNA, 18 nt, Artificial Sequence
  Description of Artificial Sequence: Synthetic oligonucleotide
caugccuguaaucccagc

SEQ ID NO: 29484 - RNA, 18 nt, Artificial Sequence
  Description of Artificial Sequence: Synthetic oligonucleotide
uggcucaugccuguaauc

SEQ ID NO: 29485 - RNA, 18 nt, Artificial Sequence
  Description of Artificial Sequence: Synthetic oligonucleotide
cgcgguggcucaugccug

SEQ ID NO: 29486 - RNA, 18 nt, Artificial Sequence
  Description of Artificial Sequence: Synthetic oligonucleotide
ccaagcgcgguggcucau

SEQ ID NO: 29487 - RNA, 18 nt, Artificial Sequence
  Description of Artificial Sequence: Synthetic oligonucleotide
ucuggccaagcgcggugg

SEQ ID NO: 29488 - RNA, 18 nt, Artificial Sequence
  Description of Artificial Sequence: Synthetic oligonucleotide
cgcagucuggccaagcgc

SEQ ID NO: 29489 - RNA, 18 nt, Artificial Sequence
  Description of Artificial Sequence: Synthetic oligonucleotide
aaggacgcagucuggcca

SEQ ID NO: 29490 - RNA, 18 nt, Artificial Sequence
  Description of Artificial Sequence: Synthetic oligonucleotide
uuaaaaaggacgcagucu

SEQ ID NO: 29491 - RNA, 18 nt, Artificial Sequence
  Description of Artificial Sequence: Synthetic oligonucleotide
uucgcuuaaaaaggacgc

SEQ ID NO: 29492 - RNA, 18 nt, Artificial Sequence
  Description of Artificial Sequence: Synthetic oligonucleotide
aaauguucgcuuaaaaag

SEQ ID NO: 29493 - RNA, 18 nt, Artificial Sequence
  Description of Artificial Sequence: Synthetic oligonucleotide
cccuaaaauguucgcuua

SEQ ID NO: 29494 - RNA, 18 nt, Artificial Sequence
  Description of Artificial Sequence: Synthetic oligonucleotide
ccaggcccuaaaauguuc

SEQ ID NO: 29495 - RNA, 18 nt, Artificial Sequence
  Description of Artificial Sequence: Synthetic oligonucleotide
aacucccaggcccuaaaa

SEQ ID NO: 29496 - RNA, 18 nt, Artificial Sequence
  Description of Artificial Sequence: Synthetic oligonucleotide
ugacaaacucccaggccc

SEQ ID NO: 29497 - RNA, 18 nt, Artificial Sequence
  Description of Artificial Sequence: Synthetic oligonucleotide
uuacuugacaaacuccca

SEQ ID NO: 29498 - RNA, 18 nt, Artificial Sequence
  Description of Artificial Sequence: Synthetic oligonucleotide
cuuccuuacuugacaaac

SEQ ID NO: 29499 - RNA, 18 nt, Artificial Sequence
  Description of Artificial Sequence: Synthetic oligonucleotide
ugagacuuccuuacuuga

SEQ ID NO: 29500 - RNA, 18 nt, Artificial Sequence
  Description of Artificial Sequence: Synthetic oligonucleotide
gggcuugagacuuccuua

SEQ ID NO: 29501 - RNA, 18 nt, Artificial Sequence
  Description of Artificial Sequence: Synthetic oligonucleotide
ucuuugggcuugagacuu

SEQ ID NO: 29502 - RNA, 18 nt, Artificial Sequence
  Description of Artificial Sequence: Synthetic oligonucleotide
gcugcucuuugggcuuga

SEQ ID NO: 29503 - RNA, 18 nt, Artificial Sequence
  Description of Artificial Sequence: Synthetic oligonucleotide
aggacgcugcucuuuggg

SEQ ID NO: 29504 - RNA, 18 nt, Artificial Sequence
  Description of Artificial Sequence: Synthetic oligonucleotide
uggucaggacgcugcucu

SEQ ID NO: 29505 - RNA, 18 nt, Artificial Sequence
  Description of Artificial Sequence: Synthetic oligonucleotide
caccauggucaggacgcu

SEQ ID NO: 29506 - RNA, 18 nt, Artificial Sequence
  Description of Artificial Sequence: Synthetic oligonucleotide
gaaaccaccauggucagg

SEQ ID NO: 29507 - RNA, 18 nt, Artificial Sequence
  Description of Artificial Sequence: Synthetic oligonucleotide
guaaugaaaccaccaugg

SEQ ID NO: 29508 - RNA, 18 nt, Artificial Sequence
  Description of Artificial Sequence: Synthetic oligonucleotide
ggcucguaaugaaaccac

SEQ ID NO: 29509 - RNA, 18 nt, Artificial Sequence
  Description of Artificial Sequence: Synthetic oligonucleotide
agaagggcucguaaugaa

SEQ ID NO: 29510 - RNA, 18 nt, Artificial Sequence
  Description of Artificial Sequence: Synthetic oligonucleotide
ccagcagaagggcucgua

SEQ ID NO: 29511 - RNA, 18 nt, Artificial Sequence
  Description of Artificial Sequence: Synthetic oligonucleotide
gagagccagcagaagggc

SEQ ID NO: 29512 - RNA, 18 nt, Artificial Sequence
  Description of Artificial Sequence: Synthetic oligonucleotide
ugccugagagccagcaga

SEQ ID NO: 29513 - RNA, 18 nt, Artificial Sequence
  Description of Artificial Sequence: Synthetic oligonucleotide
gcuucugccugagagcca

SEQ ID NO: 29514 - RNA, 18 nt, Artificial Sequence
  Description of Artificial Sequence: Synthetic oligonucleotide
gggcuucugccugagagc

SEQ ID NO: 29515 - RNA, 18 nt, Artificial Sequence
  Description of Artificial Sequence: Synthetic oligonucleotide
uggucccggugcuguggg

SEQ ID NO: 29516 - RNA, 18 nt, Artificial Sequence
  Description of Artificial Sequence: Synthetic oligonucleotide
augaauggucccggugcu

SEQ ID NO: 29517 - RNA, 18 nt, Artificial Sequence
  Description of Artificial Sequence: Synthetic oligonucleotide
accucaugaauggucccg

SEQ ID NO: 29518 - RNA, 18 nt, Artificial Sequence
  Description of Artificial Sequence: Synthetic oligonucleotide
cagugaccucaugaaugg

SEQ ID NO: 29519 - RNA, 18 nt, Artificial Sequence
  Description of Artificial Sequence: Synthetic oligonucleotide
cugggcagugaccucaug

SEQ ID NO: 29520 - RNA, 18 nt, Artificial Sequence
  Description of Artificial Sequence: Synthetic oligonucleotide
augagcugggcagugacc

SEQ ID NO: 29521 - RNA, 18 nt, Artificial Sequence
  Description of Artificial Sequence: Synthetic oligonucleotide
acaucaugagcugggcag

SEQ ID NO: 29522 - RNA, 18 nt, Artificial Sequence
  Description of Artificial Sequence: Synthetic oligonucleotide
cacggacaucaugagcug

SEQ ID NO: 29523 - RNA, 18 nt, Artificial Sequence
  Description of Artificial Sequence: Synthetic oligonucleotide
agccucacggacaucaug

SEQ ID NO: 29524 - RNA, 18 nt, Artificial Sequence
  Description of Artificial Sequence: Synthetic oligonucleotide
aggacagccucacggaca

SEQ ID NO: 29525 - RNA, 18 nt, Artificial Sequence
  Description of Artificial Sequence: Synthetic oligonucleotide
ccaaaaggacagccucac

SEQ ID NO: 29526 - RNA, 18 nt, Artificial Sequence
  Description of Artificial Sequence: Synthetic oligonucleotide
acuggccaaaaggacagc

SEQ ID NO: 29527 - RNA, 18 nt, Artificial Sequence
  Description of Artificial Sequence: Synthetic oligonucleotide
cggcuacuggccaaaagg

SEQ ID NO: 29528 - RNA, 18 nt, Artificial Sequence
  Description of Artificial Sequence: Synthetic oligonucleotide
gcacacggcuacuggcca

SEQ ID NO: 29529 - RNA, 18 nt, Artificial Sequence
  Description of Artificial Sequence: Synthetic oligonucleotide
cagcugcacacggcuacu

SEQ ID NO: 29530 - RNA, 18 nt, Artificial Sequence
  Description of Artificial Sequence: Synthetic oligonucleotide
ccacacagcugcacacgg

SEQ ID NO: 29531 - RNA, 18 nt, Artificial Sequence
  Description of Artificial Sequence: Synthetic oligonucleotide
cugugccacacagcugca

SEQ ID NO: 29532 - RNA, 18 nt, Artificial Sequence
  Description of Artificial Sequence: Synthetic oligonucleotide
gccaucugugccacacag

SEQ ID NO: 29533 - RNA, 18 nt, Artificial Sequence
  Description of Artificial Sequence: Synthetic oligonucleotide
acgaagccaucugugcca

SEQ ID NO: 29534 - RNA, 18 nt, Artificial Sequence
  Description of Artificial Sequence: Synthetic oligonucleotide
gaugaacgaagccaucug

SEQ ID NO: 29535 - RNA, 18 nt, Artificial Sequence
  Description of Artificial Sequence: Synthetic oligonucleotide
aucaggaugaacgaagcc

SEQ ID NO: 29536 - RNA, 18 nt, Artificial Sequence
  Description of Artificial Sequence: Synthetic oligonucleotide
ccuugaucaggaugaacg

SEQ ID NO: 29537 - RNA, 18 nt, Artificial Sequence
  Description of Artificial Sequence: Synthetic oligonucleotide
gggccuugaucaggauga

SEQ ID NO: 29538 - RNA, 18 nt, Artificial Sequence
  Description of Artificial Sequence: Synthetic oligonucleotide
ugcuguggcugagguggg

SEQ ID NO: 29539 - RNA, 18 nt, Artificial Sequence
  Description of Artificial Sequence: Synthetic oligonucleotide
gggacugcuguggcugag

SEQ ID NO: 29540 - RNA, 18 nt, Artificial Sequence
  Description of Artificial Sequence: Synthetic oligonucleotide
gguggacaacacagguug

SEQ ID NO: 29541 - RNA, 18 nt, Artificial Sequence
  Description of Artificial Sequence: Synthetic oligonucleotide
aauaggguggacaacaca

SEQ ID NO: 29542 - RNA, 18 nt, Artificial Sequence
  Description of Artificial Sequence: Synthetic oligonucleotide
ugaauaauaggguggaca

SEQ ID NO: 29543 - RNA, 18 nt, Artificial Sequence
  Description of Artificial Sequence: Synthetic oligonucleotide
guacaugaauaauagggu

SEQ ID NO: 29544 - RNA, 18 nt, Artificial Sequence
  Description of Artificial Sequence: Synthetic oligonucleotide
ggcagguacaugaauaau

SEQ ID NO: 29545 - RNA, 18 nt, Artificial Sequence
  Description of Artificial Sequence: Synthetic oligonucleotide
ggccuggcagguacauga

SEQ ID NO: 29546 - RNA, 18 nt, Artificial Sequence
  Description of Artificial Sequence: Synthetic oligonucleotide
agcagggccuggcaggua

SEQ ID NO: 29547 - RNA, 18 nt, Artificial Sequence
  Description of Artificial Sequence: Synthetic oligonucleotide
uaucuagcagggccuggc

SEQ ID NO: 29548 - RNA, 18 nt, Artificial Sequence
  Description of Artificial Sequence: Synthetic oligonucleotide
ggugcuaucuagcagggc

SEQ ID NO: 29549 - RNA, 18 nt, Artificial Sequence
  Description of Artificial Sequence: Synthetic oligonucleotide
gggugcuaucuagcaggg

SEQ ID NO: 29550 - RNA, 18 nt, Artificial Sequence
  Description of Artificial Sequence: Synthetic oligonucleotide
guuauguaaugccacggg

SEQ ID NO: 29551 - RNA, 18 nt, Artificial Sequence
  Description of Artificial Sequence: Synthetic oligonucleotide
gaaguguuauguaaugcc

SEQ ID NO: 29552 - RNA, 18 nt, Artificial Sequence
  Description of Artificial Sequence: Synthetic oligonucleotide
cucaugaaguguuaugua

SEQ ID NO: 29553 - RNA, 18 nt, Artificial Sequence
  Description of Artificial Sequence: Synthetic oligonucleotide
agccacucaugaaguguu

SEQ ID NO: 29554 - RNA, 18 nt, Artificial Sequence
  Description of Artificial Sequence: Synthetic oligonucleotide
gacacagccacucaugaa

SEQ ID NO: 29555 - RNA, 18 nt, Artificial Sequence
  Description of Artificial Sequence: Synthetic oligonucleotide
uacaagacacagccacuc

SEQ ID NO: 29556 - RNA, 18 nt, Artificial Sequence
  Description of Artificial Sequence: Synthetic oligonucleotide
aaaauuacaagacacagc

SEQ ID NO: 29557 - RNA, 18 nt, Artificial Sequence
  Description of Artificial Sequence: Synthetic oligonucleotide
uccccaaaauuacaagac

SEQ ID NO: 29558 - RNA, 18 nt, Artificial Sequence
  Description of Artificial Sequence: Synthetic oligonucleotide
accuguccccaaaauuac

SEQ ID NO: 29559 - RNA, 18 nt, Artificial Sequence
  Description of Artificial Sequence: Synthetic oligonucleotide
gagaaaccuguccccaaa

SEQ ID NO: 29560 - RNA, 18 nt, Artificial Sequence
  Description of Artificial Sequence: Synthetic oligonucleotide
aaagagagaaaccugucc

SEQ ID NO: 29561 - RNA, 18 nt, Artificial Sequence
  Description of Artificial Sequence: Synthetic oligonucleotide
gagggaaagagagaaacc

SEQ ID NO: 29562 - RNA, 18 nt, Artificial Sequence
  Description of Artificial Sequence: Synthetic oligonucleotide
aaagagagggaaagagag

SEQ ID NO: 29563 - RNA, 18 nt, Artificial Sequence
  Description of Artificial Sequence: Synthetic oligonucleotide
aaaaaaaagagagggaaa

SEQ ID NO: 29564 - RNA, 18 nt, Artificial Sequence
  Description of Artificial Sequence: Synthetic oligonucleotide
uugacaaaaaaaagagag

SEQ ID NO: 29565 - RNA, 18 nt, Artificial Sequence
  Description of Artificial Sequence: Synthetic oligonucleotide
ggcuuuugacaaaaaaaa

SEQ ID NO: 29566 - RNA, 18 nt, Artificial Sequence
  Description of Artificial Sequence: Synthetic oligonucleotide
cucugggcuuuugacaaa

SEQ ID NO: 29567 - RNA, 18 nt, Artificial Sequence
  Description of Artificial Sequence: Synthetic oligonucleotide
ucagucucugggcuuuug

SEQ ID NO: 29568 - RNA, 18 nt, Artificial Sequence
  Description of Artificial Sequence: Synthetic oligonucleotide
gguugucagucucugggc

SEQ ID NO: 29569 - RNA, 18 nt, Artificial Sequence
  Description of Artificial Sequence: Synthetic oligonucleotide
cagcugguugucagucuc

SEQ ID NO: 29570 - RNA, 18 nt, Artificial Sequence
  Description of Artificial Sequence: Synthetic oligonucleotide
cacugcagcugguuguca

SEQ ID NO: 29571 - RNA, 18 nt, Artificial Sequence
  Description of Artificial Sequence: Synthetic oligonucleotide
uuagacacugcagcuggu

SEQ ID NO: 29572 - RNA, 18 nt, Artificial Sequence
  Description of Artificial Sequence: Synthetic oligonucleotide
aacacuuagacacugcag

SEQ ID NO: 29573 - RNA, 18 nt, Artificial Sequence
  Description of Artificial Sequence: Synthetic oligonucleotide
ugaggaacacuuagacac

SEQ ID NO: 29574 - RNA, 18 nt, Artificial Sequence
  Description of Artificial Sequence: Synthetic oligonucleotide
gucagugaggaacacuua

SEQ ID NO: 29575 - RNA, 18 nt, Artificial Sequence
  Description of Artificial Sequence: Synthetic oligonucleotide
acccugucagugaggaac

SEQ ID NO: 29576 - RNA, 18 nt, Artificial Sequence
  Description of Artificial Sequence: Synthetic oligonucleotide
gccccacccugucaguga

SEQ ID NO: 29577 - RNA, 18 nt, Artificial Sequence
  Description of Artificial Sequence: Synthetic oligonucleotide
gugaggccccacccuguc

SEQ ID NO: 29578 - RNA, 18 nt, Artificial Sequence
  Description of Artificial Sequence: Synthetic oligonucleotide
ggguggugaggccccacc

SEQ ID NO: 29579 - RNA, 18 nt, Artificial Sequence
  Description of Artificial Sequence: Synthetic oligonucleotide
gccaacgcugcucccucc

SEQ ID NO: 29580 - RNA, 18 nt, Artificial Sequence
  Description of Artificial Sequence: Synthetic oligonucleotide
ucccugccaacgcugcuc

SEQ ID NO: 29581 - RNA, 18 nt, Artificial Sequence
  Description of Artificial Sequence: Synthetic oligonucleotide
cugucucccugccaacgc

SEQ ID NO: 29582 - RNA, 18 nt, Artificial Sequence
  Description of Artificial Sequence: Synthetic oligonucleotide
ccaggcugucucccugcc

SEQ ID NO: 29583 - RNA, 18 nt, Artificial Sequence
  Description of Artificial Sequence: Synthetic oligonucleotide
cugggccaggcugucucc

SEQ ID NO: 29584 - RNA, 18 nt, Artificial Sequence
  Description of Artificial Sequence: Synthetic oligonucleotide
ggucacugggccaggcug

SEQ ID NO: 29585 - RNA, 18 nt, Artificial Sequence
  Description of Artificial Sequence: Synthetic oligonucleotide
cccagggucacugggcca

SEQ ID NO: 29586 - RNA, 18 nt, Artificial Sequence
  Description of Artificial Sequence: Synthetic oligonucleotide
uugggcccagggucacug

SEQ ID NO: 29587 - RNA, 18 nt, Artificial Sequence
  Description of Artificial Sequence: Synthetic oligonucleotide
cuggcuugggcccagggu

SEQ ID NO: 29588 - RNA, 18 nt, Artificial Sequence
  Description of Artificial Sequence: Synthetic oligonucleotide
gggcuggcuugggcccag

SEQ ID NO: 29589 - RNA, 18 nt, Artificial Sequence
  Description of Artificial Sequence: Synthetic oligonucleotide
ccugaaagcccuggaggg

SEQ ID NO: 29590 - RNA, 18 nt, Artificial Sequence
  Description of Artificial Sequence: Synthetic oligonucleotide
gcuucccugaaagcccug

SEQ ID NO: 29591 - RNA, 18 nt, Artificial Sequence
  Description of Artificial Sequence: Synthetic oligonucleotide
auggcgcuucccugaaag

SEQ ID NO: 29592 - RNA, 18 nt, Artificial Sequence
  Description of Artificial Sequence: Synthetic oligonucleotide
aauggauggcgcuucccu

SEQ ID NO: 29593 - RNA, 18 nt, Artificial Sequence
  Description of Artificial Sequence: Synthetic oligonucleotide
uugaaaauggauggcgcu

SEQ ID NO: 29594 - RNA, 18 nt, Artificial Sequence
  Description of Artificial Sequence: Synthetic oligonucleotide
caucuuugaaaauggaug

SEQ ID NO: 29595 - RNA, 18 nt, Artificial Sequence
  Description of Artificial Sequence: Synthetic oligonucleotide
uuugacaucuuugaaaau

SEQ ID NO: 29596 - RNA, 18 nt, Artificial Sequence
  Description of Artificial Sequence: Synthetic oligonucleotide
ugacguuugacaucuuug

SEQ ID NO: 29597 - RNA, 18 nt, Artificial Sequence
  Description of Artificial Sequence: Synthetic oligonucleotide
agaagugacguuugacau

SEQ ID NO: 29598 - RNA, 18 nt, Artificial Sequence
  Description of Artificial Sequence: Synthetic oligonucleotide
caggaagaagugacguuu

SEQ ID NO: 29599 - RNA, 18 nt, Artificial Sequence
  Description of Artificial Sequence: Synthetic oligonucleotide
cccuacaggaagaaguga

SEQ ID NO: 29600 - RNA, 18 nt, Artificial Sequence
  Description of Artificial Sequence: Synthetic oligonucleotide
ucgggcccuacaggaaga

SEQ ID NO: 29601 - RNA, 18 nt, Artificial Sequence
  Description of Artificial Sequence: Synthetic oligonucleotide
aggacucgggcccuacag

SEQ ID NO: 29602 - RNA, 18 nt, Artificial Sequence
  Description of Artificial Sequence: Synthetic oligonucleotide
gaggcaggacucgggccc

SEQ ID NO: 29603 - RNA, 18 nt, Artificial Sequence
  Description of Artificial Sequence: Synthetic oligonucleotide
gauaggaggcaggacucg

SEQ ID NO: 29604 - RNA, 18 nt, Artificial Sequence
  Description of Artificial Sequence: Synthetic oligonucleotide
gcccugauaggaggcagg

SEQ ID NO: 29605 - RNA, 18 nt, Artificial Sequence
  Description of Artificial Sequence: Synthetic oligonucleotide
aucuggcccugauaggag

SEQ ID NO: 29606 - RNA, 18 nt, Artificial Sequence
  Description of Artificial Sequence: Synthetic oligonucleotide
cuaugaucuggcccugau

SEQ ID NO: 29607 - RNA, 18 nt, Artificial Sequence
  Description of Artificial Sequence: Synthetic oligonucleotide
gccuucuaugaucuggcc

SEQ ID NO: 29608 - RNA, 18 nt, Artificial Sequence
  Description of Artificial Sequence: Synthetic oligonucleotide
aaauagccuucuaugauc

SEQ ID NO: 29609 - RNA, 18 nt, Artificial Sequence
  Description of Artificial Sequence: Synthetic oligonucleotide
auagaaaauagccuucua

SEQ ID NO: 29610 - RNA, 18 nt, Artificial Sequence
  Description of Artificial Sequence: Synthetic oligonucleotide
ccagaauagaaaauagcc

SEQ ID NO: 29611 - RNA, 18 nt, Artificial Sequence
  Description of Artificial Sequence: Synthetic oligonucleotide
guuccccagaauagaaaa

SEQ ID NO: 29612 - RNA, 18 nt, Artificial Sequence
  Description of Artificial Sequence: Synthetic oligonucleotide
uaaucguuccccagaaua

SEQ ID NO: 29613 - RNA, 18 nt, Artificial Sequence
  Description of Artificial Sequence: Synthetic oligonucleotide
aguuauaaucguucccca

SEQ ID NO: 29614 - RNA, 18 nt, Artificial Sequence
  Description of Artificial Sequence: Synthetic oligonucleotide
auuuaaguuauaaucguu

SEQ ID NO: 29615 - RNA, 18 nt, Artificial Sequence
  Description of Artificial Sequence: Synthetic oligonucleotide
caaucauuuaaguuauaa

SEQ ID NO: 29616 - RNA, 18 nt, Artificial Sequence
  Description of Artificial Sequence: Synthetic oligonucleotide
uaaaacaaucauuuaagu

SEQ ID NO: 29617 - RNA, 18 nt, Artificial Sequence
  Description of Artificial Sequence: Synthetic oligonucleotide
uuuauuaaaacaaucauu

SEQ ID NO: 29618 - RNA, 18 nt, Artificial Sequence
  Description of Artificial Sequence: Synthetic oligonucleotide
gaauuuuuauuaaaacaa

SEQ ID NO: 29619 - RNA, 18 nt, Artificial Sequence
  Description of Artificial Sequence: Synthetic oligonucleotide
gcuuagaauuuuuauuaa

SEQ ID NO: 29620 - RNA, 18 nt, Artificial Sequence
  Description of Artificial Sequence: Synthetic oligonucleotide
uuccagcuuagaauuuuu

SEQ ID NO: 29621 - RNA, 18 nt, Artificial Sequence
  Description of Artificial Sequence: Synthetic oligonucleotide
accacguucaccccguuc

SEQ ID NO: 29622 - RNA, 18 nt, Artificial Sequence
  Description of Artificial Sequence: Synthetic oligonucleotide
ccuucaccacguucaccc

SEQ ID NO: 29623 - RNA, 18 nt, Artificial Sequence
  Description of Artificial Sequence: Synthetic oligonucleotide
uccgaccuucaccacguu

SEQ ID NO: 29624 - RNA, 18 nt, Artificial Sequence
  Description of Artificial Sequence: Synthetic oligonucleotide
uuguguccgaccuucacc

SEQ ID NO: 29625 - RNA, 18 nt, Artificial Sequence
  Description of Artificial Sequence: Synthetic oligonucleotide
ccugcuuguguccgaccu

SEQ ID NO: 29626 - RNA, 18 nt, Artificial Sequence
  Description of Artificial Sequence: Synthetic oligonucleotide
caccaccugcuugugucc

SEQ ID NO: 29627 - RNA, 18 nt, Artificial Sequence
  Description of Artificial Sequence: Synthetic oligonucleotide
agagccaccaccugcuug

SEQ ID NO: 29628 - RNA, 18 nt, Artificial Sequence
  Description of Artificial Sequence: Synthetic oligonucleotide
gaaucagagccaccaccu

SEQ ID NO: 29629 - RNA, 18 nt, Artificial Sequence
  Description of Artificial Sequence: Synthetic oligonucleotide
cuggcgaaucagagccac

SEQ ID NO: 29630 - RNA, 18 nt, Artificial Sequence
  Description of Artificial Sequence: Synthetic oligonucleotide
ccacccuggcgaaucaga

SEQ ID NO: 29631 - RNA, 18 nt, Artificial Sequence
  Description of Artificial Sequence: Synthetic oligonucleotide
gguugccacccuggcgaa

SEQ ID NO: 29632 - RNA, 18 nt, Artificial Sequence
  Description of Artificial Sequence: Synthetic oligonucleotide
gaggcgguugccacccug

SEQ ID NO: 29633 - RNA, 18 nt, Artificial Sequence
  Description of Artificial Sequence: Synthetic oligonucleotide
augacgaggcgguugcca

SEQ ID NO: 29634 - RNA, 18 nt, Artificial Sequence
  Description of Artificial Sequence: Synthetic oligonucleotide
ccuucaugacgaggcggu

SEQ ID NO: 29635 - RNA, 18 nt, Artificial Sequence
  Description of Artificial Sequence: Synthetic oligonucleotide
cacaaccuucaugacgag

SEQ ID NO: 29636 - RNA, 18 nt, Artificial Sequence
  Description of Artificial Sequence: Synthetic oligonucleotide
acagacacaaccuucaug

SEQ ID NO: 29637 - RNA, 18 nt, Artificial Sequence
  Description of Artificial Sequence: Synthetic oligonucleotide
uugucacagacacaaccu

SEQ ID NO: 29638 - RNA, 18 nt, Artificial Sequence
  Description of Artificial Sequence: Synthetic oligonucleotide
cuuccuugucacagacac

SEQ ID NO: 29639 - RNA, 18 nt, Artificial Sequence
  Description of Artificial Sequence: Synthetic oligonucleotide
ucuggcuuccuugucaca

SEQ ID NO: 29640 - RNA, 18 nt, Artificial Sequence
  Description of Artificial Sequence: Synthetic oligonucleotide
ccucuucuggcuuccuug

SEQ ID NO: 29641 - RNA, 18 nt, Artificial Sequence
  Description of Artificial Sequence: Synthetic oligonucleotide
cccguccucuucuggcuu

SEQ ID NO: 29642 - RNA, 18 nt, Artificial Sequence
  Description of Artificial Sequence: Synthetic oligonucleotide
cgagccccguccucuucu

SEQ ID NO: 29643 - RNA, 18 nt, Artificial Sequence
  Description of Artificial Sequence: Synthetic oligonucleotide
ugcgccgagccccguccu

SEQ ID NO: 29644 - RNA, 18 nt, Artificial Sequence
  Description of Artificial Sequence: Synthetic oligonucleotide
aggccugaagcgugaccc

SEQ ID NO: 29645 - RNA, 18 nt, Artificial Sequence
  Description of Artificial Sequence: Synthetic oligonucleotide
cacagaggccugaagcgu

SEQ ID NO: 29646 - RNA, 18 nt, Artificial Sequence
  Description of Artificial Sequence: Synthetic oligonucleotide
uugggcacagaggccuga

SEQ ID NO: 29647 - RNA, 18 nt, Artificial Sequence
  Description of Artificial Sequence: Synthetic oligonucleotide
aaaguuugggcacagagg

SEQ ID NO: 29648 - RNA, 18 nt, Artificial Sequence
  Description of Artificial Sequence: Synthetic oligonucleotide
gggaaaguuugggcacag

SEQ ID NO: 29649 - RNA, 18 nt, Artificial Sequence
  Description of Artificial Sequence: Synthetic oligonucleotide
aaaggucuaaggucaggg

SEQ ID NO: 29650 - RNA, 18 nt, Artificial Sequence
  Description of Artificial Sequence: Synthetic oligonucleotide
aagucaaaggucuaaggu

SEQ ID NO: 29651 - RNA, 18 nt, Artificial Sequence
  Description of Artificial Sequence: Synthetic oligonucleotide
gccugaagucaaaggucu

SEQ ID NO: 29652 - RNA, 18 nt, Artificial Sequence
  Description of Artificial Sequence: Synthetic oligonucleotide
ugugggccugaagucaaa

SEQ ID NO: 29653 - RNA, 18 nt, Artificial Sequence
  Description of Artificial Sequence: Synthetic oligonucleotide
aggaaugugggccugaag

SEQ ID NO: 29654 - RNA, 18 nt, Artificial Sequence
  Description of Artificial Sequence: Synthetic oligonucleotide
ggaagaggaaugugggcc

SEQ ID NO: 29655 - RNA, 18 nt, Artificial Sequence
  Description of Artificial Sequence: Synthetic oligonucleotide
ggaugggaagaggaaugu

SEQ ID NO: 29656 - RNA, 18 nt, Artificial Sequence
  Description of Artificial Sequence: Synthetic oligonucleotide
gucagggaugggaagagg

SEQ ID NO: 29657 - RNA, 18 nt, Artificial Sequence
  Description of Artificial Sequence: Synthetic oligonucleotide
gggucagggaugggaaga

SEQ ID NO: 29658 - RNA, 18 nt, Artificial Sequence
  Description of Artificial Sequence: Synthetic oligonucleotide
cugaugucagcaguuggg

SEQ ID NO: 29659 - RNA, 18 nt, Artificial Sequence
  Description of Artificial Sequence: Synthetic oligonucleotide
ggaaucugaugucagcag

SEQ ID NO: 29660 - RNA, 18 nt, Artificial Sequence
  Description of Artificial Sequence: Synthetic oligonucleotide
guucaggaaucugauguc

SEQ ID NO: 29661 - RNA, 18 nt, Artificial Sequence
  Description of Artificial Sequence: Synthetic oligonucleotide
uugagguucaggaaucug

SEQ ID NO: 29662 - RNA, 18 nt, Artificial Sequence
  Description of Artificial Sequence: Synthetic oligonucleotide
guucauugagguucagga

SEQ ID NO: 29663 - RNA, 18 nt, Artificial Sequence
  Description of Artificial Sequence: Synthetic oligonucleotide
gggugguucauugagguu

SEQ ID NO: 29664 - RNA, 18 nt, Artificial Sequence
  Description of Artificial Sequence: Synthetic oligonucleotide
cgugugggugguucauug

SEQ ID NO: 29665 - RNA, 18 nt, Artificial Sequence
  Description of Artificial Sequence: Synthetic oligonucleotide
ccacacgugugggugguu

SEQ ID NO: 29666 - RNA, 18 nt, Artificial Sequence
  Description of Artificial Sequence: Synthetic oligonucleotide
ccagcccacacguguggg

SEQ ID NO: 29667 - RNA, 18 nt, Artificial Sequence
  Description of Artificial Sequence: Synthetic oligonucleotide
gggucccagcccacacgu

SEQ ID NO: 29668 - RNA, 18 nt, Artificial Sequence
  Description of Artificial Sequence: Synthetic oligonucleotide
cuagcaccagggaucggg

SEQ ID NO: 29669 - RNA, 18 nt, Artificial Sequence
  Description of Artificial Sequence: Synthetic oligonucleotide
gcagucuagcaccaggga

SEQ ID NO: 29670 - RNA, 18 nt, Artificial Sequence
  Description of Artificial Sequence: Synthetic oligonucleotide
gacuggcagucuagcacc

SEQ ID NO: 29671 - RNA, 18 nt, Artificial Sequence
  Description of Artificial Sequence: Synthetic oligonucleotide
gacaggacuggcagucua

SEQ ID NO: 29672 - RNA, 18 nt, Artificial Sequence
  Description of Artificial Sequence: Synthetic oligonucleotide
gggacaggacuggcaguc

SEQ ID NO: 29673 - RNA, 18 nt, Artificial Sequence
  Description of Artificial Sequence: Synthetic oligonucleotide
aaaggccucaggccaggg

SEQ ID NO: 29674 - RNA, 18 nt, Artificial Sequence
  Description of Artificial Sequence: Synthetic oligonucleotide
gggucaaaggccucaggc

SEQ ID NO: 29675 - RNA, 18 nt, Artificial Sequence
  Description of Artificial Sequence: Synthetic oligonucleotide
gggcagccugaggucagg

SEQ ID NO: 29676 - RNA, 18 nt, Artificial Sequence
  Description of Artificial Sequence: Synthetic oligonucleotide
gcagggaucugaggaggg

SEQ ID NO: 29677 - RNA, 18 nt, Artificial Sequence
  Description of Artificial Sequence: Synthetic oligonucleotide
gggcagggaucugaggag

SEQ ID NO: 29678 - RNA, 18 nt, Artificial Sequence
  Description of Artificial Sequence: Synthetic oligonucleotide
gaacgccgggaaggaggg

SEQ ID NO: 29679 - RNA, 18 nt, Artificial Sequence
  Description of Artificial Sequence: Synthetic oligonucleotide
gggaacgccgggaaggag

SEQ ID NO: 29680 - RNA, 18 nt, Artificial Sequence
  Description of Artificial Sequence: Synthetic oligonucleotide
ggcucugccacgccaggg

SEQ ID NO: 29681 - RNA, 18 nt, Artificial Sequence
  Description of Artificial Sequence: Synthetic oligonucleotide
aggagggcucugccacgc

SEQ ID NO: 29682 - RNA, 18 nt, Artificial Sequence
  Description of Artificial Sequence: Synthetic oligonucleotide
agggaaggagggcucugc

SEQ ID NO: 29683 - RNA, 18 nt, Artificial Sequence
  Description of Artificial Sequence: Synthetic oligonucleotide
gguguagggaaggagggc

SEQ ID NO: 29684 - RNA, 18 nt, Artificial Sequence
  Description of Artificial Sequence: Synthetic oligonucleotide
cuggcgguguagggaagg

SEQ ID NO: 29685 - RNA, 18 nt, Artificial Sequence
  Description of Artificial Sequence: Synthetic oligonucleotide
agcugcuggcgguguagg

SEQ ID NO: 29686 - RNA, 18 nt, Artificial Sequence
  Description of Artificial Sequence: Synthetic oligonucleotide
caggcagcugcuggcggu

SEQ ID NO: 29687 - RNA, 18 nt, Artificial Sequence
  Description of Artificial Sequence: Synthetic oligonucleotide
gccuccaggcagcugcug

SEQ ID NO: 29688 - RNA, 18 nt, Artificial Sequence
  Description of Artificial Sequence: Synthetic oligonucleotide
ccccggccuccaggcagc

SEQ ID NO: 29689 - RNA, 18 nt, Artificial Sequence
  Description of Artificial Sequence: Synthetic oligonucleotide
ggcaaccccggccuccag

SEQ ID NO: 29690 - RNA, 18 nt, Artificial Sequence
  Description of Artificial Sequence: Synthetic oligonucleotide
gcuauggcaaccccggcc

SEQ ID NO: 29691 - RNA, 18 nt, Artificial Sequence
  Description of Artificial Sequence: Synthetic oligonucleotide
caguugcuauggcaaccc

SEQ ID NO: 29692 - RNA, 18 nt, Artificial Sequence
  Description of Artificial Sequence: Synthetic oligonucleotide
ccucacaguugcuauggc

SEQ ID NO: 29693 - RNA, 18 nt, Artificial Sequence
  Description of Artificial Sequence: Synthetic oligonucleotide
gucaaccucacaguugcu

SEQ ID NO: 29694 - RNA, 18 nt, Artificial Sequence
  Description of Artificial Sequence: Synthetic oligonucleotide
gcagcgucaaccucacag

SEQ ID NO: 29695 - RNA, 18 nt, Artificial Sequence
  Description of Artificial Sequence: Synthetic oligonucleotide
gcgcggcagcgucaaccu

SEQ ID NO: 29696 - RNA, 18 nt, Artificial Sequence
  Description of Artificial Sequence: Synthetic oligonucleotide
aagcagcgcggcagcguc

SEQ ID NO: 29697 - RNA, 18 nt, Artificial Sequence
  Description of Artificial Sequence: Synthetic oligonucleotide
acaauaagcagcgcggca

SEQ ID NO: 29698 - RNA, 18 nt, Artificial Sequence
  Description of Artificial Sequence: Synthetic oligonucleotide
cuccgacaauaagcagcg

SEQ ID NO: 29699 - RNA, 18 nt, Artificial Sequence
  Description of Artificial Sequence: Synthetic oligonucleotide
cuucccuccgacaauaag

SEQ ID NO: 29700 - RNA, 18 nt, Artificial Sequence
  Description of Artificial Sequence: Synthetic oligonucleotide
ucccccuucccuccgaca

SEQ ID NO: 29701 - RNA, 18 nt, Artificial Sequence
  Description of Artificial Sequence: Synthetic oligonucleotide
ccgccucccccuucccuc

SEQ ID NO: 29702 - RNA, 18 nt, Artificial Sequence
  Description of Artificial Sequence: Synthetic oligonucleotide
aggugccgccucccccuu

SEQ ID NO: 29703 - RNA, 18 nt, Artificial Sequence
  Description of Artificial Sequence: Synthetic oligonucleotide
cccucaggugccgccucc

SEQ ID NO: 29704 - RNA, 18 nt, Artificial Sequence
  Description of Artificial Sequence: Synthetic oligonucleotide
cucuucccucaggugccg

SEQ ID NO: 29705 - RNA, 18 nt, Artificial Sequence
  Description of Artificial Sequence: Synthetic oligonucleotide
uuuuccucuucccucagg

SEQ ID NO: 29706 - RNA, 18 nt, Artificial Sequence
  Description of Artificial Sequence: Synthetic oligonucleotide
gacgcuuuuccucuuccc

SEQ ID NO: 29707 - RNA, 18 nt, Artificial Sequence
  Description of Artificial Sequence: Synthetic oligonucleotide
gagaagacgcuuuuccuc

SEQ ID NO: 29708 - RNA, 18 nt, Artificial Sequence
  Description of Artificial Sequence: Synthetic oligonucleotide
gggagaagacgcuuuucc

SEQ ID NO: 29709 - RNA, 18 nt, Artificial Sequence
  Description of Artificial Sequence: Synthetic oligonucleotide
gugccgcgucgucgcggg

SEQ ID NO: 29710 - RNA, 18 nt, Artificial Sequence
  Description of Artificial Sequence: Synthetic oligonucleotide
aggcugugccgcgucguc

SEQ ID NO: 29711 - RNA, 18 nt, Artificial Sequence
  Description of Artificial Sequence: Synthetic oligonucleotide
ggcccaggcugugccgcg

SEQ ID NO: 29712 - RNA, 18 nt, Artificial Sequence
  Description of Artificial Sequence: Synthetic oligonucleotide
uccugggcccaggcugug

SEQ ID NO: 29713 - RNA, 18 nt, Artificial Sequence
  Description of Artificial Sequence: Synthetic oligonucleotide
aagccuccugggcccagg

SEQ ID NO: 29714 - RNA, 18 nt, Artificial Sequence
  Description of Artificial Sequence: Synthetic oligonucleotide
cggcaaagccuccugggc

SEQ ID NO: 29715 - RNA, 18 nt, Artificial Sequence
  Description of Artificial Sequence: Synthetic oligonucleotide
cuggccggcaaagccucc

SEQ ID NO: 29716 - RNA, 18 nt, Artificial Sequence
  Description of Artificial Sequence: Synthetic oligonucleotide
ugggccuggccggcaaag

SEQ ID NO: 29717 - RNA, 18 nt, Artificial Sequence
  Description of Artificial Sequence: Synthetic oligonucleotide
ugggcugggccuggccgg

SEQ ID NO: 29718 - RNA, 18 nt, Artificial Sequence
  Description of Artificial Sequence: Synthetic oligonucleotide
gggccugggcugggccug

SEQ ID NO: 29719 - RNA, 18 nt, Artificial Sequence
  Description of Artificial Sequence: Synthetic oligonucleotide
gccacgggccugggcugg

SEQ ID NO: 29720 - RNA, 18 nt, Artificial Sequence
  Description of Artificial Sequence: Synthetic oligonucleotide
gccaagccacgggccugg

SEQ ID NO: 29721 - RNA, 18 nt, Artificial Sequence
  Description of Artificial Sequence: Synthetic oligonucleotide
ggucagccaagccacggg

SEQ ID NO: 29722 - RNA, 18 nt, Artificial Sequence
  Description of Artificial Sequence: Synthetic oligonucleotide
gguguggucagccaagcc

SEQ ID NO: 29723 - RNA, 18 nt, Artificial Sequence
  Description of Artificial Sequence: Synthetic oligonucleotide
gccggcaaagccuccugg

SEQ ID NO: 29724 - RNA, 18 nt, Artificial Sequence
  Description of Artificial Sequence: Synthetic oligonucleotide
gccuggccggcaaagccu

SEQ ID NO: 29725 - RNA, 18 nt, Artificial Sequence
  Description of Artificial Sequence: Synthetic oligonucleotide
gcugggccuggccggcaa

SEQ ID NO: 29726 - RNA, 18 nt, Artificial Sequence
  Description of Artificial Sequence: Synthetic oligonucleotide
ccugggcugggccuggcc

SEQ ID NO: 29727 - RNA, 18 nt, Artificial Sequence
  Description of Artificial Sequence: Synthetic oligonucleotide
acgggccugggcugggcc

SEQ ID NO: 29728 - RNA, 18 nt, Artificial Sequence
  Description of Artificial Sequence: Synthetic oligonucleotide
aagccacgggccugggcu

SEQ ID NO: 29729 - RNA, 18 nt, Artificial Sequence
  Description of Artificial Sequence: Synthetic oligonucleotide
cagccaagccacgggccu

SEQ ID NO: 29730 - RNA, 18 nt, Artificial Sequence
  Description of Artificial Sequence: Synthetic oligonucleotide
guggucagccaagccacg

SEQ ID NO: 29731 - RNA, 18 nt, Artificial Sequence
  Description of Artificial Sequence: Synthetic oligonucleotide
aggguguggucagccaag

SEQ ID NO: 29732 - RNA, 18 nt, Artificial Sequence
  Description of Artificial Sequence: Synthetic oligonucleotide
gggccaggguguggucag

SEQ ID NO: 29733 - RNA, 18 nt, Artificial Sequence
  Description of Artificial Sequence: Synthetic oligonucleotide
gccacugccccuuguggg

SEQ ID NO: 29734 - RNA, 18 nt, Artificial Sequence
  Description of Artificial Sequence: Synthetic oligonucleotide
gguggccacugccccuug

SEQ ID NO: 29735 - RNA, 18 nt, Artificial Sequence
  Description of Artificial Sequence: Synthetic oligonucleotide
gcccggguggccacugcc

SEQ ID NO: 29736 - RNA, 18 nt, Artificial Sequence
  Description of Artificial Sequence: Synthetic oligonucleotide
cccaggcccggguggcca

SEQ ID NO: 29737 - RNA, 18 nt, Artificial Sequence
  Description of Artificial Sequence: Synthetic oligonucleotide
cuccccccaggcccgggu

SEQ ID NO: 29738 - RNA, 18 nt, Artificial Sequence
  Description of Artificial Sequence: Synthetic oligonucleotide
cagggcuccccccaggcc

SEQ ID NO: 29739 - RNA, 18 nt, Artificial Sequence
  Description of Artificial Sequence: Synthetic oligonucleotide
ugcuccagggcucccccc

SEQ ID NO: 29740 - RNA, 18 nt, Artificial Sequence
  Description of Artificial Sequence: Synthetic oligonucleotide
ccugcugcuccagggcuc

SEQ ID NO: 29741 - RNA, 18 nt, Artificial Sequence
  Description of Artificial Sequence: Synthetic oligonucleotide
gggcuccugcugcuccag

SEQ ID NO: 29742 - RNA, 18 nt, Artificial Sequence
  Description of Artificial Sequence: Synthetic oligonucleotide
ggucuccuugcgggcggg

SEQ ID NO: 29743 - RNA, 18 nt, Artificial Sequence
  Description of Artificial Sequence: Synthetic oligonucleotide
gggcaccagagccauggg

SEQ ID NO: 29744 - RNA, 18 nt, Artificial Sequence
  Description of Artificial Sequence: Synthetic oligonucleotide
ucgagggcuaagcaaggg

SEQ ID NO: 29745 - RNA, 18 nt, Artificial Sequence
  Description of Artificial Sequence: Synthetic oligonucleotide
gcuucgagggcuaagcaa

SEQ ID NO: 29746 - RNA, 18 nt, Artificial Sequence
  Description of Artificial Sequence: Synthetic oligonucleotide
ugcaggcuucgagggcua

SEQ ID NO: 29747 - RNA, 18 nt, Artificial Sequence
  Description of Artificial Sequence: Synthetic oligonucleotide
cacccugcaggcuucgag

SEQ ID NO: 29748 - RNA, 18 nt, Artificial Sequence
  Description of Artificial Sequence: Synthetic oligonucleotide
gcacccacccugcaggcu

SEQ ID NO: 29749 - RNA, 18 nt, Artificial Sequence
  Description of Artificial Sequence: Synthetic oligonucleotide
ccugagcacccacccugc

SEQ ID NO: 29750 - RNA, 18 nt, Artificial Sequence
  Description of Artificial Sequence: Synthetic oligonucleotide
ucuggccugagcacccac

SEQ ID NO: 29751 - RNA, 18 nt, Artificial Sequence
  Description of Artificial Sequence: Synthetic oligonucleotide
cuggcucuggccugagca

SEQ ID NO: 29752 - RNA, 18 nt, Artificial Sequence
  Description of Artificial Sequence: Synthetic oligonucleotide
gccggcuggcucuggccu

SEQ ID NO: 29753 - RNA, 18 nt, Artificial Sequence
  Description of Artificial Sequence: Synthetic oligonucleotide
acggugccggcuggcucu

SEQ ID NO: 29754 - RNA, 18 nt, Artificial Sequence
  Description of Artificial Sequence: Synthetic oligonucleotide
gggucacggugccggcug

SEQ ID NO: 29755 - RNA, 18 nt, Artificial Sequence
  Description of Artificial Sequence: Synthetic oligonucleotide
aucaagggugcuggcggg

SEQ ID NO: 29756 - RNA, 18 nt, Artificial Sequence
  Description of Artificial Sequence: Synthetic oligonucleotide
gacgaucaagggugcugg

SEQ ID NO: 29757 - RNA, 18 nt, Artificial Sequence
  Description of Artificial Sequence: Synthetic oligonucleotide
caggagacgaucaagggu

SEQ ID NO: 29758 - RNA, 18 nt, Artificial Sequence
  Description of Artificial Sequence: Synthetic oligonucleotide
ggccucaggagacgauca

SEQ ID NO: 29759 - RNA, 18 nt, Artificial Sequence
  Description of Artificial Sequence: Synthetic oligonucleotide
aucagggccucaggagac

SEQ ID NO: 29760 - RNA, 18 nt, Artificial Sequence
  Description of Artificial Sequence: Synthetic oligonucleotide
ccagaaucagggccucag

SEQ ID NO: 29761 - RNA, 18 nt, Artificial Sequence
  Description of Artificial Sequence: Synthetic oligonucleotide
aacccccagaaucagggc

SEQ ID NO: 29762 - RNA, 18 nt, Artificial Sequence
  Description of Artificial Sequence: Synthetic oligonucleotide
cugggaacccccagaauc

SEQ ID NO: 29763 - RNA, 18 nt, Artificial Sequence
  Description of Artificial Sequence: Synthetic oligonucleotide
gggcccugggaaccccca

SEQ ID NO: 29764 - RNA, 18 nt, Artificial Sequence
  Description of Artificial Sequence: Synthetic oligonucleotide
gcggucagggccucaggg

SEQ ID NO: 29765 - RNA, 18 nt, Artificial Sequence
  Description of Artificial Sequence: Synthetic oligonucleotide
ggcggucagggccucagg

SEQ ID NO: 29766 - RNA, 18 nt, Artificial Sequence
  Description of Artificial Sequence: Synthetic oligonucleotide
gggcgggcggucagggcc

SEQ ID NO: 29767 - RNA, 18 nt, Artificial Sequence
  Description of Artificial Sequence: Synthetic oligonucleotide
gagcucagggagugcggg

SEQ ID NO: 29768 - RNA, 18 nt, Artificial Sequence
  Description of Artificial Sequence: Synthetic oligonucleotide
ucaaggagcucagggagu

SEQ ID NO: 29769 - RNA, 18 nt, Artificial Sequence
  Description of Artificial Sequence: Synthetic oligonucleotide
auggcucaaggagcucag

SEQ ID NO: 29770 - RNA, 18 nt, Artificial Sequence
  Description of Artificial Sequence: Synthetic oligonucleotide
ucuucauggcucaaggag

SEQ ID NO: 29771 - RNA, 18 nt, Artificial Sequence
  Description of Artificial Sequence: Synthetic oligonucleotide
aaacuucuucauggcuca

SEQ ID NO: 29772 - RNA, 18 nt, Artificial Sequence
  Description of Artificial Sequence: Synthetic oligonucleotide
gacgcaaacuucuucaug

SEQ ID NO: 29773 - RNA, 18 nt, Artificial Sequence
  Description of Artificial Sequence: Synthetic oligonucleotide
ggcuggacgcaaacuucu

SEQ ID NO: 29774 - RNA, 18 nt, Artificial Sequence
  Description of Artificial Sequence: Synthetic oligonucleotide
guuacggcuggacgcaaa

SEQ ID NO: 29775 - RNA, 18 nt, Artificial Sequence
  Description of Artificial Sequence: Synthetic oligonucleotide
uucagguuacggcuggac

SEQ ID NO: 29776 - RNA, 18 nt, Artificial Sequence
  Description of Artificial Sequence: Synthetic oligonucleotide
ucuuguucagguuacggc

SEQ ID NO: 29777 - RNA, 18 nt, Artificial Sequence
  Description of Artificial Sequence: Synthetic oligonucleotide
caggaucuuguucagguu

SEQ ID NO: 29778 - RNA, 18 nt, Artificial Sequence
  Description of Artificial Sequence: Synthetic oligonucleotide
ugugccaggaucuuguuc

SEQ ID NO: 29779 - RNA, 18 nt, Artificial Sequence
  Description of Artificial Sequence: Synthetic oligonucleotide
cgcacugugccaggaucu

SEQ ID NO: 29780 - RNA, 18 nt, Artificial Sequence
  Description of Artificial Sequence: Synthetic oligonucleotide
ugagucgcacugugccag

SEQ ID NO: 29781 - RNA, 18 nt, Artificial Sequence
  Description of Artificial Sequence: Synthetic oligonucleotide
gaggaugagucgcacugu

SEQ ID NO: 29782 - RNA, 18 nt, Artificial Sequence
  Description of Artificial Sequence: Synthetic oligonucleotide
cccgcgaggaugagucgc

SEQ ID NO: 29783 - RNA, 18 nt, Artificial Sequence
  Description of Artificial Sequence: Synthetic oligonucleotide
guacucccgcgaggauga

SEQ ID NO: 29784 - RNA, 18 nt, Artificial Sequence
  Description of Artificial Sequence: Synthetic oligonucleotide
uccucguacucccgcgag

SEQ ID NO: 29785 - RNA, 18 nt, Artificial Sequence
  Description of Artificial Sequence: Synthetic oligonucleotide
ggaucuccucguacuccc

SEQ ID NO: 29786 - RNA, 18 nt, Artificial Sequence
  Description of Artificial Sequence: Synthetic oligonucleotide
cgccuggaucuccucgua

SEQ ID NO: 29787 - RNA, 18 nt, Artificial Sequence
  Description of Artificial Sequence: Synthetic oligonucleotide
uccaccgccuggaucucc

SEQ ID NO: 29788 - RNA, 18 nt, Artificial Sequence
  Description of Artificial Sequence: Synthetic oligonucleotide
ugcgcuccaccgccugga

SEQ ID NO: 29789 - RNA, 18 nt, Artificial Sequence
  Description of Artificial Sequence: Synthetic oligonucleotide
ccacuugcgcuccaccgc

SEQ ID NO: 29790 - RNA, 18 nt, Artificial Sequence
  Description of Artificial Sequence: Synthetic oligonucleotide
aggugccacuugcgcucc

SEQ ID NO: 29791 - RNA, 18 nt, Artificial Sequence
  Description of Artificial Sequence: Synthetic oligonucleotide
ggugcaggugccacuugc

SEQ ID NO: 29792 - RNA, 18 nt, Artificial Sequence
  Description of Artificial Sequence: Synthetic oligonucleotide
ggccaggugcaggugcca

SEQ ID NO: 29793 - RNA, 18 nt, Artificial Sequence
  Description of Artificial Sequence: Synthetic oligonucleotide
ggcguggccaggugcagg

SEQ ID NO: 29794 - RNA, 18 nt, Artificial Sequence
  Description of Artificial Sequence: Synthetic oligonucleotide
ggcgcggcguggccaggu

SEQ ID NO: 29795 - RNA, 18 nt, Artificial Sequence
  Description of Artificial Sequence: Synthetic oligonucleotide
caggcggcgcggcguggc

SEQ ID NO: 29796 - RNA, 18 nt, Artificial Sequence
  Description of Artificial Sequence: Synthetic oligonucleotide
agcagcaggcggcgcggc

SEQ ID NO: 29797 - RNA, 18 nt, Artificial Sequence
  Description of Artificial Sequence: Synthetic oligonucleotide
uguccagcagcaggcggc

SEQ ID NO: 29798 - RNA, 18 nt, Artificial Sequence
  Description of Artificial Sequence: Synthetic oligonucleotide
ccuccuguccagcagcag

SEQ ID NO: 29799 - RNA, 18 nt, Artificial Sequence
  Description of Artificial Sequence: Synthetic oligonucleotide
uuggaccuccuguccagc

SEQ ID NO: 29800 - RNA, 18 nt, Artificial Sequence
  Description of Artificial Sequence: Synthetic oligonucleotide
aggccuuggaccuccugu

SEQ ID NO: 29801 - RNA, 18 nt, Artificial Sequence
  Description of Artificial Sequence: Synthetic oligonucleotide
cagggucaguguggugcu

SEQ ID NO: 29802 - RNA, 18 nt, Artificial Sequence
  Description of Artificial Sequence: Synthetic oligonucleotide
gagcgcagggucagugug

SEQ ID NO: 29803 - RNA, 18 nt, Artificial Sequence
  Description of Artificial Sequence: Synthetic oligonucleotide
acuuggagcgcaggguca

SEQ ID NO: 29804 - RNA, 18 nt, Artificial Sequence
  Description of Artificial Sequence: Synthetic oligonucleotide
cauggacuuggagcgcag

SEQ ID NO: 29805 - RNA, 18 nt, Artificial Sequence
  Description of Artificial Sequence: Synthetic oligonucleotide
gcugucauggacuuggag

SEQ ID NO: 29806 - RNA, 18 nt, Artificial Sequence
  Description of Artificial Sequence: Synthetic oligonucleotide
gcucagcugucauggacu

SEQ ID NO: 29807 - RNA, 18 nt, Artificial Sequence
  Description of Artificial Sequence: Synthetic oligonucleotide
cucgagcucagcugucau

SEQ ID NO: 29808 - RNA, 18 nt, Artificial Sequence
  Description of Artificial Sequence: Synthetic oligonucleotide
aguuccucgagcucagcu

SEQ ID NO: 29809 - RNA, 18 nt, Artificial Sequence
  Description of Artificial Sequence: Synthetic oligonucleotide
ggccggucaggagggcgg

SEQ ID NO: 29810 - RNA, 18 nt, Artificial Sequence
  Description of Artificial Sequence: Synthetic oligonucleotide
gagccggccggucaggag

SEQ ID NO: 29811 - RNA, 18 nt, Artificial Sequence
  Description of Artificial Sequence: Synthetic oligonucleotide
accgggagccggccgguc

SEQ ID NO: 29812 - RNA, 18 nt, Artificial Sequence
  Description of Artificial Sequence: Synthetic oligonucleotide
uccgaaccgggagccggc

SEQ ID NO: 29813 - RNA, 18 nt, Artificial Sequence
  Description of Artificial Sequence: Synthetic oligonucleotide
gcccauccgaaccgggag

SEQ ID NO: 29814 - RNA, 18 nt, Artificial Sequence
  Description of Artificial Sequence: Synthetic oligonucleotide
uacaugcccauccgaacc

SEQ ID NO: 29815 - RNA, 18 nt, Artificial Sequence
  Description of Artificial Sequence: Synthetic oligonucleotide
caggguacaugcccaucc

SEQ ID NO: 29816 - RNA, 18 nt, Artificial Sequence
  Description of Artificial Sequence: Synthetic oligonucleotide
gacgccaggguacaugcc

SEQ ID NO: 29817 - RNA, 18 nt, Artificial Sequence
  Description of Artificial Sequence: Synthetic oligonucleotide
accaggacgccaggguac

SEQ ID NO: 29818 - RNA, 18 nt, Artificial Sequence
  Description of Artificial Sequence: Synthetic oligonucleotide
ugggcaccaggacgccag

SEQ ID NO: 29819 - RNA, 18 nt, Artificial Sequence
  Description of Artificial Sequence: Synthetic oligonucleotide
ggagcugggcaccaggac

SEQ ID NO: 29820 - RNA, 18 nt, Artificial Sequence
  Description of Artificial Sequence: Synthetic oligonucleotide
ccccgggagcugggcacc

SEQ ID NO: 29821 - RNA, 18 nt, Artificial Sequence
  Description of Artificial Sequence: Synthetic oligonucleotide
ggcccccccgggagcugg

SEQ ID NO: 29822 - RNA, 18 nt, Artificial Sequence
  Description of Artificial Sequence: Synthetic oligonucleotide
gggcaggcccccccggga

SEQ ID NO: 29823 - RNA, 18 nt, Artificial Sequence
  Description of Artificial Sequence: Synthetic oligonucleotide
cggucaccuccuccaggg

SEQ ID NO: 29824 - RNA, 18 nt, Artificial Sequence
  Description of Artificial Sequence: Synthetic oligonucleotide
gccacggucaccuccucc

SEQ ID NO: 29825 - RNA, 18 nt, Artificial Sequence
  Description of Artificial Sequence: Synthetic oligonucleotide
cuucggccacggucaccu

SEQ ID NO: 29826 - RNA, 18 nt, Artificial Sequence
  Description of Artificial Sequence: Synthetic oligonucleotide
caggacuucggccacggu

SEQ ID NO: 29827 - RNA, 18 nt, Artificial Sequence
  Description of Artificial Sequence: Synthetic oligonucleotide
gcagccaggacuucggcc

SEQ ID NO: 29828 - RNA, 18 nt, Artificial Sequence
  Description of Artificial Sequence: Synthetic oligonucleotide
cucgggcagccaggacuu

SEQ ID NO: 29829 - RNA, 18 nt, Artificial Sequence
  Description of Artificial Sequence: Synthetic oligonucleotide
guagccucgggcagccag

SEQ ID NO: 29830 - RNA, 18 nt, Artificial Sequence
  Description of Artificial Sequence: Synthetic oligonucleotide
gugagguagccucgggca

SEQ ID NO: 29831 - RNA, 18 nt, Artificial Sequence
  Description of Artificial Sequence: Synthetic oligonucleotide
uuccugugagguagccuc

SEQ ID NO: 29832 - RNA, 18 nt, Artificial Sequence
  Description of Artificial Sequence: Synthetic oligonucleotide
ggccauuccugugaggua

SEQ ID NO: 29833 - RNA, 18 nt, Artificial Sequence
  Description of Artificial Sequence: Synthetic oligonucleotide
uugccggccauuccugug

SEQ ID NO: 29834 - RNA, 18 nt, Artificial Sequence
  Description of Artificial Sequence: Synthetic oligonucleotide
gccacuugccggccauuc

SEQ ID NO: 29835 - RNA, 18 nt, Artificial Sequence
  Description of Artificial Sequence: Synthetic oligonucleotide
aaggugccacuugccggc

SEQ ID NO: 29836 - RNA, 18 nt, Artificial Sequence
  Description of Artificial Sequence: Synthetic oligonucleotide
accccaaggugccacuug

SEQ ID NO: 29837 - RNA, 18 nt, Artificial Sequence
  Description of Artificial Sequence: Synthetic oligonucleotide
gccccaccccaaggugcc

SEQ ID NO: 29838 - RNA, 18 nt, Artificial Sequence
  Description of Artificial Sequence: Synthetic oligonucleotide
cucaggccccaccccaag

SEQ ID NO: 29839 - RNA, 18 nt, Artificial Sequence
  Description of Artificial Sequence: Synthetic oligonucleotide
gcccccucaggccccacc

SEQ ID NO: 29840 - RNA, 18 nt, Artificial Sequence
  Description of Artificial Sequence: Synthetic oligonucleotide
ggaaggcccccucaggcc

SEQ ID NO: 29841 - RNA, 18 nt, Artificial Sequence
  Description of Artificial Sequence: Synthetic oligonucleotide
gggcaggaaggcccccuc

SEQ ID NO: 29842 - RNA, 18 nt, Artificial Sequence
  Description of Artificial Sequence: Synthetic oligonucleotide
gauggaagcccugauggg

SEQ ID NO: 29843 - RNA, 18 nt, Artificial Sequence
  Description of Artificial Sequence: Synthetic oligonucleotide
aaucgauggaagcccuga

SEQ ID NO: 29844 - RNA, 18 nt, Artificial Sequence
  Description of Artificial Sequence: Synthetic oligonucleotide
cuagaaaucgauggaagc

SEQ ID NO: 29845 - RNA, 18 nt, Artificial Sequence
  Description of Artificial Sequence: Synthetic oligonucleotide
gaugccuagaaaucgaug

SEQ ID NO: 29846 - RNA, 18 nt, Artificial Sequence
  Description of Artificial Sequence: Synthetic oligonucleotide
uacgggaugccuagaaau

SEQ ID NO: 29847 - RNA, 18 nt, Artificial Sequence
  Description of Artificial Sequence: Synthetic oligonucleotide
gggaguacgggaugccua

SEQ ID NO: 29848 - RNA, 18 nt, Artificial Sequence
  Description of Artificial Sequence: Synthetic oligonucleotide
gucgugggaguacgggau

SEQ ID NO: 29849 - RNA, 18 nt, Artificial Sequence
  Description of Artificial Sequence: Synthetic oligonucleotide
cugagggcccgggugguu

SEQ ID NO: 29850 - RNA, 18 nt, Artificial Sequence
  Description of Artificial Sequence: Synthetic oligonucleotide
gguggcugagggcccggg

SEQ ID NO: 29851 - RNA, 18 nt, Artificial Sequence
  Description of Artificial Sequence: Synthetic oligonucleotide
gggaggguggcugagggc

SEQ ID NO: 29852 - RNA, 18 nt, Artificial Sequence
  Description of Artificial Sequence: Synthetic oligonucleotide
gaggugggaggguggcug

SEQ ID NO: 29853 - RNA, 18 nt, Artificial Sequence
  Description of Artificial Sequence: Synthetic oligonucleotide
uuugggaggugggagggu

SEQ ID NO: 29854 - RNA, 18 nt, Artificial Sequence
  Description of Artificial Sequence: Synthetic oligonucleotide
gggacuuugggagguggg

SEQ ID NO: 29855 - RNA, 18 nt, Artificial Sequence
  Description of Artificial Sequence: Synthetic oligonucleotide
gcgggagcaucaagggcu

SEQ ID NO: 29856 - RNA, 18 nt, Artificial Sequence
  Description of Artificial Sequence: Synthetic oligonucleotide
gggcugcgggagcaucaa

SEQ ID NO: 29857 - RNA, 18 nt, Artificial Sequence
  Description of Artificial Sequence: Synthetic oligonucleotide
uuugggaggugggagggu

SEQ ID NO: 29858 - RNA, 18 nt, Artificial Sequence
  Description of Artificial Sequence: Synthetic oligonucleotide
gggacuuugggagguggg

SEQ ID NO: 29859 - RNA, 18 nt, Artificial Sequence
  Description of Artificial Sequence: Synthetic oligonucleotide
ggagcaucaagggcuggg

SEQ ID NO: 29860 - RNA, 18 nt, Artificial Sequence
  Description of Artificial Sequence: Synthetic oligonucleotide
gcgggagcaucaagggcu

SEQ ID NO: 29861 - RNA, 18 nt, Artificial Sequence
  Description of Artificial Sequence: Synthetic oligonucleotide
gggcugcgggagcaucaa

SEQ ID NO: 29862 - RNA, 18 nt, Artificial Sequence
  Description of Artificial Sequence: Synthetic oligonucleotide
gcugggcuggcagguggg

SEQ ID NO: 29863 - RNA, 18 nt, Artificial Sequence
  Description of Artificial Sequence: Synthetic oligonucleotide
gagggcugggcuggcagg

SEQ ID NO: 29864 - RNA, 18 nt, Artificial Sequence
  Description of Artificial Sequence: Synthetic oligonucleotide
gccgugagggcugggcug

SEQ ID NO: 29865 - RNA, 18 nt, Artificial Sequence
  Description of Artificial Sequence: Synthetic oligonucleotide
gcaggucagguucuggca

SEQ ID NO: 29866 - RNA, 18 nt, Artificial Sequence
  Description of Artificial Sequence: Synthetic oligonucleotide
gggaagcaggucagguuc

SEQ ID NO: 29867 - RNA, 18 nt, Artificial Sequence
  Description of Artificial Sequence: Synthetic oligonucleotide
ccggcgggaagcagguca

SEQ ID NO: 29868 - RNA, 18 nt, Artificial Sequence
  Description of Artificial Sequence: Synthetic oligonucleotide
aguggccggcgggaagca

SEQ ID NO: 29869 - RNA, 18 nt, Artificial Sequence
  Description of Artificial Sequence: Synthetic oligonucleotide
caaggaguggccggcggg

SEQ ID NO: 29870 - RNA, 18 nt, Artificial Sequence
  Description of Artificial Sequence: Synthetic oligonucleotide
cgucgcaaggaguggccg

SEQ ID NO: 29871 - RNA, 18 nt, Artificial Sequence
  Description of Artificial Sequence: Synthetic oligonucleotide
gccaccgucgcaaggagu

SEQ ID NO: 29872 - RNA, 18 nt, Artificial Sequence
  Description of Artificial Sequence: Synthetic oligonucleotide
ucacagccaccgucgcaa

SEQ ID NO: 29873 - RNA, 18 nt, Artificial Sequence
  Description of Artificial Sequence: Synthetic oligonucleotide
ccuggucacagccaccgu

SEQ ID NO: 29874 - RNA, 18 nt, Artificial Sequence
  Description of Artificial Sequence: Synthetic oligonucleotide
caggcccuggucacagcc

SEQ ID NO: 29875 - RNA, 18 nt, Artificial Sequence
  Description of Artificial Sequence: Synthetic oligonucleotide
gggaccaggcccugguca

SEQ ID NO: 29876 - RNA, 18 nt, Artificial Sequence
  Description of Artificial Sequence: Synthetic oligonucleotide
gguuggccaacaguggga

SEQ ID NO: 29877 - RNA, 18 nt, Artificial Sequence
  Description of Artificial Sequence: Synthetic oligonucleotide
ggacagguuggccaacag

SEQ ID NO: 29878 - RNA, 18 nt, Artificial Sequence
  Description of Artificial Sequence: Synthetic oligonucleotide
uccacggacagguuggcc

SEQ ID NO: 29879 - RNA, 18 nt, Artificial Sequence
  Description of Artificial Sequence: Synthetic oligonucleotide
gcgccuccacggacaggu

SEQ ID NO: 29880 - RNA, 18 nt, Artificial Sequence
  Description of Artificial Sequence: Synthetic oligonucleotide
gggcugcgccuccacgga

SEQ ID NO: 29881 - RNA, 18 nt, Artificial Sequence
  Description of Artificial Sequence: Synthetic oligonucleotide
ucuaguccgggcagccag

SEQ ID NO: 29882 - RNA, 18 nt, Artificial Sequence
  Description of Artificial Sequence: Synthetic oligonucleotide
gggccucuaguccgggca

SEQ ID NO: 29883 - RNA, 18 nt, Artificial Sequence
  Description of Artificial Sequence: Synthetic oligonucleotide
guagcgggccucuagucc

SEQ ID NO: 29884 - RNA, 18 nt, Artificial Sequence
  Description of Artificial Sequence: Synthetic oligonucleotide
gccauguagcgggccucu

SEQ ID NO: 29885 - RNA, 18 nt, Artificial Sequence
  Description of Artificial Sequence: Synthetic oligonucleotide
cgaaagccauguagcggg

SEQ ID NO: 29886 - RNA, 18 nt, Artificial Sequence
  Description of Artificial Sequence: Synthetic oligonucleotide
augggcgaaagccaugua

SEQ ID NO: 29887 - RNA, 18 nt, Artificial Sequence
  Description of Artificial Sequence: Synthetic oligonucleotide
aggucaugggcgaaagcc

SEQ ID NO: 29888 - RNA, 18 nt, Artificial Sequence
  Description of Artificial Sequence: Synthetic oligonucleotide
ccaugaggucaugggcga

SEQ ID NO: 29889 - RNA, 18 nt, Artificial Sequence
  Description of Artificial Sequence: Synthetic oligonucleotide
gucggccaugaggucaug

SEQ ID NO: 29890 - RNA, 18 nt, Artificial Sequence
  Description of Artificial Sequence: Synthetic oligonucleotide
ugggcgucggccaugagg

SEQ ID NO: 29891 - RNA, 18 nt, Artificial Sequence
  Description of Artificial Sequence: Synthetic oligonucleotide
ggcgcugggcgucggcca

SEQ ID NO: 29892 - RNA, 18 nt, Artificial Sequence
  Description of Artificial Sequence: Synthetic oligonucleotide
auccuggcgcugggcguc

SEQ ID NO: 29893 - RNA, 18 nt, Artificial Sequence
  Description of Artificial Sequence: Synthetic oligonucleotide
gggcgauccuggcgcugg

SEQ ID NO: 29894 - RNA, 18 nt, Artificial Sequence
  Description of Artificial Sequence: Synthetic oligonucleotide
aggcauaguacaggaaga

SEQ ID NO: 29895 - RNA, 18 nt, Artificial Sequence
  Description of Artificial Sequence: Synthetic oligonucleotide
gugagaggcauaguacag

SEQ ID NO: 29896 - RNA, 18 nt, Artificial Sequence
  Description of Artificial Sequence: Synthetic oligonucleotide
ggucagguucuggcaggg

SEQ ID NO: 29897 - RNA, 18 nt, Artificial Sequence
  Description of Artificial Sequence: Synthetic oligonucleotide
gcaggucagguucuggca

SEQ ID NO: 29898 - RNA, 18 nt, Artificial Sequence
  Description of Artificial Sequence: Synthetic oligonucleotide
gggaagcaggucagguuc

SEQ ID NO: 29899 - RNA, 18 nt, Artificial Sequence
  Description of Artificial Sequence: Synthetic oligonucleotide
ccggcgggaagcagguca

SEQ ID NO: 29900 - RNA, 18 nt, Artificial Sequence
  Description of Artificial Sequence: Synthetic oligonucleotide
aguggccggcgggaagca

SEQ ID NO: 29901 - RNA, 18 nt, Artificial Sequence
  Description of Artificial Sequence: Synthetic oligonucleotide
caaggaguggccggcggg

SEQ ID NO: 29902 - RNA, 18 nt, Artificial Sequence
  Description of Artificial Sequence: Synthetic oligonucleotide
cgucgcaaggaguggccg

SEQ ID NO: 29903 - RNA, 18 nt, Artificial Sequence
  Description of Artificial Sequence: Synthetic oligonucleotide
gccaccgucgcaaggagu

SEQ ID NO: 29904 - RNA, 18 nt, Artificial Sequence
  Description of Artificial Sequence: Synthetic oligonucleotide
ucacagccaccgucgcaa

SEQ ID NO: 29905 - RNA, 18 nt, Artificial Sequence
  Description of Artificial Sequence: Synthetic oligonucleotide
ccuggucacagccaccgu

SEQ ID NO: 29906 - RNA, 18 nt, Artificial Sequence
  Description of Artificial Sequence: Synthetic oligonucleotide
caggcccuggucacagcc

SEQ ID NO: 29907 - RNA, 18 nt, Artificial Sequence
  Description of Artificial Sequence: Synthetic oligonucleotide
gggaccaggcccugguca

SEQ ID NO: 29908 - RNA, 18 nt, Artificial Sequence
  Description of Artificial Sequence: Synthetic oligonucleotide
ggccaacagugggauggg

SEQ ID NO: 29909 - RNA, 18 nt, Artificial Sequence
  Description of Artificial Sequence: Synthetic oligonucleotide
gguuggccaacaguggga

SEQ ID NO: 29910 - RNA, 18 nt, Artificial Sequence
  Description of Artificial Sequence: Synthetic oligonucleotide
ggacagguuggccaacag

SEQ ID NO: 29911 - RNA, 18 nt, Artificial Sequence
  Description of Artificial Sequence: Synthetic oligonucleotide
uccacggacagguuggcc

SEQ ID NO: 29912 - RNA, 18 nt, Artificial Sequence
  Description of Artificial Sequence: Synthetic oligonucleotide
gcgccuccacggacaggu

SEQ ID NO: 29913 - RNA, 18 nt, Artificial Sequence
  Description of Artificial Sequence: Synthetic oligonucleotide
gggcugcgccuccacgga

SEQ ID NO: 29914 - RNA, 18 nt, Artificial Sequence
  Description of Artificial Sequence: Synthetic oligonucleotide
uaguccgggcagccaggg

SEQ ID NO: 29915 - RNA, 18 nt, Artificial Sequence
  Description of Artificial Sequence: Synthetic oligonucleotide
ucuaguccgggcagccag

SEQ ID NO: 29916 - RNA, 18 nt, Artificial Sequence
  Description of Artificial Sequence: Synthetic oligonucleotide
gggccucuaguccgggca

SEQ ID NO: 29917 - RNA, 18 nt, Artificial Sequence
  Description of Artificial Sequence: Synthetic oligonucleotide
guagcgggccucuagucc

SEQ ID NO: 29918 - RNA, 18 nt, Artificial Sequence
  Description of Artificial Sequence: Synthetic oligonucleotide
gccauguagcgggccucu

SEQ ID NO: 29919 - RNA, 18 nt, Artificial Sequence
  Description of Artificial Sequence: Synthetic oligonucleotide
cgaaagccauguagcggg

SEQ ID NO: 29920 - RNA, 18 nt, Artificial Sequence
  Description of Artificial Sequence: Synthetic oligonucleotide
augggcgaaagccaugua

SEQ ID NO: 29921 - RNA, 18 nt, Artificial Sequence
  Description of Artificial Sequence: Synthetic oligonucleotide
aggucaugggcgaaagcc

SEQ ID NO: 29922 - RNA, 18 nt, Artificial Sequence
  Description of Artificial Sequence: Synthetic oligonucleotide
ccaugaggucaugggcga

SEQ ID NO: 29923 - RNA, 18 nt, Artificial Sequence
  Description of Artificial Sequence: Synthetic oligonucleotide
gucggccaugaggucaug

SEQ ID NO: 29924 - RNA, 18 nt, Artificial Sequence
  Description of Artificial Sequence: Synthetic oligonucleotide
ugggcgucggccaugagg

SEQ ID NO: 29925 - RNA, 18 nt, Artificial Sequence
  Description of Artificial Sequence: Synthetic oligonucleotide
ggcgcugggcgucggcca

SEQ ID NO: 29926 - RNA, 18 nt, Artificial Sequence
  Description of Artificial Sequence: Synthetic oligonucleotide
auccuggcgcugggcguc

SEQ ID NO: 29927 - RNA, 18 nt, Artificial Sequence
  Description of Artificial Sequence: Synthetic oligonucleotide
gggcgauccuggcgcugg

SEQ ID NO: 29928 - RNA, 18 nt, Artificial Sequence
  Description of Artificial Sequence: Synthetic oligonucleotide
auaguacaggaagaaggg

SEQ ID NO: 29929 - RNA, 18 nt, Artificial Sequence
  Description of Artificial Sequence: Synthetic oligonucleotide
cauaguacaggaagaagg

SEQ ID NO: 29930 - RNA, 18 nt, Artificial Sequence
  Description of Artificial Sequence: Synthetic oligonucleotide
agaggcauaguacaggaa

SEQ ID NO: 29931 - RNA, 18 nt, Artificial Sequence
  Description of Artificial Sequence: Synthetic oligonucleotide
ggguugggccaagaucac

SEQ ID NO: 29932 - RNA, 18 nt, Artificial Sequence
  Description of Artificial Sequence: Synthetic oligonucleotide
ggucacgggcagccaggg

SEQ ID NO: 29933 - RNA, 18 nt, Artificial Sequence
  Description of Artificial Sequence: Synthetic oligonucleotide
gggucacgggcagccagg

SEQ ID NO: 29934 - RNA, 18 nt, Artificial Sequence
  Description of Artificial Sequence: Synthetic oligonucleotide
aguuagcacuggguaggg

SEQ ID NO: 29935 - RNA, 18 nt, Artificial Sequence
  Description of Artificial Sequence: Synthetic oligonucleotide
acuggaguuagcacuggg

SEQ ID NO: 29936 - RNA, 18 nt, Artificial Sequence
  Description of Artificial Sequence: Synthetic oligonucleotide
caaagacuggaguuagca

SEQ ID NO: 29937 - RNA, 18 nt, Artificial Sequence
  Description of Artificial Sequence: Synthetic oligonucleotide
ggucacgggcagccaggg

SEQ ID NO: 29938 - RNA, 18 nt, Artificial Sequence
  Description of Artificial Sequence: Synthetic oligonucleotide
gggucacgggcagccagg

SEQ ID NO: 29939 - RNA, 18 nt, Artificial Sequence
  Description of Artificial Sequence: Synthetic oligonucleotide
aguuagcacuggguaggg

SEQ ID NO: 29940 - RNA, 18 nt, Artificial Sequence
  Description of Artificial Sequence: Synthetic oligonucleotide
ggaguuagcacuggguag

SEQ ID NO: 29941 - RNA, 18 nt, Artificial Sequence
  Description of Artificial Sequence: Synthetic oligonucleotide
acugaggguagugggugu

SEQ ID NO: 29942 - RNA, 18 nt, Artificial Sequence
  Description of Artificial Sequence: Synthetic oligonucleotide
acugaacugaggguagug

SEQ ID NO: 29943 - RNA, 18 nt, Artificial Sequence
  Description of Artificial Sequence: Synthetic oligonucleotide
ugcccacugaacugaggg

SEQ ID NO: 29944 - RNA, 18 nt, Artificial Sequence
  Description of Artificial Sequence: Synthetic oligonucleotide
agcucugcccacugaacu

SEQ ID NO: 29945 - RNA, 18 nt, Artificial Sequence
  Description of Artificial Sequence: Synthetic oligonucleotide
ugcaaagcucugcccacu

SEQ ID NO: 29946 - RNA, 18 nt, Artificial Sequence
  Description of Artificial Sequence: Synthetic oligonucleotide
cgcucugcaaagcucugc

SEQ ID NO: 29947 - RNA, 18 nt, Artificial Sequence
  Description of Artificial Sequence: Synthetic oligonucleotide
cugaacgcucugcaaagc

SEQ ID NO: 29948 - RNA, 18 nt, Artificial Sequence
  Description of Artificial Sequence: Synthetic oligonucleotide
gcggccugaacgcucugc

SEQ ID NO: 29949 - RNA, 18 nt, Artificial Sequence
  Description of Artificial Sequence: Synthetic oligonucleotide
ggcccgcggccugaacgc

SEQ ID NO: 29950 - RNA, 18 nt, Artificial Sequence
  Description of Artificial Sequence: Synthetic oligonucleotide
caaauggcccgcggccug

SEQ ID NO: 29951 - RNA, 18 nt, Artificial Sequence
  Description of Artificial Sequence: Synthetic oligonucleotide
guccccaaauggcccgcg

SEQ ID NO: 29952 - RNA, 18 nt, Artificial Sequence
  Description of Artificial Sequence: Synthetic oligonucleotide
agggaguccccaaauggc

SEQ ID NO: 29953 - RNA, 18 nt, Artificial Sequence
  Description of Artificial Sequence: Synthetic oligonucleotide
ccaucagggaguccccaa

SEQ ID NO: 29954 - RNA, 18 nt, Artificial Sequence
  Description of Artificial Sequence: Synthetic oligonucleotide
cagcuccaucagggaguc

SEQ ID NO: 29955 - RNA, 18 nt, Artificial Sequence
  Description of Artificial Sequence: Synthetic oligonucleotide
gcauccagcuccaucagg

SEQ ID NO: 29956 - RNA, 18 nt, Artificial Sequence
  Description of Artificial Sequence: Synthetic oligonucleotide
cagcugcauccagcucca

SEQ ID NO: 29957 - RNA, 18 nt, Artificial Sequence
  Description of Artificial Sequence: Synthetic oligonucleotide
ccccacagcugcauccag

SEQ ID NO: 29958 - RNA, 18 nt, Artificial Sequence
  Description of Artificial Sequence: Synthetic oligonucleotide
aggguccccacagcugca

SEQ ID NO: 29959 - RNA, 18 nt, Artificial Sequence
  Description of Artificial Sequence: Synthetic oligonucleotide
ucaucaggguccccacag

SEQ ID NO: 29960 - RNA, 18 nt, Artificial Sequence
  Description of Artificial Sequence: Synthetic oligonucleotide
ggcugucaucaggguccc

SEQ ID NO: 29961 - RNA, 18 nt, Artificial Sequence
  Description of Artificial Sequence: Synthetic oligonucleotide
ccuauggcugucaucagg

SEQ ID NO: 29962 - RNA, 18 nt, Artificial Sequence
  Description of Artificial Sequence: Synthetic oligonucleotide
gguccccuauggcuguca

SEQ ID NO: 29963 - RNA, 18 nt, Artificial Sequence
  Description of Artificial Sequence: Synthetic oligonucleotide
ccccagguccccuauggc

SEQ ID NO: 29964 - RNA, 18 nt, Artificial Sequence
  Description of Artificial Sequence: Synthetic oligonucleotide
agcagccccagguccccu

SEQ ID NO: 29965 - RNA, 18 nt, Artificial Sequence
  Description of Artificial Sequence: Synthetic oligonucleotide
cuucaagcagccccaggu

SEQ ID NO: 29966 - RNA, 18 nt, Artificial Sequence
  Description of Artificial Sequence: Synthetic oligonucleotide
cgucucuucaagcagccc

SEQ ID NO: 29967 - RNA, 18 nt, Artificial Sequence
  Description of Artificial Sequence: Synthetic oligonucleotide
accagcgucucuucaagc

SEQ ID NO: 29968 - RNA, 18 nt, Artificial Sequence
  Description of Artificial Sequence: Synthetic oligonucleotide
agaugaccagcgucucuu

SEQ ID NO: 29969 - RNA, 18 nt, Artificial Sequence
  Description of Artificial Sequence: Synthetic oligonucleotide
agugaagaugaccagcgu

SEQ ID NO: 29970 - RNA, 18 nt, Artificial Sequence
  Description of Artificial Sequence: Synthetic oligonucleotide
ucugcagugaagaugacc

SEQ ID NO: 29971 - RNA, 18 nt, Artificial Sequence
  Description of Artificial Sequence: Synthetic oligonucleotide
cauugucugcagugaaga

SEQ ID NO: 29972 - RNA, 18 nt, Artificial Sequence
  Description of Artificial Sequence: Synthetic oligonucleotide
ggccggucaggagggcgg

SEQ ID NO: 29973 - RNA, 18 nt, Artificial Sequence
  Description of Artificial Sequence: Synthetic oligonucleotide
gagccggccggucaggag

SEQ ID NO: 29974 - RNA, 18 nt, Artificial Sequence
  Description of Artificial Sequence: Synthetic oligonucleotide
accgggagccggccgguc

SEQ ID NO: 29975 - RNA, 18 nt, Artificial Sequence
  Description of Artificial Sequence: Synthetic oligonucleotide
uccgaaccgggagccggc

SEQ ID NO: 29976 - RNA, 18 nt, Artificial Sequence
  Description of Artificial Sequence: Synthetic oligonucleotide
gcccauccgaaccgggag

SEQ ID NO: 29977 - RNA, 18 nt, Artificial Sequence
  Description of Artificial Sequence: Synthetic oligonucleotide
uacaugcccauccgaacc

SEQ ID NO: 29978 - RNA, 18 nt, Artificial Sequence
  Description of Artificial Sequence: Synthetic oligonucleotide
caggguacaugcccaucc

SEQ ID NO: 29979 - RNA, 18 nt, Artificial Sequence
  Description of Artificial Sequence: Synthetic oligonucleotide
gacgccaggguacaugcc

SEQ ID NO: 29980 - RNA, 18 nt, Artificial Sequence
  Description of Artificial Sequence: Synthetic oligonucleotide
accaggacgccaggguac

SEQ ID NO: 29981 - RNA, 18 nt, Artificial Sequence
  Description of Artificial Sequence: Synthetic oligonucleotide
ugggcaccaggacgccag

SEQ ID NO: 29982 - RNA, 18 nt, Artificial Sequence
  Description of Artificial Sequence: Synthetic oligonucleotide
ggagcugggcaccaggac

SEQ ID NO: 29983 - RNA, 18 nt, Artificial Sequence
  Description of Artificial Sequence: Synthetic oligonucleotide
ccccgggagcugggcacc

SEQ ID NO: 29984 - RNA, 18 nt, Artificial Sequence
  Description of Artificial Sequence: Synthetic oligonucleotide
ggcccccccgggagcugg

SEQ ID NO: 29985 - RNA, 18 nt, Artificial Sequence
  Description of Artificial Sequence: Synthetic oligonucleotide
gggcaggcccccccggga

SEQ ID NO: 29986 - RNA, 18 nt, Artificial Sequence
  Description of Artificial Sequence: Synthetic oligonucleotide
cggucaccuccuccaggg

SEQ ID NO: 29987 - RNA, 18 nt, Artificial Sequence
  Description of Artificial Sequence: Synthetic oligonucleotide
gccacggucaccuccucc

SEQ ID NO: 29988 - RNA, 18 nt, Artificial Sequence
  Description of Artificial Sequence: Synthetic oligonucleotide
cuucggccacggucaccu

SEQ ID NO: 29989 - RNA, 18 nt, Artificial Sequence
  Description of Artificial Sequence: Synthetic oligonucleotide
caggacuucggccacggu

SEQ ID NO: 29990 - RNA, 18 nt, Artificial Sequence
  Description of Artificial Sequence: Synthetic oligonucleotide
gcagccaggacuucggcc

SEQ ID NO: 29991 - RNA, 18 nt, Artificial Sequence
  Description of Artificial Sequence: Synthetic oligonucleotide
cucgggcagccaggacuu

SEQ ID NO: 29992 - RNA, 18 nt, Artificial Sequence
  Description of Artificial Sequence: Synthetic oligonucleotide
guagccucgggcagccag

SEQ ID NO: 29993 - RNA, 18 nt, Artificial Sequence
  Description of Artificial Sequence: Synthetic oligonucleotide
gugagguagccucgggca

SEQ ID NO: 29994 - RNA, 18 nt, Artificial Sequence
  Description of Artificial Sequence: Synthetic oligonucleotide
uuccugugagguagccuc

SEQ ID NO: 29995 - RNA, 18 nt, Artificial Sequence
  Description of Artificial Sequence: Synthetic oligonucleotide
ggccauuccugugaggua

SEQ ID NO: 29996 - RNA, 18 nt, Artificial Sequence
  Description of Artificial Sequence: Synthetic oligonucleotide
uugccggccauuccugug

SEQ ID NO: 29997 - RNA, 18 nt, Artificial Sequence
  Description of Artificial Sequence: Synthetic oligonucleotide
gccacuugccggccauuc

SEQ ID NO: 29998 - RNA, 18 nt, Artificial Sequence
  Description of Artificial Sequence: Synthetic oligonucleotide
aaggugccacuugccggc

SEQ ID NO: 29999 - RNA, 18 nt, Artificial Sequence
  Description of Artificial Sequence: Synthetic oligonucleotide
accccaaggugccacuug

SEQ ID NO: 30000 - RNA, 18 nt, Artificial Sequence
  Description of Artificial Sequence: Synthetic oligonucleotide
gccccaccccaaggugcc

SEQ ID NO: 30001 - RNA, 18 nt, Artificial Sequence
  Description of Artificial Sequence: Synthetic oligonucleotide
cucaggccccaccccaag

SEQ ID NO: 30002 - RNA, 18 nt, Artificial Sequence
  Description of Artificial Sequence: Synthetic oligonucleotide
gcccccucaggccccacc

SEQ ID NO: 30003 - RNA, 18 nt, Artificial Sequence
  Description of Artificial Sequence: Synthetic oligonucleotide
ggaaggcccccucaggcc

SEQ ID NO: 30004 - RNA, 18 nt, Artificial Sequence
  Description of Artificial Sequence: Synthetic oligonucleotide
gggcaggaaggcccccuc

SEQ ID NO: 30005 - RNA, 18 nt, Artificial Sequence
  Description of Artificial Sequence: Synthetic oligonucleotide
gauggaagcccugauggg

SEQ ID NO: 30006 - RNA, 18 nt, Artificial Sequence
  Description of Artificial Sequence: Synthetic oligonucleotide
aaucgauggaagcccuga

SEQ ID NO: 30007 - RNA, 18 nt, Artificial Sequence
  Description of Artificial Sequence: Synthetic oligonucleotide
cuagaaaucgauggaagc

SEQ ID NO: 30008 - RNA, 18 nt, Artificial Sequence
  Description of Artificial Sequence: Synthetic oligonucleotide
gaugccuagaaaucgaug

SEQ ID NO: 30009 - RNA, 18 nt, Artificial Sequence
  Description of Artificial Sequence: Synthetic oligonucleotide
uacgggaugccuagaaau

SEQ ID NO: 30010 - RNA, 18 nt, Artificial Sequence
  Description of Artificial Sequence: Synthetic oligonucleotide
gggaguacgggaugccua

SEQ ID NO: 30011 - RNA, 18 nt, Artificial Sequence
  Description of Artificial Sequence: Synthetic oligonucleotide
gucgugggaguacgggau

SEQ ID NO: 30012 - RNA, 18 nt, Artificial Sequence
  Description of Artificial Sequence: Synthetic oligonucleotide
cugagggcccgggugguu

SEQ ID NO: 30013 - RNA, 18 nt, Artificial Sequence
  Description of Artificial Sequence: Synthetic oligonucleotide
gguggcugagggcccggg

SEQ ID NO: 30014 - RNA, 18 nt, Artificial Sequence
  Description of Artificial Sequence: Synthetic oligonucleotide
gggaggguggcugagggc

SEQ ID NO: 30015 - RNA, 18 nt, Artificial Sequence
  Description of Artificial Sequence: Synthetic oligonucleotide
gaggugggaggguggcug

SEQ ID NO: 30016 - RNA, 18 nt, Artificial Sequence
  Description of Artificial Sequence: Synthetic oligonucleotide
uuugggaggugggagggu

SEQ ID NO: 30017 - RNA, 18 nt, Artificial Sequence
  Description of Artificial Sequence: Synthetic oligonucleotide
gggacuuugggagguggg

SEQ ID NO: 30018 - RNA, 18 nt, Artificial Sequence
  Description of Artificial Sequence: Synthetic oligonucleotide
gcgggagcaucaagggcu

SEQ ID NO: 30019 - RNA, 18 nt, Artificial Sequence
  Description of Artificial Sequence: Synthetic oligonucleotide
gggcugcgggagcaucaa

SEQ ID NO: 30020 - RNA, 18 nt, Artificial Sequence
  Description of Artificial Sequence: Synthetic oligonucleotide
uuugggaggugggagggu

SEQ ID NO: 30021 - RNA, 18 nt, Artificial Sequence
  Description of Artificial Sequence: Synthetic oligonucleotide
gggacuuugggagguggg

SEQ ID NO: 30022 - RNA, 18 nt, Artificial Sequence
  Description of Artificial Sequence: Synthetic oligonucleotide
ggagcaucaagggcuggg

SEQ ID NO: 30023 - RNA, 18 nt, Artificial Sequence
  Description of Artificial Sequence: Synthetic oligonucleotide
gcgggagcaucaagggcu

SEQ ID NO: 30024 - RNA, 18 nt, Artificial Sequence
  Description of Artificial Sequence: Synthetic oligonucleotide
gggcugcgggagcaucaa

SEQ ID NO: 30025 - RNA, 18 nt, Artificial Sequence
  Description of Artificial Sequence: Synthetic oligonucleotide
gcugggcuggcagguggg

SEQ ID NO: 30026 - RNA, 18 nt, Artificial Sequence
  Description of Artificial Sequence: Synthetic oligonucleotide
gagggcugggcuggcagg

SEQ ID NO: 30027 - RNA, 18 nt, Artificial Sequence
  Description of Artificial Sequence: Synthetic oligonucleotide
gccgugagggcugggcug

SEQ ID NO: 30028 - RNA, 18 nt, Artificial Sequence
  Description of Artificial Sequence: Synthetic oligonucleotide
gcaggucagguucuggca

SEQ ID NO: 30029 - RNA, 18 nt, Artificial Sequence
  Description of Artificial Sequence: Synthetic oligonucleotide
gggaagcaggucagguuc

SEQ ID NO: 30030 - RNA, 18 nt, Artificial Sequence
  Description of Artificial Sequence: Synthetic oligonucleotide
ccggcgggaagcagguca

SEQ ID NO: 30031 - RNA, 18 nt, Artificial Sequence
  Description of Artificial Sequence: Synthetic oligonucleotide
aguggccggcgggaagca

SEQ ID NO: 30032 - RNA, 18 nt, Artificial Sequence
  Description of Artificial Sequence: Synthetic oligonucleotide
caaggaguggccggcggg

SEQ ID NO: 30033 - RNA, 18 nt, Artificial Sequence
  Description of Artificial Sequence: Synthetic oligonucleotide
cgucgcaaggaguggccg

SEQ ID NO: 30034 - RNA, 18 nt, Artificial Sequence
  Description of Artificial Sequence: Synthetic oligonucleotide
gccaccgucgcaaggagu

SEQ ID NO: 30035 - RNA, 18 nt, Artificial Sequence
  Description of Artificial Sequence: Synthetic oligonucleotide
ucacagccaccgucgcaa

SEQ ID NO: 30036 - RNA, 18 nt, Artificial Sequence
  Description of Artificial Sequence: Synthetic oligonucleotide
ccuggucacagccaccgu

SEQ ID NO: 30037 - RNA, 18 nt, Artificial Sequence
  Description of Artificial Sequence: Synthetic oligonucleotide
caggcccuggucacagcc

SEQ ID NO: 30038 - RNA, 18 nt, Artificial Sequence
  Description of Artificial Sequence: Synthetic oligonucleotide
gggaccaggcccugguca

SEQ ID NO: 30039 - RNA, 18 nt, Artificial Sequence
  Description of Artificial Sequence: Synthetic oligonucleotide
gguuggccaacaguggga

SEQ ID NO: 30040 - RNA, 18 nt, Artificial Sequence
  Description of Artificial Sequence: Synthetic oligonucleotide
ggacagguuggccaacag

SEQ ID NO: 30041 - RNA, 18 nt, Artificial Sequence
  Description of Artificial Sequence: Synthetic oligonucleotide
uccacggacagguuggcc

SEQ ID NO: 30042 - RNA, 18 nt, Artificial Sequence
  Description of Artificial Sequence: Synthetic oligonucleotide
gcgccuccacggacaggu

SEQ ID NO: 30043 - RNA, 18 nt, Artificial Sequence
  Description of Artificial Sequence: Synthetic oligonucleotide
gggcugcgccuccacgga

SEQ ID NO: 30044 - RNA, 18 nt, Artificial Sequence
  Description of Artificial Sequence: Synthetic oligonucleotide
ucuaguccgggcagccag

SEQ ID NO: 30045 - RNA, 18 nt, Artificial Sequence
  Description of Artificial Sequence: Synthetic oligonucleotide
gggccucuaguccgggca

SEQ ID NO: 30046 - RNA, 18 nt, Artificial Sequence
  Description of Artificial Sequence: Synthetic oligonucleotide
guagcgggccucuagucc

SEQ ID NO: 30047 - RNA, 18 nt, Artificial Sequence
  Description of Artificial Sequence: Synthetic oligonucleotide
gccauguagcgggccucu

SEQ ID NO: 30048 - RNA, 18 nt, Artificial Sequence
  Description of Artificial Sequence: Synthetic oligonucleotide
cgaaagccauguagcggg

SEQ ID NO: 30049 - RNA, 18 nt, Artificial Sequence
  Description of Artificial Sequence: Synthetic oligonucleotide
augggcgaaagccaugua

SEQ ID NO: 30050 - RNA, 18 nt, Artificial Sequence
  Description of Artificial Sequence: Synthetic oligonucleotide
aggucaugggcgaaagcc

SEQ ID NO: 30051 - RNA, 18 nt, Artificial Sequence
  Description of Artificial Sequence: Synthetic oligonucleotide
ccaugaggucaugggcga

SEQ ID NO: 30052 - RNA, 18 nt, Artificial Sequence
  Description of Artificial Sequence: Synthetic oligonucleotide
gucggccaugaggucaug

SEQ ID NO: 30053 - RNA, 18 nt, Artificial Sequence
  Description of Artificial Sequence: Synthetic oligonucleotide
ugggcgucggccaugagg

SEQ ID NO: 30054 - RNA, 18 nt, Artificial Sequence
  Description of Artificial Sequence: Synthetic oligonucleotide
ggcgcugggcgucggcca

SEQ ID NO: 30055 - RNA, 18 nt, Artificial Sequence
  Description of Artificial Sequence: Synthetic oligonucleotide
auccuggcgcugggcguc

SEQ ID NO: 30056 - RNA, 18 nt, Artificial Sequence
  Description of Artificial Sequence: Synthetic oligonucleotide
gggcgauccuggcgcugg

SEQ ID NO: 30057 - RNA, 18 nt, Artificial Sequence
  Description of Artificial Sequence: Synthetic oligonucleotide
aggcauaguacaggaaga

SEQ ID NO: 30058 - RNA, 18 nt, Artificial Sequence
  Description of Artificial Sequence: Synthetic oligonucleotide
gugagaggcauaguacag

SEQ ID NO: 30059 - RNA, 18 nt, Artificial Sequence
  Description of Artificial Sequence: Synthetic oligonucleotide
ggucagguucuggcaggg

SEQ ID NO: 30060 - RNA, 18 nt, Artificial Sequence
  Description of Artificial Sequence: Synthetic oligonucleotide
gcaggucagguucuggca

SEQ ID NO: 30061 - RNA, 18 nt, Artificial Sequence
  Description of Artificial Sequence: Synthetic oligonucleotide
gggaagcaggucagguuc

SEQ ID NO: 30062 - RNA, 18 nt, Artificial Sequence
  Description of Artificial Sequence: Synthetic oligonucleotide
ccggcgggaagcagguca

SEQ ID NO: 30063 - RNA, 18 nt, Artificial Sequence
  Description of Artificial Sequence: Synthetic oligonucleotide
aguggccggcgggaagca

SEQ ID NO: 30064 - RNA, 18 nt, Artificial Sequence
  Description of Artificial Sequence: Synthetic oligonucleotide
caaggaguggccggcggg

SEQ ID NO: 30065 - RNA, 18 nt, Artificial Sequence
  Description of Artificial Sequence: Synthetic oligonucleotide
cgucgcaaggaguggccg

SEQ ID NO: 30066 - RNA, 18 nt, Artificial Sequence
  Description of Artificial Sequence: Synthetic oligonucleotide
gccaccgucgcaaggagu

SEQ ID NO: 30067 - RNA, 18 nt, Artificial Sequence
  Description of Artificial Sequence: Synthetic oligonucleotide
ucacagccaccgucgcaa

SEQ ID NO: 30068 - RNA, 18 nt, Artificial Sequence
  Description of Artificial Sequence: Synthetic oligonucleotide
ccuggucacagccaccgu

SEQ ID NO: 30069 - RNA, 18 nt, Artificial Sequence
  Description of Artificial Sequence: Synthetic oligonucleotide
caggcccuggucacagcc

SEQ ID NO: 30070 - RNA, 18 nt, Artificial Sequence
  Description of Artificial Sequence: Synthetic oligonucleotide
gggaccaggcccugguca

SEQ ID NO: 30071 - RNA, 18 nt, Artificial Sequence
  Description of Artificial Sequence: Synthetic oligonucleotide
ggccaacagugggauggg

SEQ ID NO: 30072 - RNA, 18 nt, Artificial Sequence
  Description of Artificial Sequence: Synthetic oligonucleotide
gguuggccaacaguggga

SEQ ID NO: 30073 - RNA, 18 nt, Artificial Sequence
  Description of Artificial Sequence: Synthetic oligonucleotide
ggacagguuggccaacag

SEQ ID NO: 30074 - RNA, 18 nt, Artificial Sequence
  Description of Artificial Sequence: Synthetic oligonucleotide
uccacggacagguuggcc

SEQ ID NO: 30075 - RNA, 18 nt, Artificial Sequence
  Description of Artificial Sequence: Synthetic oligonucleotide
gcgccuccacggacaggu

SEQ ID NO: 30076 - RNA, 18 nt, Artificial Sequence
  Description of Artificial Sequence: Synthetic oligonucleotide
gggcugcgccuccacgga

SEQ ID NO: 30077 - RNA, 18 nt, Artificial Sequence
  Description of Artificial Sequence: Synthetic oligonucleotide
uaguccgggcagccaggg

SEQ ID NO: 30078 - RNA, 18 nt, Artificial Sequence
  Description of Artificial Sequence: Synthetic oligonucleotide
ucuaguccgggcagccag

SEQ ID NO: 30079 - RNA, 18 nt, Artificial Sequence
  Description of Artificial Sequence: Synthetic oligonucleotide
gggccucuaguccgggca

SEQ ID NO: 30080 - RNA, 18 nt, Artificial Sequence
  Description of Artificial Sequence: Synthetic oligonucleotide
guagcgggccucuagucc

SEQ ID NO: 30081 - RNA, 18 nt, Artificial Sequence
  Description of Artificial Sequence: Synthetic oligonucleotide
gccauguagcgggccucu

SEQ ID NO: 30082 - RNA, 18 nt, Artificial Sequence
  Description of Artificial Sequence: Synthetic oligonucleotide
cgaaagccauguagcggg

SEQ ID NO: 30083 - RNA, 18 nt, Artificial Sequence
  Description of Artificial Sequence: Synthetic oligonucleotide
augggcgaaagccaugua

SEQ ID NO: 30084 - RNA, 18 nt, Artificial Sequence
  Description of Artificial Sequence: Synthetic oligonucleotide
aggucaugggcgaaagcc

SEQ ID NO: 30085 - RNA, 18 nt, Artificial Sequence
  Description of Artificial Sequence: Synthetic oligonucleotide
ccaugaggucaugggcga

SEQ ID NO: 30086 - RNA, 18 nt, Artificial Sequence
  Description of Artificial Sequence: Synthetic oligonucleotide
gucggccaugaggucaug

SEQ ID NO: 30087 - RNA, 18 nt, Artificial Sequence
  Description of Artificial Sequence: Synthetic oligonucleotide
ugggcgucggccaugagg

SEQ ID NO: 30088 - RNA, 18 nt, Artificial Sequence
  Description of Artificial Sequence: Synthetic oligonucleotide
ggcgcugggcgucggcca

SEQ ID NO: 30089 - RNA, 18 nt, Artificial Sequence
  Description of Artificial Sequence: Synthetic oligonucleotide
auccuggcgcugggcguc

SEQ ID NO: 30090 - RNA, 18 nt, Artificial Sequence
  Description of Artificial Sequence: Synthetic oligonucleotide
gggcgauccuggcgcugg

SEQ ID NO: 30091 - RNA, 18 nt, Artificial Sequence
  Description of Artificial Sequence: Synthetic oligonucleotide
auaguacaggaagaaggg

SEQ ID NO: 30092 - RNA, 18 nt, Artificial Sequence
  Description of Artificial Sequence: Synthetic oligonucleotide
cauaguacaggaagaagg

SEQ ID NO: 30093 - RNA, 18 nt, Artificial Sequence
  Description of Artificial Sequence: Synthetic oligonucleotide
agaggcauaguacaggaa

SEQ ID NO: 30094 - RNA, 18 nt, Artificial Sequence
  Description of Artificial Sequence: Synthetic oligonucleotide
ggguugggccaagaucac

SEQ ID NO: 30095 - RNA, 18 nt, Artificial Sequence
  Description of Artificial Sequence: Synthetic oligonucleotide
ggucacgggcagccaggg

SEQ ID NO: 30096 - RNA, 18 nt, Artificial Sequence
  Description of Artificial Sequence: Synthetic oligonucleotide
gggucacgggcagccagg

SEQ ID NO: 30097 - RNA, 18 nt, Artificial Sequence
  Description of Artificial Sequence: Synthetic oligonucleotide
aguuagcacuggguaggg

SEQ ID NO: 30098 - RNA, 18 nt, Artificial Sequence
  Description of Artificial Sequence: Synthetic oligonucleotide
acuggaguuagcacuggg

SEQ ID NO: 30099 - RNA, 18 nt, Artificial Sequence
  Description of Artificial Sequence: Synthetic oligonucleotide
caaagacuggaguuagca

SEQ ID NO: 30100 - RNA, 18 nt, Artificial Sequence
  Description of Artificial Sequence: Synthetic oligonucleotide
ggucacgggcagccaggg

SEQ ID NO: 30101 - RNA, 18 nt, Artificial Sequence
  Description of Artificial Sequence: Synthetic oligonucleotide
gggucacgggcagccagg

SEQ ID NO: 30102 - RNA, 18 nt, Artificial Sequence
  Description of Artificial Sequence: Synthetic oligonucleotide
aguuagcacuggguaggg

SEQ ID NO: 30103 - RNA, 18 nt, Artificial Sequence
  Description of Artificial Sequence: Synthetic oligonucleotide
ggaguuagcacuggguag

SEQ ID NO: 30104 - RNA, 18 nt, Artificial Sequence
  Description of Artificial Sequence: Synthetic oligonucleotide
acugaggguagugggugu

SEQ ID NO: 30105 - RNA, 18 nt, Artificial Sequence
  Description of Artificial Sequence: Synthetic oligonucleotide
acugaacugaggguagug

SEQ ID NO: 30106 - RNA, 18 nt, Artificial Sequence
  Description of Artificial Sequence: Synthetic oligonucleotide
ugcccacugaacugaggg

SEQ ID NO: 30107 - RNA, 18 nt, Artificial Sequence
  Description of Artificial Sequence: Synthetic oligonucleotide
agcucugcccacugaacu

SEQ ID NO: 30108 - RNA, 18 nt, Artificial Sequence
  Description of Artificial Sequence: Synthetic oligonucleotide
ugcaaagcucugcccacu

SEQ ID NO: 30109 - RNA, 18 nt, Artificial Sequence
  Description of Artificial Sequence: Synthetic oligonucleotide
cgcucugcaaagcucugc

SEQ ID NO: 30110 - RNA, 18 nt, Artificial Sequence
  Description of Artificial Sequence: Synthetic oligonucleotide
cugaacgcucugcaaagc

SEQ ID NO: 30111 - RNA, 18 nt, Artificial Sequence
  Description of Artificial Sequence: Synthetic oligonucleotide
gcggccugaacgcucugc

SEQ ID NO: 30112 - RNA, 18 nt, Artificial Sequence
  Description of Artificial Sequence: Synthetic oligonucleotide
ggcccgcggccugaacgc

SEQ ID NO: 30113 - RNA, 18 nt, Artificial Sequence
  Description of Artificial Sequence: Synthetic oligonucleotide
caaauggcccgcggccug

SEQ ID NO: 30114 - RNA, 18 nt, Artificial Sequence
  Description of Artificial Sequence: Synthetic oligonucleotide
guccccaaauggcccgcg

SEQ ID NO: 30115 - RNA, 18 nt, Artificial Sequence
  Description of Artificial Sequence: Synthetic oligonucleotide
agggaguccccaaauggc

SEQ ID NO: 30116 - RNA, 18 nt, Artificial Sequence
  Description of Artificial Sequence: Synthetic oligonucleotide
ccaucagggaguccccaa

SEQ ID NO: 30117 - RNA, 18 nt, Artificial Sequence
  Description of Artificial Sequence: Synthetic oligonucleotide
cagcuccaucagggaguc

SEQ ID NO: 30118 - RNA, 18 nt, Artificial Sequence
  Description of Artificial Sequence: Synthetic oligonucleotide
gcauccagcuccaucagg

SEQ ID NO: 30119 - RNA, 18 nt, Artificial Sequence
  Description of Artificial Sequence: Synthetic oligonucleotide
cagcugcauccagcucca

SEQ ID NO: 30120 - RNA, 18 nt, Artificial Sequence
  Description of Artificial Sequence: Synthetic oligonucleotide
ccccacagcugcauccag

SEQ ID NO: 30121 - RNA, 18 nt, Artificial Sequence
  Description of Artificial Sequence: Synthetic oligonucleotide
aggguccccacagcugca

SEQ ID NO: 30122 - RNA, 18 nt, Artificial Sequence
  Description of Artificial Sequence: Synthetic oligonucleotide
ucaucaggguccccacag

SEQ ID NO: 30123 - RNA, 18 nt, Artificial Sequence
  Description of Artificial Sequence: Synthetic oligonucleotide
ggcugucaucaggguccc

SEQ ID NO: 30124 - RNA, 18 nt, Artificial Sequence
  Description of Artificial Sequence: Synthetic oligonucleotide
ccuauggcugucaucagg

SEQ ID NO: 30125 - RNA, 18 nt, Artificial Sequence
  Description of Artificial Sequence: Synthetic oligonucleotide
gguccccuauggcuguca

SEQ ID NO: 30126 - RNA, 18 nt, Artificial Sequence
  Description of Artificial Sequence: Synthetic oligonucleotide
ccccagguccccuauggc

SEQ ID NO: 30127 - RNA, 18 nt, Artificial Sequence
  Description of Artificial Sequence: Synthetic oligonucleotide
agcagccccagguccccu

SEQ ID NO: 30128 - RNA, 18 nt, Artificial Sequence
  Description of Artificial Sequence: Synthetic oligonucleotide
cuucaagcagccccaggu

SEQ ID NO: 30129 - RNA, 18 nt, Artificial Sequence
  Description of Artificial Sequence: Synthetic oligonucleotide
cgucucuucaagcagccc

SEQ ID NO: 30130 - RNA, 18 nt, Artificial Sequence
  Description of Artificial Sequence: Synthetic oligonucleotide
accagcgucucuucaagc

SEQ ID NO: 30131 - RNA, 18 nt, Artificial Sequence
  Description of Artificial Sequence: Synthetic oligonucleotide
agaugaccagcgucucuu

SEQ ID NO: 30132 - RNA, 18 nt, Artificial Sequence
  Description of Artificial Sequence: Synthetic oligonucleotide
agugaagaugaccagcgu

SEQ ID NO: 30133 - RNA, 18 nt, Artificial Sequence
  Description of Artificial Sequence: Synthetic oligonucleotide
ucugcagugaagaugacc

SEQ ID NO: 30134 - RNA, 18 nt, Artificial Sequence
  Description of Artificial Sequence: Synthetic oligonucleotide
cauugucugcagugaaga

SEQ ID NO: 30135 - RNA, 18 nt, Artificial Sequence
  Description of Artificial Sequence: Synthetic oligonucleotide
ggccggucaggagggcgg

SEQ ID NO: 30136 - RNA, 18 nt, Artificial Sequence
  Description of Artificial Sequence: Synthetic oligonucleotide
gagccggccggucaggag

SEQ ID NO: 30137 - RNA, 18 nt, Artificial Sequence
  Description of Artificial Sequence: Synthetic oligonucleotide
accgggagccggccgguc

SEQ ID NO: 30138 - RNA, 18 nt, Artificial Sequence
  Description of Artificial Sequence: Synthetic oligonucleotide
uccgaaccgggagccggc

SEQ ID NO: 30139 - RNA, 18 nt, Artificial Sequence
  Description of Artificial Sequence: Synthetic oligonucleotide
gcccauccgaaccgggag

SEQ ID NO: 30140 - RNA, 18 nt, Artificial Sequence
  Description of Artificial Sequence: Synthetic oligonucleotide
uacaugcccauccgaacc

SEQ ID NO: 30141 - RNA, 18 nt, Artificial Sequence
  Description of Artificial Sequence: Synthetic oligonucleotide
caggguacaugcccaucc

SEQ ID NO: 30142 - RNA, 18 nt, Artificial Sequence
  Description of Artificial Sequence: Synthetic oligonucleotide
gacgccaggguacaugcc

SEQ ID NO: 30143 - RNA, 18 nt, Artificial Sequence
  Description of Artificial Sequence: Synthetic oligonucleotide
accaggacgccaggguac

SEQ ID NO: 30144 - RNA, 18 nt, Artificial Sequence
  Description of Artificial Sequence: Synthetic oligonucleotide
ugggcaccaggacgccag

SEQ ID NO: 30145 - RNA, 18 nt, Artificial Sequence
  Description of Artificial Sequence: Synthetic oligonucleotide
ggagcugggcaccaggac

SEQ ID NO: 30146 - RNA, 18 nt, Artificial Sequence
  Description of Artificial Sequence: Synthetic oligonucleotide
ccccgggagcugggcacc

SEQ ID NO: 30147 - RNA, 18 nt, Artificial Sequence
  Description of Artificial Sequence: Synthetic oligonucleotide
ggcccccccgggagcugg

SEQ ID NO: 30148 - RNA, 18 nt, Artificial Sequence
  Description of Artificial Sequence: Synthetic oligonucleotide
gggcaggcccccccggga

SEQ ID NO: 30149 - RNA, 18 nt, Artificial Sequence
  Description of Artificial Sequence: Synthetic oligonucleotide
cggucaccuccuccaggg

SEQ ID NO: 30150 - RNA, 18 nt, Artificial Sequence
  Description of Artificial Sequence: Synthetic oligonucleotide
gccacggucaccuccucc

SEQ ID NO: 30151 - RNA, 18 nt, Artificial Sequence
  Description of Artificial Sequence: Synthetic oligonucleotide
cuucggccacggucaccu

SEQ ID NO: 30152 - RNA, 18 nt, Artificial Sequence
  Description of Artificial Sequence: Synthetic oligonucleotide
caggacuucggccacggu

SEQ ID NO: 30153 - RNA, 18 nt, Artificial Sequence
  Description of Artificial Sequence: Synthetic oligonucleotide
gcagccaggacuucggcc

SEQ ID NO: 30154 - RNA, 18 nt, Artificial Sequence
  Description of Artificial Sequence: Synthetic oligonucleotide
cucgggcagccaggacuu

SEQ ID NO: 30155 - RNA, 18 nt, Artificial Sequence
  Description of Artificial Sequence: Synthetic oligonucleotide
guagccucgggcagccag

SEQ ID NO: 30156 - RNA, 18 nt, Artificial Sequence
  Description of Artificial Sequence: Synthetic oligonucleotide
gugagguagccucgggca

SEQ ID NO: 30157 - RNA, 18 nt, Artificial Sequence
  Description of Artificial Sequence: Synthetic oligonucleotide
uuccugugagguagccuc

SEQ ID NO: 30158 - RNA, 18 nt, Artificial Sequence
  Description of Artificial Sequence: Synthetic oligonucleotide
ggccauuccugugaggua

SEQ ID NO: 30159 - RNA, 18 nt, Artificial Sequence
  Description of Artificial Sequence: Synthetic oligonucleotide
uugccggccauuccugug

SEQ ID NO: 30160 - RNA, 18 nt, Artificial Sequence
  Description of Artificial Sequence: Synthetic oligonucleotide
gccacuugccggccauuc

SEQ ID NO: 30161 - RNA, 18 nt, Artificial Sequence
  Description of Artificial Sequence: Synthetic oligonucleotide
aaggugccacuugccggc

SEQ ID NO: 30162 - RNA, 18 nt, Artificial Sequence
  Description of Artificial Sequence: Synthetic oligonucleotide
accccaaggugccacuug

SEQ ID NO: 30163 - RNA, 18 nt, Artificial Sequence
  Description of Artificial Sequence: Synthetic oligonucleotide
gccccaccccaaggugcc

SEQ ID NO: 30164 - RNA, 18 nt, Artificial Sequence
  Description of Artificial Sequence: Synthetic oligonucleotide
cucaggccccaccccaag

SEQ ID NO: 30165 - RNA, 18 nt, Artificial Sequence
  Description of Artificial Sequence: Synthetic oligonucleotide
gcccccucaggccccacc

SEQ ID NO: 30166 - RNA, 18 nt, Artificial Sequence
  Description of Artificial Sequence: Synthetic oligonucleotide
ggaaggcccccucaggcc

SEQ ID NO: 30167 - RNA, 18 nt, Artificial Sequence
  Description of Artificial Sequence: Synthetic oligonucleotide
gggcaggaaggcccccuc

SEQ ID NO: 30168 - RNA, 18 nt, Artificial Sequence
  Description of Artificial Sequence: Synthetic oligonucleotide
gauggaagcccugauggg

SEQ ID NO: 30169 - RNA, 18 nt, Artificial Sequence
  Description of Artificial Sequence: Synthetic oligonucleotide
aaucgauggaagcccuga

SEQ ID NO: 30170 - RNA, 18 nt, Artificial Sequence
  Description of Artificial Sequence: Synthetic oligonucleotide
cuagaaaucgauggaagc

SEQ ID NO: 30171 - RNA, 18 nt, Artificial Sequence
  Description of Artificial Sequence: Synthetic oligonucleotide
gaugccuagaaaucgaug

SEQ ID NO: 30172 - RNA, 18 nt, Artificial Sequence
  Description of Artificial Sequence: Synthetic oligonucleotide
uacgggaugccuagaaau

SEQ ID NO: 30173 - RNA, 18 nt, Artificial Sequence
  Description of Artificial Sequence: Synthetic oligonucleotide
gggaguacgggaugccua

SEQ ID NO: 30174 - RNA, 18 nt, Artificial Sequence
  Description of Artificial Sequence: Synthetic oligonucleotide
gucgugggaguacgggau

SEQ ID NO: 30175 - RNA, 18 nt, Artificial Sequence
  Description of Artificial Sequence: Synthetic oligonucleotide
cugagggcccgggugguu

SEQ ID NO: 30176 - RNA, 18 nt, Artificial Sequence
  Description of Artificial Sequence: Synthetic oligonucleotide
gguggcugagggcccggg

SEQ ID NO: 30177 - RNA, 18 nt, Artificial Sequence
  Description of Artificial Sequence: Synthetic oligonucleotide
gggaggguggcugagggc

SEQ ID NO: 30178 - RNA, 18 nt, Artificial Sequence
  Description of Artificial Sequence: Synthetic oligonucleotide
gaggugggaggguggcug

SEQ ID NO: 30179 - RNA, 18 nt, Artificial Sequence
  Description of Artificial Sequence: Synthetic oligonucleotide
uuugggaggugggagggu

SEQ ID NO: 30180 - RNA, 18 nt, Artificial Sequence
  Description of Artificial Sequence: Synthetic oligonucleotide
gggacuuugggagguggg

SEQ ID NO: 30181 - RNA, 18 nt, Artificial Sequence
  Description of Artificial Sequence: Synthetic oligonucleotide
gcgggagcaucaagggcu

SEQ ID NO: 30182 - RNA, 18 nt, Artificial Sequence
  Description of Artificial Sequence: Synthetic oligonucleotide
gggcugcgggagcaucaa

SEQ ID NO: 30183 - RNA, 18 nt, Artificial Sequence
  Description of Artificial Sequence: Synthetic oligonucleotide
uuugggaggugggagggu

SEQ ID NO: 30184 - RNA, 18 nt, Artificial Sequence
  Description of Artificial Sequence: Synthetic oligonucleotide
gggacuuugggagguggg

SEQ ID NO: 30185 - RNA, 18 nt, Artificial Sequence
  Description of Artificial Sequence: Synthetic oligonucleotide
ggagcaucaagggcuggg

SEQ ID NO: 30186 - RNA, 18 nt, Artificial Sequence
  Description of Artificial Sequence: Synthetic oligonucleotide
gcgggagcaucaagggcu

SEQ ID NO: 30187 - RNA, 18 nt, Artificial Sequence
  Description of Artificial Sequence: Synthetic oligonucleotide
gggcugcgggagcaucaa

SEQ ID NO: 30188 - RNA, 18 nt, Artificial Sequence
  Description of Artificial Sequence: Synthetic oligonucleotide
gcugggcuggcagguggg

SEQ ID NO: 30189 - RNA, 18 nt, Artificial Sequence
  Description of Artificial Sequence: Synthetic oligonucleotide
gagggcugggcuggcagg

SEQ ID NO: 30190 - RNA, 18 nt, Artificial Sequence
  Description of Artificial Sequence: Synthetic oligonucleotide
gccgugagggcugggcug

SEQ ID NO: 30191 - RNA, 18 nt, Artificial Sequence
  Description of Artificial Sequence: Synthetic oligonucleotide
gcaggucagguucuggca

SEQ ID NO: 30192 - RNA, 18 nt, Artificial Sequence
  Description of Artificial Sequence: Synthetic oligonucleotide
gggaagcaggucagguuc

SEQ ID NO: 30193 - RNA, 18 nt, Artificial Sequence
  Description of Artificial Sequence: Synthetic oligonucleotide
ccggcgggaagcagguca

SEQ ID NO: 30194 - RNA, 18 nt, Artificial Sequence
  Description of Artificial Sequence: Synthetic oligonucleotide
aguggccggcgggaagca

SEQ ID NO: 30195 - RNA, 18 nt, Artificial Sequence
  Description of Artificial Sequence: Synthetic oligonucleotide
caaggaguggccggcggg

SEQ ID NO: 30196 - RNA, 18 nt, Artificial Sequence
  Description of Artificial Sequence: Synthetic oligonucleotide
cgucgcaaggaguggccg

SEQ ID NO: 30197 - RNA, 18 nt, Artificial Sequence
  Description of Artificial Sequence: Synthetic oligonucleotide
gccaccgucgcaaggagu

SEQ ID NO: 30198 - RNA, 18 nt, Artificial Sequence
  Description of Artificial Sequence: Synthetic oligonucleotide
ucacagccaccgucgcaa

SEQ ID NO: 30199 - RNA, 18 nt, Artificial Sequence
  Description of Artificial Sequence: Synthetic oligonucleotide
ccuggucacagccaccgu

SEQ ID NO: 30200 - RNA, 18 nt, Artificial Sequence
  Description of Artificial Sequence: Synthetic oligonucleotide
caggcccuggucacagcc

SEQ ID NO: 30201 - RNA, 18 nt, Artificial Sequence
  Description of Artificial Sequence: Synthetic oligonucleotide
gggaccaggcccugguca

SEQ ID NO: 30202 - RNA, 18 nt, Artificial Sequence
  Description of Artificial Sequence: Synthetic oligonucleotide
gguuggccaacaguggga

SEQ ID NO: 30203 - RNA, 18 nt, Artificial Sequence
  Description of Artificial Sequence: Synthetic oligonucleotide
ggacagguuggccaacag

SEQ ID NO: 30204 - RNA, 18 nt, Artificial Sequence
  Description of Artificial Sequence: Synthetic oligonucleotide
uccacggacagguuggcc

SEQ ID NO: 30205 - RNA, 18 nt, Artificial Sequence
  Description of Artificial Sequence: Synthetic oligonucleotide
gcgccuccacggacaggu

SEQ ID NO: 30206 - RNA, 18 nt, Artificial Sequence
  Description of Artificial Sequence: Synthetic oligonucleotide
gggcugcgccuccacgga

SEQ ID NO: 30207 - RNA, 18 nt, Artificial Sequence
  Description of Artificial Sequence: Synthetic oligonucleotide
ucuaguccgggcagccag

SEQ ID NO: 30208 - RNA, 18 nt, Artificial Sequence
  Description of Artificial Sequence: Synthetic oligonucleotide
gggccucuaguccgggca

SEQ ID NO: 30209 - RNA, 18 nt, Artificial Sequence
  Description of Artificial Sequence: Synthetic oligonucleotide
guagcgggccucuagucc

SEQ ID NO: 30210 - RNA, 18 nt, Artificial Sequence
  Description of Artificial Sequence: Synthetic oligonucleotide
gccauguagcgggccucu

SEQ ID NO: 30211 - RNA, 18 nt, Artificial Sequence
  Description of Artificial Sequence: Synthetic oligonucleotide
cgaaagccauguagcggg

SEQ ID NO: 30212 - RNA, 18 nt, Artificial Sequence
  Description of Artificial Sequence: Synthetic oligonucleotide
augggcgaaagccaugua

SEQ ID NO: 30213 - RNA, 18 nt, Artificial Sequence
  Description of Artificial Sequence: Synthetic oligonucleotide
aggucaugggcgaaagcc

SEQ ID NO: 30214 - RNA, 18 nt, Artificial Sequence
  Description of Artificial Sequence: Synthetic oligonucleotide
ccaugaggucaugggcga

SEQ ID NO: 30215 - RNA, 18 nt, Artificial Sequence
  Description of Artificial Sequence: Synthetic oligonucleotide
gucggccaugaggucaug

SEQ ID NO: 30216 - RNA, 18 nt, Artificial Sequence
  Description of Artificial Sequence: Synthetic oligonucleotide
ugggcgucggccaugagg

SEQ ID NO: 30217 - RNA, 18 nt, Artificial Sequence
  Description of Artificial Sequence: Synthetic oligonucleotide
ggcgcugggcgucggcca

SEQ ID NO: 30218 - RNA, 18 nt, Artificial Sequence
  Description of Artificial Sequence: Synthetic oligonucleotide
auccuggcgcugggcguc

SEQ ID NO: 30219 - RNA, 18 nt, Artificial Sequence
  Description of Artificial Sequence: Synthetic oligonucleotide
gggcgauccuggcgcugg

SEQ ID NO: 30220 - RNA, 18 nt, Artificial Sequence
  Description of Artificial Sequence: Synthetic oligonucleotide
aggcauaguacaggaaga

SEQ ID NO: 30221 - RNA, 18 nt, Artificial Sequence
  Description of Artificial Sequence: Synthetic oligonucleotide
gugagaggcauaguacag

SEQ ID NO: 30222 - RNA, 18 nt, Artificial Sequence
  Description of Artificial Sequence: Synthetic oligonucleotide
ggucagguucuggcaggg

SEQ ID NO: 30223 - RNA, 18 nt, Artificial Sequence
  Description of Artificial Sequence: Synthetic oligonucleotide
gcaggucagguucuggca

SEQ ID NO: 30224 - RNA, 18 nt, Artificial Sequence
  Description of Artificial Sequence: Synthetic oligonucleotide
gggaagcaggucagguuc

SEQ ID NO: 30225 - RNA, 18 nt, Artificial Sequence
  Description of Artificial Sequence: Synthetic oligonucleotide
ccggcgggaagcagguca

SEQ ID NO: 30226 - RNA, 18 nt, Artificial Sequence
  Description of Artificial Sequence: Synthetic oligonucleotide
aguggccggcgggaagca

SEQ ID NO: 30227 - RNA, 18 nt, Artificial Sequence
  Description of Artificial Sequence: Synthetic oligonucleotide
caaggaguggccggcggg

SEQ ID NO: 30228 - RNA, 18 nt, Artificial Sequence
  Description of Artificial Sequence: Synthetic oligonucleotide
cgucgcaaggaguggccg

SEQ ID NO: 30229 - RNA, 18 nt, Artificial Sequence
  Description of Artificial Sequence: Synthetic oligonucleotide
gccaccgucgcaaggagu

SEQ ID NO: 30230 - RNA, 18 nt, Artificial Sequence
  Description of Artificial Sequence: Synthetic oligonucleotide
ucacagccaccgucgcaa

SEQ ID NO: 30231 - RNA, 18 nt, Artificial Sequence
  Description of Artificial Sequence: Synthetic oligonucleotide
ccuggucacagccaccgu

SEQ ID NO: 30232 - RNA, 18 nt, Artificial Sequence
  Description of Artificial Sequence: Synthetic oligonucleotide
caggcccuggucacagcc

SEQ ID NO: 30233 - RNA, 18 nt, Artificial Sequence
  Description of Artificial Sequence: Synthetic oligonucleotide
gggaccaggcccugguca

SEQ ID NO: 30234 - RNA, 18 nt, Artificial Sequence
  Description of Artificial Sequence: Synthetic oligonucleotide
ggccaacagugggauggg

SEQ ID NO: 30235 - RNA, 18 nt, Artificial Sequence
  Description of Artificial Sequence: Synthetic oligonucleotide
gguuggccaacaguggga

SEQ ID NO: 30236 - RNA, 18 nt, Artificial Sequence
  Description of Artificial Sequence: Synthetic oligonucleotide
ggacagguuggccaacag

SEQ ID NO: 30237 - RNA, 18 nt, Artificial Sequence
  Description of Artificial Sequence: Synthetic oligonucleotide
uccacggacagguuggcc

SEQ ID NO: 30238 - RNA, 18 nt, Artificial Sequence
  Description of Artificial Sequence: Synthetic oligonucleotide
gcgccuccacggacaggu

SEQ ID NO: 30239 - RNA, 18 nt, Artificial Sequence
  Description of Artificial Sequence: Synthetic oligonucleotide
gggcugcgccuccacgga

SEQ ID NO: 30240 - RNA, 18 nt, Artificial Sequence
  Description of Artificial Sequence: Synthetic oligonucleotide
uaguccgggcagccaggg

SEQ ID NO: 30241 - RNA, 18 nt, Artificial Sequence
  Description of Artificial Sequence: Synthetic oligonucleotide
ucuaguccgggcagccag

SEQ ID NO: 30242 - RNA, 18 nt, Artificial Sequence
  Description of Artificial Sequence: Synthetic oligonucleotide
gggccucuaguccgggca

SEQ ID NO: 30243 - RNA, 18 nt, Artificial Sequence
  Description of Artificial Sequence: Synthetic oligonucleotide
guagcgggccucuagucc

SEQ ID NO: 30244 - RNA, 18 nt, Artificial Sequence
  Description of Artificial Sequence: Synthetic oligonucleotide
gccauguagcgggccucu

SEQ ID NO: 30245 - RNA, 18 nt, Artificial Sequence
  Description of Artificial Sequence: Synthetic oligonucleotide
cgaaagccauguagcggg

SEQ ID NO: 30246 - RNA, 18 nt, Artificial Sequence
  Description of Artificial Sequence: Synthetic oligonucleotide
augggcgaaagccaugua

SEQ ID NO: 30247 - RNA, 18 nt, Artificial Sequence
  Description of Artificial Sequence: Synthetic oligonucleotide
aggucaugggcgaaagcc

SEQ ID NO: 30248 - RNA, 18 nt, Artificial Sequence
  Description of Artificial Sequence: Synthetic oligonucleotide
ccaugaggucaugggcga

SEQ ID NO: 30249 - RNA, 18 nt, Artificial Sequence
  Description of Artificial Sequence: Synthetic oligonucleotide
gucggccaugaggucaug

SEQ ID NO: 30250 - RNA, 18 nt, Artificial Sequence
  Description of Artificial Sequence: Synthetic oligonucleotide
ugggcgucggccaugagg

SEQ ID NO: 30251 - RNA, 18 nt, Artificial Sequence
  Description of Artificial Sequence: Synthetic oligonucleotide
ggcgcugggcgucggcca

SEQ ID NO: 30252 - RNA, 18 nt, Artificial Sequence
  Description of Artificial Sequence: Synthetic oligonucleotide
auccuggcgcugggcguc

SEQ ID NO: 30253 - RNA, 18 nt, Artificial Sequence
  Description of Artificial Sequence: Synthetic oligonucleotide
gggcgauccuggcgcugg

SEQ ID NO: 30254 - RNA, 18 nt, Artificial Sequence
  Description of Artificial Sequence: Synthetic oligonucleotide
auaguacaggaagaaggg

SEQ ID NO: 30255 - RNA, 18 nt, Artificial Sequence
  Description of Artificial Sequence: Synthetic oligonucleotide
cauaguacaggaagaagg

SEQ ID NO: 30256 - RNA, 18 nt, Artificial Sequence
  Description of Artificial Sequence: Synthetic oligonucleotide
agaggcauaguacaggaa

SEQ ID NO: 30257 - RNA, 18 nt, Artificial Sequence
  Description of Artificial Sequence: Synthetic oligonucleotide
ggguugggccaagaucac

SEQ ID NO: 30258 - RNA, 18 nt, Artificial Sequence
  Description of Artificial Sequence: Synthetic oligonucleotide
ggucacgggcagccaggg

SEQ ID NO: 30259 - RNA, 18 nt, Artificial Sequence
  Description of Artificial Sequence: Synthetic oligonucleotide
gggucacgggcagccagg

SEQ ID NO: 30260 - RNA, 18 nt, Artificial Sequence
  Description of Artificial Sequence: Synthetic oligonucleotide
aguuagcacuggguaggg

SEQ ID NO: 30261 - RNA, 18 nt, Artificial Sequence
  Description of Artificial Sequence: Synthetic oligonucleotide
acuggaguuagcacuggg

SEQ ID NO: 30262 - RNA, 18 nt, Artificial Sequence
  Description of Artificial Sequence: Synthetic oligonucleotide
caaagacuggaguuagca

SEQ ID NO: 30263 - RNA, 18 nt, Artificial Sequence
  Description of Artificial Sequence: Synthetic oligonucleotide
ggucacgggcagccaggg

SEQ ID NO: 30264 - RNA, 18 nt, Artificial Sequence
  Description of Artificial Sequence: Synthetic oligonucleotide
gggucacgggcagccagg

SEQ ID NO: 30265 - RNA, 18 nt, Artificial Sequence
  Description of Artificial Sequence: Synthetic oligonucleotide
aguuagcacuggguaggg

SEQ ID NO: 30266 - RNA, 18 nt, Artificial Sequence
  Description of Artificial Sequence: Synthetic oligonucleotide
ggaguuagcacuggguag

SEQ ID NO: 30267 - RNA, 18 nt, Artificial Sequence
  Description of Artificial Sequence: Synthetic oligonucleotide
acugaggguagugggugu

SEQ ID NO: 30268 - RNA, 18 nt, Artificial Sequence
  Description of Artificial Sequence: Synthetic oligonucleotide
acugaacugaggguagug

SEQ ID NO: 30269 - RNA, 18 nt, Artificial Sequence
  Description of Artificial Sequence: Synthetic oligonucleotide
ugcccacugaacugaggg

SEQ ID NO: 30270 - RNA, 18 nt, Artificial Sequence
  Description of Artificial Sequence: Synthetic oligonucleotide
agcucugcccacugaacu

SEQ ID NO: 30271 - RNA, 18 nt, Artificial Sequence
  Description of Artificial Sequence: Synthetic oligonucleotide
ugcaaagcucugcccacu

SEQ ID NO: 30272 - RNA, 18 nt, Artificial Sequence
  Description of Artificial Sequence: Synthetic oligonucleotide
cgcucugcaaagcucugc

SEQ ID NO: 30273 - RNA, 18 nt, Artificial Sequence
  Description of Artificial Sequence: Synthetic oligonucleotide
cugaacgcucugcaaagc

SEQ ID NO: 30274 - RNA, 18 nt, Artificial Sequence
  Description of Artificial Sequence: Synthetic oligonucleotide
gcggccugaacgcucugc

SEQ ID NO: 30275 - RNA, 18 nt, Artificial Sequence
  Description of Artificial Sequence: Synthetic oligonucleotide
ggcccgcggccugaacgc

SEQ ID NO: 30276 - RNA, 18 nt, Artificial Sequence
  Description of Artificial Sequence: Synthetic oligonucleotide
caaauggcccgcggccug

SEQ ID NO: 30277 - RNA, 18 nt, Artificial Sequence
  Description of Artificial Sequence: Synthetic oligonucleotide
guccccaaauggcccgcg

SEQ ID NO: 30278 - RNA, 18 nt, Artificial Sequence
  Description of Artificial Sequence: Synthetic oligonucleotide
agggaguccccaaauggc

SEQ ID NO: 30279 - RNA, 18 nt, Artificial Sequence
  Description of Artificial Sequence: Synthetic oligonucleotide
ccaucagggaguccccaa

SEQ ID NO: 30280 - RNA, 18 nt, Artificial Sequence
  Description of Artificial Sequence: Synthetic oligonucleotide
cagcuccaucagggaguc

SEQ ID NO: 30281 - RNA, 18 nt, Artificial Sequence
  Description of Artificial Sequence: Synthetic oligonucleotide
gcauccagcuccaucagg

SEQ ID NO: 30282 - RNA, 18 nt, Artificial Sequence
  Description of Artificial Sequence: Synthetic oligonucleotide
cagcugcauccagcucca

SEQ ID NO: 30283 - RNA, 18 nt, Artificial Sequence
  Description of Artificial Sequence: Synthetic oligonucleotide
ccccacagcugcauccag

SEQ ID NO: 30284 - RNA, 18 nt, Artificial Sequence
  Description of Artificial Sequence: Synthetic oligonucleotide
aggguccccacagcugca

SEQ ID NO: 30285 - RNA, 18 nt, Artificial Sequence
  Description of Artificial Sequence: Synthetic oligonucleotide
ucaucaggguccccacag

SEQ ID NO: 30286 - RNA, 18 nt, Artificial Sequence
  Description of Artificial Sequence: Synthetic oligonucleotide
ggcugucaucaggguccc

SEQ ID NO: 30287 - RNA, 18 nt, Artificial Sequence
  Description of Artificial Sequence: Synthetic oligonucleotide
ccuauggcugucaucagg

SEQ ID NO: 30288 - RNA, 18 nt, Artificial Sequence
  Description of Artificial Sequence: Synthetic oligonucleotide
gguccccuauggcuguca

SEQ ID NO: 30289 - RNA, 18 nt, Artificial Sequence
  Description of Artificial Sequence: Synthetic oligonucleotide
ccccagguccccuauggc

SEQ ID NO: 30290 - RNA, 18 nt, Artificial Sequence
  Description of Artificial Sequence: Synthetic oligonucleotide
agcagccccagguccccu

SEQ ID NO: 30291 - RNA, 18 nt, Artificial Sequence
  Description of Artificial Sequence: Synthetic oligonucleotide
cuucaagcagccccaggu

SEQ ID NO: 30292 - RNA, 18 nt, Artificial Sequence
  Description of Artificial Sequence: Synthetic oligonucleotide
cgucucuucaagcagccc

SEQ ID NO: 30293 - RNA, 18 nt, Artificial Sequence
  Description of Artificial Sequence: Synthetic oligonucleotide
accagcgucucuucaagc

SEQ ID NO: 30294 - RNA, 18 nt, Artificial Sequence
  Description of Artificial Sequence: Synthetic oligonucleotide
agaugaccagcgucucuu

SEQ ID NO: 30295 - RNA, 18 nt, Artificial Sequence
  Description of Artificial Sequence: Synthetic oligonucleotide
agugaagaugaccagcgu

SEQ ID NO: 30296 - RNA, 18 nt, Artificial Sequence
  Description of Artificial Sequence: Synthetic oligonucleotide
ucugcagugaagaugacc

SEQ ID NO: 30297 - RNA, 18 nt, Artificial Sequence
  Description of Artificial Sequence: Synthetic oligonucleotide
cauugucugcagugaaga

SEQ ID NO: 30298 - RNA, 18 nt, Artificial Sequence
  Description of Artificial Sequence: Synthetic oligonucleotide
ggccggucaggagggcgg

SEQ ID NO: 30299 - RNA, 18 nt, Artificial Sequence
  Description of Artificial Sequence: Synthetic oligonucleotide
gagccggccggucaggag

SEQ ID NO: 30300 - RNA, 18 nt, Artificial Sequence
  Description of Artificial Sequence: Synthetic oligonucleotide
accgggagccggccgguc

SEQ ID NO: 30301 - RNA, 18 nt, Artificial Sequence
  Description of Artificial Sequence: Synthetic oligonucleotide
uccgaaccgggagccggc

SEQ ID NO: 30302 - RNA, 18 nt, Artificial Sequence
  Description of Artificial Sequence: Synthetic oligonucleotide
gcccauccgaaccgggag

SEQ ID NO: 30303 - RNA, 18 nt, Artificial Sequence
  Description of Artificial Sequence: Synthetic oligonucleotide
uacaugcccauccgaacc

SEQ ID NO: 30304 - RNA, 18 nt, Artificial Sequence
  Description of Artificial Sequence: Synthetic oligonucleotide
caggguacaugcccaucc

SEQ ID NO: 30305 - RNA, 18 nt, Artificial Sequence
  Description of Artificial Sequence: Synthetic oligonucleotide
gacgccaggguacaugcc

SEQ ID NO: 30306 - RNA, 18 nt, Artificial Sequence
  Description of Artificial Sequence: Synthetic oligonucleotide
accaggacgccaggguac

SEQ ID NO: 30307 - RNA, 18 nt, Artificial Sequence
  Description of Artificial Sequence: Synthetic oligonucleotide
ugggcaccaggacgccag

SEQ ID NO: 30308 - RNA, 18 nt, Artificial Sequence
  Description of Artificial Sequence: Synthetic oligonucleotide
ggagcugggcaccaggac

SEQ ID NO: 30309 - RNA, 18 nt, Artificial Sequence
  Description of Artificial Sequence: Synthetic oligonucleotide
ccccgggagcugggcacc

SEQ ID NO: 30310 - RNA, 18 nt, Artificial Sequence
  Description of Artificial Sequence: Synthetic oligonucleotide
ggcccccccgggagcugg

SEQ ID NO: 30311 - RNA, 18 nt, Artificial Sequence
  Description of Artificial Sequence: Synthetic oligonucleotide
gggcaggcccccccggga

SEQ ID NO: 30312 - RNA, 18 nt, Artificial Sequence
  Description of Artificial Sequence: Synthetic oligonucleotide
cggucaccuccuccaggg

SEQ ID NO: 30313 - RNA, 18 nt, Artificial Sequence
  Description of Artificial Sequence: Synthetic oligonucleotide
gccacggucaccuccucc

SEQ ID NO: 30314 - RNA, 18 nt, Artificial Sequence
  Description of Artificial Sequence: Synthetic oligonucleotide
cuucggccacggucaccu

SEQ ID NO: 30315 - RNA, 18 nt, Artificial Sequence
  Description of Artificial Sequence: Synthetic oligonucleotide
caggacuucggccacggu

SEQ ID NO: 30316 - RNA, 18 nt, Artificial Sequence
  Description of Artificial Sequence: Synthetic oligonucleotide
gcagccaggacuucggcc

SEQ ID NO: 30317 - RNA, 18 nt, Artificial Sequence
  Description of Artificial Sequence: Synthetic oligonucleotide
cucgggcagccaggacuu

SEQ ID NO: 30318 - RNA, 18 nt, Artificial Sequence
  Description of Artificial Sequence: Synthetic oligonucleotide
guagccucgggcagccag

SEQ ID NO: 30319 - RNA, 18 nt, Artificial Sequence
  Description of Artificial Sequence: Synthetic oligonucleotide
gugagguagccucgggca

SEQ ID NO: 30320 - RNA, 18 nt, Artificial Sequence
  Description of Artificial Sequence: Synthetic oligonucleotide
uuccugugagguagccuc

SEQ ID NO: 30321 - RNA, 18 nt, Artificial Sequence
  Description of Artificial Sequence: Synthetic oligonucleotide
ggccauuccugugaggua

SEQ ID NO: 30322 - RNA, 18 nt, Artificial Sequence
  Description of Artificial Sequence: Synthetic oligonucleotide
uugccggccauuccugug

SEQ ID NO: 30323 - RNA, 18 nt, Artificial Sequence
  Description of Artificial Sequence: Synthetic oligonucleotide
gccacuugccggccauuc

SEQ ID NO: 30324 - RNA, 18 nt, Artificial Sequence
  Description of Artificial Sequence: Synthetic oligonucleotide
aaggugccacuugccggc

SEQ ID NO: 30325 - RNA, 18 nt, Artificial Sequence
  Description of Artificial Sequence: Synthetic oligonucleotide
accccaaggugccacuug

SEQ ID NO: 30326 - RNA, 18 nt, Artificial Sequence
  Description of Artificial Sequence: Synthetic oligonucleotide
gccccaccccaaggugcc

SEQ ID NO: 30327 - RNA, 18 nt, Artificial Sequence
  Description of Artificial Sequence: Synthetic oligonucleotide
cucaggccccaccccaag

SEQ ID NO: 30328 - RNA, 18 nt, Artificial Sequence
  Description of Artificial Sequence: Synthetic oligonucleotide
gcccccucaggccccacc

SEQ ID NO: 30329 - RNA, 18 nt, Artificial Sequence
  Description of Artificial Sequence: Synthetic oligonucleotide
ggaaggcccccucaggcc

SEQ ID NO: 30330 - RNA, 18 nt, Artificial Sequence
  Description of Artificial Sequence: Synthetic oligonucleotide
gggcaggaaggcccccuc

SEQ ID NO: 30331 - RNA, 18 nt, Artificial Sequence
  Description of Artificial Sequence: Synthetic oligonucleotide
gauggaagcccugauggg

SEQ ID NO: 30332 - RNA, 18 nt, Artificial Sequence
  Description of Artificial Sequence: Synthetic oligonucleotide
aaucgauggaagcccuga

SEQ ID NO: 30333 - RNA, 18 nt, Artificial Sequence
  Description of Artificial Sequence: Synthetic oligonucleotide
cuagaaaucgauggaagc

SEQ ID NO: 30334 - RNA, 18 nt, Artificial Sequence
  Description of Artificial Sequence: Synthetic oligonucleotide
gaugccuagaaaucgaug

SEQ ID NO: 30335 - RNA, 18 nt, Artificial Sequence
  Description of Artificial Sequence: Synthetic oligonucleotide
uacgggaugccuagaaau

SEQ ID NO: 30336 - RNA, 18 nt, Artificial Sequence
  Description of Artificial Sequence: Synthetic oligonucleotide
gggaguacgggaugccua

SEQ ID NO: 30337 - RNA, 18 nt, Artificial Sequence
  Description of Artificial Sequence: Synthetic oligonucleotide
gucgugggaguacgggau

SEQ ID NO: 30338 - RNA, 18 nt, Artificial Sequence
  Description of Artificial Sequence: Synthetic oligonucleotide
cugagggcccgggugguu

SEQ ID NO: 30339 - RNA, 18 nt, Artificial Sequence
  Description of Artificial Sequence: Synthetic oligonucleotide
gguggcugagggcccggg

SEQ ID NO: 30340 - RNA, 18 nt, Artificial Sequence
  Description of Artificial Sequence: Synthetic oligonucleotide
gggaggguggcugagggc

SEQ ID NO: 30341 - RNA, 18 nt, Artificial Sequence
  Description of Artificial Sequence: Synthetic oligonucleotide
gaggugggaggguggcug

SEQ ID NO: 30342 - RNA, 18 nt, Artificial Sequence
  Description of Artificial Sequence: Synthetic oligonucleotide
uuugggaggugggagggu

SEQ ID NO: 30343 - RNA, 18 nt, Artificial Sequence
  Description of Artificial Sequence: Synthetic oligonucleotide
gggacuuugggagguggg

SEQ ID NO: 30344 - RNA, 18 nt, Artificial Sequence
  Description of Artificial Sequence: Synthetic oligonucleotide
gcgggagcaucaagggcu

SEQ ID NO: 30345 - RNA, 18 nt, Artificial Sequence
  Description of Artificial Sequence: Synthetic oligonucleotide
gggcugcgggagcaucaa

SEQ ID NO: 30346 - RNA, 18 nt, Artificial Sequence
  Description of Artificial Sequence: Synthetic oligonucleotide
uuugggaggugggagggu

SEQ ID NO: 30347 - RNA, 18 nt, Artificial Sequence
  Description of Artificial Sequence: Synthetic oligonucleotide
gggacuuugggagguggg

SEQ ID NO: 30348 - RNA, 18 nt, Artificial Sequence
  Description of Artificial Sequence: Synthetic oligonucleotide
ggagcaucaagggcuggg

SEQ ID NO: 30349 - RNA, 18 nt, Artificial Sequence
  Description of Artificial Sequence: Synthetic oligonucleotide
gcgggagcaucaagggcu

SEQ ID NO: 30350 - RNA, 18 nt, Artificial Sequence
  Description of Artificial Sequence: Synthetic oligonucleotide
gggcugcgggagcaucaa

SEQ ID NO: 30351 - RNA, 18 nt, Artificial Sequence
  Description of Artificial Sequence: Synthetic oligonucleotide
gcugggcuggcagguggg

SEQ ID NO: 30352 - RNA, 18 nt, Artificial Sequence
  Description of Artificial Sequence: Synthetic oligonucleotide
gagggcugggcuggcagg

SEQ ID NO: 30353 - RNA, 18 nt, Artificial Sequence
  Description of Artificial Sequence: Synthetic oligonucleotide
gccgugagggcugggcug

SEQ ID NO: 30354 - RNA, 18 nt, Artificial Sequence
  Description of Artificial Sequence: Synthetic oligonucleotide
gcaggucagguucuggca

SEQ ID NO: 30355 - RNA, 18 nt, Artificial Sequence
  Description of Artificial Sequence: Synthetic oligonucleotide
gggaagcaggucagguuc

SEQ ID NO: 30356 - RNA, 18 nt, Artificial Sequence
  Description of Artificial Sequence: Synthetic oligonucleotide
ccggcgggaagcagguca

SEQ ID NO: 30357 - RNA, 18 nt, Artificial Sequence
  Description of Artificial Sequence: Synthetic oligonucleotide
aguggccggcgggaagca

SEQ ID NO: 30358 - RNA, 18 nt, Artificial Sequence
  Description of Artificial Sequence: Synthetic oligonucleotide
caaggaguggccggcggg

SEQ ID NO: 30359 - RNA, 18 nt, Artificial Sequence
  Description of Artificial Sequence: Synthetic oligonucleotide
cgucgcaaggaguggccg

SEQ ID NO: 30360 - RNA, 18 nt, Artificial Sequence
  Description of Artificial Sequence: Synthetic oligonucleotide
gccaccgucgcaaggagu

SEQ ID NO: 30361 - RNA, 18 nt, Artificial Sequence
  Description of Artificial Sequence: Synthetic oligonucleotide
ucacagccaccgucgcaa

SEQ ID NO: 30362 - RNA, 18 nt, Artificial Sequence
  Description of Artificial Sequence: Synthetic oligonucleotide
ccuggucacagccaccgu

SEQ ID NO: 30363 - RNA, 18 nt, Artificial Sequence
  Description of Artificial Sequence: Synthetic oligonucleotide
caggcccuggucacagcc

SEQ ID NO: 30364 - RNA, 18 nt, Artificial Sequence
  Description of Artificial Sequence: Synthetic oligonucleotide
gggaccaggcccugguca

SEQ ID NO: 30365 - RNA, 18 nt, Artificial Sequence
  Description of Artificial Sequence: Synthetic oligonucleotide
gguuggccaacaguggga

SEQ ID NO: 30366 - RNA, 18 nt, Artificial Sequence
  Description of Artificial Sequence: Synthetic oligonucleotide
ggacagguuggccaacag

SEQ ID NO: 30367 - RNA, 18 nt, Artificial Sequence
  Description of Artificial Sequence: Synthetic oligonucleotide
uccacggacagguuggcc

SEQ ID NO: 30368 - RNA, 18 nt, Artificial Sequence
  Description of Artificial Sequence: Synthetic oligonucleotide
gcgccuccacggacaggu

SEQ ID NO: 30369 - RNA, 18 nt, Artificial Sequence
  Description of Artificial Sequence: Synthetic oligonucleotide
gggcugcgccuccacgga

SEQ ID NO: 30370 - RNA, 18 nt, Artificial Sequence
  Description of Artificial Sequence: Synthetic oligonucleotide
ucuaguccgggcagccag

SEQ ID NO: 30371 - RNA, 18 nt, Artificial Sequence
  Description of Artificial Sequence: Synthetic oligonucleotide
gggccucuaguccgggca

SEQ ID NO: 30372 - RNA, 18 nt, Artificial Sequence
  Description of Artificial Sequence: Synthetic oligonucleotide
guagcgggccucuagucc

SEQ ID NO: 30373 - RNA, 18 nt, Artificial Sequence
  Description of Artificial Sequence: Synthetic oligonucleotide
gccauguagcgggccucu

SEQ ID NO: 30374 - RNA, 18 nt, Artificial Sequence
  Description of Artificial Sequence: Synthetic oligonucleotide
cgaaagccauguagcggg

SEQ ID NO: 30375 - RNA, 18 nt, Artificial Sequence
  Description of Artificial Sequence: Synthetic oligonucleotide
augggcgaaagccaugua

SEQ ID NO: 30376 - RNA, 18 nt, Artificial Sequence
  Description of Artificial Sequence: Synthetic oligonucleotide
aggucaugggcgaaagcc

SEQ ID NO: 30377 - RNA, 18 nt, Artificial Sequence
  Description of Artificial Sequence: Synthetic oligonucleotide
ccaugaggucaugggcga

SEQ ID NO: 30378 - RNA, 18 nt, Artificial Sequence
  Description of Artificial Sequence: Synthetic oligonucleotide
gucggccaugaggucaug

SEQ ID NO: 30379 - RNA, 18 nt, Artificial Sequence
  Description of Artificial Sequence: Synthetic oligonucleotide
ugggcgucggccaugagg

SEQ ID NO: 30380 - RNA, 18 nt, Artificial Sequence
  Description of Artificial Sequence: Synthetic oligonucleotide
ggcgcugggcgucggcca

SEQ ID NO: 30381 - RNA, 18 nt, Artificial Sequence
  Description of Artificial Sequence: Synthetic oligonucleotide
auccuggcgcugggcguc

SEQ ID NO: 30382 - RNA, 18 nt, Artificial Sequence
  Description of Artificial Sequence: Synthetic oligonucleotide
gggcgauccuggcgcugg

SEQ ID NO: 30383 - RNA, 18 nt, Artificial Sequence
  Description of Artificial Sequence: Synthetic oligonucleotide
aggcauaguacaggaaga

SEQ ID NO: 30384 - RNA, 18 nt, Artificial Sequence
  Description of Artificial Sequence: Synthetic oligonucleotide
gugagaggcauaguacag

SEQ ID NO: 30385 - RNA, 18 nt, Artificial Sequence
  Description of Artificial Sequence: Synthetic oligonucleotide
ggucagguucuggcaggg

SEQ ID NO: 30386 - RNA, 18 nt, Artificial Sequence
  Description of Artificial Sequence: Synthetic oligonucleotide
gcaggucagguucuggca

SEQ ID NO: 30387 - RNA, 18 nt, Artificial Sequence
  Description of Artificial Sequence: Synthetic oligonucleotide
gggaagcaggucagguuc

SEQ ID NO: 30388 - RNA, 18 nt, Artificial Sequence
  Description of Artificial Sequence: Synthetic oligonucleotide
ccggcgggaagcagguca

SEQ ID NO: 30389 - RNA, 18 nt, Artificial Sequence
  Description of Artificial Sequence: Synthetic oligonucleotide
aguggccggcgggaagca

SEQ ID NO: 30390 - RNA, 18 nt, Artificial Sequence
  Description of Artificial Sequence: Synthetic oligonucleotide
caaggaguggccggcggg

SEQ ID NO: 30391 - RNA, 18 nt, Artificial Sequence
  Description of Artificial Sequence: Synthetic oligonucleotide
cgucgcaaggaguggccg

SEQ ID NO: 30392 - RNA, 18 nt, Artificial Sequence
  Description of Artificial Sequence: Synthetic oligonucleotide
gccaccgucgcaaggagu

SEQ ID NO: 30393 - RNA, 18 nt, Artificial Sequence
  Description of Artificial Sequence: Synthetic oligonucleotide
ucacagccaccgucgcaa

SEQ ID NO: 30394 - RNA, 18 nt, Artificial Sequence
  Description of Artificial Sequence: Synthetic oligonucleotide
ccuggucacagccaccgu

SEQ ID NO: 30395 - RNA, 18 nt, Artificial Sequence
  Description of Artificial Sequence: Synthetic oligonucleotide
caggcccuggucacagcc

SEQ ID NO: 30396 - RNA, 18 nt, Artificial Sequence
  Description of Artificial Sequence: Synthetic oligonucleotide
gggaccaggcccugguca

SEQ ID NO: 30397 - RNA, 18 nt, Artificial Sequence
  Description of Artificial Sequence: Synthetic oligonucleotide
ggccaacagugggauggg

SEQ ID NO: 30398 - RNA, 18 nt, Artificial Sequence
  Description of Artificial Sequence: Synthetic oligonucleotide
gguuggccaacaguggga

SEQ ID NO: 30399 - RNA, 18 nt, Artificial Sequence
  Description of Artificial Sequence: Synthetic oligonucleotide
ggacagguuggccaacag

SEQ ID NO: 30400 - RNA, 18 nt, Artificial Sequence
  Description of Artificial Sequence: Synthetic oligonucleotide
uccacggacagguuggcc

SEQ ID NO: 30401 - RNA, 18 nt, Artificial Sequence
  Description of Artificial Sequence: Synthetic oligonucleotide
gcgccuccacggacaggu

SEQ ID NO: 30402 - RNA, 18 nt, Artificial Sequence
  Description of Artificial Sequence: Synthetic oligonucleotide
gggcugcgccuccacgga

SEQ ID NO: 30403 - RNA, 18 nt, Artificial Sequence
  Description of Artificial Sequence: Synthetic oligonucleotide
uaguccgggcagccaggg

SEQ ID NO: 30404 - RNA, 18 nt, Artificial Sequence
  Description of Artificial Sequence: Synthetic oligonucleotide
ucuaguccgggcagccag

SEQ ID NO: 30405 - RNA, 18 nt, Artificial Sequence
  Description of Artificial Sequence: Synthetic oligonucleotide
gggccucuaguccgggca

SEQ ID NO: 30406 - RNA, 18 nt, Artificial Sequence
  Description of Artificial Sequence: Synthetic oligonucleotide
guagcgggccucuagucc

SEQ ID NO: 30407 - RNA, 18 nt, Artificial Sequence
  Description of Artificial Sequence: Synthetic oligonucleotide
gccauguagcgggccucu

SEQ ID NO: 30408 - RNA, 18 nt, Artificial Sequence
  Description of Artificial Sequence: Synthetic oligonucleotide
cgaaagccauguagcggg

SEQ ID NO: 30409 - RNA, 18 nt, Artificial Sequence
  Description of Artificial Sequence: Synthetic oligonucleotide
augggcgaaagccaugua

SEQ ID NO: 30410 - RNA, 18 nt, Artificial Sequence
  Description of Artificial Sequence: Synthetic oligonucleotide
aggucaugggcgaaagcc

SEQ ID NO: 30411 - RNA, 18 nt, Artificial Sequence
  Description of Artificial Sequence: Synthetic oligonucleotide
ccaugaggucaugggcga

SEQ ID NO: 30412 - RNA, 18 nt, Artificial Sequence
  Description of Artificial Sequence: Synthetic oligonucleotide
gucggccaugaggucaug

SEQ ID NO: 30413 - RNA, 18 nt, Artificial Sequence
  Description of Artificial Sequence: Synthetic oligonucleotide
ugggcgucggccaugagg

SEQ ID NO: 30414 - RNA, 18 nt, Artificial Sequence
  Description of Artificial Sequence: Synthetic oligonucleotide
ggcgcugggcgucggcca

SEQ ID NO: 30415 - RNA, 18 nt, Artificial Sequence
  Description of Artificial Sequence: Synthetic oligonucleotide
auccuggcgcugggcguc

SEQ ID NO: 30416 - RNA, 18 nt, Artificial Sequence
  Description of Artificial Sequence: Synthetic oligonucleotide
gggcgauccuggcgcugg

SEQ ID NO: 30417 - RNA, 18 nt, Artificial Sequence
  Description of Artificial Sequence: Synthetic oligonucleotide
auaguacaggaagaaggg

SEQ ID NO: 30418 - RNA, 18 nt, Artificial Sequence
  Description of Artificial Sequence: Synthetic oligonucleotide
cauaguacaggaagaagg

SEQ ID NO: 30419 - RNA, 18 nt, Artificial Sequence
  Description of Artificial Sequence: Synthetic oligonucleotide
agaggcauaguacaggaa

SEQ ID NO: 30420 - RNA, 18 nt, Artificial Sequence
  Description of Artificial Sequence: Synthetic oligonucleotide
ggguugggccaagaucac

SEQ ID NO: 30421 - RNA, 18 nt, Artificial Sequence
  Description of Artificial Sequence: Synthetic oligonucleotide
ggucacgggcagccaggg

SEQ ID NO: 30422 - RNA, 18 nt, Artificial Sequence
  Description of Artificial Sequence: Synthetic oligonucleotide
gggucacgggcagccagg

SEQ ID NO: 30423 - RNA, 18 nt, Artificial Sequence
  Description of Artificial Sequence: Synthetic oligonucleotide
aguuagcacuggguaggg

SEQ ID NO: 30424 - RNA, 18 nt, Artificial Sequence
  Description of Artificial Sequence: Synthetic oligonucleotide
acuggaguuagcacuggg

SEQ ID NO: 30425 - RNA, 18 nt, Artificial Sequence
  Description of Artificial Sequence: Synthetic oligonucleotide
caaagacuggaguuagca

SEQ ID NO: 30426 - RNA, 18 nt, Artificial Sequence
  Description of Artificial Sequence: Synthetic oligonucleotide
ggucacgggcagccaggg

SEQ ID NO: 30427 - RNA, 18 nt, Artificial Sequence
  Description of Artificial Sequence: Synthetic oligonucleotide
gggucacgggcagccagg

SEQ ID NO: 30428 - RNA, 18 nt, Artificial Sequence
  Description of Artificial Sequence: Synthetic oligonucleotide
aguuagcacuggguaggg

SEQ ID NO: 30429 - RNA, 18 nt, Artificial Sequence
  Description of Artificial Sequence: Synthetic oligonucleotide
ggaguuagcacuggguag

SEQ ID NO: 30430 - RNA, 18 nt, Artificial Sequence
  Description of Artificial Sequence: Synthetic oligonucleotide
acugaggguagugggugu

SEQ ID NO: 30431 - RNA, 18 nt, Artificial Sequence
  Description of Artificial Sequence: Synthetic oligonucleotide
acugaacugaggguagug

SEQ ID NO: 30432 - RNA, 18 nt, Artificial Sequence
  Description of Artificial Sequence: Synthetic oligonucleotide
ugcccacugaacugaggg

SEQ ID NO: 30433 - RNA, 18 nt, Artificial Sequence
  Description of Artificial Sequence: Synthetic oligonucleotide
agcucugcccacugaacu

SEQ ID NO: 30434 - RNA, 18 nt, Artificial Sequence
  Description of Artificial Sequence: Synthetic oligonucleotide
ugcaaagcucugcccacu

SEQ ID NO: 30435 - RNA, 18 nt, Artificial Sequence
  Description of Artificial Sequence: Synthetic oligonucleotide
cgcucugcaaagcucugc

SEQ ID NO: 30436 - RNA, 18 nt, Artificial Sequence
  Description of Artificial Sequence: Synthetic oligonucleotide
cugaacgcucugcaaagc

SEQ ID NO: 30437 - RNA, 18 nt, Artificial Sequence
  Description of Artificial Sequence: Synthetic oligonucleotide
gcggccugaacgcucugc

SEQ ID NO: 30438 - RNA, 18 nt, Artificial Sequence
  Description of Artificial Sequence: Synthetic oligonucleotide
ggcccgcggccugaacgc

SEQ ID NO: 30439 - RNA, 18 nt, Artificial Sequence
  Description of Artificial Sequence: Synthetic oligonucleotide
caaauggcccgcggccug

SEQ ID NO: 30440 - RNA, 18 nt, Artificial Sequence
  Description of Artificial Sequence: Synthetic oligonucleotide
guccccaaauggcccgcg

SEQ ID NO: 30441 - RNA, 18 nt, Artificial Sequence
  Description of Artificial Sequence: Synthetic oligonucleotide
agggaguccccaaauggc

SEQ ID NO: 30442 - RNA, 18 nt, Artificial Sequence
  Description of Artificial Sequence: Synthetic oligonucleotide
ccaucagggaguccccaa

SEQ ID NO: 30443 - RNA, 18 nt, Artificial Sequence
  Description of Artificial Sequence: Synthetic oligonucleotide
cagcuccaucagggaguc

SEQ ID NO: 30444 - RNA, 18 nt, Artificial Sequence
  Description of Artificial Sequence: Synthetic oligonucleotide
gcauccagcuccaucagg

SEQ ID NO: 30445 - RNA, 18 nt, Artificial Sequence
  Description of Artificial Sequence: Synthetic oligonucleotide
cagcugcauccagcucca

SEQ ID NO: 30446 - RNA, 18 nt, Artificial Sequence
  Description of Artificial Sequence: Synthetic oligonucleotide
ccccacagcugcauccag

SEQ ID NO: 30447 - RNA, 18 nt, Artificial Sequence
  Description of Artificial Sequence: Synthetic oligonucleotide
aggguccccacagcugca

SEQ ID NO: 30448 - RNA, 18 nt, Artificial Sequence
  Description of Artificial Sequence: Synthetic oligonucleotide
ucaucaggguccccacag

SEQ ID NO: 30449 - RNA, 18 nt, Artificial Sequence
  Description of Artificial Sequence: Synthetic oligonucleotide
ggcugucaucaggguccc

SEQ ID NO: 30450 - RNA, 18 nt, Artificial Sequence
  Description of Artificial Sequence: Synthetic oligonucleotide
ccuauggcugucaucagg

SEQ ID NO: 30451 - RNA, 18 nt, Artificial Sequence
  Description of Artificial Sequence: Synthetic oligonucleotide
gguccccuauggcuguca

SEQ ID NO: 30452 - RNA, 18 nt, Artificial Sequence
  Description of Artificial Sequence: Synthetic oligonucleotide
ccccagguccccuauggc

SEQ ID NO: 30453 - RNA, 18 nt, Artificial Sequence
  Description of Artificial Sequence: Synthetic oligonucleotide
agcagccccagguccccu

SEQ ID NO: 30454 - RNA, 18 nt, Artificial Sequence
  Description of Artificial Sequence: Synthetic oligonucleotide
cuucaagcagccccaggu

SEQ ID NO: 30455 - RNA, 18 nt, Artificial Sequence
  Description of Artificial Sequence: Synthetic oligonucleotide
cgucucuucaagcagccc

SEQ ID NO: 30456 - RNA, 18 nt, Artificial Sequence
  Description of Artificial Sequence: Synthetic oligonucleotide
accagcgucucuucaagc

SEQ ID NO: 30457 - RNA, 18 nt, Artificial Sequence
  Description of Artificial Sequence: Synthetic oligonucleotide
agaugaccagcgucucuu

SEQ ID NO: 30458 - RNA, 18 nt, Artificial Sequence
  Description of Artificial Sequence: Synthetic oligonucleotide
agugaagaugaccagcgu

SEQ ID NO: 30459 - RNA, 18 nt, Artificial Sequence
  Description of Artificial Sequence: Synthetic oligonucleotide
ucugcagugaagaugacc

SEQ ID NO: 30460 - RNA, 18 nt, Artificial Sequence
  Description of Artificial Sequence: Synthetic oligonucleotide
cauugucugcagugaaga

SEQ ID NO: 30461 - RNA, 18 nt, Artificial Sequence
  Description of Artificial Sequence: Synthetic oligonucleotide
ggccggucaggagggcgg

SEQ ID NO: 30462 - RNA, 18 nt, Artificial Sequence
  Description of Artificial Sequence: Synthetic oligonucleotide
gagccggccggucaggag

SEQ ID NO: 30463 - RNA, 18 nt, Artificial Sequence
  Description of Artificial Sequence: Synthetic oligonucleotide
accgggagccggccgguc

SEQ ID NO: 30464 - RNA, 18 nt, Artificial Sequence
  Description of Artificial Sequence: Synthetic oligonucleotide
uccgaaccgggagccggc

SEQ ID NO: 30465 - RNA, 18 nt, Artificial Sequence
  Description of Artificial Sequence: Synthetic oligonucleotide
gcccauccgaaccgggag

SEQ ID NO: 30466 - RNA, 18 nt, Artificial Sequence
  Description of Artificial Sequence: Synthetic oligonucleotide
uacaugcccauccgaacc

SEQ ID NO: 30467 - RNA, 18 nt, Artificial Sequence
  Description of Artificial Sequence: Synthetic oligonucleotide
caggguacaugcccaucc

SEQ ID NO: 30468 - RNA, 18 nt, Artificial Sequence
  Description of Artificial Sequence: Synthetic oligonucleotide
gacgccaggguacaugcc

SEQ ID NO: 30469 - RNA, 18 nt, Artificial Sequence
  Description of Artificial Sequence: Synthetic oligonucleotide
accaggacgccaggguac

SEQ ID NO: 30470 - RNA, 18 nt, Artificial Sequence
  Description of Artificial Sequence: Synthetic oligonucleotide
ugggcaccaggacgccag

SEQ ID NO: 30471 - RNA, 18 nt, Artificial Sequence
  Description of Artificial Sequence: Synthetic oligonucleotide
ggagcugggcaccaggac

SEQ ID NO: 30472 - RNA, 18 nt, Artificial Sequence
  Description of Artificial Sequence: Synthetic oligonucleotide
ccccgggagcugggcacc

SEQ ID NO: 30473 - RNA, 18 nt, Artificial Sequence
  Description of Artificial Sequence: Synthetic oligonucleotide
ggcccccccgggagcugg

SEQ ID NO: 30474 - RNA, 18 nt, Artificial Sequence
  Description of Artificial Sequence: Synthetic oligonucleotide
gggcaggcccccccggga

SEQ ID NO: 30475 - RNA, 18 nt, Artificial Sequence
  Description of Artificial Sequence: Synthetic oligonucleotide
cggucaccuccuccaggg

SEQ ID NO: 30476 - RNA, 18 nt, Artificial Sequence
  Description of Artificial Sequence: Synthetic oligonucleotide
gccacggucaccuccucc

SEQ ID NO: 30477 - RNA, 18 nt, Artificial Sequence
  Description of Artificial Sequence: Synthetic oligonucleotide
cuucggccacggucaccu

SEQ ID NO: 30478 - RNA, 18 nt, Artificial Sequence
  Description of Artificial Sequence: Synthetic oligonucleotide
caggacuucggccacggu

SEQ ID NO: 30479 - RNA, 18 nt, Artificial Sequence
  Description of Artificial Sequence: Synthetic oligonucleotide
gcagccaggacuucggcc

SEQ ID NO: 30480 - RNA, 18 nt, Artificial Sequence
  Description of Artificial Sequence: Synthetic oligonucleotide
cucgggcagccaggacuu

SEQ ID NO: 30481 - RNA, 18 nt, Artificial Sequence
  Description of Artificial Sequence: Synthetic oligonucleotide
guagccucgggcagccag

SEQ ID NO: 30482 - RNA, 18 nt, Artificial Sequence
  Description of Artificial Sequence: Synthetic oligonucleotide
gugagguagccucgggca

SEQ ID NO: 30483 - RNA, 18 nt, Artificial Sequence
  Description of Artificial Sequence: Synthetic oligonucleotide
uuccugugagguagccuc

SEQ ID NO: 30484 - RNA, 18 nt, Artificial Sequence
  Description of Artificial Sequence: Synthetic oligonucleotide
ggccauuccugugaggua

SEQ ID NO: 30485 - RNA, 18 nt, Artificial Sequence
  Description of Artificial Sequence: Synthetic oligonucleotide
uugccggccauuccugug

SEQ ID NO: 30486 - RNA, 18 nt, Artificial Sequence
  Description of Artificial Sequence: Synthetic oligonucleotide
gccacuugccggccauuc

SEQ ID NO: 30487 - RNA, 18 nt, Artificial Sequence
  Description of Artificial Sequence: Synthetic oligonucleotide
aaggugccacuugccggc

SEQ ID NO: 30488 - RNA, 18 nt, Artificial Sequence
  Description of Artificial Sequence: Synthetic oligonucleotide
accccaaggugccacuug

SEQ ID NO: 30489 - RNA, 18 nt, Artificial Sequence
  Description of Artificial Sequence: Synthetic oligonucleotide
gccccaccccaaggugcc

SEQ ID NO: 30490 - RNA, 18 nt, Artificial Sequence
  Description of Artificial Sequence: Synthetic oligonucleotide
cucaggccccaccccaag

SEQ ID NO: 30491 - RNA, 18 nt, Artificial Sequence
  Description of Artificial Sequence: Synthetic oligonucleotide
gcccccucaggccccacc

SEQ ID NO: 30492 - RNA, 18 nt, Artificial Sequence
  Description of Artificial Sequence: Synthetic oligonucleotide
ggaaggcccccucaggcc

SEQ ID NO: 30493 - RNA, 18 nt, Artificial Sequence
  Description of Artificial Sequence: Synthetic oligonucleotide
gggcaggaaggcccccuc

SEQ ID NO: 30494 - RNA, 18 nt, Artificial Sequence
  Description of Artificial Sequence: Synthetic oligonucleotide
gauggaagcccugauggg

SEQ ID NO: 30495 - RNA, 18 nt, Artificial Sequence
  Description of Artificial Sequence: Synthetic oligonucleotide
aaucgauggaagcccuga

SEQ ID NO: 30496 - RNA, 18 nt, Artificial Sequence
  Description of Artificial Sequence: Synthetic oligonucleotide
cuagaaaucgauggaagc

SEQ ID NO: 30497 - RNA, 18 nt, Artificial Sequence
  Description of Artificial Sequence: Synthetic oligonucleotide
gaugccuagaaaucgaug

SEQ ID NO: 30498 - RNA, 18 nt, Artificial Sequence
  Description of Artificial Sequence: Synthetic oligonucleotide
uacgggaugccuagaaau

SEQ ID NO: 30499 - RNA, 18 nt, Artificial Sequence
  Description of Artificial Sequence: Synthetic oligonucleotide
gggaguacgggaugccua

SEQ ID NO: 30500 - RNA, 18 nt, Artificial Sequence
  Description of Artificial Sequence: Synthetic oligonucleotide
gucgugggaguacgggau

SEQ ID NO: 30501 - RNA, 18 nt, Artificial Sequence
  Description of Artificial Sequence: Synthetic oligonucleotide
cugagggcccgggugguu

SEQ ID NO: 30502 - RNA, 18 nt, Artificial Sequence
  Description of Artificial Sequence: Synthetic oligonucleotide
gguggcugagggcccggg

SEQ ID NO: 30503 - RNA, 18 nt, Artificial Sequence
  Description of Artificial Sequence: Synthetic oligonucleotide
gggaggguggcugagggc

SEQ ID NO: 30504 - RNA, 18 nt, Artificial Sequence
  Description of Artificial Sequence: Synthetic oligonucleotide
gaggugggaggguggcug

SEQ ID NO: 30505 - RNA, 18 nt, Artificial Sequence
  Description of Artificial Sequence: Synthetic oligonucleotide
uuugggaggugggagggu

SEQ ID NO: 30506 - RNA, 18 nt, Artificial Sequence
  Description of Artificial Sequence: Synthetic oligonucleotide
gggacuuugggagguggg

SEQ ID NO: 30507 - RNA, 18 nt, Artificial Sequence
  Description of Artificial Sequence: Synthetic oligonucleotide
gcgggagcaucaagggcu

SEQ ID NO: 30508 - RNA, 18 nt, Artificial Sequence
  Description of Artificial Sequence: Synthetic oligonucleotide
gggcugcgggagcaucaa

SEQ ID NO: 30509 - RNA, 18 nt, Artificial Sequence
  Description of Artificial Sequence: Synthetic oligonucleotide
uuugggaggugggagggu

SEQ ID NO: 30510 - RNA, 18 nt, Artificial Sequence
  Description of Artificial Sequence: Synthetic oligonucleotide
gggacuuugggagguggg

SEQ ID NO: 30511 - RNA, 18 nt, Artificial Sequence
  Description of Artificial Sequence: Synthetic oligonucleotide
ggagcaucaagggcuggg

SEQ ID NO: 30512 - RNA, 18 nt, Artificial Sequence
  Description of Artificial Sequence: Synthetic oligonucleotide
gcgggagcaucaagggcu

SEQ ID NO: 30513 - RNA, 18 nt, Artificial Sequence
  Description of Artificial Sequence: Synthetic oligonucleotide
gggcugcgggagcaucaa

SEQ ID NO: 30514 - RNA, 18 nt, Artificial Sequence
  Description of Artificial Sequence: Synthetic oligonucleotide
gcugggcuggcagguggg

SEQ ID NO: 30515 - RNA, 18 nt, Artificial Sequence
  Description of Artificial Sequence: Synthetic oligonucleotide
gagggcugggcuggcagg

SEQ ID NO: 30516 - RNA, 18 nt, Artificial Sequence
  Description of Artificial Sequence: Synthetic oligonucleotide
gccgugagggcugggcug

SEQ ID NO: 30517 - RNA, 18 nt, Artificial Sequence
  Description of Artificial Sequence: Synthetic oligonucleotide
gcaggucagguucuggca

SEQ ID NO: 30518 - RNA, 18 nt, Artificial Sequence
  Description of Artificial Sequence: Synthetic oligonucleotide
gggaagcaggucagguuc

SEQ ID NO: 30519 - RNA, 18 nt, Artificial Sequence
  Description of Artificial Sequence: Synthetic oligonucleotide
ccggcgggaagcagguca

SEQ ID NO: 30520 - RNA, 18 nt, Artificial Sequence
  Description of Artificial Sequence: Synthetic oligonucleotide
aguggccggcgggaagca

SEQ ID NO: 30521 - RNA, 18 nt, Artificial Sequence
  Description of Artificial Sequence: Synthetic oligonucleotide
caaggaguggccggcggg

SEQ ID NO: 30522 - RNA, 18 nt, Artificial Sequence
  Description of Artificial Sequence: Synthetic oligonucleotide
cgucgcaaggaguggccg

SEQ ID NO: 30523 - RNA, 18 nt, Artificial Sequence
  Description of Artificial Sequence: Synthetic oligonucleotide
gccaccgucgcaaggagu

SEQ ID NO: 30524 - RNA, 18 nt, Artificial Sequence
  Description of Artificial Sequence: Synthetic oligonucleotide
ucacagccaccgucgcaa

SEQ ID NO: 30525 - RNA, 18 nt, Artificial Sequence
  Description of Artificial Sequence: Synthetic oligonucleotide
ccuggucacagccaccgu

SEQ ID NO: 30526 - RNA, 18 nt, Artificial Sequence
  Description of Artificial Sequence: Synthetic oligonucleotide
caggcccuggucacagcc

SEQ ID NO: 30527 - RNA, 18 nt, Artificial Sequence
  Description of Artificial Sequence: Synthetic oligonucleotide
gggaccaggcccugguca

SEQ ID NO: 30528 - RNA, 18 nt, Artificial Sequence
  Description of Artificial Sequence: Synthetic oligonucleotide
gguuggccaacaguggga

SEQ ID NO: 30529 - RNA, 18 nt, Artificial Sequence
  Description of Artificial Sequence: Synthetic oligonucleotide
ggacagguuggccaacag

SEQ ID NO: 30530 - RNA, 18 nt, Artificial Sequence
  Description of Artificial Sequence: Synthetic oligonucleotide
uccacggacagguuggcc

SEQ ID NO: 30531 - RNA, 18 nt, Artificial Sequence
  Description of Artificial Sequence: Synthetic oligonucleotide
gcgccuccacggacaggu

SEQ ID NO: 30532 - RNA, 18 nt, Artificial Sequence
  Description of Artificial Sequence: Synthetic oligonucleotide
gggcugcgccuccacgga

SEQ ID NO: 30533 - RNA, 18 nt, Artificial Sequence
  Description of Artificial Sequence: Synthetic oligonucleotide
ucuaguccgggcagccag

SEQ ID NO: 30534 - RNA, 18 nt, Artificial Sequence
  Description of Artificial Sequence: Synthetic oligonucleotide
gggccucuaguccgggca

SEQ ID NO: 30535 - RNA, 18 nt, Artificial Sequence
  Description of Artificial Sequence: Synthetic oligonucleotide
guagcgggccucuagucc

SEQ ID NO: 30536 - RNA, 18 nt, Artificial Sequence
  Description of Artificial Sequence: Synthetic oligonucleotide
gccauguagcgggccucu

SEQ ID NO: 30537 - RNA, 18 nt, Artificial Sequence
  Description of Artificial Sequence: Synthetic oligonucleotide
cgaaagccauguagcggg

SEQ ID NO: 30538 - RNA, 18 nt, Artificial Sequence
  Description of Artificial Sequence: Synthetic oligonucleotide
augggcgaaagccaugua

SEQ ID NO: 30539 - RNA, 18 nt, Artificial Sequence
  Description of Artificial Sequence: Synthetic oligonucleotide
aggucaugggcgaaagcc

SEQ ID NO: 30540 - RNA, 18 nt, Artificial Sequence
  Description of Artificial Sequence: Synthetic oligonucleotide
ccaugaggucaugggcga

SEQ ID NO: 30541 - RNA, 18 nt, Artificial Sequence
  Description of Artificial Sequence: Synthetic oligonucleotide
gucggccaugaggucaug

SEQ ID NO: 30542 - RNA, 18 nt, Artificial Sequence
  Description of Artificial Sequence: Synthetic oligonucleotide
ugggcgucggccaugagg

SEQ ID NO: 30543 - RNA, 18 nt, Artificial Sequence
  Description of Artificial Sequence: Synthetic oligonucleotide
ggcgcugggcgucggcca

SEQ ID NO: 30544 - RNA, 18 nt, Artificial Sequence
  Description of Artificial Sequence: Synthetic oligonucleotide
auccuggcgcugggcguc

SEQ ID NO: 30545 - RNA, 18 nt, Artificial Sequence
  Description of Artificial Sequence: Synthetic oligonucleotide
gggcgauccuggcgcugg

SEQ ID NO: 30546 - RNA, 18 nt, Artificial Sequence
  Description of Artificial Sequence: Synthetic oligonucleotide
aggcauaguacaggaaga

SEQ ID NO: 30547 - RNA, 18 nt, Artificial Sequence
  Description of Artificial Sequence: Synthetic oligonucleotide
gugagaggcauaguacag

SEQ ID NO: 30548 - RNA, 18 nt, Artificial Sequence
  Description of Artificial Sequence: Synthetic oligonucleotide
ggucagguucuggcaggg

SEQ ID NO: 30549 - RNA, 18 nt, Artificial Sequence
  Description of Artificial Sequence: Synthetic oligonucleotide
gcaggucagguucuggca

SEQ ID NO: 30550 - RNA, 18 nt, Artificial Sequence
  Description of Artificial Sequence: Synthetic oligonucleotide
gggaagcaggucagguuc

SEQ ID NO: 30551 - RNA, 18 nt, Artificial Sequence
  Description of Artificial Sequence: Synthetic oligonucleotide
ccggcgggaagcagguca

SEQ ID NO: 30552 - RNA, 18 nt, Artificial Sequence
  Description of Artificial Sequence: Synthetic oligonucleotide
aguggccggcgggaagca

SEQ ID NO: 30553 - RNA, 18 nt, Artificial Sequence
  Description of Artificial Sequence: Synthetic oligonucleotide
caaggaguggccggcggg

SEQ ID NO: 30554 - RNA, 18 nt, Artificial Sequence
  Description of Artificial Sequence: Synthetic oligonucleotide
cgucgcaaggaguggccg

SEQ ID NO: 30555 - RNA, 18 nt, Artificial Sequence
  Description of Artificial Sequence: Synthetic oligonucleotide
gccaccgucgcaaggagu

SEQ ID NO: 30556 - RNA, 18 nt, Artificial Sequence
  Description of Artificial Sequence: Synthetic oligonucleotide
ucacagccaccgucgcaa

SEQ ID NO: 30557 - RNA, 18 nt, Artificial Sequence
  Description of Artificial Sequence: Synthetic oligonucleotide
ccuggucacagccaccgu

SEQ ID NO: 30558 - RNA, 18 nt, Artificial Sequence
  Description of Artificial Sequence: Synthetic oligonucleotide
caggcccuggucacagcc

SEQ ID NO: 30559 - RNA, 18 nt, Artificial Sequence
  Description of Artificial Sequence: Synthetic oligonucleotide
gggaccaggcccugguca

SEQ ID NO: 30560 - RNA, 18 nt, Artificial Sequence
  Description of Artificial Sequence: Synthetic oligonucleotide
ggccaacagugggauggg

SEQ ID NO: 30561 - RNA, 18 nt, Artificial Sequence
  Description of Artificial Sequence: Synthetic oligonucleotide
gguuggccaacaguggga

SEQ ID NO: 30562 - RNA, 18 nt, Artificial Sequence
  Description of Artificial Sequence: Synthetic oligonucleotide
ggacagguuggccaacag

SEQ ID NO: 30563 - RNA, 18 nt, Artificial Sequence
  Description of Artificial Sequence: Synthetic oligonucleotide
uccacggacagguuggcc

SEQ ID NO: 30564 - RNA, 18 nt, Artificial Sequence
  Description of Artificial Sequence: Synthetic oligonucleotide
gcgccuccacggacaggu

SEQ ID NO: 30565 - RNA, 18 nt, Artificial Sequence
  Description of Artificial Sequence: Synthetic oligonucleotide
gggcugcgccuccacgga

SEQ ID NO: 30566 - RNA, 18 nt, Artificial Sequence
  Description of Artificial Sequence: Synthetic oligonucleotide
uaguccgggcagccaggg

SEQ ID NO: 30567 - RNA, 18 nt, Artificial Sequence
  Description of Artificial Sequence: Synthetic oligonucleotide
ucuaguccgggcagccag

SEQ ID NO: 30568 - RNA, 18 nt, Artificial Sequence
  Description of Artificial Sequence: Synthetic oligonucleotide
gggccucuaguccgggca

SEQ ID NO: 30569 - RNA, 18 nt, Artificial Sequence
  Description of Artificial Sequence: Synthetic oligonucleotide
guagcgggccucuagucc

SEQ ID NO: 30570 - RNA, 18 nt, Artificial Sequence
  Description of Artificial Sequence: Synthetic oligonucleotide
gccauguagcgggccucu

SEQ ID NO: 30571 - RNA, 18 nt, Artificial Sequence
  Description of Artificial Sequence: Synthetic oligonucleotide
cgaaagccauguagcggg

SEQ ID NO: 30572 - RNA, 18 nt, Artificial Sequence
  Description of Artificial Sequence: Synthetic oligonucleotide
augggcgaaagccaugua

SEQ ID NO: 30573 - RNA, 18 nt, Artificial Sequence
  Description of Artificial Sequence: Synthetic oligonucleotide
aggucaugggcgaaagcc

SEQ ID NO: 30574 - RNA, 18 nt, Artificial Sequence
  Description of Artificial Sequence: Synthetic oligonucleotide
ccaugaggucaugggcga

SEQ ID NO: 30575 - RNA, 18 nt, Artificial Sequence
  Description of Artificial Sequence: Synthetic oligonucleotide
gucggccaugaggucaug

SEQ ID NO: 30576 - RNA, 18 nt, Artificial Sequence
  Description of Artificial Sequence: Synthetic oligonucleotide
ugggcgucggccaugagg

SEQ ID NO: 30577 - RNA, 18 nt, Artificial Sequence
  Description of Artificial Sequence: Synthetic oligonucleotide
ggcgcugggcgucggcca

SEQ ID NO: 30578 - RNA, 18 nt, Artificial Sequence
  Description of Artificial Sequence: Synthetic oligonucleotide
auccuggcgcugggcguc

SEQ ID NO: 30579 - RNA, 18 nt, Artificial Sequence
  Description of Artificial Sequence: Synthetic oligonucleotide
gggcgauccuggcgcugg

SEQ ID NO: 30580 - RNA, 18 nt, Artificial Sequence
  Description of Artificial Sequence: Synthetic oligonucleotide
auaguacaggaagaaggg

SEQ ID NO: 30581 - RNA, 18 nt, Artificial Sequence
  Description of Artificial Sequence: Synthetic oligonucleotide
cauaguacaggaagaagg

SEQ ID NO: 30582 - RNA, 18 nt, Artificial Sequence
  Description of Artificial Sequence: Synthetic oligonucleotide
agaggcauaguacaggaa

SEQ ID NO: 30583 - RNA, 18 nt, Artificial Sequence
  Description of Artificial Sequence: Synthetic oligonucleotide
ggguugggccaagaucac

SEQ ID NO: 30584 - RNA, 18 nt, Artificial Sequence
  Description of Artificial Sequence: Synthetic oligonucleotide
ggucacgggcagccaggg

SEQ ID NO: 30585 - RNA, 18 nt, Artificial Sequence
  Description of Artificial Sequence: Synthetic oligonucleotide
gggucacgggcagccagg

SEQ ID NO: 30586 - RNA, 18 nt, Artificial Sequence
  Description of Artificial Sequence: Synthetic oligonucleotide
aguuagcacuggguaggg

SEQ ID NO: 30587 - RNA, 18 nt, Artificial Sequence
  Description of Artificial Sequence: Synthetic oligonucleotide
acuggaguuagcacuggg

SEQ ID NO: 30588 - RNA, 18 nt, Artificial Sequence
  Description of Artificial Sequence: Synthetic oligonucleotide
caaagacuggaguuagca

SEQ ID NO: 30589 - RNA, 18 nt, Artificial Sequence
  Description of Artificial Sequence: Synthetic oligonucleotide
ggucacgggcagccaggg

SEQ ID NO: 30590 - RNA, 18 nt, Artificial Sequence
  Description of Artificial Sequence: Synthetic oligonucleotide
gggucacgggcagccagg

SEQ ID NO: 30591 - RNA, 18 nt, Artificial Sequence
  Description of Artificial Sequence: Synthetic oligonucleotide
aguuagcacuggguaggg

SEQ ID NO: 30592 - RNA, 18 nt, Artificial Sequence
  Description of Artificial Sequence: Synthetic oligonucleotide
ggaguuagcacuggguag

SEQ ID NO: 30593 - RNA, 18 nt, Artificial Sequence
  Description of Artificial Sequence: Synthetic oligonucleotide
acugaggguagugggugu

SEQ ID NO: 30594 - RNA, 18 nt, Artificial Sequence
  Description of Artificial Sequence: Synthetic oligonucleotide
acugaacugaggguagug

SEQ ID NO: 30595 - RNA, 18 nt, Artificial Sequence
  Description of Artificial Sequence: Synthetic oligonucleotide
ugcccacugaacugaggg

SEQ ID NO: 30596 - RNA, 18 nt, Artificial Sequence
  Description of Artificial Sequence: Synthetic oligonucleotide
agcucugcccacugaacu

SEQ ID NO: 30597 - RNA, 18 nt, Artificial Sequence
  Description of Artificial Sequence: Synthetic oligonucleotide
ugcaaagcucugcccacu

SEQ ID NO: 30598 - RNA, 18 nt, Artificial Sequence
  Description of Artificial Sequence: Synthetic oligonucleotide
cgcucugcaaagcucugc

SEQ ID NO: 30599 - RNA, 18 nt, Artificial Sequence
  Description of Artificial Sequence: Synthetic oligonucleotide
cugaacgcucugcaaagc

SEQ ID NO: 30600 - RNA, 18 nt, Artificial Sequence
  Description of Artificial Sequence: Synthetic oligonucleotide
gcggccugaacgcucugc

SEQ ID NO: 30601 - RNA, 18 nt, Artificial Sequence
  Description of Artificial Sequence: Synthetic oligonucleotide
ggcccgcggccugaacgc

SEQ ID NO: 30602 - RNA, 18 nt, Artificial Sequence
  Description of Artificial Sequence: Synthetic oligonucleotide
caaauggcccgcggccug

SEQ ID NO: 30603 - RNA, 18 nt, Artificial Sequence
  Description of Artificial Sequence: Synthetic oligonucleotide
guccccaaauggcccgcg

SEQ ID NO: 30604 - RNA, 18 nt, Artificial Sequence
  Description of Artificial Sequence: Synthetic oligonucleotide
agggaguccccaaauggc

SEQ ID NO: 30605 - RNA, 18 nt, Artificial Sequence
  Description of Artificial Sequence: Synthetic oligonucleotide
ccaucagggaguccccaa

SEQ ID NO: 30606 - RNA, 18 nt, Artificial Sequence
  Description of Artificial Sequence: Synthetic oligonucleotide
cagcuccaucagggaguc

SEQ ID NO: 30607 - RNA, 18 nt, Artificial Sequence
  Description of Artificial Sequence: Synthetic oligonucleotide
gcauccagcuccaucagg

SEQ ID NO: 30608 - RNA, 18 nt, Artificial Sequence
  Description of Artificial Sequence: Synthetic oligonucleotide
cagcugcauccagcucca

SEQ ID NO: 30609 - RNA, 18 nt, Artificial Sequence
  Description of Artificial Sequence: Synthetic oligonucleotide
ccccacagcugcauccag

SEQ ID NO: 30610 - RNA, 18 nt, Artificial Sequence
  Description of Artificial Sequence: Synthetic oligonucleotide
aggguccccacagcugca

SEQ ID NO: 30611 - RNA, 18 nt, Artificial Sequence
  Description of Artificial Sequence: Synthetic oligonucleotide
ucaucaggguccccacag

SEQ ID NO: 30612 - RNA, 18 nt, Artificial Sequence
  Description of Artificial Sequence: Synthetic oligonucleotide
ggcugucaucaggguccc

SEQ ID NO: 30613 - RNA, 18 nt, Artificial Sequence
  Description of Artificial Sequence: Synthetic oligonucleotide
ccuauggcugucaucagg

SEQ ID NO: 30614 - RNA, 18 nt, Artificial Sequence
  Description of Artificial Sequence: Synthetic oligonucleotide
gguccccuauggcuguca

SEQ ID NO: 30615 - RNA, 18 nt, Artificial Sequence
  Description of Artificial Sequence: Synthetic oligonucleotide
ccccagguccccuauggc

SEQ ID NO: 30616 - RNA, 18 nt, Artificial Sequence
  Description of Artificial Sequence: Synthetic oligonucleotide
agcagccccagguccccu

SEQ ID NO: 30617 - RNA, 18 nt, Artificial Sequence
  Description of Artificial Sequence: Synthetic oligonucleotide
cuucaagcagccccaggu

SEQ ID NO: 30618 - RNA, 18 nt, Artificial Sequence
  Description of Artificial Sequence: Synthetic oligonucleotide
cgucucuucaagcagccc

SEQ ID NO: 30619 - RNA, 18 nt, Artificial Sequence
  Description of Artificial Sequence: Synthetic oligonucleotide
accagcgucucuucaagc

SEQ ID NO: 30620 - RNA, 18 nt, Artificial Sequence
  Description of Artificial Sequence: Synthetic oligonucleotide
agaugaccagcgucucuu

SEQ ID NO: 30621 - RNA, 18 nt, Artificial Sequence
  Description of Artificial Sequence: Synthetic oligonucleotide
agugaagaugaccagcgu

SEQ ID NO: 30622 - RNA, 18 nt, Artificial Sequence
  Description of Artificial Sequence: Synthetic oligonucleotide
ucugcagugaagaugacc

SEQ ID NO: 30623 - RNA, 18 nt, Artificial Sequence
  Description of Artificial Sequence: Synthetic oligonucleotide
cauugucugcagugaaga

SEQ ID NO: 30624 - DNA, 8349 bp, Homo sapiens
gttctactcacattcttactcccaccaaatttctcatggacctgagacaccccgacttcagggagtcctctagggtatcttttgaggatcaggctccaacaatggagtgagagccaaagaaacaaagtaaaagcagcttattacagaaaagaaactcttccactctgaagggctttctttgattattccgtcactctttttctttatttcttcctttttagtttattatttatttgattttgtttcaacaagaaaatgcttgcagttctcaacaccgattgaaaatgtgtccagtgctgccctcacagccctgccatgaaccctctgggctctgacctgctggctcacccatgccttgggttccgcactgcttagtcagacgcctgcaggctgctgggtggaaactaaaaatgataatgactgctgtgaacagttgtcagagagggagctgaagttttgggggatgcctgaggcacagtgcccaaccctgctggtctgggatgaatttgtggcccccacaaggaatgtagagtgtcctggttgtgctgggtgtgggggtctgagagcgaggccagtggacattcagggaacaccatgtccaggaaggcaggcggtggtggagatggctggtcgtgagggaagcttggcaggcaatgtagaatagaccccaggtcagtggcagctggacggatggtgtgaatacctttttcctaggacaggcacttctcaaggaataagttaaaaggggtaattgggtcacaagccgccatctgcttggggaaccccaatctttagcgggaagagcttttgtttcatgttcctctgcaggaaacggcacttaacagtcatttgctcttttactaattacttttaattctgtggatcctttcaagagttgagtagtcatacccctctctctcccactgaagtcccttggtaaggtctgagagcctgtcagtagtaatgtatttttttttttttgagacggggtctcgctatattgcccatgctggagtgcagtggctcttcacaggtgtgatcacaacacactgcagcctcaaactcctggcctcaagagatcctcctatctcagcctcctgagtagctggcaccataggcccataccactgtgcccagcataaacctattattaatgctctgtgtggttttagagagcatcttctgtctcccaccaagcttgttacccagaacctattgtctgcttagtagactatccaaattttattttatttatttatttttatttttatttattattattattattttttttgagatagagtttcgctcttgttgcccaggctggagtgcaatggcatgatctcagctcaccacaacctctgcctcctgggttcaagtgatcctcctgccttagtctcccaggttgctgggattacaggcatgcgccaccacacctggctaatttttttttttgtatttttagtagggatggggtttctccatgttggtcaggctggtctcgaactcccaacctcaggtgatccacctgcctcagcctcccaaagtgctgggattataggcgtgagccaccgcgcccagccgactatccaaattttgatcttcaaaactgtcctcattccctcctctctctttccatccttcagatacgatagaaccttctatgtgtttaaatggcagccttccatcatcacatcagtgactccttagcttgttacatattctttcatgaggccatattttgtgtacctgactttgtgtatatcattgacaatggaccctggaaaagccccttcacctgagctgagatgtggcccagtgagtcacagagcatgagtcccctgtgagcattggagagagacctggactcagagccaggaggactggcctctactccagctactccatgggcacctgtgtggctgtgggaagataccctcgctctctggccatagcataggagcacagggagggtggatcgtgtgcccccaggcacgcaggacctctgacattctgtatattcagtgattacgatttgtgcctcaaaccatgcagtcctgctcactctctcactctctggtgatcctcaggggaatggcccttcagaaccttggctaggtgacatcagaagctgcttgtgtatgtaaggaaaatggggcttcctcctaaggtaggaacaggaggctacgctgtttatctcctcctctctcccttccttgatatgaatgtcagggcagcagtgtgctaaggaactgaaagtagttgggaacccagaaagtggacctggttatagccctaggctatagctcccatcctgcctgggctggccctccctagaaagcaaggccagtaggtggtgaataaaagccattgttttaaaaaaaatcattccttagaagcactgataggttgtaaatcagagacatctggttctgtgtgcagactgcaggtaggtggatggatttgctgcagtatgtattttaagacttctagaaagacaaatgttcagtcgagtctgcagcaatagcagaccacttgcaggatctgaaagagcacagactcaaactgcaaaggctcctgctaggatgagttctgagcttccctgcttcagaacaagcttctcctttgcagagtattttcctttgcgttatatttgctcagcagaggtctcagctgccatcaaaacaaagagaacgtaaacagactccgtatattcctggcttctgaaatcatttgctgagtggtgttgggttttagagcattcagttaagcaaggcacagagccctaataccagtgaggtcagaaagcagattaaggtctgacttgccctcttctgttgtgatcgtccaggtgaccaaagtacaggacagtgcagactgtcagaaaacttgagtgtcctaaagaccagtatcatggcagcatatcttttgtgtctttttttctttctttcttttgagtcagggtttcactctgttacccaggctggagtgcagtggcatgattttagctcacttcagcctggaccttctgggttcaagtgatccttccacctcagctcacctagtagctgggaccacaggcatgcgccaccatgcctggctaattgttttgtatttttggtagagactgggtttcaccacgttgcccaggctggtcttgaactcctgagctcaagttatcccccagcctcggcctaccaagtgctgggattacaggcatgagccactgcacctggcccaacatatcttttaggagaggatgagttttcctgcagcaaatgagagggttctcagcagacaccgtgcatgggtgatggtgccatgccctgtcttcccagctcctctccctcctgtagctgacgctggctcccccgaggtcagggttaaccaacaactctcactaaatcctcaccagtcatccctccacattgtctaaaaaatgaaatcttttgattagattttcacctctctgctctggttagtttatgataaaagtactcttctttggggaatgcccaagagactgtgagaagcaaatgtgagagagctgaagactggatcaagtctttgcagtacatgggggccacttgggagagagttggtgggtttttatattgattattttgcttcattccagattggggtcaggtatgtttcatttttctttgggactcagatttgaatctgaattcagagcccacctattgcctggctgctattcaagcatccacctgcccatcccctcccctcccaggggccacagggtcccgagaatcaagagcctggaggcactgcttctggacctgtctgtgccacccaccctgagcaagcacctgactgctctggccttcacgtgtcccatgtgtaggatgagaagggtgggccggatcacagttttccaaacctggctaatgatcatactcacctgggctgctctttaaatgtacacattttctggcgccgccctgcatattctgagtcagtaggtctgcttcagccaaactcaagaatgattggaccagctagcctgcaagaacacttttggttttcagattctgtccgtgtagaaagaaggattttgtcccatcagagcttgcggtgtctggcccacagctttgaaaacatgtagacagtcatgtagatgggcctcaacttagtttttagagaccactgtttacatttcataatcgtccagttatagggactaaataggaccctcagagcaatagggcccacttgctgctttattctggaaaaccaacatggtcagccatctgtggattcaaaatgagaactgtgcaaaatgtggattatggactcactcagcttaatttgcaatgtttatggtggtgaaaagcttgaccaatttattaaaacaacacagatgactgactttgaagaattggctttctgatgatcagcatttacaccagctagtctggtccccttaaagaaaccacgtaggtgaaggcctaggccacagcctgttgctgagggtcttcgaggcttcactgattgtctccaatactcagtcctagaattattgttcttcagtcaagactgggagcaatgaatggtcagtgattaaataatatcagagacttctagtgcattaattccctaacctctctttggcctctcccaaatcctagatttacatatcagcaaagatagggaggactttggaatcagcatctgatcagaggaaccccttcggatgcctcctttaaaatgagtctgccctcttatttcctggagtcatttggatggctaaggagggccttggggacattttctctggcacgtgcgctccttgctgttgcttgtaacgaggaagctcccaagcgaatcctcacgctctgcaggacaggctgtctttcagcatctggacacgtgggctacatggagttgcaatttggagggcccccatcctggcaatggttcactcttcagagtttggggcaagccttgtaatatgcgtcctttctcctcatttgtacagcagcctttggcctcttttaggactagcaggaggagtggtgaggtcacagaaatgagtggacttcaggggaaaggagtgctataaaaaagcccagggacacactcctgaaacctgcatcgcatttgctgaaggggcctcaggtctgcagaatgatgagtcagctttccagcgcagggcccctacaggctgcgtgcacagggcatcatgccgaggacaagttcctcactcagctgggagtgggcagctggggcctgaactgcagagaaagggatgttggaagaacagagacggctttccaagtttctgctagtctggagtgaccaggaagggctgcagttccagcagtcttcggtcagctgagcgagtagttagtggtcaaaggcatagggaccctggtattggagtcatgcccagtgagccagccaaagccttcttttgcctgcccttggggtggaaatccagcatccggtggtttccgctcccctgctcccatgaaggcccattcctttgccacgtctccagggaggcacattttcaagtacgtgtctcttttgttcagttcttgtctcccaccaggacctttctttgaagcacactgctgcatgcgtgcaggcctcatgctcacccacacaccaccccggtcacctctgttctgtttaagtccatgtccaaaccacacgacccatgcatctttttttactgcacttactagatctctctctctctccttatgacaaagactttcatttatttttatttttatttttgcagtagaagtatatctaattccattagcttaaatttttgcaagcatttctaatctcttacaatacgcggtctctgcaaggtaaggcctcaggtcccctggccctttccctctcacacctgaggtcccacccaccagggcagtaccaactggctggctcccagaggtcagtggattctcccagggggctttgcctatcaacttcctctcccaggcaccatgctttccacacatggtccccctaccaactctggccccattttcagcctttccctgccttgccatgtttggaatttctctccctggcttcacctggagtttaagagtgaattagaaacgcagctgcccatcacctgcagatggctctgcaccctgatggtgaggcagctcgttccttggtgcagcctgggaccctgcctgagccagaggatgtgttttgtttatccacagcccccaaatatctcccaggcctattgcgacgggaccccaaccccaattctgactcccctccctgcttccactatacccagaccagggttggggaggggggtgggtgcagatctgggaatcgagaagcgcaggaaaggaagtgttggaaaccagaactggcaagctcactgtcttctctgcctcctccaggatccacacacatcctcaccccacagaaactgctggacacactgaagaaactgaataaaacagatgaagaaataagcagttaaaaaaataagtcgcccctccaaaacacgcccccatcccacagcgctccgcagcttcccaccaccgcccgcctcagttcctttgcgtctgttgcctccccagccctgcacgccctggctggcactgttgccgctgcattctcgtgttcagtgatgccctcttcttgtttgaaacaaaagaaaataatgcattgtgttttttaaaaagagtatcttatacatgtatcctaaaaagagaagctcatgtgcaattggtgcacagcaggagaaatttctggactgttaggatgaatggacgccttctccccgttatttaagatttgtgaccttgtacataaccctgggtgacgtgcacattgcttgggtatggaacggtagaaatttgggtgtttttaaaaccttgtttggggttgttcctgtccttgttgagaatcatagagatgtctgtgttcttggagtatttcacactgaggactaatctgctatcttcattccagtccctacccctcagtgcctgctctcatccaaataacctgggaggtgacaatcaggatatctcaggaggtccaaggtggaacagacctctttgcctttcccagcgtctcatacccccggtagtgcagctgtgggtggaggctggggtgtctgcacgaagtcaggccagcgtcctcctccacagcctgtcactgccccctccccagcctgtgtccacagtgctgtgatcccgagggaagtcctccagtctaagtcacagtgccctgacaggtgagaagcaaactcccgctggaagcctccatctctttggaaaaacagttagtctggagcctgtggcccaggcccttctgtccccaggcatcatcccaacagctcattttccctagtccgccttcgttcaagggtcaggaatggaccagaacagatgggttctggaggcccctgaacagagggctatggctgtggagaaggttcttggcccgttggactcacacagaccctgtaccctctcggcaagcatcttcagtcagattatcctcagtttcagatacttcataataccttgtgttgtgtggggtcatacatcatcgtgtttgtaagagaagatggtcattttattctctgtataaaacttagctctaaagcagaaactaaagcagcaaatgcaggaaggctgtctcgccatcctcaagactcagcagctctcattctccagtggtgagcacaccatttgtgctgctgctgttgtcgtgaaatataataacagtggaagtcacaaaaatgtcccctgcccagccccctcgccgcccttgacctcctgcaggccatgtgtgtattacttgtctagtgatgtcctctcaaagtgctgtacgcgagctcggcgccacctccgcctccctttcagagcctgctccccgccctctctgctcgctgcattgtggtgttctcttctcaaggctttgaaatctccccttgcactgagattagtcgtcagatctctccccgtctccctcccaacttatacgacctgatttccttaggacggaaccgcaggcacctgcgccgggcgtcttactcccgctgcttgttctgtcccctccctcggaccaaacagtgctcatgcttcaggaccttgtttgtcgaagatgttggtttccctttctctgttatttatataaaaataatttatcaaaaggatattttaaaaaagctagtctgtcttgaaacttgtttaccttaaaattatcagaatctcagtgtttgaaagtactgaagcacaaacatatatcatctctgtaccattctgtactaaagcacttgagtctaataaataaagaaatcagcaccccttcccggtgtccaggggg

SEQ ID NO: 30625 - DNA, 15581 bp, Homo sapiens
cctcaagcccaaggcagaagacctatctgcatttgagccctcaaagtaggttgttcccaggtactctctatgtggtgatggtgctgccctctgtgatactaacccgtgcatgagcttgcctgtctctgtcctcgggccacactgagcccttacgagggcaggtggtgcctgggtactggccgcagcatgctttgagtctaaaagtaggcacccaccctgtgaagccagaccagcctccagggccccagaagactgcctcgttccgaagagcatgtcatggggctgtaggaccagccattcttcccatctcgggtcattgttgggctggggaaggttatggcttcttgtccagtcaggtgtgtctaaaagtcctttgtcttggtggcatactcctagcatggaaatggggtcaatctgggcactttggagactggtgtgtttaactcaagatcaagaccttttatgcgttgacagcctctcaagacccatggtcacacctggcagcttctggtagtggggcaaaagggttgcttgtgctggctcattttcctttagagctttccctttctgcacacatcccttttcttttcaaataaagcaaacccagagcacagggtctgatatgtgagtccacggggagtggactgtctgttcatctgtgctcagccacctctgcttcagcttcctctccataggctgagcagagatgtggtcagagtgaactcacattggaacagtacactcacggcaccctggagaggagcggtcactggttgctgagtgaattaaccgaatgtttgctgcttttctcctgcaacagttcattattcctccagcatgcctaggcagtggagagaatgtattttgcccaataataaaatgacatcctgcctctacttctcacctaatccccagtagtacccatgccaacaagccccacaccacctgacagcagcataggatgtgtcctttggagtcttccctgcagtttctgctcatagagtggaataagctcattggaacctttctaacaaaaagagatctggcataagatagatcctacttgtggtcgttatcccatcaagagaggtcagctgttaaagtccctgatagatcttattaaaaggtacacttgagctgtcagtggttccaagaatccatgacatgaaccctgttttgtatgcgacactttcatttagcgggctcctgtttcttcagctttcatatccttgttggcattgataccctgatacagaacagtccgcgctctgagcagggcagttatggccagcattgtcacgggcaggccagctcatggcacccagagcagccaggtggacccaccttggtttactgaactttttgtaaccatgggggcaagcagaaaaccccgctgcatttcagccagtgctgccaggtgttccctccatgggaaggtgctgctcaacctgaatgtgacttcctctttcttctttctataatgatgcagaatgctgaaattcttcagggtcctgattttgactgtcatttctcactgagcttttactgcagacaaaagaagtttcatttttagttaaatttgcactgctcctgggacatacatggatgcatttatttattcatccattttaatgtctcgatgtgaacttgtttttaaagcaggctaccaggcagttaatcaaacactcgggttaatcaagggttaataaaagcagggacttgatgtttaatgggacaggcattctctcagcatcactagattcaataatgctgcactattaaattttgctgcacatgaagttcagtgcatgttccattttctagactttggcagtgcctgtggtcagtgaccgggactgatgagcagccacatgcctgcactagggtggctctggggtggtgcatgctgcagtctggctggcacaagcctagctgaagagaagtactgctttaggcttggatgtggggatacctagatgtcaagggcagaactccatctagaatgcctggggatgagatgcaaaagctgatagtgaatggaacagtttccaatgtccaaaagcttgctaatctgggatcaaaccagcctgtgttgatgttagttttgctttgttttgagacacggtctccctctgtcacccaggctggtacattctcggctcactgcaacctccacctcacaggctcaagtgatcctcctgcctcagcctcccaagtagctgagactagaggtactagccaccacactcaactaatttttgtattttttatagagatggggtttcgccatgttgcccaggctggtctcgaactcctgagctcaaccaatctgcccgcctctgcctcccagagtgctgggattataaaagtgagccactgtgcctggcctgttttgtttttaataaggttttttgtttgttttgttttgtttgagacaggatctcactctgtcacccaccttggtgacagcctcgacctcctgggctcaagcgatcctcccacgtcagcctcccaagtagctgggactacaggcatttgccaccatgcctgactgatttttttatttttatttttgtaaagatgggtttcgccatgtttccaggctggtctcgaactcctgagctcaagtgatcttcctgccacagcctcccaaaatgctgggattacagacatgagccatcttgcctggccattgtatttgtcctcgttttcagtactcttctgcctcactgagaggtctcagagtctgctgtgtggtttcagcagtacccatgggggctgtgtaacattgaagctgattcaaggagtttgcccttaggttaccaggggttaccgcattccctgaggaatgctgagcggccatccagtctgattaaccgaggttcctacttctctgccacttcctttctctataattcttactcgctcgctctctctttttttttttttattatactttaagttctagggtacatgtgcacaacgtgcaggtttgttacatatgtatacatgcagctataaaaaaggatgaattcttactctctcttgaggcacagtgtcctcacctgcaaaaggtggataaaaatagtctttgcccccaggagtgttgtgaggaataaatgagagaatgtgtgtgcaacactcagtgcacagtcagagctcagtaaggggttaaaactctgaaaagggaaaatctgcttgtgatcctgcagcaaagggcgaaggacggcatgtgggccacaccgccacatctaggtacactgcttgtgctgggcatattcattcattgtattaattgctacgtggctgaaagtaaaaacttttaaaaagccataattggccgggcacagtggctcatgcctataatcccagcacgttgggaggccgaggcaggtgaatcacctgaggtcaggagttcgagaccagcctgaccaacatggagaaaccccgtctctaccaaaaatacaaaatttgccaggtgtggtggcgcatgcctgtaaacccagctacttgggaggctgaggcaggagaattgcttgaacctgggaggtgggggttgcagtgagccaagatcgtgccattgcactccagcctgggcaacaagagcaagattccatctcataaataaataaataaatagccataattaacttcactgtttccttgtaatatttcacttgggtttgcaaggatgtatttttctcctcttgctaatcttaacttcctgtatttccatttttcccaattgatgatcagtacaactagtttgccatttgcatctgagtcagagcagtgctagcgatcaaaagccgccctggggaacctggaattgtttcattctcagtgggagcgacacgtgtcctggcatctgagccttccgagtgaggggagtgagtctggccatcaggctggggttgagggacacagggtgccttgagcctggctttcgtgccttcagagccacagtgccaatgatgggagtggtggcttggtgtggcgtaactgtaccaccataccttgatggtagaatgcagtcctggaatatatacattcagggtctttctttcatcgcttctcaagagaggggtttcagtctcccgatcctgagctggtctgagtgccagcaaacaaagtcatcacttttgtgcctgtggtctcccaaggagcacaggatttccaaggaaattgacggatgagaaatcatgggggtggtggagcttagaaagcttatttcattagtaaatggtttgaaccgtcaaggtccagctgtggtttccactgatggaggaacaggaagaagaggagccttgacatttatctcaagcgccagcagcttctcttggatcaggaagacataaaagtccaatgtcatcttcaatttgtgcaggctccccttggagttgcagagccagtgaagtgaagtagaacagttaaaaaaacacccggggaagtgataaatcacagagagagattgcatatgcgggaaaggtgtctcccacaattaaaacaagtggccagagcctccctggcgacctctggtctgcattgccagccctgaagatggctcctaaattacttaagtttaataggtagttaatatagccaaccctccttatgaccccagtgggctgaatggctctgcttgctttaggaactgggcgttgtatggtagagcatcttggccttgacataaaaggtagcatactggctccccagccctgaaccttccctgctagagcaaggcaggggtgagagggggaaggaaagaaaaaggagtggggagtggggtggggagcaaggattaacagggagcagtagcagcaccagatgtgggcatagcacactgggaagaaattgcagtggcgatctgaactcttcctctccgcctcctggctctgtggaagcccagggaaggcattaggaactgcaggctgctcttagtgctcctcccggatgggacaccttgggctcatccctgaaggccactcctaccactctcacacactgagttcctggtgtctcgtaactgttgagagcttagttttcttgcttgtttctggtagctctagatagaagactgtatcggcctcttctaaaagtcaacaagccaatcctgtttttggttaagagactttacctggtcaagcagttgttctttgggaggtgttgaagagcctacaaacctgccttgcctgcctaggtactttaccaccatttggagatgcctgaggatattaccaggccttatttgaggcagtaaaacaccctgttcggcccctcggcactgaagatgtgtttcagtgcagctctcctcggcaccggattcgttgctgcaacagtgggagggaagagccagatgcaaactcgttctgcgagcccgaggttctgttctcatgatccttgctgtgatttctcttttgatgttggcaattttaaaatgacatcagtctatctggacctttttcctaaggctcttgctcagaccactcagtagatagccgccacctgcccagtgaggtgaatcaggcccattaggccatttgtcaggggaaggaacagaggagcagcggagggccccgccggccagtgccacagggcagcctgcaaagcaggtagacaggttttcaggcagcttttgctgctttgggtccctcagggattaatacacaaaaagggccccttgggtattcagtggcagatttctcttgagagcagataaagtcgctaataacaaattggatttgttcattggggtggacttggcctttcgttccacctctgtgtaggataagtgtgtggatagtgctcccactgtgcacatcaccatatggcatttgggtgcagctgtccctagccagactgcagaaaagcttgatctgggccggacgcggtggcttatgcctgtaatcccagcactttgggaggccgaggcaggcggatcacgaagtcaagagattgagaccatcctggccaacatggtgaaaccctgtctctactaaaaatacaaaaattagctgggcgtggtggcatgcgcctgtagttccagctactcaggaggctgaggcaggagaatcacttaaacccaggaggcagaggctgcagtgagcggagatcgcgccactgcagttcagcctggcaacggagtgagactccgtctcaaaaaaaaaaaaaaaaaaaaaaagagaaagtaaagaaaagcttgatctggccacttagtacagccatccccctttactggcccttcctctttgcttatttggaagggggaaggtttcccacaccccaaaccaaagattcttttggaatttgctgctgctggattcagctgtcacctttctgctctgagtctgctttctccctgtggatccggtgccagaggatctgcacgtccttttgtgtctacaccctcccccgctccttcgttttcaatatgtagtagtggagaggaagtgtaacatgattttagggctcacatttcaattccactgcatttttatgggacaagcagagacccagcgcctggagttattaggttagtatctaaaatgggttcagtactgtgagtcttattgtttaaaatgaatgagatggtcccctcctaccttcttttctcctcccctgggatgagtggattgaggcaaggcccccagagactagttgaaggaatcctggtgctctgattagttttgttccccagcttaattgtacagcttcctttctctcaccactgatagccaaagtagctctgtgtctcccccaaccttcccttgctttaggaacaagatgatcacaatgcagccttgtgaatcaattttctgtctgtgctgatgaaagtgtaattcattcttaatcaagcagccttgctgctgcaggctccgtgccggaatacatttagttaccctcccatcactttgggaaacgatcccccaaaagggcttttagaggagagctggaaggagagttggccgtgcgcctcatgctgtggttttccagcagggggcactcaggaacgatgctggcggaggctttgtagctggaagccgtctgctgctggcagggcagcaggagaatgtttgtcacaggtgccttccaggcttgctttctccagaccctggggccatttctcagaagtaccctaatgggccacccaaaatcctcaggtagcagtgaggaggaacagttgaagatgcagattgcatgcctgggttagagagtgccggctgggtaccaggttcttttagccagcctcttctgtctttttaagtagacagatgtgtctcctgaatctgaacttgtttagattgggtggatgtgtctgtttttgtcacaccacacacaatttggggagcgtaaggaggcccagctctgccagaatggaactctcctaagttctcccctgccgtctcacagcctgctggctgtcacaaacagctggcagttttatggacaagtgggcaggggaaaagggaccctgccggggctgagtctcgatgttgggcaggaagtaaaagccaggacccaacaagtggatcagaggggggatgtgaagatgaacagtcagatagcaataaagcctcatagatctgccccagagaaagaaaaggaagttcgtctcctcagaatggaattggattagtgacagacttgagcagccggttcagtcgagagagaacttaattcctcctgtgttattcacacggctgattctaatcagatgtgaagagacagctggaggagagcagcgggtcagcccatgcctggtgcggaggcttcatgttcttgtaggcatcttcagggaactggcaggagcgctttgggttggagactctgagcagggcccttgggtttatagcctgcccaaggaactgggcctggctgcgggactcccatggttggaccttgtctagattcagtgaaagttttgaaggacagtgcatgacagacgtcactggtcaggttcaccagagcttggctcacttgtcttcagaaggattcaaaggcagttgaccagacttggcaagtcccagactggtgcagccactgtcctcgagaccctggttgtacaccctgaggtgcttctgcttcattacctgctgaaatttggagacctcttcttcctggataaccttcaagatactcattgtgcatgcgaggaattccccgccctcctggggggactccactccccaggcaggcaaggttgggcaaggggagggctgttgctggattgccaaagggagcatggacatttttgtttggaattcagggtgggaatgggactcaccagagtggcttcagtgctcaactcacagtgcaacataggacaaggtgaaggccttcttgggaggcctcttctggctctagcaagcaggtgttgctgggcagtgtagagggacccaggccggttgctgagcaggaagatgtacctaacactgatgggcctgcacaccttagggtatgagagcatcgcaggggaaccaggaaacttgttagctggttttcatgtgtttaaaaagaagactcggaggcagagtttattttatgaagggctagctttttgccatttcttctgagcttttgccttttcctttatgaatacttcctgcctatgggtgtactgtaaatgtaacagccagtgagctttctagaagcagcagatggtgaaagatccacaggtgaggagcctgcccactggaggggcgagacagtgcccaggcagggcgtgcaggtggcagagctgtttgcatgctccgcggggtggcttcccaagctctctgtagaaaaactgcctgagggcaaatggctccactgagctgctacctgcaggaaagaagctcaagggctctcctcgtctcactgcctgccttcttcacctgctgggaggagggcattgtggtgtctgagataaaggatacccccaaggtggaagcagagccatgggggtggcctccagcagcagggaggagcattgtgcagtaaattctgactccggggctcctgtggggattggaacccataggaattgcacaatgagggtaaaggatggggcggcagcagccaggtctgtctaaggggcgagcagcagtggccgaaggctcccagggccctcgggcagcagcccttgctgaccagtgcagccaggtcgtggctgcctccagctggtgggtctgccttcccctctgaccgcctcagtgccttctggaggactgtggctctctctcctgcccagtggctgtggtgccttcctacttctgtgtgggcagactgatttccctctctacctttacttgtggctgaggcgaagctcctgctcttgcaagataagaggtggggctgaggcgctgcagtgcagctcaggtggggctcaggaagcaccccacccaccccagagcactctgcatcctaataagcacatgctcgagtcactggaatctggtgctgctggcagtgccagaaccctcccctagcacctcgaggggacagccagcatgctcctcgggtggaggatccaggaattcttggagccaacattgcacaaatgggcaggagcctctcaaggcccccacagcctgggctccctgcctggggaagtggccaggcttcataggggcatcacttggcccgcctggtaggcatggaggccagtgccatacgtgaccttgttgttgcctgcaccccttcctaacgagcaccctgctccccactggaaggagaggggccagggctcctccctccccagggaggggagaaacgtgatgttgctattagcaataacagctgccgagttcccaccatgcgccaggtgcagtgttgagtgcatcacacgcggttcccaattcctctgcctgtcaccccacgaggaaggggctgccatcacgcccgcttcacagtgaggaactgaggctagaggggagcaagtgacctgcccagggccacacagctggtcagtggcccagctgggccttgcaccaggcagctgactgtgcctgtatctgactcaaagtggctgttcttttcagaaacctgagcggagatactgggctcacatgctttcatttaaaccctctctcatttttgccccagtagttatctggcagctaaatctcttcctcctttcttccccagtgaccattctggttcccatcatcacagggcacataactcctggcccttctcctctgattacatttagggagaagcccatcctgatgcagctcccttctagagggagttccatttaggcaaaaaagcgctctccattcccatcagaaccgggctttccaaagggctctgaaattggttccactgaagaaggcagctgagctgcctccccacattccgcttgttagtcgggaacttcaaggccaaaagatttggcaggatttaaagagttgctctcaagctgtctcattctgagcacactaatgctgtctgtcttctgatggtgaagtggtgggtttggagtctccctcccctgccctttatggagccgccgatagtaccgaggactcttcacatgcagactcgaggggtccagagaatgggccagaccatcttgcctgccccatggcaacctccagaggaaagaggctcagagaggtcaggggtgtctgcagtgagctgctgatggcagagagtgagctctcggaccttctcagccgggtgtggagctcttgcctctcccgcgaacctcagtttagttatcttcatagcccacgtcctggtcgcttaacaaacattgagctcctgatcggcacataacactaagccagatatttgggggatatgaagatgaatggtacagactccctcccctccacccccgcactcctgtgggaagtcccggagctggaaatggaacacagtcacacccaaggcattgatttcaggagtcagcagagagcagggagtagggagagtgctggctccagatgcttctatccagggagatgctgggaagtggcccagagtcaagggcttaggaggttgcaaacctcactatgccaagagctcggtccctgatccaccccatccccttccacatctccctgactgtccttctttacatttgctgggcagagtgccacctgtgtgcaccagccctccctgcctgcacaagccacactgagaaagccgttgcctccagctcatggagagaaacaccttctcagctgccacgtcatgagcaagtttgcttcgggaccacctgggaaaccaggagtagaaggggtaaactcttcctcatctgccacaggcctgccttgcctcaggccacgtcaccttaccccagccatgttgccagggcatgaggactaagatgcttgccctgccaagcccggaggggatgagcagcctcagctggtgccgccacagacagcacaccacagaggtggctcagggaccttggtagatgggaatgtgagaatctattaaaataggcagggatctccggtcctctgtcaagaggcaatgctgacggctttttcctgctggcgtgcctctgcccaccagccttccccttgcacatcctcatttgtcacctcctaatttgaattattgggcaaatctggccgcttatttgggactgacagccaacttcttgagcatctatttgaacagccttccctttcgctcccagccacctttgaggtgagtccaagtggcaggacaggaccctgtgtgacagagcggaggtcttgtgccctctcagcttcttctctgctttcttacagctcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcattgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctgtttctgtttctgttttttttttgagatggagtctcgctctgtcgcccaggctggagtgcagtgtcacgatctcagctcactgcaacctccgcctcccaggtacaagagattctcctgcctcagcctcccgagtagctgggactacaggcgtgtgccaccatgcctggctaatttttgtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctggaaaata

SEQ ID NO: 30626 - DNA, 1707 bp, Homo sapiens
taagaaaatggccaaagccctctgccacctcaacgtccctgtcactgtggtgctagatgctgctgtcgggtgagtgcccatcttccccagccataatcacctcccccaccccatgctggcttacagcaagttttcagattgaaagtttgagtcccgttcataaagccacaccaggtagcgtcctacttcttaattaatagctgccctaaaccagcaagcttgttatgaggttgtgatagcatacaaagaagacagagctgtaggatgttggggagagtgggagttgtgtctatagctttatggctgtaagtgttgagtttgttgttgttgttgtttttgtttgtttgttttttgtttttttgagatggagtcttgccctgttgcccaggctggagtgcaatggcatgatcttggttcactgcaatctccacctcccaggttcaagcgattctcctgcctcagcctcctaagtagctgggattaccggcgcatgccaccatgccacgttaattcttttatatttttagtagagatggggtttcaccatgttggccaggctggtctcgaactcctgaactcaggtgatctgcccgccttggcctcccaaagtgctgggattacaggcgtgagccaccacgcccagccagtgcaaatgcattttaagagcaaagtacaaaggtcagttgggatcagcagagggtaatcagggctctgtatttctgtgaagacctggctgtcctcagtggcatactgggatgctttgtctcacctagaagatgcagcttgtgtcgcaaagccaagtcacatgttcctgggattgtcagtgtatttcccaagaaaaaacaagagtagtgatctcttggaatgaaaacaagatagatgattaaggaaattaggaatgtgttcaaaagtaaggattttgaggaattctactaattgctcattttaaagactaaattggccttcatcctaccagaaagattcttaaggttgggcacagtggctcatacctgaggcaggtggatcgctagagttcaggagttggagaccagcctgggcaatatggcgaaaccccatctctagggcatggtggcatatgctgtggtcccagctacctgggaggctgaaatgggaggatcgcttgagcctaagaggtagaggtttgggctgagatcatgccactgcactctagcctgggcaacagagtgagatctggtctcaaaaaaaaaaagaaagatttttaaaactgcataacacttttgtccaacttcagatctcatcagattttaaaattttgtttggtttgtgctgaagtagaaaagaaagtagaggataccacacttggaaggaagactgctgtgtcaggacattcttgcttcacttacacacatatgtacgtgtgcatgcgccgggcggcagtgtgaagtgtatgtctcattgtagggtcatgaccagaaaacacccctggtaacaatgccaggggtctatcgcgtgttaagtgcgctttaaaaaaaacaggtagttatgggaggaacttaccttgatagaaatggaatattgatctttgcagatgatgatgctactcgttagagccaagaaaataaagcatgaaaagctttttttccccttagctacatcatggagaaagcagatcttgtcatagttggtgctgaaggagttgttgaaaacggaggaattattaacaag

SEQ ID NO: 30627 - DNA, 2088 bp, Homo sapiens
cgcccgctatgggcactggcataagaacaaggccccaggcgagtaccgcagtggcccccgcctcatcattttcatccttgggggtgtgagcctgaatgagatgcgctgcgcctacgaggtgacccaggccaacggaaagtgggaggtgctgataggtgagtggccgtgcttccagcggaaggcgccgccgcatcgcacctcaactccattccacgctttggtgtcgcattctgtcatagactcccttgacccacaaaacttagtctttaggtaactgtggacagcagaagctaggggcaaagggttccctccttggtctgccctgctgcatctctcaatggaaggcagcctcatgaggtaggaagtgcctgatcccagggtccggcagactcaggctcagattcctgctctgcaaactgcaagtgggggaccttgagcaagtggttcgagctctccaaccatttccttactcagcaaaacaggatcagtcatactcattcacagccttgaactaggcccaagatgaggtctgtcagtctcctggcattggcctcatgcccaggcaggaatgggcagtgaatggcagtcaatcgctgccctgtcaggtggagatggacagacagctgtgagcaggtgctgcctgaaactactgcctgaccgctggactctgcccagggctcccccagccacctccaaccactttctaggtctgccatgccctttctcgtatttcctgttcgtttcccaaaagagaggaagcgacttgtaggagctagcttaacgcagcaggagccttttctcctttttcgtgccttttgggggcttctatgatgtttagggctggaagaagatgaacgagctaagaaaagtcttgctttctccagatgcctccctttttgtcctgttttgcccttaacaaaatggagggtacctgccagcctgggagtccctctcaacactgtctggcaagaagctgtcatgttcactaccctggctgggctctgtcctcagtggaaacaggctcacgctgagcaaggagtgaggccagggctcttggcctccttttggaagggggtgtgctctgcacagtggggaattatactctccagggccaaggatggcctctcaggccacttacacatgaagtgctacagggagaggccctgagctgccccagctgggaggcatcgctgaccttctcccataggtgcccaccactggtcttaatcccaggcacagtcatgatctcgataacaagtggtggttttatacctcctatttggggtgagcaagtcgcagcaccccccccctcccaagctatccaagtgagcagactccatagaccagtccacatggctgtttctgggtttttcaagatggatctggggctgtcagccgcctctctgatagcacaatccagtggggagactgtacctccccaccgcagccctcaagcttcccgtgtcaggtcaccagctctccacataactgtttttcccttctgttgtgtagccccggtgataaagctctctgctccctgcttgcatatgtattgcatgaatgtagtgagtaattctgagcccaaacacagcttttctggacagaagctgtcacagccaggctttgggtgtaaatcttccccttcatctttagacctgacttgaggttccatatatcgggaggtgggaacctgggggtatgcagttgcccatgaagattcatggaggggcctcgcgcagacagctgacgtccgctgtgtggcctcccctgctttgtgcatgccagcctccttgctaccatgtgtgttcatgcgcgcttgtgtgtgtgtgtatgcatgcgcacacatgtgtgtgtgtcttgctttctcatacctcattggctgcataaaatgtaggcctaagttggcatgttcctgtgacgtacctttgttcaagcagtcagctggcctctgttctcccacaggttctactcacattcttactcccaccaaatttctcatggacctgagacaccccgacttcagggagtcctctagggtatcttttgaggatcaggctccaacaatggagtgagagccaaagaaacaaa

SEQ ID NO: 30628 - DNA, 2163 bp, Homo sapiens
gtggggacccatcgtgaagatggcgtggccctgagaggcagccattctcttctgccaaaccaggttccggttccacagcttcctgtccagtctgcgacttcccctgacctgaacccaccccaggacccttacagaggtaggttggcctcaccagggcacttctgacctcactttcacaataggaccagtgttgatacccagcctcttggtgttcatccctcaagaagcactggcagaaacccaggaatcaaattgggcacaaaaatggtaaggaaatggcaaagtatttagaacttcgcccgctaattgtgtttctccagggactgttttcctcaaacatcctctgaaatcctggtcctatatcagcagggaatgaggccacagactgatgagaggaaattttattttagctatttccacatttttctcattcaggtcctctaatgtggttagttgtggcctgaaaatgatatttccaaatgaataggaaggaaggaaattgtttttgttgtttaagatggaaggaaatataggtgcatttaaaaaatggagcttggttgcatgattttcgctcttgagtcatctagccctctaatgattgcctcataccggtgattacgagcggcttttcatgaccccaggaagttgggctattgctggccagctgactaggagtcgcttagataacatcttctcagtcccttcacatttaatataaaaatgataacattgccacaggaatacatgtgggcattttttcagctgttcaacattgtacagatctgagtgtcaattatatgtatgggtatgtctgcccattttttatgaataataatcattttatggactttttttttttttttttttgacagagcctcactctgtcgcccaggctggagtacagtggtgcgatctcagctcactgcaacctccacctcccaggttcaagcgattctcctgcctcagcctcccagggggtagctaggattacagacatgcatcaccatgcctggctatttttcgtatttttagtagagacagggtttcaccacattagccaggctggtcttgaattcctgacctcaagtgatgcacccgcctcagcctcccgaagtgctgggattacaggtgtgaaccaccacaactggccaggacctttcttatcaggaggctttggattttgccctctttgtcctaaacctgtgcttctcaaactgcacataagcacaacctgagcatcttgttaaaatgcagattccacttctgtaggtctgggattgtccatttctaatgggctcacagatgatgaggccgcatggaccaaagtttgagtggcaaggttctagaatacacagattacaaataaagaggaatacttgacagatatgcttctacctttaaaaaaattactacattagggtcgtgttttaaaatgcagtgtgacttggaaagttgagcaatgataaagctagaaatttctaaaatgagtagcaaactgccttccatatgtaccattttaaaatgctgattacttcttgagaataagagaagcctaatttcagaatatcattagggtacctattgaagtcttgactgcacatatttagcatactccctgggaattatattttaaggacatttttctattaaatcattgcatatggaagaaactcaatataatagctgatatttacttgggttcttaatcagaacattggctgtgtgattttcatgattatgattttcattgcaattaagttgatgttttgtagacagtgaaattaccatctactccaaaagattgcaaaatagaatttaaccttagagccaatgcagggaaaacttgtttctgcaggtgcattttttgaaacttcaacagatagcagggggaaaaaaaagtgacagaaggatcacagttcagcagtatgaattgtctgctggcagccttgcaatctggtgtgcaggcagtgagattgtggtgtacatgtcacctgatttctctttttcggcaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactag

SEQ ID NO: 30629 - DNA, 573 bp, Homo sapiens
gaacaaagatgtgaaattctgtgtaatgtaataaaaaataaattggactgtgatataaacaagttcaccgatcttgacctgcagcatgtagctaaagaaactggcgggtttgtggctagagattttacagtacttgtggatcgagccatacattctcgactctctcgtcagagtatatccaccagagaaagtatgttttactattaaaacctgaacttggaatcttctttctattgtggagaaatgtaattgtagtaagacaagaattaaatatattccattgtagtatttgaataagcagttatttgagtagaaaattagtgtttccagctaagatgatggcatattttgaaaattcatatagtgaatataactagtaaaagaagttttgtttatttttaaacagaattagttttaacaacattggacttccaaaaggctctccgcggatttcttcctgcgtctttgcgaagtgtcaacctgcataaacctagagacctgggttgggacaagattggtgggttacatgaagttaggcagatactcatggatactatccagttacctgccaag

SEQ ID NO: 30630 - DNA, 1189 bp, Homo sapiens
gtgaacggggtgaacgtggtgaaggtcggacacaagcaggtggtggctctgattcgccagggtggcaaccgcctcgtcatgaaggttgtgtctgtgacaaggaagccagaagaggacggggctcggcgcagaggtgaggggtcacgcttcaggcctctgtgcccaaactttcccctgaccttagacctttgacttcaggcccacattcctcttcccatccctgacccccaactgctgacatcagattcctgaacctcaatgaaccacccacacgtgtgggctgggacccctcccgatccctggtgctagactgccagtcctgtcccctggcctgaggcctttgacccctgacccctgacctcaggctgcccctcctcagatccctgccccctccttcccggcgttcccccagcccctggcgtggcagagccctccttccctacaccgccagcagctgcctggaggccggggttgccatagcaactgtgaggttgacgctgccgcgctgcttattgtcggagggaagggggaggcggcacctgagggaagaggaaaagcgtcttctccccgcgacgacgcggcacagcctgggcccaggaggctttgccggccaggcccagcccaggcccgtggcttggctgaccacaccctggccccacaaggggcagtggccacccgggcctggggggagccctggagcagcaggagccccgcccgcaaggagacccctcccagcccccaccccatggctctggtgcccccttgcttagccctcgaagcctgcagggtgggtgctcaggccagagccagccggcaccgtgacccccgccagcacccttgatcgtctcctgaggccctgattctgggggttcccagggcccctgaggccctgaccgcccgcccccccccccccgcactccctgagctccttgagccatgaagaagtttgcgtccagccgtaacctgaacaagatcctggcacagtgcgactcatcctcgcgggagtacgaggagatccaggcggtggagcgcaagtggcacctgcacctggccacgccgcgccgcctgctgctggacaggaggtccaaggcctccctcttctttgcagccccaccgccccccaagagggcccccagcaccacactgaccctgcgctccaagtccatgacagctgagctcgaggaacttg

SEQ ID NO: 30631 - DNA, 487 bp, Homo sapiens
ctcgcccgccccggaagtgcaaactgtgtggtctggcaggtgtggattccgccggtgaaggctgaaggcagctaccttaaagatgccgggatccgcagcgaagggctcggagttgtcagagaggatcgagagcttcgtggagaccctgaagcggggtggtgggccgcgcagctccgaggaaatggctcgggagaccctagggttgctgcgccagatcatcacggaccaccgctggagcaacgcgggtgaggccggcctgcctccgccggcgaacctggcccctgtctgttcccgatcccagggctgaaaatttcccaggcctcacttcgcgttggctcctcttatcctctctcttttggactgtaggggagctgatggagctgatccgcagagagggcaggaggatgacggccgctcagccctccgagaccaccgtgggcaacatggtgcggagagtgctcaagattatccgggaggagtatggcag

SEQ ID NO: 30632 - DNA, 3692 bp, Homo sapiens
agtcacctggtggttctgcgccttcccctacagcctcctcatcttcatctatgatgaggtccgaaagctcatcctgcggcggtatcctggtggtaagcccctccacattccccccagcaaagtgcaagccccaccaccagctcctccctccaggaccacacgcagactccactcccactactggttcctgcttctgttcctcaacaccctcagatcctggggtcccaggtcccaggagccctgactctttcgaacctgttgtctctgccctcttcccatcagattctaaaccccgcctaactcacagttggtctccgaggccctccaccttccacctgaaaccacagaacatcagaattagaagggcctttccaggtcacctagtcccacgtccatattttacagatagaggaggctcagaggtgaatctgttcagggtcgtaaagcaaagaatagcaggactggtactagaacccaggcctcctgatccccactcatcaaccgacaagttattgtttttcctacaagcgttttttaatcacttagtagaggttaaaatatgatggcttacaaaccaaatactgtccaggaatactgtttggtttgacctgtgccatattttgtgtgtgtggggggaggagggtggattaattggtccgatatagaaaatttagggtctttcacataaaatctgaattcgacttctcctgaagatcagaagagctgttaatcccatgtccacatctctgcacagcaagaatggacagctgctcccttagactctcgttcgtcacctgaagaggccctgtgggcgtttgcattttcaccctcgacctattctgccccagcctccaatgtgctaaatacaagtctcccctaaaggcaggttcaccctcccttcctttaacctatggccccagctcactggacctccttctcctccctttcaccttctttttttttttttttttttttttttttttgagacggagtctcgctctgtcgcccaaccaggagtgcagtgcagtggcacgatctcggctcactgcaagctccgcctcctgggttcaagcaattctcttgcctcagcctccagagtagctgggattgcaggcgcatgccactatgcccgactaattttttgtatttttagtacagacagggtttcactgggttagccaggagtcttgatctccgcctgcctcagcctcccagtatgctgggattacaggcatgagccactgcacccagcctccttccaccttcctaagccacttcccccagtgcccttcaccaggcttctccttccacctggcttcagcgacccaagcccctaggaaattgatctcttgcctccttttaagctcatgctgcaatctccactcccaatctctctaacaggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatgtacttgaaaataataaagtggcatttctttatgaa

SEQ ID NO: 30633 - DNA, 10311 bp, Homo sapiens
cgcccgctatgggcactggcataagaacaaggccccaggcgagtaccgcagtggcccccgcctcatcattttcatccttgggggtgtgagcctgaatgagatgcgctgcgcctacgaggtgacccaggccaacggaaagtgggaggtgctgataggtgagtggccgtgcttccagcggaaggcgccgccgcatcgcacctcaactccattccacgctttggtgtcgcattctgtcatagactcccttgacccacaaaacttagtctttaggtaactgtggacagcagaagctaggggcaaagggttccctccttggtctgccctgctgcatctctcaatggaaggcagcctcatgaggtaggaagtgcctgatcccagggtccggcagactcaggctcagattcctgctctgcaaactgcaagtgggggaccttgagcaagtggttcgagctctccaaccatttccttactcagcaaaacaggatcagtcatactcattcacagccttgaactaggcccaagatgaggtctgtcagtctcctggcattggcctcatgcccaggcaggaatgggcagtgaatggcagtcaatcgctgccctgtcaggtggagatggacagacagctgtgagcaggtgctgcctgaaactactgcctgaccgctggactctgcccagggctcccccagccacctccaaccactttctaggtctgccatgccctttctcgtatttcctgttcgtttcccaaaagagaggaagcgacttgtaggagctagcttaacgcagcaggagccttttctcctttttcgtgccttttgggggcttctatgatgtttagggctggaagaagatgaacgagctaagaaaagtcttgctttctccagatgcctccctttttgtcctgttttgcccttaacaaaatggagggtacctgccagcctgggagtccctctcaacactgtctggcaagaagctgtcatgttcactaccctggctgggctctgtcctcagtggaaacaggctcacgctgagcaaggagtgaggccagggctcttggcctccttttggaagggggtgtgctctgcacagtggggaattatactctccagggccaaggatggcctctcaggccacttacacatgaagtgctacagggagaggccctgagctgccccagctgggaggcatcgctgaccttctcccataggtgcccaccactggtcttaatcccaggcacagtcatgatctcgataacaagtggtggttttatacctcctatttggggtgagcaagtcgcagcaccccccccctcccaagctatccaagtgagcagactccatagaccagtccacatggctgtttctgggtttttcaagatggatctggggctgtcagccgcctctctgatagcacaatccagtggggagactgtacctccccaccgcagccctcaagcttcccgtgtcaggtcaccagctctccacataactgtttttcccttctgttgtgtagccccggtgataaagctctctgctccctgcttgcatatgtattgcatgaatgtagtgagtaattctgagcccaaacacagcttttctggacagaagctgtcacagccaggctttgggtgtaaatcttccccttcatctttagacctgacttgaggttccatatatcgggaggtgggaacctgggggtatgcagttgcccatgaagattcatggaggggcctcgcgcagacagctgacgtccgctgtgtggcctcccctgctttgtgcatgccagcctccttgctaccatgtgtgttcatgcgcgcttgtgtgtgtgtgtatgcatgcgcacacatgtgtgtgtgtcttgctttctcatacctcattggctgcataaaatgtaggcctaagttggcatgttcctgtgacgtacctttgttcaagcagtcagctggcctctgttctcccacaggttctactcacattcttactcccaccaaatttctcatggacctgagacaccccgacttcagggagtcctctagggtatcttttgaggatcaggctccaacaatggagtgagagccaaagaaacaaagtaaaagcagcttattacagaaaagaaactcttccactctgaagggctttctttgattattccgtcactctttttctttatttcttcctttttagtttattatttatttgattttgtttcaacaagaaaatgcttgcagttctcaacaccgattgaaaatgtgtccagtgctgccctcacagccctgccatgaaccctctgggctctgacctgctggctcacccatgccttgggttccgcactgcttagtcagacgcctgcaggctgctgggtggaaactaaaaatgataatgactgctgtgaacagttgtcagagagggagctgaagttttgggggatgcctgaggcacagtgcccaaccctgctggtctgggatgaatttgtggcccccacaaggaatgtagagtgtcctggttgtgctgggtgtgggggtctgagagcgaggccagtggacattcagggaacaccatgtccaggaaggcaggcggtggtggagatggctggtcgtgagggaagcttggcaggcaatgtagaatagaccccaggtcagtggcagctggacggatggtgtgaatacctttttcctaggacaggcacttctcaaggaataagttaaaaggggtaattgggtcacaagccgccatctgcttggggaaccccaatctttagcgggaagagcttttgtttcatgttcctctgcaggaaacggcacttaacagtcatttgctcttttactaattacttttaattctgtggatcctttcaagagttgagtagtcatacccctctctctcccactgaagtcccttggtaaggtctgagagcctgtcagtagtaatgtatttttttttttttgagacggggtctcgctatattgcccatgctggagtgcagtggctcttcacaggtgtgatcacaacacactgcagcctcaaactcctggcctcaagagatcctcctatctcagcctcctgagtagctggcaccataggcccataccactgtgcccagcataaacctattattaatgctctgtgtggttttagagagcatcttctgtctcccaccaagcttgttacccagaacctattgtctgcttagtagactatccaaattttattttatttatttatttttatttttatttattattattattattttttttgagatagagtttcgctcttgttgcccaggctggagtgcaatggcatgatctcagctcaccacaacctctgcctcctgggttcaagtgatcctcctgccttagtctcccaggttgctgggattacaggcatgcgccaccacacctggctaatttttttttttgtatttttagtagggatggggtttctccatgttggtcaggctggtctcgaactcccaacctcaggtgatccacctgcctcagcctcccaaagtgctgggattataggcgtgagccaccgcgcccagccgactatccaaattttgatcttcaaaactgtcctcattccctcctctctctttccatccttcagatacgatagaaccttctatgtgtttaaatggcagccttccatcatcacatcagtgactccttagcttgttacatattctttcatgaggccatattttgtgtacctgactttgtgtatatcattgacaatggaccctggaaaagccccttcacctgagctgagatgtggcccagtgagtcacagagcatgagtcccctgtgagcattggagagagacctggactcagagccaggaggactggcctctactccagctactccatgggcacctgtgtggctgtgggaagataccctcgctctctggccatagcataggagcacagggagggtggatcgtgtgcccccaggcacgcaggacctctgacattctgtatattcagtgattacgatttgtgcctcaaaccatgcagtcctgctcactctctcactctctggtgatcctcaggggaatggcccttcagaaccttggctaggtgacatcagaagctgcttgtgtatgtaaggaaaatggggcttcctcctaaggtaggaacaggaggctacgctgtttatctcctcctctctcccttccttgatatgaatgtcagggcagcagtgtgctaaggaactgaaagtagttgggaacccagaaagtggacctggttatagccctaggctatagctcccatcctgcctgggctggccctccctagaaagcaaggccagtaggtggtgaataaaagccattgttttaaaaaaaatcattccttagaagcactgataggttgtaaatcagagacatctggttctgtgtgcagactgcaggtaggtggatggatttgctgcagtatgtattttaagacttctagaaagacaaatgttcagtcgagtctgcagcaatagcagaccacttgcaggatctgaaagagcacagactcaaactgcaaaggctcctgctaggatgagttctgagcttccctgcttcagaacaagcttctcctttgcagagtattttcctttgcgttatatttgctcagcagaggtctcagctgccatcaaaacaaagagaacgtaaacagactccgtatattcctggcttctgaaatcatttgctgagtggtgttgggttttagagcattcagttaagcaaggcacagagccctaataccagtgaggtcagaaagcagattaaggtctgacttgccctcttctgttgtgatcgtccaggtgaccaaagtacaggacagtgcagactgtcagaaaacttgagtgtcctaaagaccagtatcatggcagcatatcttttgtgtctttttttctttctttcttttgagtcagggtttcactctgttacccaggctggagtgcagtggcatgattttagctcacttcagcctggaccttctgggttcaagtgatccttccacctcagctcacctagtagctgggaccacaggcatgcgccaccatgcctggctaattgttttgtatttttggtagagactgggtttcaccacgttgcccaggctggtcttgaactcctgagctcaagttatcccccagcctcggcctaccaagtgctgggattacaggcatgagccactgcacctggcccaacatatcttttaggagaggatgagttttcctgcagcaaatgagagggttctcagcagacaccgtgcatgggtgatggtgccatgccctgtcttcccagctcctctccctcctgtagctgacgctggctcccccgaggtcagggttaaccaacaactctcactaaatcctcaccagtcatccctccacattgtctaaaaaatgaaatcttttgattagattttcacctctctgctctggttagtttatgataaaagtactcttctttggggaatgcccaagagactgtgagaagcaaatgtgagagagctgaagactggatcaagtctttgcagtacatgggggccacttgggagagagttggtgggtttttatattgattattttgcttcattccagattggggtcaggtatgtttcatttttctttgggactcagatttgaatctgaattcagagcccacctattgcctggctgctattcaagcatccacctgcccatcccctcccctcccaggggccacagggtcccgagaatcaagagcctggaggcactgcttctggacctgtctgtgccacccaccctgagcaagcacctgactgctctggccttcacgtgtcccatgtgtaggatgagaagggtgggccggatcacagttttccaaacctggctaatgatcatactcacctgggctgctctttaaatgtacacattttctggcgccgccctgcatattctgagtcagtaggtctgcttcagccaaactcaagaatgattggaccagctagcctgcaagaacacttttggttttcagattctgtccgtgtagaaagaaggattttgtcccatcagagcttgcggtgtctggcccacagctttgaaaacatgtagacagtcatgtagatgggcctcaacttagtttttagagaccactgtttacatttcataatcgtccagttatagggactaaataggaccctcagagcaatagggcccacttgctgctttattctggaaaaccaacatggtcagccatctgtggattcaaaatgagaactgtgcaaaatgtggattatggactcactcagcttaatttgcaatgtttatggtggtgaaaagcttgaccaatttattaaaacaacacagatgactgactttgaagaattggctttctgatgatcagcatttacaccagctagtctggtccccttaaagaaaccacgtaggtgaaggcctaggccacagcctgttgctgagggtcttcgaggcttcactgattgtctccaatactcagtcctagaattattgttcttcagtcaagactgggagcaatgaatggtcagtgattaaataatatcagagacttctagtgcattaattccctaacctctctttggcctctcccaaatcctagatttacatatcagcaaagatagggaggactttggaatcagcatctgatcagaggaaccccttcggatgcctcctttaaaatgagtctgccctcttatttcctggagtcatttggatggctaaggagggccttggggacattttctctggcacgtgcgctccttgctgttgcttgtaacgaggaagctcccaagcgaatcctcacgctctgcaggacaggctgtctttcagcatctggacacgtgggctacatggagttgcaatttggagggcccccatcctggcaatggttcactcttcagagtttggggcaagccttgtaatatgcgtcctttctcctcatttgtacagcagcctttggcctcttttaggactagcaggaggagtggtgaggtcacagaaatgagtggacttcaggggaaaggagtgctataaaaaagcccagggacacactcctgaaacctgcatcgcatttgctgaaggggcctcaggtctgcagaatgatgagtcagctttccagcgcagggcccctacaggctgcgtgcacagggcatcatgccgaggacaagttcctcactcagctgggagtgggcagctggggcctgaactgcagagaaagggatgttggaagaacagagacggctttccaagtttctgctagtctggagtgaccaggaagggctgcagttccagcagtcttcggtcagctgagcgagtagttagtggtcaaaggcatagggaccctggtattggagtcatgcccagtgagccagccaaagccttcttttgcctgcccttggggtggaaatccagcatccggtggtttccgctcccctgctcccatgaaggcccattcctttgccacgtctccagggaggcacattttcaagtacgtgtctcttttgttcagttcttgtctcccaccaggacctttctttgaagcacactgctgcatgcgtgcaggcctcatgctcacccacacaccaccccggtcacctctgttctgtttaagtccatgtccaaaccacacgacccatgcatctttttttactgcacttactagatctctctctctctccttatgacaaagactttcatttatttttatttttatttttgcagtagaagtatatctaattccattagcttaaatttttgcaagcatttctaatctcttacaatacgcggtctctgcaaggtaaggcctcaggtcccctggccctttccctctcacacctgaggtcccacccaccagggcagtaccaactggctggctcccagaggtcagtggattctcccagggggctttgcctatcaacttcctctcccaggcaccatgctttccacacatggtccccctaccaactctggccccattttcagcctttccctgccttgccatgtttggaatttctctccctggcttcacctggagtttaagagtgaattagaaacgcagctgcccatcacctgcagatggctctgcaccctgatggtgaggcagctcgttccttggtgcagcctgggaccctgcctgagccagaggatgtgttttgtttatccacagcccccaaatatctcccaggcctattgcgacgggaccccaaccccaattctgactcccctccctgcttccactatacccagaccagggttggggaggggggtgggtgcagatctgggaatcgagaagcgcaggaaaggaagtgttggaaaccagaactggcaagctcactgtcttctctgcctcctccaggatccacacacatcctcaccccacagaaactgctggacacactgaagaaactgaataaaacagatgaagaaataagcagttaaaaaaataagtcgcccctccaaaacacgcccccatcccacagcgctccgcagcttcccaccaccgcccgcctcagttcctttgcgtctgttgcctccccagccctgcacgccctggctggcactgttgccgctgcattctcgtgttcagtgatgccctcttcttgtttgaaacaaaagaaaataatgcattgtgttttttaaaaagagtatcttatacatgtatcctaaaaagagaagctcatgtgcaattggtgcacagcaggagaaatttctggactgttaggatgaatggacgccttctccccgttatttaagatttgtgaccttgtacataaccctgggtgacgtgcacattgcttgggtatggaacggtagaaatttgggtgtttttaaaaccttgtttggggttgttcctgtccttgttgagaatcatagagatgtctgtgttcttggagtatttcacactgaggactaatctgctatcttcattccagtccctacccctcagtgcctgctctcatccaaataacctgggaggtgacaatcaggatatctcaggaggtccaaggtggaacagacctctttgcctttcccagcgtctcatacccccggtagtgcagctgtgggtggaggctggggtgtctgcacgaagtcaggccagcgtcctcctccacagcctgtcactgccccctccccagcctgtgtccacagtgctgtgatcccgagggaagtcctccagtctaagtcacagtgccctgacaggtgagaagcaaactcccgctggaagcctccatctctttggaaaaacagttagtctggagcctgtggcccaggcccttctgtccccaggcatcatcccaacagctcattttccctagtccgccttcgttcaagggtcaggaatggaccagaacagatgggttctggaggcccctgaacagagggctatggctgtggagaaggttcttggcccgttggactcacacagaccctgtaccctctcggcaagcatcttcagtcagattatcctcagtttcagatacttcataataccttgtgttgtgtggggtcatacatcatcgtgtttgtaagagaagatggtcattttattctctgtataaaacttagctctaaagcagaaactaaagcagcaaatgcaggaaggctgtctcgccatcctcaagactcagcagctctcattctccagtggtgagcacaccatttgtgctgctgctgttgtcgtgaaatataataacagtggaagtcacaaaaatgtcccctgcccagccccctcgccgcccttgacctcctgcaggccatgtgtgtattacttgtctagtgatgtcctctcaaagtgctgtacgcgagctcggcgccacctccgcctccctttcagagcctgctccccgccctctctgctcgctgcattgtggtgttctcttctcaaggctttgaaatctccccttgcactgagattagtcgtcagatctctccccgtctccctcccaacttatacgacctgatttccttaggacggaaccgcaggcacctgcgccgggcgtcttactcccgctgcttgttctgtcccctccctcggaccaaacagtgctcatgcttcaggaccttgtttgtcgaagatgttggtttccctttctctgttatttatataaaaataatttatcaaaaggatattttaaaaaagctagtctgtcttgaaacttgtttaccttaaaattatcagaatctcagtgtttgaaagtactgaagcacaaacatatatcatctctgtaccattctgtactaaagcacttgagtctaataaataaagaaatcagcaccccttcccggtgtccaggggg

SEQ ID NO: 30634 - DNA, 879 bp, Homo sapiens
aggagtgaattccttaggcgtatcctccttggagcacatcactcacagcctcctgggacgccctttgtctcggcagctgatgtctcttgttgcaggacttaggaatggagctcttttactcacaggaggaaaggtaagtggttaaggtgtgttcatttttctgtaacatttaataacttttcatttatctttctttgggttttgaccatctattatatagggtgggttttgaccatctattatatagggtttatacgacatatggaaagcattcatttattcactaatatttctgtgtgtctgcttttaggtgttgggggagtgatgacgaataagactgatgttctccatgccctttttctgtgtcagttgatacaattatatggtttttcttttttaggctattaggtgttgatagggttgagtaacttacaaatgttgaaccagccttgcatacctgtgataaataccacgtagttgtggtgtatcattctttctacattgctgagttttatctgctaatgttctgttgagcttttgtccatttaagtttgaaagtgattagtttgcagttttctgtttttgtgttgtctttgtctggttttgctatccgtgtaaatctggcctcataaaatgagatgggaagtattctctcctcttcttttgtttttttggaagaggttgtataaaattgaggctgaatcttggtggttgccacaatgacaggaactatttctgtgactgaatatattgggaattcctataaagcaattattttctagggaagtggaaaatcaactttagccaaagcaatctgtaaagaagcatttgacaaactggatgcccatgtggagagagttgactgtaaagctttacgag

SEQ ID NO: 30635 - DNA, 222 bp, Homo sapiens
aacggagaaaaaaatggctcgcgccaaaacagtcatgaactccaaggtaaacatctgccgggaataaagccggtggcggcgctcacgaggcggctgggagctgctctctgagtgccatcatctgtgttcctgctcccacagacccaccctcccaagtgcattcagtgcgggcagtacctggacgaccctgacctcaaatatgggcagcacccaccagacgcg

SEQ ID NO: 30636 - DNA, 462 bp, Homo sapiens
ggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcacgtaagtgatcttggcccaaccccctggctgcccgtgacccctacccagtgctaactccagtctttgcccccagcacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatgg

SEQ ID NO: 30637 - DNA, 783 bp, Homo sapiens
gtatgcctataacataagtctaaaggaggtgatgcaggtactgagccacgtggtcctggagttccccctgcaacagatggattccccgcttgactcaagccgctactgtgccctgctgcttcctgtgagcaaagattggagctgagtacaagggattgggtacaggcaaaggaaatcaggagtagactgtcttgttatattgggtgtatgtcacttctggttcctttttccttgcctctggaagctggttgggctctagagcagccttggctggttcagaggggtcagattgagttcaatactgactggcctttgagactccaggatttcataccatcctaggcccacaaaggtatattcagaatggacctggacattcagactctatggcagcaatttgacccaacacaagatcagcctctggggtgggaataggtattttgaggcagcctatagcatctgatcccctttcaccttccctaaggaatctctttttcccaaaccctgtcaacaactcccaagtccctctgacataattccacagaacctgtatcatctcccttttgtccacccatgtcatcagtatggatttgcttggatgtccaggtataggtgaatgcttaggaatatactgcagctcccttctttcttccatagctgctaaaggcctggagccctgtttttaggaactacataaagcgcgcagccgaccatttggaagcgttagcagccattgaggacttcttcctagagcatgaagctcttggtatttccatggccaag

SEQ ID NO: 30638 - DNA, 1846 bp, Homo sapiens
gtaacgcgtggctcccttgggctggcgggaggggccggaggctcgcgaggggcgggggcggcgacggcggcggagcgtaggggaggggaccggagaggaggggatgagcacacgggagaggagaagagggagacccgccgcctccctccctccctagctgacttgctccctcccgggctgcggctgctgcaaaagccagcagcggcagcgggagctgtccggaggccggcgtcgaggtgagacccgggcagactgaggctgcgggtaggagtggaccgaccgacggctgacgccgggcggactgcacgggaatgcgggtgtctggagggctggtggtggtgctgggcgggctgaaccatcgggaggaggcgccagcccaccgaaggcgagggaagccccgggagaggggctgacaggggatcgaaggagataaccaggtcccccagaaaggggcgggagcgtcctcgccctaaacgcgcagcaagaaaacccgcaccgcctgggagcccagggaggaggggaggatgcagagggagtggaatgcgaatgtcgggtcctctgcccagtcggcctgtcggagtgctatttgcacagctcgttgattttggggtgctgggatctgagagtctggatcttgttggatggacccagggagagaccctggagaaggtcctgtttacaaaagggttaatcttccccagggctctccaagcagaagactttgagtagagcactcctcccgcagggatgtcccaccctaaggcaaaggaaaccccaacttttcttcctctccctagaggcagtgcaaggctggccctgagacaggaatgtggcccaattgggcctgcagtgctgagcgccctcttccctcctcaccccaagcctatctcctcctcttccagggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaagaaacagtgtccaaaccagaagtgagcaaagaggccactgcagaccaggggtccaggctggagtctgcagccccacctgaaccagccccagagcctgctccccaaccagacccccggccagattcccagcctacccccaagccagcccttcaaccagagctccctacccaggaggaccccacccctgagattctgtctgagagtgtaggggaaaagcaagagaatggggcagtggtgcccctgcaggctggtgatggggaagagggcccagcccctgagcctcactcaccaccctcaaaaaaatcccccccagccaatggggcccccccccgagtgctgcagcagctggttgaggaggatcgaatgagaagggcacacagtgggcatccaggatctccccgaggtagcctgagccgccaccccagctcccagttggcaggtcctggggtggaggggggtgaaggcacccagaaacctcgggactacatcatccttgccatcctgtcctgcttctgccccatgtggcctgtcaacatcgtggccttcgcttatgctgtcatg

SEQ ID NO: 30639 - DNA, 4129 bp, Homo sapiens
cggtcggattcattataaggatatgtacagtttattacgagtaatatctccccctctcggcttaggcaagaaatgtcctcatagggttgcttgcaaggtttgacttccactaaaacctgctagcatccatggaatgagtgtggcttggggttcttcaatatatatatttcatatatatatatatatatatctctctctctctctaaaaaaacagagccatctctctttcttgcattaaactagaaaactctcttagccaacagaatgcagtcatgtagactcgataaagcatggaacatatttcctccttcccttcagccttcagccatctttgcttgctcttagctgaagctgcccatcctggggtctccacggcaccccaaatcagatacatcccctgggggattgtaactttgcatttctcccccaaccatcacctccactctctccccctccacccctcacctcccaaagcccctagccctcctcccctccctggcactggcccctgctccccacctaggccccctcagagaccagcctcagccaaaccagagaacgtgacccaactgtagaaataacagtgatggccgggcgcagtggctcatgcctgtaatcccagcactttgggaggccaaagcaggaggatcgcttgagcccaggagtttgagaccagcctgggcaacatagcaagaacccccttctctataaaaaattagccaggcattgtggcgcatgcctgtagtcccagctacttgggaggctgaggcagaaggattgcttgagcccaggaggtggaggctgcagtgagctatgatcacaccactgcactccaacccaggcgacagagagagaccctgtctctttaaaaaaaaaaaaaaaaaaaaaaaaaggcaatgaacaaaagcatggctctacgtcttccaaagtgagaattctccctcccctccgcatccctccagaactgtagctcagagcccacgctgaatctgacttttctcttttctctctctctccctgctcccgagcagtgaagtaatctttttttactgaccttttcttccattttttttcctcctcttttccattgatttgaaatatctattttatcattctctgcatctttctctctctattttttcggctcgtgtggatttcttttttctttcttctgtttctccccacctctcttcctttggttctctgttcccattcccgttttgtttttttgtttttgtttttgtttttttcattttcggtgctgccaggggccgcatgccttacctggacatgtatcagatgctgagacacatgtctccgcccctgggtctggggaagaagtgtccggccagagtggcttacaaggtagactacccttgccgaccaccgacgtccaggcactgggtttttttttcttcttcttcttctttttttttagtgctgaccagaaacacccggccgactctctttttccaacgtttctcttcttttttgtttttgattcttttttttcttttctcgagtcaactgatcatgaccatcccttgattctaagcagcacactgtgtccgtcctttctgatgagtgtcttcgtgttttgagactccattatggccgacatgccggggggagggggaggggagcgcccaggtccccttgcacctggtctcccaggtaccaaattggaaacaaacacgcttcttcagggagtcaaaacccatgcttcccacttctgcccacccagagcggcccccatgcccaggctggggcaggcgccttgcagagaggggctttagcccccgaaagcaggcgaggtcccgggtccccgcccctgccacgcacacctgaagctgatctctgacctagggccttggggattcgagaccttccaaggagcaccaagaacctctcttcccctcccttccttcccctggagtttcgtccccagcccccgtccctaatccccccaagacaccccaacatgcctctccattgttccagagtgggcaggcggccgcagctggacccctggacggtggcacactgatgcaggccatgcacgctgccttggcggggcctggggcgggcaggcaccatggccgacggggggtggtgcatgctggctgagagagcgagcgtcctgccgccaagcggctggcccgggccacccctccagatccctgtcctggaatctcccttggtgcccaaggacagatgctctgttccctccattcatccacaagaagttcagggatgacctttaaagattctccccacccaaaaagtattaccccatcatcctattctcccatccaccttgatcttccctgcgtccctatccatcaatgctatttgtacctgccccgtgttgccacctcattcctttccttcctctgtgcacccctcctcacctaacctatatgtctcccctccttctcaatcaaagccggggacaaggttgtcccaccagcatctcagacaatgagcctctcctggcacctgtcgctctgtgcccctccctgccgcccccccccccccccccggttttcctcaagtcgcttctctcagtctctgcttagatgaatgtgtgcgcatgtgcaagagagggagggcgagcccttcctctcctggtctttgtgcaggaccaccatgggtccataagacaactttgtgcaaatttgaaaaaggcaccctttccacagaacatgcctgttggaaaattgttgcaatctaccaatgtggtgagaacaagacactttttttctatcacctgggaagctgttatatttaatatacaaatcgggggctgggcgtggtggctcatgcctgtaatcctagtgctttgggaggctgagacgggaggatcacttgagcccagttcgagactagcctgggcaacatagcgagaccccatctctacaaaaagaaaaaatattttaattaataaataagtacataaatctatcatttccaagatgggagccctttgtgcggtgtacaacctgcacaactgtgcacagtggcccagtctatgtgtgtttctctatttcccacctccttccccaccctacccccagtgtcccctccagtgtcctgctctggatttaccatacccctccccatcttcaactctgtgtttcctgcccacttgtgtctgaatccccacccaagttgccctcaccccccttctctgtgccacttcagcctgggctggtgcacaccagcccagcatcctctcccatgccaccaagcatggtggacagagcccctgcctgggacatggggaatcttttcttccctgggctggaagggagtgcccctcaccccttccccctgccattgcacagagagccaagatctggacatgcccctgagatacacttcccacggagctatgaatgagtctcgagattccgtctgcatgcgcccctgtctgtgctgttctgtgtcacagcctcgctgcatgcctgcgaggggcctgccccgtcagtggggggctgcctgcctgctgcttctcagaggaatgatgtggtctgtgcccatctgctctgtcctggtctgggccaagccagggattgggtgtggggagccagtggcaccccccaccagcggctgtggtcctggccccctcagccttggctgttgcatgcactgctcaaatccagcttgtgctctttttctttggggtcagactgaaacggggccatccagaagaactctggggcagggcgggggtggggcaagggttgaggcaaaccctggaaatgccagctctcaggtcaagcaggtgggggaaaaaaggagagggcaggggaccagaagtacaagagagccttttgtgccctccctgcgggccaccaagagaaactgagtactgggacaggtaacctaagtaagagacacctcagccgccacagctttcagagttcttcctgggactccctgggtaggggcgggcgcggctcacgggagacccaggagggatgcctgggaatgactgcgcttgccttgggttttctgtagcggcttctgcggatggacctgcccgtcgcagatgacaacaccgtccacttcaattccaccctcatggctctgatccgcacagccctggacatcaagattgccaagg

SEQ ID NO: 30640 - DNA, 56399 bp, Homo sapiens
gtaaagaagcagattttagatgaaaagatctactgccctcctgaggcttctgtgctcctggcttcttacgccgtccaggccaaggtaggctcaaagaagaaaaatgtatttttcctgggcgttaatttgggtcatgggatcactcctatcttctctttctttgggttttctgtacttcagagagacttgccccagaaagtgagatgttatgggacttgtggacttgaagaaccactgtcactgttccagtgtttgtataatcttgtgtgtgtatgtgtgtgtgtgtgtatgtgtgtgtgtggtgtgcagaaattataagtatcgttctaatgaattagaattcattctaagtgaattcattcagaaagatgaatttcctgtgtaatctcattatgtacatgtggtttatgacatttactggaaaaaccttttttcttttttttttttaaaccataaactcaaccatgtggtacaacctttctattagccaggaaaaatgaatttatggtctccaattttagccaaacatggcctttaggtcagaaaggcccaggtcctcactccaaactcatttgcaaacaagctgccttgtgtgtggacactacactacaccttcagagaatgccctgcttcatctgcccctgattgacatgctagctgttcatgtggctaagcactgcaggtgctgtggcccaccaagcccacttgagctgtctggttagctgaaaatcgttcacttccgttaaatcactatagaccttttttttttttttacaagaccgatgagagggttagccacggagtttcatgtccctcagatttttcacttcagtcatatatcaccttctcttggttcccctgatccctgcctttcaccagagcacaagatgttgtccccagaattggggctccttgattacttgtgtgattttattttatttatgttttatttgtatttttatagagatggggtctcactatgttgtccaggctggtcttgaactcctgagctcaagtgatccttccaccttggcctcccaaagtgctgggattacaggtctgagtcaccatgcctggtcttacttgtgtgatttttttttttttttttattgatcattcttgggtgtttctcacagagggggctttggcagggtcataggacaatagtggagggaaggtcagcagataaacaagtgaacaaaggtctctggttttcctaggcagaggaccctgcggacttccgcagcgtttgtgtccctgggtacttgagattagggagtggtgatgactcttaatgagcatgctgccttcaagcatctgtttaacaaagcacatcttgcaccgcccttaatccatttaaccctgagtggacatagcacatgtttcagagagcacagggttgggggtaaggtcacagatcaacaggatcccaaggcagaagaatttttcttagtacagaacaaaatgaaaagtctcccgtgtctacttctttctacacagacacggcaaccatccgatttctcaatcttttccccacctttcccccctttctattccacaaagccgccattgtcatcctggcccgttctcaatgagctgttgggcacacctcccagacggggtggtggccgggcagaggggctccttacttcccagtaggggcggccgggcagaggcgcccctcacctcccggatggggcggctggccgggcggggggctgaccccccaacctccctcccggacggggcggctggcctggcggggggctgacccccccacctccctcccggacggggcggctggcctggccggggggctgacccccccacctccctcccggacggggtggctgccgggcggagacgctcctcacttcccagacggggtggctgccgggcggaggggctcctcacttctcatatggggcggctgcctggcggaggagctcctcacttcacagacggggcggttgccaggcagagggtctcctcacttctcagacggggcggccgggcagagatgctcctcacctcccagacggggtggcggccgggcagaggcgctcctcacatcccagacggggcggcggggcagaggcgctccccacatcccagacgatgggcggccgggcagagacgctcctcacttcctagatgtgatggcggccgggaagaggcgctcctcacttcccagatgggatggcggctgggcagagacgctcctcactttccagactgggcagccaggcagaggggctcctcacatcccagacgatgggcggccaggcagagacgctcctcacttcccagacggggtggcggccgggcagaggctgcaatctcggcactttgggaggccaaggcaggcggctgggaggtggaggttgtagcgagccgagatcacgccactgcactccagcctgggcaccattgagcactgagtgaacgagactccgtctgcaatcccggcacctcgggaggccgaggctggcggatcactcgcggttaggagctggagaccggcccggccaacacagcgaaaccccgtctccaccaaaaaaatacgaaaacccgtcaggcgtggtggcgcgcgcctgcaattgcaggcactcggcaggctgaggcaggagaatcaggcagggaggttgcagtgagccgagatggcagcagtatagtccagctttggctcggcatgagagggagaccgtggaaagagagggagagggagaccatggggagagggagaccatggggagagggagagggagagggcacttgtgtgattttaaaacataatcttttcacttatttttctttttaattaaaggtgttcatgaagccatttcccttaaggttagaaaaaataataaaatactcttaactcactttttggggtagattaatgcaatttcagatcaaagccaggaagtaactgtcatttgtggggaaaaaaggctatacatgctagtcagaccaatagaagcaccaaagtcaatttaatcatttgatggctcatgtaatatttgctgagtattcatcaggcccagggtggggagagagcatgagagttgttgaccatctcatagttgcaggcactaaagcaagtatctgccctcagtgatttgcccaagatcattcagacaatcttgggcaaagctaagagcagaagggtagaattcatggctttgagattgcattttgtgcctccaatattctactttcctgaaaaattagtaattgagaaaacagaaaatgggccctcattcaactaaaacatatgcttccttttatgctttgatcaagaatattagtaagaggaaaaatgtgtcctttcaatcagtatcaccccgacagtgatgaagcagtcattggcactttgattaaatccgagcacttcctggcctggagttgagttccttttcgcacgctttctccccagcgagagcagacccagcctctcaaggacaccacctctctttgaagggcttccatctcaaaggctacattttctttccatggatttttgggccacaaattcaaaggccacctgtagaaaaaaattacttttcagtgaaccagcagatgtttgcttaaacaggtttcactgtaggaaagccctgctaatttggatcgtactaatttggagatgaaagtgattcacagacgacatatgtggctcacatggaggaggatgttctagctattttttctggtgtaaattttaaggatcttacaaataaaggtaatctatggcttaaagtcttcatttgggaaactaaggcttactatgacatacttccagtttctaggactgctggttaatagttaaaggatatctgattataatattaataagatcttacatgcccatagtgttttctagttttaccaaagcaatacaaatgaatattttgtgcgacactcagtgtagtctttccagaagccaaggcttgagagtattatgcctgttttgcagatgaggaatttaaggctcagaaagggatttgtgacttgtgcaaactcacaatacttttatgttaagcctatttttatgaaatttttagcccacttctcgatggagaggatttcaggccaaatagaatgagtggagctgggatgggaaccctagtgtccaggctgcctaagttagcacattgcacttgcctgtcactgtctagcttgagggaggtctttgggtagcaaccactgcctttcactaaaggctagtttcatttatatgatcacatttgtctaagttcttcagtaagtcatactggttccttccattatattcagcttgttttcttccacaacctttctgaaacagaaaggaactttagaagtgtggaagggaaagcgaattgagctcattaacacatggaatgtaattatgcacaaatgtattcattacagtatttcagctgttggaatgatatagacacagttaattccaaagcataaagaaacaattaccctcaaagtataaatacaatactaatcacatggttcagttaacaagaaccatatatgagttatacttgaatcaaaagtgtaggcagggactgggcacagtggctcacacctgtaatcctagcactttgggaggccaaggaggatggatcacctgaggtcaggagttctagaccagcctgaccaatgtggtgaaacctaatctctactaaaaatacaaaaattagccaggcgtggtggtgtagtcccagctacttgggaggctgagacaggaggattgcttgaacctgggaggtggaggttacagtgagctgagattgagccattgcactccagcctgggtgacaaagtgagactccatctcaaaaaaaaaaaaaaaaatgtagtcagggtttttttggtgcagtcacatgacacactaaaccatcttgcaatgtttaagtcacctgttggattgtatattgaccatttggtgttggaaatgtgttcttattgaaaatgactttgggagagaatggcatataatttatgaatctcatgttgctgtgtgcagactcctagtgatcagaagagagaaaagaattgtgggaagggaagcttagtttcttagtactctttaatgcaaatcagggacagagtgccaaagtacaattgagttagaaaattgagtgtgtaaagtgtaggtagagagtggcaagagttgaggctggagaggtatgcaaaaaatcagatcttaaaaggtcttaactttatcctgtaggcgatgcagtgaagggtttatattttagatagagcctgtagtggctgtgtgatggacagattggagtgagacaactttggaaacagggagacctattagaaggctgtgatagttgccctggtgagagaatattaggttcacacttcaggtggttggttggatgggggctgactgatttaaaaatatccaggagataaaaagttgattagatggtgctatactctgcatatccctttttttcatatccttttacagaatggtatttttcttcccactcagcatctactttgagatgtatccatgttgtgtgtatagatgtagctcactgattttaattgatttaatatggtaaccactgataaataaacctagtttatttatctgttcctcttctgagggagaggtagtttgtttccactttttccttattatctaaacagtgctcaaatgaagatccttttatgtgattccttatgtacatgtgcaaatgctttttccccttaaggtaggtgcctacgaaaataaataaataaatacatacatacaaaaaatagctgggtgcagtggtgggcgcctgtagtcccagctacttgggagactgaggcagaagaatcgcttgaatccgggaggcagaagttgcagagagccaagatcacaccactgcactccagcctggacgacagagtgagactccatctcaaaataaataaataaataaataaataaataaataaagtaaaaaaattaaaaaaggtaggtgtctagaagaagaattgcatagaattgacagaagaggtgaaccccaatataaaaaaaatcttaagttgataaaaagacaaatgctataaacagggcatgaaacatgcactttatagaagagaaaacaagaatggtcataaatacaaaaagatgtttcatctcacaggtaatcaagaaaaagaaaaaacaacaataaggcaacatttcaaacccataagattggcagggattactagattgggtaactgcattgttggtgctcatttacctgccaaagggattgtgaaattggcataacctctgtagagcaccaagtgtggaagggacgggtggaagtgaggagacacaccgctggctgttccaggtggctactccagaggaatctctgcacacacatccttttcacttaaaactgtcacaacagatagacccacttcattttctttttctttttgagacagcagtctctctctgtcacccaggtggcacaatctccacccactacaacttctgcctcccaggctcaagggatcctcccacctcagcctcagcgtatgccctgctaatttttgtgttttttgtagagacagggtttccccttgttgcccaggcaggtcccaaactccagggcacaaactctatacccgcctcagcctcccaaagtgcagggattacaggcatgaatcactgcacctgaccccagctcattttcatttaactgccgaactatgtttcatagaaaggagggactggattatttaaatatatctttattggtagatatttaggtttgtttttctttctgttgtttttctattggtgaaacagatgcaatggacatccttgaatatgcatctttgggcatatatggataatatctctctataatagatatcaagacatggtataactgggttaaagaataagaacatttaaaatgtaagtaatgtgaagcaaaaaaaaaagccagacacaaaaggccacatattttatgcttccacttacctgtagatgaaatgtccagaacaggcaaatccatagagacagaaagtagatttagtggttgccagggaaagggagaaggaggaaattaggagtgactgatactggccaggcacggtggctcacacctgtaatcccaacactttgggaggctgaagtgggtggatcactggaggccaggagcttgagaccagcttggccacatggcaaaaccctgtctctacttggccgggtgcggtggctcacgcctgtaatcccaactctcagggaggcaagaggtgggaggatagcttgagcccaggagttcgagacctgcctgggcaatatagcgagacccctttctccagaaaaaggcaaaaacaaaacaaaacaaaacaaaacaaaagacaaaaaatatataaaagccagctgtggtggcatatgcctgtaatcccagctactcaggaggctgaggcacgagaatcacttgaacccaggaggcagaggttgcagtgagctgagattgcacccctgcactctagcctggggtgacagagtgagactctgtctgaaaaataaaataaaaataaaaaaggagccactggtacaaaaaaaaaaaagaaaaaatgagtaagacctactatttgatagcacaacagggtgactatagtcaataataattatacacttaaaaataactacaagaacataattggattgtttgtaaaacaaaggataaatgcttgaggggatggacaccccattctccatgatgtgattatttcacattgcacaccgtatcaaaacatctcaggtaccacacaaatatatatatacctactatgtacccacaaacattaaaaattaaaaataaatataacttacaaagattaaaaatgaaattagaagtgatggctagtgggtacaggacttctttttggggtgatggaaatgttctggaattagatagtggtgatggttgcacaagattctgaatatactaaaaaacactgaattgtacacttaatgtaaattttatgtatataaattttatctcaataaaaaatttaaatagatatagccaaatcaccctccaaaactgatgtcataatttaactttcaataacagtgtgtgagaatacctgtttttccacattcttgcgaacagtagatactatcagtctttaaaatttttgctaattgatagaaaaagattttttaaaatttgcatttccttgattgctattgggactgaacgtcttttcataaacttactgtccatttgtatttctttgttctgtgaatcaaccgtttatgacttgcctactactgtattgtttgtttgtttctttctttttctttctttctctttctctttctttctctctctctctccttcctccctccccttccttttctttcctttttcttttctttctcccttcccttcccttctctcccctttgctcccctcccctccccttctgtttctttttcttttctttcttcctttcttcctttcccaggttcaagtgatccatccgcctcagcctccagaggagccgggactataggcatgcgccaccatgccaagctaatttttgtatttttagtacagatgaggtttcaccatgttggccagactggtctggaactcctgacctcaggtgatccatccgcctcggcctctcaaagtgctgggattacaggcatgagccactgcacccaacctgttcatctttttccgattgatttgtagatgctccatgtattatgagttatcaaccttttgtctattttacgtataggactggtcaatctttttctttgtatgttttgagtgacttttagaatgcgtttaccaaccattattatatccatactctgttatgttttgttctggtatttttatggattttcatttataggtttaagaatttattgactggtgtgtgggtatagtagggagggggtctgtcttttttctatatatgtagtaatctaacctttatgtttttgtgaaatcctactcagagcattttatctcatttctcatagttatagacaggaaattatttcatatccagatagagcctccgtttaacctaagtattggctccacaagtcttttaaatggtaaactccttgaatttaaattcaattagtttatgtcacgagtaggtccaggttttctgggtctgaattttaataatttaggggattgtctttaatgcaagagtaccaaattaggtacaggcatatgaaggtgcagagacctgaaatccaagcttccttagcttcccagtaaattcaccctggttacattatcagaatgcatctgttacataaaacgatgaggagcagccatctccatccctggagtggtatgactttcttttgtattcaccagctaccacaacttcaggatttttttcttcccttgttgtttaaagagacatttaagagcagacacatacatcaaggtggctttaatgttggaagcagagttagtccagtggagaagttctttcagcagggtctttgccacctctgcattgctcaaatgtgatgtatttgatcagtggactagctgagaacttggtataataatgggggttgttaatcttgcatgcctttggaacctgaatttacagctttaactttgcatatctgcttgcttttgcattagagcttggtcagcactgttgagagatttgcaaatgcaactaacagggctttcttttagcatcctaccctttcaaaaatccaggaggcaaacaatgatcaatgttgtcataagtaatgcagaggatggcaataataataatacctgactttcaccataagccatgtgctgtgcgaaatgcttacctgtattgttttacttcatcctcatcatcccctataaggcagatgctattatgaccctcactctacagatgaggaagttgaggcttagagagaggatgccttactcaaggcctcagaaggggtacttcagcacccccccacttcccttcaggatcctctaaggccagtgctctcatttgacaaatgaaagacagatttggagagacctgagatcttttggacatcaggtttatgtgtcaagcatagttttatttattttattttattttgttattttttgagatggagttttgctcttgttgcccaggctgtagtgcaatggcatgatcttggctcactgcaacctccgcctcccgggttcaagcgattctcctgcctcagcctcccgaatagctgggattacaggcatgtaccaccacgcctggctgattttgtatttttagtagagacgggtttctccatttggtcaggctgctctcaaactctcaacttcaggtgatctgcccgcctaggcctcccaaaagtgctgggattacaggtgtgagccaccacgcccagccaagcatagttttaaaaactttgctggtcttatttaattaaatccctgtaagagtcctgcaagataaatactattattattcctgttttacagatgagaaagctgagacacaaaaatttccaaggccacatagctactatgtgaaagatgtaggataaaaccttaggcagcctgcctccagagccaggctcctaccctcactctacagctgccttgcagggagtactgttaaagcttagtacagttacgacttactgcatcacatctctgagcctcccagaaatagagagataccaaggcctttcatttataatttctaagttattttttatttttatagacagggtcttccactgtcactcaggctggagtgtagtggcacaatcacagctcactgtagccttaacccgtgggctcaagtgaccctcccattttggcctcccaaagtcctaggattacaggcatgagccatggtgcccaccctatttttttaaatgaagaaatgcctaaactgtgttacaaaaactgtggcatgtttaaaatgtttaaatttgacaaattaggccaggcgcggtggctgacgcctgtaatctcagcactttgggaggctgaggcgggcagatcacaacatcagaagtccgagaccagcctggccaacatggtgaaaccctgtctctactaaaaatacagaaattagcccggggtggtggcgtgcacctgtaatcccagttgctcaggatactgaggcaggagaattgcttgaacctgggaggtggaggttgcggtgagctgagatcacgccattgcactccagcctgggtgacagagcgagactctgtctcaaaaaaaaaaaaaaaaaaaattgacaaattaattctcttaagattcaaaaaaaacaatgcaatacaattctgctatttgaaagataattatgagattcaaaagaaatatgaattcatggggcttttacagttaaggtgatatgggaatgagacatgatttaaagttaatgatgaatatcttctttcactcctgtgtctgtagttttaggccgcttcatttggagaacacaccagaagtcttaacttgaggctctttgagaatgagagaacataacgaaataatgagatttggtggtatatagaaacagcagccttgtgcctgacctttgttttttcactgttggtggctaaaagaataaatgtttatagattatactgaagtactgagctttgttgtttttggtaaaatgaagagccactgtacgctgattgataagagataggctttgattttatattctactgtatgtttcagttagtttctttttaaacattctttaacttttgattatttccttatcagacttgagttttctaggaaaggagtttttttttttaatcagagaataaatttccaagtcattgtccccggagggataaattaaaatgcagggcctatttccaaccgcattagtgacttctctgtagctttaggaagatcaattaaccttttactcacttctttgtctgtacaataggaatggcagtgttgacatcagatttttccaaagtatttttcagaaacttgggtgaaaggtattaaaactactgcctgcattattcctggatccccctagtaatgggctccaattaccagtcacttataagaatttataggtaagactcttatcatatgttgttaatcacaactttcacagttgtgatttggtgttttaattcaaaagctactgttttggaagtgactgctttctttgagggttagaaaacatgcccacatttccatacaagtgtcacattcttgttagcacatcacccatccatctcttacaggattatgcaactcagttcatagatataatcagctttgtattttcattcaaggataacaaactagcaaggttgaaatcttgacttgtcatcggaattgaattgctccctggagctgggagggaatgagattggtccagctctgttcagaaatggcagttatctttagaatctcaatcgcctgctctccctttcttctttccagtatggtgactacgaccccagtgttcacaagcggggatttttggcccaagaggaattgcttccaaaaagggtaagagattaaattcccttttcaggaagacatagcagatatgtggtctaaaagaaagctaaccaaaggacttgaaggaatattggaagtacatagcaatttaattttaataaatattttgtaatctccagtaaacagtgtgggatctctgttaagaatattaaaaagcaaaggtttttggagttagtttggggtcaccaggactagcatggcctgtaaatgttttttctagcgtggttgttttttcagatgcagttgagcatcattgattcccaaagaggaggctggagcagagtgtattcagcttggggaattgagctgtttgcagtggcgaggggcggatagaggagatgaggtaggggtgggcattgtggtttttaatcctcagtgttgttcatcttattcattagccacagaagcaggcccgccctcccttttgctcctgccgattttacagccctcactcatctgtcactgggtaataaaggcccgtttctcacctctcactctctttacctgtccctcgatggcttctgagcatgtgaaggcctgagatgagtgagcattgcttctgactgagctccgctgtcagaggtggtctctgtgatgtatcgcccaggcagggacaggggcactgccagatgagggttgcacctaggtctgagttatcatgcagctttctgagttgctcctccaatagaatggtgccttatttacacgccctctctctgtgtgactatctccctgggtgtagctttttaaaaatagctttactgttttgtaaaaatgatgcataattataaaagtggcaaacaataccaaatttacttcatgtgtaggttttttattttgctctattttttggtaggtaataaatctgtatcagatgactccggaaatgtgggaggagagaattactgcttggtacgcagagcaccgaggccgagccaggtgaggcccattcattgttggtttacattcctttatgggcttttttttttttttttgccttaaagaactgcaaaactaggacatgcttgttaaacaaaatgcagtactgaagtctataaaagaaaaggggagagctggggagctgggagtaacgttggtcttcagttttgtgtgtgtccttttctagtacgtatgacataaagtaggtatgtgtactgcctgtcaagatatatagacctgtactcactggtaattaagtttaagatttttttttttttttgagacagagtcttgctctgttgtccaggctgaaatgcagtggcgccatctcagctcactgcagccttgacctcctgggttcaagcaaacctcctgcctcagcacccccagtagctggcactacaggcacacgccaccatgcccagctagtttttctatttttagtagagatggggtttcaacatgttacccaggctggtcttcaactcctgggctcaaagcaatctgcccacctcggcctcccaaagtgttgggattagaggcgtgagctgagccactgtgcctagcctgaattttaagaattctattgtatggctatcccattgcttttgcatccatccctttattgatggcatttgagtatctgtaggtttttcacttttacaaaaatttctgcagtgcacaatcttttatttttatacaattgtatgagtagttctggggatatattctttttttttttttttttttttttgagacggagtctcactcagtcacccaggctggagtgcagtggcgcgatctcggctcactgcatctccgcctcccaggttcacgccattctcctgcctcagcctcccgagtagctgggactacaggcacccgccaccacgcctaggctaattttttgtgtttttagtagagatggggtttcactgtgttagccgggatggtctcgatctcctgacctcgtgatctgcctgcctcggcctcccaaagtgctgggattacaggcatgagccaccgcgcccagccaatatattctttaaaacaagagttgttgggacaaaggatgtgagcattttgcattttgccaggtaccaccaaattgttctccaaaaaggctgtacctgtttatacatgcctgtcgacaagtgttatgagagtgtcccaccccccacccccagtctatcctcaacaattgtttttatcagtctaatttttgtaatctaaaaagtgaaaagttgtattatgttagaattccattcccttgattaggaattggtcatgttttcattagcctttaacatttttttctcttcttcaaatcagtttcctaacacttttttttttaaacttaagtgcaacatgcatatggaaaagtagacaaattataagtatacaacttgatcaattattgtaaggtgaaaacaccagaggaagaaataacctgtgtctccctacccccaattcccctttcttcctccccaaaggcaaccagtctcctgatttttaattccagattggcgttgcccatcttaaactttgcattctgttttttgtgtctccttttactcagcatcatgttgtcagattggggtttgtggcatgtggcaatagttttctcattttcattgctgtatagacttccactgtattagtatattaaaaattatttattcattctactaatgatggacagttaggttgttgggttgtcccctgagttttgctattacaataatgtcaaacaatttcccaaagtaattgtaccaatttacgtcaatgtgcatgatttctgatttctccaccttttcaccaacacttggcgttctctcaggctgggtttttaaaaattcattgagagcatttggagattggagagagaaggaagaggacaaggtcatagggagacttgagttaaaatatttcagtatgatacctgtttgggagttttctgcaagttattgctacttcaagagcttactttaaattataacttagatgaaggtgatctgacttgggttttacaacccagataactcttgccctaacctccaacaatactcaggaagcttgcagagagagctgtttcatttccagaaccttccaggtaaagaaagtacacaaaggaaaagcaagaacttaaataaaattccaacacccaaatctgtttgagggtagaagataacataccacacactcttgttgaattacttgagatgagtttactgtttaccaagggcaaggtgggaaactaaggccaagaaactccgtgatgagtctgttctctgactatcttttgatggggatgggaaattctgcttgacctcagtgtgtttaatagactcagggccgggcagagctttgctggtgtctgctgtggcttttgtcttctggcagcgacgtggctctagaggaatggcagggtcagaatgcttgatttggtgcccacccgctctccacccatctcacttagctccaatgacagtgtcttccgttctccccacagggatgaagctgaaatggaatatctgaagatagctcaggacctggagatgtacggtgtgaactactttgcaatccgggtgtgttgaaacctctctgagctccttgtgtagtagacagagactgagtgagggccagactgctaaaatggttacttcttcattccaaggcgatagactcttttatggttctgtggtaaagaaggaaagaggaaggaaagagaggtcttagtgcctaactttctatttttggacttcaattagatcataggtaattaagtgtcacttgagccttgggggacttggacctggttctgctctcagcagaaacctgtttgaatgctctgagtgtaagatttgattatttctggctctgtgagatctccgtccacagggagcacttgtaagtacttctccccccaacacacaccccacccccatccccacccccacccccaccccaggcactagtagagtagatctgcctttatagattactgatttgtttgggattctcactatgaggctaattggttttctattcagactattaatagtctgctgtctgctgggaacccactgcttctgcagggagaggcatttgtgtgcagcccagatctgggcctttagaatgtctttctcctgtgggtcagtatctggatgcagtgtataggcagcttcttacaaagggatgcatgcgatttgccaaagcatttcactacggactccaaactgcagatgagtagatgttaaaacaatgaggcgggtccacctttattttcatagtcatgctttgctttcccttattgggttcctacagttgttgtattaaattcaggtaaattgaaacatattttaaatattctaggatagctttctacttcatttgtattttgtaaatacagatttgtatggattacactgcataagaaaataaggcacacttaaagtgcctaaaagatgctccataatagtacaggaagttcttttctaaagttctgtcagtttgtatttgctaattgcttggtttctttaaggtcaaactaatgtaacacatttctgtggttttgtcaactcaactcctcttgccccatgttctggccacctagattctagaaaactaaagttttataatcctcagaaaacagtttttttggtttttaaaaatcttttttgttttttagaggtggagttttgctatatcgcccaggcctgctaggctcaagtgatccttccaccccagccttccaagtagctggggagtatcactgtgcctggctgaaaaggtttcttattagggaatatttctacatcagtcagactaatggatactgttttttgtgtgtgtttcctatattgagcaatagacaaagctactggctatcttagtgtcttttatgttaaatttcctgaaatctcaccattaactaaggaagatgtatgcttaaaacagtttaaaaggggctgcttgagtcctcacctctctctctgtttaatctctaggagtgttggagtcataatggtaggaggcagaaggctgaatctttttttaaaaatttaaactaaatagtcagaaactattttctgactattgaaacacaatgaaacatctcattttccaaaatgtactgcagatgtaaaagtacaaagcctcacttctattaatgcagtagctttcatggctttgctgacgagcagaagagtctctcatggtttggtgatagcacctgacttcaggatgttaggagtaaaaagatttatgctggagtactcactcctcagtctgatatctgctgttagatgggtacttctcttcacagtcccagtaccttctcagtttgcagacctgtttttctgcccttgagtcttggttcagtttccattatcgtcaaggggtcaggagctgtagtatccttgtgcagcgagtttccttccactccaaatgagggctagaccacagcactggcgggtggacctgcacgtgaagatacagccactcagtccgtcgcaggttcagtgctgtgggagcccagggcacccgccgcgggctgctctgactgctggccaggaccgctgtcaggggcagagcataagtacggcttttagacaactttgttgatgaatagaattctttttgatatgtatttcccatcatgcaattattaaaaatttcaaacttacaggaaaactgaaagaatttttcagtgaatacccatatatatgcacaatctagattctacagttaacattttaccagacttgctttatcacatgaagactacattttatcataaaatgagaccatccagccccaggcactgaaaattttcttcctagtagtccaacaatggtttctttaaatataagaaatcattaaacctatgggttttttttgttttgttttttaacgaagtctctctttgtcgaccaggctggagtgccggggcaccatctcagctcactgcagccttctgggttcaaccagttctcctgctcagcctcctgagtagctgggattacaggcgcgtgccaccatgcccggctaatttttttgtgtgtatttttagtagagatggggtttcaccatgctggccaggctggtcttgaactcctgacctcgtgaaccgcccgcctcggcctcccaaagtgctgggattacaggcatgagccactgctccccgcctaaacctatgggctttaattctatacctatgatagcctgcttatttaaccagagggaacaacacttatgttactcttcctttagccatcgagccagtgacagaagccctcagtgattgttctgggggacccagaagtcacaagaatggaacagttttgcttctacctgccccaattcagaaagctgaaatcttcttggtttataagacagctgtgacttctgttgggacctgctgaaacttgtcacatgtgacagtgtgtgccagattctttggaaggttgaataaaattttgagcctcagctggcgcttacagtagctgttcttattggatccacagaataaaaagggcacagagctgctgcttggagtggatgccctggggcttcacatttatgaccctgagaacagactgacccccaagatctccttcccgtggaatgaaatccgaaacatctcgtacagtgacaaggaggtaggacatgtgtgtactgcagatgggtccagcagatctttccctgtctgcccccctcactggagcctccccagccagggcatctccttgttattcatagagtcctttaattcccaggctttgagggtgtggttgttgattttcgaagtctttacagaacagtattggcatcaataaccccactatgactaataggaaactgggaagctcaactggccagggagaaaccccaaagaatagtgaacaaaaacagtaacattttcttattacttggctttctatttttgtcgatacattctctttgtatgttttcttttcttttttagagacaggatttcattatgcatgcccagactggatttgaatcctgggctcaagcaatccttccacctcagcctcctgagtagctactacaggtgtgcgccacagcacctggcttaaattctcttcgtattttaagtgtggtctttattgagctttctttctgtgtccggtgcttgatacatgtggcagagaaatacatatacacacatatacacatatggacatatatgtgttttgtgtgtgtatctctcagtaattatataaataagtatattaggttaatatgcttacaagaattccaaaataattaaggtggaataacttagataaatgctcttagaatttaaatatttccatatagggtggtgacttttaccaaaaaggtcccataatgtataatcttatgtttactcatccatccattcattcattcactcatccattcattcattcttcattcattttattttattattatcattttttgagacaggctctcattctgtcaccgaggctggaatgcagtggcacatgatcacggctcactgcagccttgacctccctgggctcaggtgatcctctcacctcagcctcccaggtaacagactacaggcgtgtgccaccacatctggctaattttttgtagagatggggttttgccacattgcccaccaggctggtcttgaacttctgggcttgagcaatcctcccacctcagcctcccaaagtgctggaattacaggtgtgagccactgtgctcagcagttcttcattaattttaaaggaattattgagcatctgctttgtgttagatttcatgggggaaacaaagatgtagaaaatccagtcttagcattcaaggaagtcaagtaactactcacctgctataataaataagtgccgtggaagagacatgatgacaacaaatgtagtcttccacatacaagcacattcaccctgaccgtctgaatttaatctctataagaacactgctgtaaaggcaggggctgtgttgtcaatatctctgtgtcacatcaggaagcagagacacagaaggatcaagtgacctgtgtctgagtgaagtagcagagattaggagccagagttgctgatgccacagcccccgcctttcagggaggcccagaggctgagtcctgagagcacaggggcactggggagagggaggctccactcagtgacctcctggtacctgcacagccaggacacagactagagagtgaagaacaggaacagcttatgttgctgcctgcagagccccaaacctgagcatatttcctgttttctctttttcatggcaactcaaggaagggaacaccaggcccctggtttccagtatatggttgggatctactcagccatgcttgataagacagactgagccccttaattcaaaacattctgactttgaagtttttgttagtagttagcccaggagataagcagttaggtatttcttttttaaagtacttaaattgaaagttccacatgacataaagctgtatgtgtgccaccgtatggtagtttttcatctcccaatttcataaagtctgtttattgcacgtccacacatttgtgtgctaaaggctccctaaacacccgttcttcaaagaagccaaggattgaaatctcccatactatggcctgacacagtaaactctaatatgccctctccgggggacaggcgccatcatgttccatcatgtcaataactcatgcagtaagcagaccccaagctgacttgacataaaagaagtagtcttggtagttatgcatgacagccatgctgtcaaaacagaaatgttagtttattttaaatgatccattgattctttgtgtacgccctggcatggtgcagagcctgcggtttccccactacttgtggtttcccaatgacagctccagggtttgacagcaaagccaaaaataagctcacaaaattcatgaatagcagcctacacaagagcaacactgcttctaagttaacttggctgaaagctaaacaaaggatcattttctgtcctcagtgtactaaccccttcttgggcaatataacgtgtgaaagaaatatatcttcccaaacatatttatctgcttagcaagtctttcttgggaatggatatccattttgtaagtgcatcttggaaatctaggatctgtttggtcttatcgggagtggttgagagcagcagccatttgttccttgcaggctttcctgctagtggtctaaccctaggttctcctaccaagccaccaccctgtctttatcattcatctttctctccattttgatttcagcatcaagaactgttttcccttctactatagtccattttttccccatttgattctattaacagcttttaccaaattattcccatgttcagaaacctgtggtgagctcaggtatcctgtcacatcaaacctaaacccttcttttttttgagataggggtctgctctgttgcccagcctggagtgcagttgtgcaattacagctcactgcagcctcaaactcttggcctcaagcgatcctcctgctttggccttccaaagtgttgggattacgggtgtgagccaccatatctggccgcctctgacttttattctcactgccagcccctacacccaccccttcctccctctcaggctaaacctattatatcatcttagtcaccaaaaagctaataccacacacacacacacacacacacacacacacacacagctcatttccctgtctctaccttatttctggttttgccctgtgcagaatgccccttcacctgccttttagctaccctgttggattgttcttctaagatcagcttcactctctcttgcttatggtggatctactctgaacctccacatatttgtgatttgtaccacccagtgaagcactaatatttgatgtgatttcttgagtaattggctgttgttagcctagttccaactagatggtgagcttcatgaaggtgggcccatgccctcgactacagtagccctccagtgttggcctcagggttgggcccattaaggatgcttattttaggttgtcaagaatcccttcccacactcatgcctaagatggtctagagagcgtacctttagggtcctgagcttccacagcccgagacttggtgctcctaattccctgaggtttagtgcctggatactgggaagccaggacaaggcataacttcatgctggtctgtggccagtgtggttgcgcatttgtggaatttccaattgctggtaacattccaggctgtcggactgaaactgtgttctgcttcattcttccagtttactattaaaccactggataagaaaattgatgtcttcaagtttaactcctcaaagcttcgtgttaataagctggtaagttgagatcctggttttcattactgataatggtagcttttctgagaattgaatacttctttttaaaggatatcagagtgacatcttgtgaagtatagaatggtatctcacttggcgcatactttctgtttagcttaaagagttaaaactaaattatatcatgaagaagtttttttttttgttttttttttgagacagagtctcgctctgtcgcccaggctggagtgcagtggcagtgccatctcggctcactgcaacgtccgcctcccagattcaagagattctcctggctcagcctcccaagtagctgggattacaggcatgagacaccatgcccagctaatttttgtattttcagtagagacggggtttcaccatattggtaaggctggtctcgaactcctgacctcaggtgacccatccgcctgggcttcccaaagtgctgggattacagtcatgacccactgcgcccagccgatgaggaatttttaaaaaggatttttaatgcagtatttcatacatataaaaggataagtgtaacatatgaattataaagaataacaaaagtgaatagctgtgtacccacaaccccactttaagaaatagcacagtcctggccgggtgcggtggcttacgcctgtaatcccagcactttgggtggccgagacgggtggatcacaaggtcaggaaaaaaaaaaaaaaagaaaaagaaaaaggaaaaaagaaatagcacagtcccaatactgttgagacccttcatgttaacaccctgctggtctctcctttccctctccccaagggtgatcactgttttgagttgagtattcatcatcctcttgcttttcaacagaattttatttcatatatggcaaaagaaaaataccattcaatgtcatatgtttatgaaatttatctaaatgctgtcaagtatatatattcttttgtcattttccttttcctttttcattatttttttgagatatatctttgttgatgcttaaagatagtctgttcattctcacctctgtagcactctgttatatatttttctgattcttctgttaatggataattaagtgctttttacttctatacttttttttttgaaatggggtctcactctgttgcccaggcacaatctcggctcactgcaacctccgcctcccggatttaagcaattctcctgcctcagcctcctgagtagctgggattacaggcggccactaccacgcccggctaatttttgtatttttagtagagatggtgtttcaccatgttggtcaggctggtctcgaactcctgaccttgtgatctgcccaccttggcctcccaaagtgctgggattacaggcgtgagccactgcacccagccacttctatactgttttaacaggctgttatgaaaacttttgtatctgcctcctggtgcacataggcaatagtttctttggagtcttgagtatactgggctaggtggggtggctcacgcctgtaatctcagcacttggagaggtcaaggcaggataactgtttgaggccaggagttcgagaccaacctgggcaacatagcaagaccctgtctccaaaaaaatgaaaataaataaaatttttaaataataaaaaagagggccaggcacagtggctcaactcctgtaatcccagcactttgggaggctgaggcaggcggatcacctgaggtcaggagttcaagaccagcctgaccaacatggagaaatcctgtctctactaaaaatacaaaattagctgggcgtggtggcgcatgcctataaatcccagctacttaggaggctgaggcaggagatcgcttgaacccaggaggtggaggttgcagtgagccgagatcatgccattgcactccagcctgggcaacaagagtaaaacttcgtctccaaaaaaaaaataaatacataaaaataaatcaaaaatagagcttagagtatatacacaggagtagaagtacagggcttggtatatgtttaaatttcaaaattatgacacattgttttctaaagaaggtgaatcgatttttacagacccaacagtagtgggtgaagtttgttttttgctatccttaatacttgtattatcagccttttaaaatttttgccaatcttgtgcatctaaaatggtatctcattatcaaatgaactttttttttttgagattttgagatagggtctcactctgttgcccaggctgaaatgtaatgacacgatcatgtctcactgcagcatggacctgcccaggctcagtgatcctcccacctcaccctccccagtagctgggactacagacacacaccaccatgcccagctaattttttgtattttttttatagagacaaagttttgccatgttgtccaggcttgtcttaaactcctgggctcaagcaatctgcctgcctccccttcccaaagtgctaggattacacttcccaaagtgctgagccaccaggtctggccaaatgttttgagttttttgtggagatggcgtctcactatgtcacccaggctggtcttgaactcctgggctcaaggatcctctcaccttggcctccgaaagtgctgggattacaggtgtgagctactgcacctagcctgttttctttattggctatatcttccagtttgttgctctttttctttttttatgtcttgacaataagaatttttaattttaatgtagacaaatatatacattttttccttaatcactttttgtgtcttacttggcatcttctcttatcctatgatcataaagatattcttctatattgtcttctaaaagtttcaagggcttaatctttgcatttaagtatttaatccttctggagttgatttttgtgtaaggtgtaagggagggatacaacttatttttttccacatgcataacctgttgcctcagcccagcttactgaacgagctttcctatcctccctggtctgcagaaccacatcttgatgtaggagagtaaggtgcacccagaagacatggtgaagtgtcctccagtcctctcttgatttatgatttttacctcctggcatatctgaggcgccttcattttgcatgtttccagagctgacggcactagaggccactagtagggctttggtgtttcactctatgcattcatcttcacgtttactgctacctgcaagagctcaaactgctatggcactagtgggccagtaggcagtgaagtaaatttgtggatattaacctttttgtctgcttctgtggccacagattctccagctatgtatcgggaaccatgatctatttatgaggagaaggaaagccgattctttggaagttcagcagatgaaagcccaggccagggaggagaaggctagaaagcaggtgagcacaaccttgttttaactgatgatgtcactgtgtggtcagtcctggcctgggaggcgaggagtggtcatgggctggcaggagtcttttggccgtggacatacctgctcttgttttataccttttggatcttcatttgccgatgcctacctggtgggatgtcatctctggaaatgaggaataaaccctaatagcatatctaaaagaaacatctctagtaatttctacgcttggagaaattaagtgtgattaacaccagtttgggatgaaatagccaagagtgcatgcatctatccgtccggctagctagcttgctttctttttttgcctgtctgcctccttgtgcagccttctccttttctaattagatggtgatagaatgccaggtggcatttcagtgcttgcggctggaatgctaatttgactctggctgcaattccccactgcaggtcaggccttatggcatgtcacctgccccaggaggtgccaggagcatctatcagcagactggatgatctgcatcattgttttctactcataaaccttctctgctcatggaaatccacacaactaatttgggccttactgctgagaatatcaattgtgtttttggataaactactagatagagtagcagcagctgcagttggctgcccgcaggacttgcaagctcagaagtgtaataattagtctgtgtgcacctttctgatttggatacattggagaggctggtcccagccctaggatttagaatgaaatgcccagtgtgctttcagctctctatctctttgctttctgaggtagtgggccacaaatgtgttctttgggatgctttcagggtgatgggatggatttgttggacaaagaaatcctactgagccagcatggggtcatagtggcagtttcatgaagagctcgtggcagtggctcatccctataactccagcactttgggaggccaaggcaggaggatcacttgcctaggaatttgaggctgcagtgagctatgattgcaccactacattccagcctgggtgaccaagcaagaccctgttttaaaacagaagcagaaacaaaataccaaaataaataaataaataagtaaataaataagaaggaggaggagagctttctttgacctttttcttagcagagcaaagcttagaagtaagaaatctgaaagtgtcagggaatatgcagtctgtgggccctggcagagaatagcaggaacactgcagatcggcactgcttacagcacagcagagccacaaacctggcatctgggcaaccacagatcaggtggacagacactgaccttggagccagatctgaaatttagaatgtgagtaagtcaatgacttaccttccagaccttagttttctcatccatcaggtgaaactaatgatataccttctccatctcagatgaagggacgtatattacaccttacagtctttgtatgcagtaaacttcttttgtgaataggaggtcttttatattggggtagaggtctcagggaaagtacagggccaggaactgaaggagattacctggcttttttttttaataaaagggtcttgttctgtcactgaggctggagtgcagtggtgccatcatagctcactgtaacctcaagctcctgggcttgagcaatccttctgcctcagcccctcaagtagctgggactacaagtgcatgctaccacacctagttaattttaattgtttcgtagagatcaggtcttgctatgttacccaggctgatctcaaactcctgggctcaaacattcctcctacttcagccccccaaagtgctagggttacaggcatgagctgctatgcctgcctggcctgactgggctttttctttctttctttcttagtttctttttttttaaaagaattgtagatatgtagtaagccaccttatggaaattgtaatatgatggaaattagagaacaaattggccaagcttttcattgacttacaaggagaaaattggagaagaactttcactgttttattgcttgtctttgcattatctttttgagcttgtgtgtgtgtgtgtgtgtgtgtgtgtgtgtgtgtatttggcttaggatttagaaaaagcagcagtcttagaaaccttgtatgaccagagtgtgggataagattgaagcaagaagtaattaaatgtgctttaattatttaaggcagaaaatagtgcagtggtcacttctgggttctgctttttgaactcagttagtaccctgggatcacagaggaatggcactgtcttgtgcttgttccccttattaagctcagcatgtggcccaattaatgcagtgatccagaaggcaagggaggtagtggtggctttgtgctgttgccttaaggacacggggctgtgtttcccgcctggctccctcctgtcctaggcctggctcaggagttgtctccacatgaggctgtgcaagtctgtgctgtggctgttgcagctcccccctgtgaaatacaatgtgtgaactattgatgcatcacgtagaatgattccatcttctctgtgggtcagaggcaagagtggagctattgttgatgaaatcagagatgtgagaggggtccatgtggattagaaatggtgagatggcttgcctgcccagatgagaaagctgcttatttctggggctctatctgagggaggaggtcctgcattgcatcccatcggccatggggcagagccacctggggtttcccaacaaaaagcaacattggcaaggtagccatttcagtgcaccgtgtataagaatgcctccttctgccaggcgcggcggctcatgcctgtaatcccagcactttgggaggccaaggtgggtggatcataaggtcaggagttcaagaccagcctggccaatatggtgaaacctgatctctactaaaaatacaaaaattagccaggcatggtggcgggtgcctatagtcccagctactcgggaggctgaggcaggagaattgattgaacctgggaggcggaggttgcagtgagccgagatcgcgccactgcactccagcctgggtgacagagcaaaactctgtcccctccaccaaaaaaaaagaatgcctttttctatccgggtcaagactcaacaggtttttattgtttgttcatttgttcattcaccactagactgtttttcaagtggcacagctttcaactctgcaactggtttagaaggacggggtggggggcaataagaatgaccctggctacctaaaggaaagggaaggaaaaaggtcccaaaaggggagactggagatggggcatctttgggcccttgtggcaccctaggtctcgagccctgtgattcaatgactgtttttcttcacccctcgcagatggagcggcagcgcctcgctcgagagaagcagatgagggaggaggctgaacgcacgagggatgagttggagaggaggctgctgcagatgaaagaagaagcaacaatggccaacgaagcactggtgatttctgaggggctggggttccaggaggctacttggggacttccttggcttttctggagcttggtctcctgaaaaccatgagttagcagcgtttgctttgaaatacttaatttcagctttgaaaaaatcagtgccttttcttttcacctgtgttggcagaagcagatttaggttgagcttatgtgcagccaaactccactttcaccacgaggttgcctttatagcagggcttctcagcctgggcactactgacatttggggctgaccatcctttgctgtaggaactagatcccagtagcagcacctcaccctccatttgtaacaatccaaaacatcttcagacattgccacatgtctcttttttttttttttttttttgagacggagtctcgctctgttgcctaggctggagtgtacagtggcacgatctcagcttactgcaatcttcacctcccaggttcaagcaattctcctgcctcagcctcctgagcagctgggattacaggcatgcatcaccatgcccagctaatttttgtatttttagtagagatggggtttccccatgttggtcaggctggtttcgaactcctgacctcgtgatctgcccgcctcagcctcccaaagtgctgggattataggtgttagccaccgtgcccagctgtacttttattttttttttttgagatggagtttcactcttgttgcccaagctggagtgcaatggcatgatcttggctcactgcaacctccgcctcctgggttcaagcgattctcctgcctcagcctcccaagtagctgggattacaggtgcgcgccaacacatccagcttttttttttttgtatttttagtagaaatgggttttcaccatgttagccaggctggtcttgaactcctgacctcaggtgatctgcccgcctcagcctcccaaaaggctgggattataggcgtgagccaccgtgccccacctgccacatgtctcttgcaggggacaaaaaactcctctggttctaaccactgatttaaagggaaagaacagagtttaagttgtttttctccacgtgaagcataagcctgagctgaggtgggtactcagagaaggtgctcttgttactccccatgggtgcagcccgaagggcccttctgaaaagttggggaatgtggcttgtcatttcttgtcagagggtcatggagggcactcagcagcagggccccaggagtccgagactctggtttgtcccatctcagtgttcaaggcagatctgggcgggagaacagcacatgatcccacttcagctaagagcactgtgccctccagatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggaggtgagggggcaccgggcaccagactggcgaggaggctggcgaagggccgcagaccagcctgccctgaggctgagctctacagcagttgtcctcaagctgcttgcccatcttctgggccgtggggaggctcctccttggctgatggtgactggtgctttatccattttggggctggcgctactggttgggcacaggaactcagttccccctccaggggggcctctctggtcatacttgtgtctctttgataagcccctgtccctctgatggccgtgtgtgcaggaaaacccctgagcatatccacagaccgctttcagctgaagagatgtgaggaggctctttgtgcatttaaaaaaagtgtggttcttttctgctttcattcagtggggctgcaggagaacagcagctgcctacctttaaagggaagctagtgcctgcatcccccagcctttcttggcacatgggggaggagggctaggatgatctctgtgactgggatgtcccactcatggccaggttgaaggatggaactgttgtctgtacttttgaaagactattctaggcctgcaaccttcagataaacactgacacattccccacagcttttggctctgttgatttagagcacttgaatttggcttttagctaccaaggtgcattcactacagttttcctcaccacgctttgcatgtcgttctgggaatatggttcctttttgcctgccctgcttcaggccccttactgtattcgggggtcactccctgtgcatgatgcaggttgggccaggtccctgcaccaggcctcacatgccgtgaccacctgagccccataggatgaggatctgcaccagggtgcgggtgccctcagtgactgggctcatctttctgctggagaaagtgggcacaaggcccactggtgttttatccgggggctgtgaagacgcagttcttgcacattctgccctttgcgatccaatataagaactttgatcctccaggttcttcctttgcccagctcactctcacccaaaaataaagcagagaaagctgctggtgccctctccagctcctctgtctcctggctgcagaaggtctggtttctctcattccccaccagttttcctgctcttccagtttagatttaccaactcaaacaaaagtcctcaggaatgttgtccttgcttggaagttctgatttcatgtaaatatccctgtctcactgtcctttttcacctctttgggtgccatcctcagggttagcccaggtccctcctctgcaggggtggggtggtgtcttttcctgctacctgccctcttctgtgaagctgacatctcatcctttccttgcagggccaaagaggcagatcagctgaagcaggacctgcaggaagcacgcgaggcggagcgaagagccaagcagaagctcctggagattgccaccaagcccacgtacccggtgagcctgggggccaccagctggggctgccttagtcctggtgatgttctctttcctcccggcccttcagttcatctggcggtgccttcagggtgaccattcaggcaaacacatggctggatgagaggtgcagagagcctgcagttagggactgggtagaacatcctggtctgccatttggctttggactagttagttgtctctttggttgcctggataacaggcaacagggccttttccagctctggaatgtttttctttttctaagtaatatagtcccaaattatcctcaagagaatttgctctcttgcctcttaatgctgagctgaatgtaatcttcaactatcagtatataccatatatcataattatagttctgggaagggattggctgtacacctcagagtgaattactgccgtgcaagaacgagcagccactctcagtttggggacagagagtcagacttccattaaatggggtcacaaaatgaatagaagcctctttccttcctttcttctgtgcattcagtttggcatttttttttttttcatatttgttcagtgtccacatagtgccatgcagttggaagtctctatcctgacaggtgttctcagggtgcacaggtgcctagaggaggaggacacagcccaccctggaggagcaggagaggctcagtgtggtgtctacactgatgcttgaagggggagcaggaagtagccaggtggagaagagaacatagggtattcagggtgagggcacagatgcacacatggcccagactcacacacagcacagtcatctacatggcacagacacacacacgtacccatacatacattgatgcacatagcacatccacacacacagcacggacacacacgcacccatacttacattcatgcacatggcacaggcacatacatgacccagatgcacaaagggcaccagaggcacaagctgcccagggtttgaggtggggaaaatgtaagcagtttgctgttgccgtatatcccggttctccgttactgtgtaacaacccacccaagccagctgtgtggctttgttagtacctctggtggcttgttgggttgactgggccagacagagatccttgctggggatctctctggtggtcacagtcagatggtagctgggactggagtcgtctgagcagtcaactgggctgaacacctgagatgtgttatgtttttattttttattttatttattatttttttttttagagagagagagttttatttactctgtcacccaggctggaatgcggtggcagaatctcggctcactgcaaccttagcctcataggctcaagcgatcttcccgccccagtctcctgagtagctgggaccacagacatgcaccaccacgcccagctaatttttttttttatttggtagggacagggttttgccatgttgccacagctggtctcaaactcccgagctcaagtgatctgcctgcctcagcttcccaaagtgctgggattataggcatgagccactgtgcccagcctatatgtgttgtttttaaaatatacactggagcaaagcttatacactgctgtaactgctctttcctcttagcagtcaatcctgaaggagatcatccatatcagctttttaatcatgttttgttgtgtggatggattgtaatttatttaaccagtccctcatggatgagtatttagtctgttttcttttgcaattttgaacaaaatgacactgaacatccctgaacacaaatcttgacacacacacgtggatatattggtagaataaattcttataatagaactgtggggtcaaattttcgattttgatactctccaaagaagtcataccagttcatgctctcactagtggtgcagcaactagtacgcgtttttgctgaaaatttttatgatgtgtaacatacacatagagaagtgcccaaattacaactgtacagtttgaagaattttcacaaactgaacatacccatgtacccagcacccagatcagaaaacaggacatccctggcacccaaggagccttctctcagcacccttgcagacggtctgcctcaggccttgagaatgtctcaaatgaatgttccaagcctctgctctttcccagacactgtcctagactcaatacgggatccaaggatgaaaaagaggcagattgtttgcaggaaacttgcaaatagtagaaagaagatacagccaaaaagaaatcttttacagggtggaatcgcagaagaaccattagagaaccgtaaacacagcgttaagggacagcaaagaaaagggttgccggctggctgggaggggctagaaaggctttggtgagagatcgtggtgtttgagaagggccttgaaagagggatggagcatagggaggagaaatgggataggcaggggtacagagatgggaaggcagtagtccaggggataataaacaatactgtctgtgacttagtagggcaaatagtaggagaagccgggaagctagattggggtcctctttagatgaccctttgtgctgggatgaaagtccaaaaaaaaaaaaaactacaccacccctgcttcaggccctactccggttccattgtccaagcccaagcccctcggtgggccggtggggagccctttgtggtggtgcccatctcccaccccacctctccacactgcatggcagactcctggcaccctcactgggcactgccccacccattgccatacttcccgtccggcagaccttctcctggcactgccttggatcccagcaaaagcagcatctcttctagcctctgttcgctccctggctacagtgtttaccttttttaacagtgatgatctgtgaacacatctatttcctgaacaagactttcagctgctcaaagccaaggatgctgtcttgttttctgcatctccagccccttgcacagggcctgggagtttcctaaatgaaaaagcgagtgggagtttgtgtttgattcagctgagcatgaagaacggttagagatttgagggatgattttcctggatttgtagtctttgatattgtttacctggcagtggcaaatgtggagggagtgaagtggagggatggggactcgtggtggcattgggaggtgggacccgagttgtgcccattgcctctgtggctgctggaggatcggttgtcaacacagtagtgtccttctgtgcttgtatgacccaagctcctaatccgaaatttctcattaacagcccatgaacccaattccagcaccgttgcctcctgacataccaagcttcaacctcattggtgacagcctgtctttcgacttcaaagatactgacatgaagcggctttccatggagatagagaaagaaaagtatgtagccccctgtgccctgctgtgggcagctgtgaactagactgagtgattggggccttgggaagctggggcagaggtgagaggtcgctgcagcagcctgtcattactcctgcaaaggtttgctctgctcttacaccctggaggaagaatttccttaatcagaaattaaggacaacagatcagcattcattctgaacgaataaaaataacaatttttatccaggataaaaataacacttgactggtgagctggagtttttggtggctctaagcctcacctaaagtgtaggactgggttgttagcatctctgagtcagttcaactgctgttatactactggactgtagtcacctcctagttgtgttctccagcaactgggatctgtggtggttcccatgtctagaacaaacaaaggtgagagaagagactcaggctcgaggctaaggaaagctgacagctggtggggccactttgctgcagtgggtggcactgggcagggccccagcatggcctgatcatggcagcaattgctgagctgccctccgtcttccctttattgtgggtagaagtggatcagagatggaaaggaaaggatccccactgcagaggaaatctaagcgagggcccctagttcccagagctagcggtaagttggttaactgctgctgcttgctagaggacaaccacagtagctaccatgcattgagtgcctgtgtgtcaggggttttggcttttgtctcatttaattcctgctaacttacaaacatcaaaatgacatcaaaggtaggttttcatgttcccattttataagtgagaactcagatttagagagtttagtgaactccaccagcatcccacagctgatgcagaggggttgaaacccctcacccatctgactctgcagcccatgtgcttttaccatgggtggtatcctcaggaaaaccctttggggaaagtgtctccatggagtccagtatgggcaaccagaacccaggctgtttttctttgggctctcacactgagggtatagctaagtagccaatgaaccagagcctctagctgtcatatctgctgtccatgttcctttcaccattatccagacatatacatttatgtggttgggatccgggatcagggtgaagctgttctgtgtctgctattttatagtttgtattttgttactatcttagtttgttttggctactgtaacaaaataccagaggctgggtagcttataaacaacagaaatttatttcttggccaggcacagtggctcatgcctgtaattccagcactttgggagtccaaggggggcagatctcttgagccaggagttcaagaccagcctgggcaacatggcaaaaccccatttctactaagaatacaaaaattagctgggtgtggtggcacatgcctgtggtcccagctactcgggaggctgaggtgggaggattgcttgagcctgggaggcagaggttgcagtgagcccagattgcaccactgcactccagcctgggcaacagagagacaccctgtctcaaaaaaaaaaaaaagaaaagaaagaaattgatttctcacagtttgggaggctgagaaggccaagatcaaggcacgggcagaggtggagtctagtgagggcattcttgctggttcataatcagcccctttttgctgcatgctcacccagtggaagggatgaggggtctctctggagtctcttttataagggcactaatcccattcatgaggctctaccctcatgactgcccaaaggccccacctcctgacactttttttttttttgagatggagtctcactccatcgcccaggctggagtgcagtggtgcgatctcggctcactgtaacctccacctcctgggtgcaagcgattctcctgcctcagcctcctgagtagctgggattacaggcgcatgctatcacgcccagctaacttttgtatttttagtagagatggggtttcaccatgttggtcaggctggtctcgaactcctgacctcatgatccgcccaccttggcctcccaaagtgttgggattacaggcgtgagccaccacacccagccggtgattaggtttccacatatgaattttgaagacacgaacattcagaccatagcacttcttacccttgcacatattggcagagtctctatactaaccatggcaatccctatggagtgtttttggtatttgtattgcatggtttttctggccatgccttgtagttggacactttgtgggtggtttccagattttcaccatcatagatgctgtcactcagtgttatctgttctcaggtgagggtggggatcttttcttccttgcgttgggtgagcttctgagtgagcttctgtcatctttagatgaagtctcagaacaagtgggaatgtggatgtggcctatcaaaagagatcacgtgaagctgggcgctgtggcttatgcctataatcccagccctttgagaccaggggttcaaagccagcctgggcagcatagcaagatcctataaaaaaaaaaaagagtttacttgaattactgctccaagaagggttgagacaaggagattgttctgggttcccaggaagcttgtttcacgtatgttttttttttgtacagaacgaaaagctgtccatgagagctggtatttgtagagccccctatgagaatttaccaagggcttttctactctttctttttctttccttttctttttttttttttaaaaatagagacagggtcttgctatgtttcccaagctggtctccaactcctgggctcaagcaatcctcctgcctcagccacccaaagtactgggattacaggtggagccaccgtgcctggcctcctacactgttttatttaatcctaaccacggccctgtgatcattatcccaattttaatgatgaggaaacattcatagcatttaagtgaccagcccaagctcccatggcctgtgagtggccaagtagagacgtgaaccccaggcctcaaaccctagatcgcacaccaagcagcttgtgggccgcagagcacctgagccgtgtctcactgtctgcccaagccctgatgcatgataccctcttgccggcagagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaaggtacccagggtctctttcttgtattttgctgatcaggaccatcattaatgaaatgtgcggttggcatctggtttcctcagtagccaagtcactagactattggcatcttttgtatgtacttagttgaggaaattttttaacttatgccagaaagggaatttaatctgccaatgactatgaacccattggctggatggaagttgagcttgtgttaaaagctctgatgtaatgaacccctgttacagggtggattttgagccctcatttagcagtaaagcataatgcccttttaagccaaggggtgttatacccagggagctgccttactttatgagaaagcagaatgaaatggaggctattgagaatggactttccctctagtcttgtggtgtctttaagtggcaaggactataaaaccaaactgaatttttaacttttttcatacttaaaaggaagtgtctaggaaagaacctctttgttttaaaagagaagactttattactttgcaaatggtttcatatctttctctactggtattttgagctttcagcattgtcgagattcagaagctaaattccatactaattatcagcccaagagcatacctctctcatttgggccaagcagaagggtcctctcataccaaataatgctctgctcttaactgatagcccaggaccaggttaacacctataaaataggtgttattaagataagactgtccattgagtttaggtgatactgatacagttaattttttattctttacctcagtctttaaaataggcttccagttttatggactgtctctgtttttagtggttaagctgtatctgaaaactccaggggatctgtttctgcctgccttcgttgttgggtacagtaggcagccctgacttctacctctcgactccagtcacaactggcaccgggtagagaattccttttaatagtgcaacctagaaggaaaggcatttccacattccacattcttctttcctctggcttctgtaatttactgggcttcccttccaaaacaaaattattaaacagtaaaggggagttcaagggaggcctcggtcattaaggaaagaggtaaaacgatggctgagccagtgagccagtcagcccttaaatgaactgcctcagacaccccatctcaccccttacccccagccttgtcatctgggtcccaggaacagtctcaccatttccactgctgctgcaatgagcagtgccctcagccacagaaacctgcagtgtgagagctggagagaccccgttccaagccattaaaacaaacaaaatcactcatcacgatttcaggcctatccaagcattttgcagatggcacttatggcattgttgatatcacagggtatgtttttgtttttcttcattttattttgctggtttagcctcaagcccaaggcagaagacctatctgcatttgagccctcaaagtaggttgttcccaggtactctctatgtggtgatggtgctgccctctgtgatactaacccgtgcatgagcttgcctgtctctgtcctcgggccacactgagcccttacgagggcaggtggtgcctgggtactggccgcagcatgctttgagtctaaaagtaggcacccaccctgtgaagccagaccagcctccagggccccagaagactgcctcgttccgaagagcatgtcatggggctgtaggaccagccattcttcccatctcgggtcattgttgggctggggaaggttatggcttcttgtccagtcaggtgtgtctaaaagtcctttgtcttggtggcatactcctagcatggaaatggggtcaatctgggcactttggagactggtgtgtttaactcaagatcaagaccttttatgcgttgacagcctctcaagacccatggtcacacctggcagcttctggtagtggggcaaaagggttgcttgtgctggctcattttcctttagagctttccctttctgcacacatcccttttcttttcaaataaagcaaacccagagcacagggtctgatatgtgagtccacggggagtggactgtctgttcatctgtgctcagccacctctgcttcagcttcctctccataggctgagcagagatgtggtcagagtgaactcacattggaacagtacactcacggcaccctggagaggagcggtcactggttgctgagtgaattaaccgaatgtttgctgcttttctcctgcaacagttcattattcctccagcatgcctaggcagtggagagaatgtattttgcccaataataaaatgacatcctgcctctacttctcacctaatccccagtagtacccatgccaacaagccccacaccacctgacagcagcataggatgtgtcctttggagtcttccctgcagtttctgctcatagagtggaataagctcattggaacctttctaacaaaaagagatctggcataagatagatcctacttgtggtcgttatcccatcaagagaggtcagctgttaaagtccctgatagatcttattaaaaggtacacttgagctgtcagtggttccaagaatccatgacatgaaccctgttttgtatgcgacactttcatttagcgggctcctgtttcttcagctttcatatccttgttggcattgataccctgatacagaacagtccgcgctctgagcagggcagttatggccagcattgtcacgggcaggccagctcatggcacccagagcagccaggtggacccaccttggtttactgaactttttgtaaccatgggggcaagcagaaaaccccgctgcatttcagccagtgctgccaggtgttccctccatgggaaggtgctgctcaacctgaatgtgacttcctctttcttctttctataatgatgcagaatgctgaaattcttcagggtcctgattttgactgtcatttctcactgagcttttactgcagacaaaagaagtttcatttttagttaaatttgcactgctcctgggacatacatggatgcatttatttattcatccattttaatgtctcgatgtgaacttgtttttaaagcaggctaccaggcagttaatcaaacactcgggttaatcaagggttaataaaagcagggacttgatgtttaatgggacaggcattctctcagcatcactagattcaataatgctgcactattaaattttgctgcacatgaagttcagtgcatgttccattttctagactttggcagtgcctgtggtcagtgaccgggactgatgagcagccacatgcctgcactagggtggctctggggtggtgcatgctgcagtctggctggcacaagcctagctgaagagaagtactgctttaggcttggatgtggggatacctagatgtcaagggcagaactccatctagaatgcctggggatgagatgcaaaagctgatagtgaatggaacagtttccaatgtccaaaagcttgctaatctgggatcaaaccagcctgtgttgatgttagttttgctttgttttgagacacggtctccctctgtcacccaggctggtacattctcggctcactgcaacctccacctcacaggctcaagtgatcctcctgcctcagcctcccaagtagctgagactagaggtactagccaccacactcaactaatttttgtattttttatagagatggggtttcgccatgttgcccaggctggtctcgaactcctgagctcaaccaatctgcccgcctctgcctcccagagtgctgggattataaaagtgagccactgtgcctggcctgttttgtttttaataaggttttttgtttgttttgttttgtttgagacaggatctcactctgtcacccaccttggtgacagcctcgacctcctgggctcaagcgatcctcccacgtcagcctcccaagtagctgggactacaggcatttgccaccatgcctgactgatttttttatttttatttttgtaaagatgggtttcgccatgtttccaggctggtctcgaactcctgagctcaagtgatcttcctgccacagcctcccaaaatgctgggattacagacatgagccatcttgcctggccattgtatttgtcctcgttttcagtactcttctgcctcactgagaggtctcagagtctgctgtgtggtttcagcagtacccatgggggctgtgtaacattgaagctgattcaaggagtttgcccttaggttaccaggggttaccgcattccctgaggaatgctgagcggccatccagtctgattaaccgaggttcctacttctctgccacttcctttctctataattcttactcgctcgctctctctttttttttttttattatactttaagttctagggtacatgtgcacaacgtgcaggtttgttacatatgtatacatgcagctataaaaaaggatgaattcttactctctcttgaggcacagtgtcctcacctgcaaaaggtggataaaaatagtctttgcccccaggagtgttgtgaggaataaatgagagaatgtgtgtgcaacactcagtgcacagtcagagctcagtaaggggttaaaactctgaaaagggaaaatctgcttgtgatcctgcagcaaagggcgaaggacggcatgtgggccacaccgccacatctaggtacactgcttgtgctgggcatattcattcattgtattaattgctacgtggctgaaagtaaaaacttttaaaaagccataattggccgggcacagtggctcatgcctataatcccagcacgttgggaggccgaggcaggtgaatcacctgaggtcaggagttcgagaccagcctgaccaacatggagaaaccccgtctctaccaaaaatacaaaatttgccaggtgtggtggcgcatgcctgtaaacccagctacttgggaggctgaggcaggagaattgcttgaacctgggaggtgggggttgcagtgagccaagatcgtgccattgcactccagcctgggcaacaagagcaagattccatctcataaataaataaataaatagccataattaacttcactgtttccttgtaatatttcacttgggtttgcaaggatgtatttttctcctcttgctaatcttaacttcctgtatttccatttttcccaattgatgatcagtacaactagtttgccatttgcatctgagtcagagcagtgctagcgatcaaaagccgccctggggaacctggaattgtttcattctcagtgggagcgacacgtgtcctggcatctgagccttccgagtgaggggagtgagtctggccatcaggctggggttgagggacacagggtgccttgagcctggctttcgtgccttcagagccacagtgccaatgatgggagtggtggcttggtgtggcgtaactgtaccaccataccttgatggtagaatgcagtcctggaatatatacattcagggtctttctttcatcgcttctcaagagaggggtttcagtctcccgatcctgagctggtctgagtgccagcaaacaaagtcatcacttttgtgcctgtggtctcccaaggagcacaggatttccaaggaaattgacggatgagaaatcatgggggtggtggagcttagaaagcttatttcattagtaaatggtttgaaccgtcaaggtccagctgtggtttccactgatggaggaacaggaagaagaggagccttgacatttatctcaagcgccagcagcttctcttggatcaggaagacataaaagtccaatgtcatcttcaatttgtgcaggctccccttggagttgcagagccagtgaagtgaagtagaacagttaaaaaaacacccggggaagtgataaatcacagagagagattgcatatgcgggaaaggtgtctcccacaattaaaacaagtggccagagcctccctggcgacctctggtctgcattgccagccctgaagatggctcctaaattacttaagtttaataggtagttaatatagccaaccctccttatgaccccagtgggctgaatggctctgcttgctttaggaactgggcgttgtatggtagagcatcttggccttgacataaaaggtagcatactggctccccagccctgaaccttccctgctagagcaaggcaggggtgagagggggaaggaaagaaaaaggagtggggagtggggtggggagcaaggattaacagggagcagtagcagcaccagatgtgggcatagcacactgggaagaaattgcagtggcgatctgaactcttcctctccgcctcctggctctgtggaagcccagggaaggcattaggaactgcaggctgctcttagtgctcctcccggatgggacaccttgggctcatccctgaaggccactcctaccactctcacacactgagttcctggtgtctcgtaactgttgagagcttagttttcttgcttgtttctggtagctctagatagaagactgtatcggcctcttctaaaagtcaacaagccaatcctgtttttggttaagagactttacctggtcaagcagttgttctttgggaggtgttgaagagcctacaaacctgccttgcctgcctaggtactttaccaccatttggagatgcctgaggatattaccaggccttatttgaggcagtaaaacaccctgttcggcccctcggcactgaagatgtgtttcagtgcagctctcctcggcaccggattcgttgctgcaacagtgggagggaagagccagatgcaaactcgttctgcgagcccgaggttctgttctcatgatccttgctgtgatttctcttttgatgttggcaattttaaaatgacatcagtctatctggacctttttcctaaggctcttgctcagaccactcagtagatagccgccacctgcccagtgaggtgaatcaggcccattaggccatttgtcaggggaaggaacagaggagcagcggagggccccgccggccagtgccacagggcagcctgcaaagcaggtagacaggttttcaggcagcttttgctgctttgggtccctcagggattaatacacaaaaagggccccttgggtattcagtggcagatttctcttgagagcagataaagtcgctaataacaaattggatttgttcattggggtggacttggcctttcgttccacctctgtgtaggataagtgtgtggatagtgctcccactgtgcacatcaccatatggcatttgggtgcagctgtccctagccagactgcagaaaagcttgatctgggccggacgcggtggcttatgcctgtaatcccagcactttgggaggccgaggcaggcggatcacgaagtcaagagattgagaccatcctggccaacatggtgaaaccctgtctctactaaaaatacaaaaattagctgggcgtggtggcatgcgcctgtagttccagctactcaggaggctgaggcaggagaatcacttaaacccaggaggcagaggctgcagtgagcggagatcgcgccactgcagttcagcctggcaacggagtgagactccgtctcaaaaaaaaaaaaaaaaaaaaaaagagaaagtaaagaaaagcttgatctggccacttagtacagccatccccctttactggcccttcctctttgcttatttggaagggggaaggtttcccacaccccaaaccaaagattcttttggaatttgctgctgctggattcagctgtcacctttctgctctgagtctgctttctccctgtggatccggtgccagaggatctgcacgtccttttgtgtctacaccctcccccgctccttcgttttcaatatgtagtagtggagaggaagtgtaacatgattttagggctcacatttcaattccactgcatttttatgggacaagcagagacccagcgcctggagttattaggttagtatctaaaatgggttcagtactgtgagtcttattgtttaaaatgaatgagatggtcccctcctaccttcttttctcctcccctgggatgagtggattgaggcaaggcccccagagactagttgaaggaatcctggtgctctgattagttttgttccccagcttaattgtacagcttcctttctctcaccactgatagccaaagtagctctgtgtctcccccaaccttcccttgctttaggaacaagatgatcacaatgcagccttgtgaatcaattttctgtctgtgctgatgaaagtgtaattcattcttaatcaagcagccttgctgctgcaggctccgtgccggaatacatttagttaccctcccatcactttgggaaacgatcccccaaaagggcttttagaggagagctggaaggagagttggccgtgcgcctcatgctgtggttttccagcagggggcactcaggaacgatgctggcggaggctttgtagctggaagccgtctgctgctggcagggcagcaggagaatgtttgtcacaggtgccttccaggcttgctttctccagaccctggggccatttctcagaagtaccctaatgggccacccaaaatcctcaggtagcagtgaggaggaacagttgaagatgcagattgcatgcctgggttagagagtgccggctgggtaccaggttcttttagccagcctcttctgtctttttaagtagacagatgtgtctcctgaatctgaacttgtttagattgggtggatgtgtctgtttttgtcacaccacacacaatttggggagcgtaaggaggcccagctctgccagaatggaactctcctaagttctcccctgccgtctcacagcctgctggctgtcacaaacagctggcagttttatggacaagtgggcaggggaaaagggaccctgccggggctgagtctcgatgttgggcaggaagtaaaagccaggacccaacaagtggatcagaggggggatgtgaagatgaacagtcagatagcaataaagcctcatagatctgccccagagaaagaaaaggaagttcgtctcctcagaatggaattggattagtgacagacttgagcagccggttcagtcgagagagaacttaattcctcctgtgttattcacacggctgattctaatcagatgtgaagagacagctggaggagagcagcgggtcagcccatgcctggtgcggaggcttcatgttcttgtaggcatcttcagggaactggcaggagcgctttgggttggagactctgagcagggcccttgggtttatagcctgcccaaggaactgggcctggctgcgggactcccatggttggaccttgtctagattcagtgaaagttttgaaggacagtgcatgacagacgtcactggtcaggttcaccagagcttggctcacttgtcttcagaaggattcaaaggcagttgaccagacttggcaagtcccagactggtgcagccactgtcctcgagaccctggttgtacaccctgaggtgcttctgcttcattacctgctgaaatttggagacctcttcttcctggataaccttcaagatactcattgtgcatgcgaggaattccccgccctcctggggggactccactccccaggcaggcaaggttgggcaaggggagggctgttgctggattgccaaagggagcatggacatttttgtttggaattcagggtgggaatgggactcaccagagtggcttcagtgctcaactcacagtgcaacataggacaaggtgaaggccttcttgggaggcctcttctggctctagcaagcaggtgttgctgggcagtgtagagggacccaggccggttgctgagcaggaagatgtacctaacactgatgggcctgcacaccttagggtatgagagcatcgcaggggaaccaggaaacttgttagctggttttcatgtgtttaaaaagaagactcggaggcagagtttattttatgaagggctagctttttgccatttcttctgagcttttgccttttcctttatgaatacttcctgcctatgggtgtactgtaaatgtaacagccagtgagctttctagaagcagcagatggtgaaagatccacaggtgaggagcctgcccactggaggggcgagacagtgcccaggcagggcgtgcaggtggcagagctgtttgcatgctccgcggggtggcttcccaagctctctgtagaaaaactgcctgagggcaaatggctccactgagctgctacctgcaggaaagaagctcaagggctctcctcgtctcactgcctgccttcttcacctgctgggaggagggcattgtggtgtctgagataaaggatacccccaaggtggaagcagagccatgggggtggcctccagcagcagggaggagcattgtgcagtaaattctgactccggggctcctgtggggattggaacccataggaattgcacaatgagggtaaaggatggggcggcagcagccaggtctgtctaaggggcgagcagcagtggccgaaggctcccagggccctcgggcagcagcccttgctgaccagtgcagccaggtcgtggctgcctccagctggtgggtctgccttcccctctgaccgcctcagtgccttctggaggactgtggctctctctcctgcccagtggctgtggtgccttcctacttctgtgtgggcagactgatttccctctctacctttacttgtggctgaggcgaagctcctgctcttgcaagataagaggtggggctgaggcgctgcagtgcagctcaggtggggctcaggaagcaccccacccaccccagagcactctgcatcctaataagcacatgctcgagtcactggaatctggtgctgctggcagtgccagaaccctcccctagcacctcgaggggacagccagcatgctcctcgggtggaggatccaggaattcttggagccaacattgcacaaatgggcaggagcctctcaaggcccccacagcctgggctccctgcctggggaagtggccaggcttcataggggcatcacttggcccgcctggtaggcatggaggccagtgccatacgtgaccttgttgttgcctgcaccccttcctaacgagcaccctgctccccactggaaggagaggggccagggctcctccctccccagggaggggagaaacgtgatgttgctattagcaataacagctgccgagttcccaccatgcgccaggtgcagtgttgagtgcatcacacgcggttcccaattcctctgcctgtcaccccacgaggaaggggctgccatcacgcccgcttcacagtgaggaactgaggctagaggggagcaagtgacctgcccagggccacacagctggtcagtggcccagctgggccttgcaccaggcagctgactgtgcctgtatctgactcaaagtggctgttcttttcagaaacctgagcggagatactgggctcacatgctttcatttaaaccctctctcatttttgccccagtagttatctggcagctaaatctcttcctcctttcttccccagtgaccattctggttcccatcatcacagggcacataactcctggcccttctcctctgattacatttagggagaagcccatcctgatgcagctcccttctagagggagttccatttaggcaaaaaagcgctctccattcccatcagaaccgggctttccaaagggctctgaaattggttccactgaagaaggcagctgagctgcctccccacattccgcttgttagtcgggaacttcaaggccaaaagatttggcaggatttaaagagttgctctcaagctgtctcattctgagcacactaatgctgtctgtcttctgatggtgaagtggtgggtttggagtctccctcccctgccctttatggagccgccgatagtaccgaggactcttcacatgcagactcgaggggtccagagaatgggccagaccatcttgcctgccccatggcaacctccagaggaaagaggctcagagaggtcaggggtgtctgcagtgagctgctgatggcagagagtgagctctcggaccttctcagccgggtgtggagctcttgcctctcccgcgaacctcagtttagttatcttcatagcccacgtcctggtcgcttaacaaacattgagctcctgatcggcacataacactaagccagatatttgggggatatgaagatgaatggtacagactccctcccctccacccccgcactcctgtgggaagtcccggagctggaaatggaacacagtcacacccaaggcattgatttcaggagtcagcagagagcagggagtagggagagtgctggctccagatgcttctatccagggagatgctgggaagtggcccagagtcaagggcttaggaggttgcaaacctcactatgccaagagctcggtccctgatccaccccatccccttccacatctccctgactgtccttctttacatttgctgggcagagtgccacctgtgtgcaccagccctccctgcctgcacaagccacactgagaaagccgttgcctccagctcatggagagaaacaccttctcagctgccacgtcatgagcaagtttgcttcgggaccacctgggaaaccaggagtagaaggggtaaactcttcctcatctgccacaggcctgccttgcctcaggccacgtcaccttaccccagccatgttgccagggcatgaggactaagatgcttgccctgccaagcccggaggggatgagcagcctcagctggtgccgccacagacagcacaccacagaggtggctcagggaccttggtagatgggaatgtgagaatctattaaaataggcagggatctccggtcctctgtcaagaggcaatgctgacggctttttcctgctggcgtgcctctgcccaccagccttccccttgcacatcctcatttgtcacctcctaatttgaattattgggcaaatctggccgcttatttgggactgacagccaacttcttgagcatctatttgaacagccttccctttcgctcccagccacctttgaggtgagtccaagtggcaggacaggaccctgtgtgacagagcggaggtcttgtgccctctcagcttcttctctgctttcttacagctcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcattgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctgtttctgtttctgttttttttttgagatggagtctcgctctgtcgcccaggctggagtgcagtgtcacgatctcagctcactgcaacctccgcctcccaggtacaagagattctcctgcctcagcctcccgagtagctgggactacaggcgtgtgccaccatgcctggctaatttttgtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctggaaaata

SEQ ID NO: 30641 - DNA, 17162 bp, Homo sapiens
agtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaaggtacccagggtctctttcttgtattttgctgatcaggaccatcattaatgaaatgtgcggttggcatctggtttcctcagtagccaagtcactagactattggcatcttttgtatgtacttagttgaggaaattttttaacttatgccagaaagggaatttaatctgccaatgactatgaacccattggctggatggaagttgagcttgtgttaaaagctctgatgtaatgaacccctgttacagggtggattttgagccctcatttagcagtaaagcataatgcccttttaagccaaggggtgttatacccagggagctgccttactttatgagaaagcagaatgaaatggaggctattgagaatggactttccctctagtcttgtggtgtctttaagtggcaaggactataaaaccaaactgaatttttaacttttttcatacttaaaaggaagtgtctaggaaagaacctctttgttttaaaagagaagactttattactttgcaaatggtttcatatctttctctactggtattttgagctttcagcattgtcgagattcagaagctaaattccatactaattatcagcccaagagcatacctctctcatttgggccaagcagaagggtcctctcataccaaataatgctctgctcttaactgatagcccaggaccaggttaacacctataaaataggtgttattaagataagactgtccattgagtttaggtgatactgatacagttaattttttattctttacctcagtctttaaaataggcttccagttttatggactgtctctgtttttagtggttaagctgtatctgaaaactccaggggatctgtttctgcctgccttcgttgttgggtacagtaggcagccctgacttctacctctcgactccagtcacaactggcaccgggtagagaattccttttaatagtgcaacctagaaggaaaggcatttccacattccacattcttctttcctctggcttctgtaatttactgggcttcccttccaaaacaaaattattaaacagtaaaggggagttcaagggaggcctcggtcattaaggaaagaggtaaaacgatggctgagccagtgagccagtcagcccttaaatgaactgcctcagacaccccatctcaccccttacccccagccttgtcatctgggtcccaggaacagtctcaccatttccactgctgctgcaatgagcagtgccctcagccacagaaacctgcagtgtgagagctggagagaccccgttccaagccattaaaacaaacaaaatcactcatcacgatttcaggcctatccaagcattttgcagatggcacttatggcattgttgatatcacagggtatgtttttgtttttcttcattttattttgctggtttagcctcaagcccaaggcagaagacctatctgcatttgagccctcaaagtaggttgttcccaggtactctctatgtggtgatggtgctgccctctgtgatactaacccgtgcatgagcttgcctgtctctgtcctcgggccacactgagcccttacgagggcaggtggtgcctgggtactggccgcagcatgctttgagtctaaaagtaggcacccaccctgtgaagccagaccagcctccagggccccagaagactgcctcgttccgaagagcatgtcatggggctgtaggaccagccattcttcccatctcgggtcattgttgggctggggaaggttatggcttcttgtccagtcaggtgtgtctaaaagtcctttgtcttggtggcatactcctagcatggaaatggggtcaatctgggcactttggagactggtgtgtttaactcaagatcaagaccttttatgcgttgacagcctctcaagacccatggtcacacctggcagcttctggtagtggggcaaaagggttgcttgtgctggctcattttcctttagagctttccctttctgcacacatcccttttcttttcaaataaagcaaacccagagcacagggtctgatatgtgagtccacggggagtggactgtctgttcatctgtgctcagccacctctgcttcagcttcctctccataggctgagcagagatgtggtcagagtgaactcacattggaacagtacactcacggcaccctggagaggagcggtcactggttgctgagtgaattaaccgaatgtttgctgcttttctcctgcaacagttcattattcctccagcatgcctaggcagtggagagaatgtattttgcccaataataaaatgacatcctgcctctacttctcacctaatccccagtagtacccatgccaacaagccccacaccacctgacagcagcataggatgtgtcctttggagtcttccctgcagtttctgctcatagagtggaataagctcattggaacctttctaacaaaaagagatctggcataagatagatcctacttgtggtcgttatcccatcaagagaggtcagctgttaaagtccctgatagatcttattaaaaggtacacttgagctgtcagtggttccaagaatccatgacatgaaccctgttttgtatgcgacactttcatttagcgggctcctgtttcttcagctttcatatccttgttggcattgataccctgatacagaacagtccgcgctctgagcagggcagttatggccagcattgtcacgggcaggccagctcatggcacccagagcagccaggtggacccaccttggtttactgaactttttgtaaccatgggggcaagcagaaaaccccgctgcatttcagccagtgctgccaggtgttccctccatgggaaggtgctgctcaacctgaatgtgacttcctctttcttctttctataatgatgcagaatgctgaaattcttcagggtcctgattttgactgtcatttctcactgagcttttactgcagacaaaagaagtttcatttttagttaaatttgcactgctcctgggacatacatggatgcatttatttattcatccattttaatgtctcgatgtgaacttgtttttaaagcaggctaccaggcagttaatcaaacactcgggttaatcaagggttaataaaagcagggacttgatgtttaatgggacaggcattctctcagcatcactagattcaataatgctgcactattaaattttgctgcacatgaagttcagtgcatgttccattttctagactttggcagtgcctgtggtcagtgaccgggactgatgagcagccacatgcctgcactagggtggctctggggtggtgcatgctgcagtctggctggcacaagcctagctgaagagaagtactgctttaggcttggatgtggggatacctagatgtcaagggcagaactccatctagaatgcctggggatgagatgcaaaagctgatagtgaatggaacagtttccaatgtccaaaagcttgctaatctgggatcaaaccagcctgtgttgatgttagttttgctttgttttgagacacggtctccctctgtcacccaggctggtacattctcggctcactgcaacctccacctcacaggctcaagtgatcctcctgcctcagcctcccaagtagctgagactagaggtactagccaccacactcaactaatttttgtattttttatagagatggggtttcgccatgttgcccaggctggtctcgaactcctgagctcaaccaatctgcccgcctctgcctcccagagtgctgggattataaaagtgagccactgtgcctggcctgttttgtttttaataaggttttttgtttgttttgttttgtttgagacaggatctcactctgtcacccaccttggtgacagcctcgacctcctgggctcaagcgatcctcccacgtcagcctcccaagtagctgggactacaggcatttgccaccatgcctgactgatttttttatttttatttttgtaaagatgggtttcgccatgtttccaggctggtctcgaactcctgagctcaagtgatcttcctgccacagcctcccaaaatgctgggattacagacatgagccatcttgcctggccattgtatttgtcctcgttttcagtactcttctgcctcactgagaggtctcagagtctgctgtgtggtttcagcagtacccatgggggctgtgtaacattgaagctgattcaaggagtttgcccttaggttaccaggggttaccgcattccctgaggaatgctgagcggccatccagtctgattaaccgaggttcctacttctctgccacttcctttctctataattcttactcgctcgctctctctttttttttttttattatactttaagttctagggtacatgtgcacaacgtgcaggtttgttacatatgtatacatgcagctataaaaaaggatgaattcttactctctcttgaggcacagtgtcctcacctgcaaaaggtggataaaaatagtctttgcccccaggagtgttgtgaggaataaatgagagaatgtgtgtgcaacactcagtgcacagtcagagctcagtaaggggttaaaactctgaaaagggaaaatctgcttgtgatcctgcagcaaagggcgaaggacggcatgtgggccacaccgccacatctaggtacactgcttgtgctgggcatattcattcattgtattaattgctacgtggctgaaagtaaaaacttttaaaaagccataattggccgggcacagtggctcatgcctataatcccagcacgttgggaggccgaggcaggtgaatcacctgaggtcaggagttcgagaccagcctgaccaacatggagaaaccccgtctctaccaaaaatacaaaatttgccaggtgtggtggcgcatgcctgtaaacccagctacttgggaggctgaggcaggagaattgcttgaacctgggaggtgggggttgcagtgagccaagatcgtgccattgcactccagcctgggcaacaagagcaagattccatctcataaataaataaataaatagccataattaacttcactgtttccttgtaatatttcacttgggtttgcaaggatgtatttttctcctcttgctaatcttaacttcctgtatttccatttttcccaattgatgatcagtacaactagtttgccatttgcatctgagtcagagcagtgctagcgatcaaaagccgccctggggaacctggaattgtttcattctcagtgggagcgacacgtgtcctggcatctgagccttccgagtgaggggagtgagtctggccatcaggctggggttgagggacacagggtgccttgagcctggctttcgtgccttcagagccacagtgccaatgatgggagtggtggcttggtgtggcgtaactgtaccaccataccttgatggtagaatgcagtcctggaatatatacattcagggtctttctttcatcgcttctcaagagaggggtttcagtctcccgatcctgagctggtctgagtgccagcaaacaaagtcatcacttttgtgcctgtggtctcccaaggagcacaggatttccaaggaaattgacggatgagaaatcatgggggtggtggagcttagaaagcttatttcattagtaaatggtttgaaccgtcaaggtccagctgtggtttccactgatggaggaacaggaagaagaggagccttgacatttatctcaagcgccagcagcttctcttggatcaggaagacataaaagtccaatgtcatcttcaatttgtgcaggctccccttggagttgcagagccagtgaagtgaagtagaacagttaaaaaaacacccggggaagtgataaatcacagagagagattgcatatgcgggaaaggtgtctcccacaattaaaacaagtggccagagcctccctggcgacctctggtctgcattgccagccctgaagatggctcctaaattacttaagtttaataggtagttaatatagccaaccctccttatgaccccagtgggctgaatggctctgcttgctttaggaactgggcgttgtatggtagagcatcttggccttgacataaaaggtagcatactggctccccagccctgaaccttccctgctagagcaaggcaggggtgagagggggaaggaaagaaaaaggagtggggagtggggtggggagcaaggattaacagggagcagtagcagcaccagatgtgggcatagcacactgggaagaaattgcagtggcgatctgaactcttcctctccgcctcctggctctgtggaagcccagggaaggcattaggaactgcaggctgctcttagtgctcctcccggatgggacaccttgggctcatccctgaaggccactcctaccactctcacacactgagttcctggtgtctcgtaactgttgagagcttagttttcttgcttgtttctggtagctctagatagaagactgtatcggcctcttctaaaagtcaacaagccaatcctgtttttggttaagagactttacctggtcaagcagttgttctttgggaggtgttgaagagcctacaaacctgccttgcctgcctaggtactttaccaccatttggagatgcctgaggatattaccaggccttatttgaggcagtaaaacaccctgttcggcccctcggcactgaagatgtgtttcagtgcagctctcctcggcaccggattcgttgctgcaacagtgggagggaagagccagatgcaaactcgttctgcgagcccgaggttctgttctcatgatccttgctgtgatttctcttttgatgttggcaattttaaaatgacatcagtctatctggacctttttcctaaggctcttgctcagaccactcagtagatagccgccacctgcccagtgaggtgaatcaggcccattaggccatttgtcaggggaaggaacagaggagcagcggagggccccgccggccagtgccacagggcagcctgcaaagcaggtagacaggttttcaggcagcttttgctgctttgggtccctcagggattaatacacaaaaagggccccttgggtattcagtggcagatttctcttgagagcagataaagtcgctaataacaaattggatttgttcattggggtggacttggcctttcgttccacctctgtgtaggataagtgtgtggatagtgctcccactgtgcacatcaccatatggcatttgggtgcagctgtccctagccagactgcagaaaagcttgatctgggccggacgcggtggcttatgcctgtaatcccagcactttgggaggccgaggcaggcggatcacgaagtcaagagattgagaccatcctggccaacatggtgaaaccctgtctctactaaaaatacaaaaattagctgggcgtggtggcatgcgcctgtagttccagctactcaggaggctgaggcaggagaatcacttaaacccaggaggcagaggctgcagtgagcggagatcgcgccactgcagttcagcctggcaacggagtgagactccgtctcaaaaaaaaaaaaaaaaaaaaaaagagaaagtaaagaaaagcttgatctggccacttagtacagccatccccctttactggcccttcctctttgcttatttggaagggggaaggtttcccacaccccaaaccaaagattcttttggaatttgctgctgctggattcagctgtcacctttctgctctgagtctgctttctccctgtggatccggtgccagaggatctgcacgtccttttgtgtctacaccctcccccgctccttcgttttcaatatgtagtagtggagaggaagtgtaacatgattttagggctcacatttcaattccactgcatttttatgggacaagcagagacccagcgcctggagttattaggttagtatctaaaatgggttcagtactgtgagtcttattgtttaaaatgaatgagatggtcccctcctaccttcttttctcctcccctgggatgagtggattgaggcaaggcccccagagactagttgaaggaatcctggtgctctgattagttttgttccccagcttaattgtacagcttcctttctctcaccactgatagccaaagtagctctgtgtctcccccaaccttcccttgctttaggaacaagatgatcacaatgcagccttgtgaatcaattttctgtctgtgctgatgaaagtgtaattcattcttaatcaagcagccttgctgctgcaggctccgtgccggaatacatttagttaccctcccatcactttgggaaacgatcccccaaaagggcttttagaggagagctggaaggagagttggccgtgcgcctcatgctgtggttttccagcagggggcactcaggaacgatgctggcggaggctttgtagctggaagccgtctgctgctggcagggcagcaggagaatgtttgtcacaggtgccttccaggcttgctttctccagaccctggggccatttctcagaagtaccctaatgggccacccaaaatcctcaggtagcagtgaggaggaacagttgaagatgcagattgcatgcctgggttagagagtgccggctgggtaccaggttcttttagccagcctcttctgtctttttaagtagacagatgtgtctcctgaatctgaacttgtttagattgggtggatgtgtctgtttttgtcacaccacacacaatttggggagcgtaaggaggcccagctctgccagaatggaactctcctaagttctcccctgccgtctcacagcctgctggctgtcacaaacagctggcagttttatggacaagtgggcaggggaaaagggaccctgccggggctgagtctcgatgttgggcaggaagtaaaagccaggacccaacaagtggatcagaggggggatgtgaagatgaacagtcagatagcaataaagcctcatagatctgccccagagaaagaaaaggaagttcgtctcctcagaatggaattggattagtgacagacttgagcagccggttcagtcgagagagaacttaattcctcctgtgttattcacacggctgattctaatcagatgtgaagagacagctggaggagagcagcgggtcagcccatgcctggtgcggaggcttcatgttcttgtaggcatcttcagggaactggcaggagcgctttgggttggagactctgagcagggcccttgggtttatagcctgcccaaggaactgggcctggctgcgggactcccatggttggaccttgtctagattcagtgaaagttttgaaggacagtgcatgacagacgtcactggtcaggttcaccagagcttggctcacttgtcttcagaaggattcaaaggcagttgaccagacttggcaagtcccagactggtgcagccactgtcctcgagaccctggttgtacaccctgaggtgcttctgcttcattacctgctgaaatttggagacctcttcttcctggataaccttcaagatactcattgtgcatgcgaggaattccccgccctcctggggggactccactccccaggcaggcaaggttgggcaaggggagggctgttgctggattgccaaagggagcatggacatttttgtttggaattcagggtgggaatgggactcaccagagtggcttcagtgctcaactcacagtgcaacataggacaaggtgaaggccttcttgggaggcctcttctggctctagcaagcaggtgttgctgggcagtgtagagggacccaggccggttgctgagcaggaagatgtacctaacactgatgggcctgcacaccttagggtatgagagcatcgcaggggaaccaggaaacttgttagctggttttcatgtgtttaaaaagaagactcggaggcagagtttattttatgaagggctagctttttgccatttcttctgagcttttgccttttcctttatgaatacttcctgcctatgggtgtactgtaaatgtaacagccagtgagctttctagaagcagcagatggtgaaagatccacaggtgaggagcctgcccactggaggggcgagacagtgcccaggcagggcgtgcaggtggcagagctgtttgcatgctccgcggggtggcttcccaagctctctgtagaaaaactgcctgagggcaaatggctccactgagctgctacctgcaggaaagaagctcaagggctctcctcgtctcactgcctgccttcttcacctgctgggaggagggcattgtggtgtctgagataaaggatacccccaaggtggaagcagagccatgggggtggcctccagcagcagggaggagcattgtgcagtaaattctgactccggggctcctgtggggattggaacccataggaattgcacaatgagggtaaaggatggggcggcagcagccaggtctgtctaaggggcgagcagcagtggccgaaggctcccagggccctcgggcagcagcccttgctgaccagtgcagccaggtcgtggctgcctccagctggtgggtctgccttcccctctgaccgcctcagtgccttctggaggactgtggctctctctcctgcccagtggctgtggtgccttcctacttctgtgtgggcagactgatttccctctctacctttacttgtggctgaggcgaagctcctgctcttgcaagataagaggtggggctgaggcgctgcagtgcagctcaggtggggctcaggaagcaccccacccaccccagagcactctgcatcctaataagcacatgctcgagtcactggaatctggtgctgctggcagtgccagaaccctcccctagcacctcgaggggacagccagcatgctcctcgggtggaggatccaggaattcttggagccaacattgcacaaatgggcaggagcctctcaaggcccccacagcctgggctccctgcctggggaagtggccaggcttcataggggcatcacttggcccgcctggtaggcatggaggccagtgccatacgtgaccttgttgttgcctgcaccccttcctaacgagcaccctgctccccactggaaggagaggggccagggctcctccctccccagggaggggagaaacgtgatgttgctattagcaataacagctgccgagttcccaccatgcgccaggtgcagtgttgagtgcatcacacgcggttcccaattcctctgcctgtcaccccacgaggaaggggctgccatcacgcccgcttcacagtgaggaactgaggctagaggggagcaagtgacctgcccagggccacacagctggtcagtggcccagctgggccttgcaccaggcagctgactgtgcctgtatctgactcaaagtggctgttcttttcagaaacctgagcggagatactgggctcacatgctttcatttaaaccctctctcatttttgccccagtagttatctggcagctaaatctcttcctcctttcttccccagtgaccattctggttcccatcatcacagggcacataactcctggcccttctcctctgattacatttagggagaagcccatcctgatgcagctcccttctagagggagttccatttaggcaaaaaagcgctctccattcccatcagaaccgggctttccaaagggctctgaaattggttccactgaagaaggcagctgagctgcctccccacattccgcttgttagtcgggaacttcaaggccaaaagatttggcaggatttaaagagttgctctcaagctgtctcattctgagcacactaatgctgtctgtcttctgatggtgaagtggtgggtttggagtctccctcccctgccctttatggagccgccgatagtaccgaggactcttcacatgcagactcgaggggtccagagaatgggccagaccatcttgcctgccccatggcaacctccagaggaaagaggctcagagaggtcaggggtgtctgcagtgagctgctgatggcagagagtgagctctcggaccttctcagccgggtgtggagctcttgcctctcccgcgaacctcagtttagttatcttcatagcccacgtcctggtcgcttaacaaacattgagctcctgatcggcacataacactaagccagatatttgggggatatgaagatgaatggtacagactccctcccctccacccccgcactcctgtgggaagtcccggagctggaaatggaacacagtcacacccaaggcattgatttcaggagtcagcagagagcagggagtagggagagtgctggctccagatgcttctatccagggagatgctgggaagtggcccagagtcaagggcttaggaggttgcaaacctcactatgccaagagctcggtccctgatccaccccatccccttccacatctccctgactgtccttctttacatttgctgggcagagtgccacctgtgtgcaccagccctccctgcctgcacaagccacactgagaaagccgttgcctccagctcatggagagaaacaccttctcagctgccacgtcatgagcaagtttgcttcgggaccacctgggaaaccaggagtagaaggggtaaactcttcctcatctgccacaggcctgccttgcctcaggccacgtcaccttaccccagccatgttgccagggcatgaggactaagatgcttgccctgccaagcccggaggggatgagcagcctcagctggtgccgccacagacagcacaccacagaggtggctcagggaccttggtagatgggaatgtgagaatctattaaaataggcagggatctccggtcctctgtcaagaggcaatgctgacggctttttcctgctggcgtgcctctgcccaccagccttccccttgcacatcctcatttgtcacctcctaatttgaattattgggcaaatctggccgcttatttgggactgacagccaacttcttgagcatctatttgaacagccttccctttcgctcccagccacctttgaggtgagtccaagtggcaggacaggaccctgtgtgacagagcggaggtcttgtgccctctcagcttcttctctgctttcttacagctcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcattgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctgtttctgtttctgttttttttttgagatggagtctcgctctgtcgcccaggctggagtgcagtgtcacgatctcagctcactgcaacctccgcctcccaggtacaagagattctcctgcctcagcctcccgagtagctgggactacaggcgtgtgccaccatgcctggctaatttttgtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctggaaaata

SEQ ID NO: 30642 - DNA, 3794 bp, Homo sapiens; identical to SEQ ID NO: 6283

SEQ ID NO: 30643 - DNA, 1444 bp, Homo sapiens
gtgtttatgtattggctgctactagtcgccctgacttgattgaccctgccctgcttaggcctggtcgactagataaatgtgtatactgtcctcctcctgatcaggtgacaatttcatatttagagtccaaaacccaacaaatgctacactctttccttgtgagctttacttctgccaggtaatggcaattgtccttagaagaccagctttcttagggaaaagctttagccactgtttgctcaaagcataaaaagattctgaattagatgcaaagcctttttttggcccagtgcaagtctgaaaactttgtaatccttctgtgttggctgattggggaaaaaaaaatgcaagaaacctaatgtattatattttcacattatcttctgttcaaagattacatacttccattatcctgtcaaaaaaaaaactctgatacagaatcaagcatgtgaatcgtaagcatgtaagcaggtttcatagagataatttttcaactcttccttgtcctgtgttgttccaactcttattctccaatttagaagcaaacaaataaatgaatgaaagaacagatagacaaatgaatagtcaaaggtataaagtatctgtatatatgttacatgtagctattatttaaattatttagattttccttttgaaataccttcttggcacacttgcctaaatctagaaaataagcactgtgtgaataagaaattatttacactgaatattttgtaggtttttgggtttttgtttttcagacaaggtctcactttgtcacccaggctggagtacactggtacgatcacaactcactgcagcctctatggcccaggctcaagcaatctccccacctcagcctcccgagtagctgggaccacaggcacacgctaccatgcccagataattttattattaatttttgtatagagatggggtctccctgtgttgcccaggctttcttgaactccagggctcaagtgatcctcccacctcaacctcccaaagtgttgggattacaggcgtgagccaccatgcccagccttaagagtgtttgattttcattcattttcctatatatattatttctgttggggaaaaaattccaaggaagataaatagtaggctgttggtacatttctcaacttacttataaagctttttagatatataaggttaatttatgaagaaaatcataagatacacaatttaagataatatttttaattttattttttatttgttaaataaatttttctcctttcaggtgtcacgtcttgaaattttaaatgtcctcagtgactctctacctctggcagatgatgttgaccttcagcatgtagcatcagtaactgactcctttactggagctgatctgaaagctttactttacaatgcccaattggaggccttacatggaatgctgctctcgagtggactccag

SEQ ID NO: 30644 - DNA, 1116 bp, Homo sapiens
gcctgagaacacccacaagtccactccagcgagctaccacgcagacatcaacctgctctactggagcgacgaggaggccgtggtggacttcaaggctgtgcagggccgctgcaccgtggagtatggggaggacctgcccgagtgcgtccaggtgtactccatgggcggccccaaccgcttctacttcctcgaggtggtgcccctgcttgctagagggaaggcttcggggtcaaagttggccagaaggagtctgatgtcgggttatacacaaggcggcttggctgcagggtttcagcttttgtaagaagtgggtggttggctgacgtgaagctgttctgcaggagctttacgggggtctgagcagggttctccagagcacaagttgtatgagattcaagtggtcccggagtttaacactcctggtttttaaaaagtacgtcattagagaacctaacgttttagtgtcttggtgcaactgaacgttgaggaccatgaggcagcttccaccagcctgactggtgtcttagtatgagttggagaaggtgcccctgctcctgggtcccttgggccaggcgcctacgtccaggcccagcccacatgcctgtgcgggtggccctcgttatggagagggcccacgagtcagctgatcaagctcatgacttgtaaattgttggggcttggcctttccgtgttgttaccttaaaacgatacatccacgttctcccaggcatggatgaggtagcccaattggacagcagattctgcatagcactttttcctgttctagaaggtactctcaagtgcttgtaataggcatttcagtgtcagccagatcaaatgttagtattaataaaatggattgttttaagtttctattgtagcaaagtcaaactactcttattggtggctaattggtcatggccccactgagggagaaattaagtgactatcaaattgccttcttactagtctgcgttagagaggggacagtgcgtttctctcccaaacgattgcagttctctccttttcaggcctataatgcaaagagcaaaagctttgaagatcctcccaaccatgcccgtagccctggaaacaaagggaagggcaagggaaaag

SEQ ID NO: 30645 - DNA, 2916 bp, Homo sapiens
gttcgatattgcaactccctggatgaggaagagaagagggagctgaagcttttcagcagccagaggaaacgcgaaaacttgggccgcgggaatgtcaggcctttcccagtcaccatgacaggagctatttgtgaacaggtaagcatggattcaggggagtgaagaggcattgttctggcatcttttcacccattcattcatccaacaattgttttactgagtgcctactatgtgcctgagatacagtagtgaacaaaagacgggaaagtttcatcttgcccttctaaggagttggattctaggggaggaagtcagacaatatatgtaatcaacaaaatagaaaaagatacagcaaggaaggagacttgaatgtactggaagtgtggggaggctgcagttttaaggaaggttgatggggaagaccccacttagaagatctgagcaaagatgtgcacagatgtgcaagagggagagagtcttgcagattttagggcagagggaatgctaaggcagaaggaatgaccggcttagaggccctgagacaggagggtgtctattatgttcaacagtgagttggccaatgggctggggcagagggagtgaagggagataattcagataaagtcagagttctgggtgagccattggaagaattgagcagagcaatggcatgatggatttatgttttaaaaagagacctttagaaaatggagttggcttgggccatgggtcagcctccctcccaggatcatcccagaacgagagccatttaaaggggaggtaaatgatcttctcctgagaattgagagttccttattgaagtgcatgaagcccttccgagtcatgttgacaggagctatttgtgaacaggtgagagtgggttcaggggagtgaagaggcattctccctgggacctcactgcgttcaagattctggatttcctgtctcctctgctcctgttgagtgctcagggtgtggtgaagaagagttttagagactgcagggtgggaacacaccttgccccacctctcagctgccacaggctttccagtgctgatcgtcattcttggtacttctctaagtcctacagctttttgaacattcctatctaactccttaagctctgcgtagaccccttgagagctgaagatatgttaactggatcaaagaagaggaggtgggatgctgcccaagggaagcagatgtcatttgaggcccttttttgagatttcagaggggtagagtgagaaggttcagttatatgggatggggtagctaattgaccagagatttggcagtgggatctttattcttatgaagtatatctgggacccacccttaaggtacaggtggtcagtggttgtgatctgagattcactgtgctccatccaggcaaggtgaaatccttgctcctctcagatcagtctcctggaaccaggcaagctgagtttgcctaagggagaaggaaggttgggcattttgtgggcaggtgccaagaattgtgtagaatagtgccaagagtgtgaaggcagaaagagctttcataagtttgactcatgtttcttccagatgaccttgaccgtgttacttttccttggttttgtcatctatagaatggatgaatgatgactcatgtgagggttatataggattatgtctgcatgctttagctctgctaacattatcacggaaggtaaggataacatgatgcctttcttttgtccagtcacacacgtggatgagttcccagagactgtttgtgaggtctttacttcattttctaagatacatttcaacgcatagcatgggaaagatttggtggtagcttctctgctctttagacattgtcccctgagctcagccactcttgtatgaccctagaactatactcaacctgtgaacctcaaggcccatgccatggtcagcagaagcatctccctagacctactttccacattttattcttccctcagagtccctcaaaccatattctttttgtcccaaccccaactgtaagcataggtggccagtgattctgccttgtttcttttaggatcaagagggaacttgagaaaatgagtgagaaggtagggaagggataggaagaaaccctttccatagtttggccttagaagtggtgccgtgtcaatcaagactatgtagaaagatgttagaggaagcagactaaaagcatgcctgaaaggcacacagagaaggtagttaaaggtgagcgtgctgttatgtatccaccctccctcccatataaaagtataggtcccacctcctccaagccccgtcctcccacccacctccctccccagccactcctggtggtgttaaacctggctgtgtctctgcatggagtttaaagtatctaaaagataatgaggctttcctctgtgccagtttgcctcctgcctgcagagcccctgtacgttattgtgctaaaagagcttttctttctttcccacctttgtgattcctcattctcccaatgactttctctctacattatttgtaagccttaggaaaggagagttcagggaggacaagaaaaacctgccctgctgcctgtgtaaagcaggaagcatagtgactgctttgaacataagcactcagtagccagctaatggtggttgtcctttatcatttatgcacagcactgggagatgggggctagtgtgactactgatgtttctgtttgcctcacagtgcggaggccagatcaatggtggagacatcgctgtgtttgcgtcacgcgctggccacggcgtttgctggcacccgccgtgcttcgtatgcactgtctgcaatgagctcctggtggatctgatctacttttaccaagatgggaagatatactgtggcaggcaccatgctgagtgcctgaagccgcgctgtgctgcctgcgatgag

SEQ ID NO: 30646 - DNA, 15581 bp, Homo sapiens; identical to SEQ ID NO: 30625

SEQ ID NO: 30647 - DNA, 1511 bp, Homo sapiens
atgctgaatctctttgtcgccgtcatcatggacaactttgagtacctcacccgagactcctccatcctgggcccccaccacctggatgagtacgtgcgtgtctgggccgagtatgaccccgcagcttggtaagaagtcaccccgaatcctccagccacaatactcacctctccctggaactggaacacgggctaggtcaggccccagactctggagcactgaactcctggggtcctagcaggggtctcacaggttcagtcaggagagaagatataagaatcatcacccttgcataccccagattaaacacgtagggtgccaaccctgcccaaaccctggactttctgggaaatgagggagggcgtcaaccatgagatgtcctgaagagccctctcctcctacgagtctctcctgtctctcactgtgaagtctccagatggtgaggatgcattagccaggctccagggagaaaaccaacagcatcccagcctcagttctcttgagagtgtggggaggagggctggcctacccttggcagacaggattggcagcaacatcagagtagcagaactcagctcccactgggacccgtgaacctgggagtgagaggacatacaggccaggggaggacgcagagcctcaggggcccatgcatctttgtggccacaaagggagtgggcgctcccatctgggtagacaccagaggggtccctctccactgacgggcaatggtttcagagggtgggttccaccttgtgcacgtgtattgagtgcccacccaacaccaagccttgaaggacactcagaggctttatctgaatacctggaacccaccagccactaactgaggatttagttcaggctggtcttggggcctgaagaagcattactggggggccctcagcagcctaagccccatcttcctctggcctcagcaccagagaggaggccgtcacgaggaaggtgggcaggaggtggtcttggctattcccatagcctcaaacaagtactccatgagaccgagaggctggggagagccgtgggtctggggctgggctttggctggttcctaactcttcctcttttgattttaggtcacagcaattggatgctgtccccaaggcctctattccacaagcccccccccacccctgtagcccatgtagactgtggaggaggcagatgcagagagagccccaggggaggtgccctgcagtcccgaactcgactgacatcctacacccctgggtctccccagtgtctgggaatgtactggggaccttcacttgtccccagtctctcccactccttcaagccagggacaccccagcctcgggcatcatgacctcgctgtgtgcccagggagcccgtgtgaacccattgcctgcactaaccccctttcttctcctttcagcggtcggattcattataaggatatgtacagtttattacgagtaatatctccccctctcggcttaggcaagaaatgtcctcatagggttgcttgcaag

SEQ ID NO: 30648 - DNA, 3410 bp, Homo sapiens
ctggaaggaccaccaccaacgaagaactggaagacatgctggagagcgggaagctggccatcttcacagatgacgtgagccgcgggtggggcgggctctgcttttggaaaatttttgcctcccctccctaagttcaggttgaactaaggtcctaagtccaccctggaaaaatgagcagcgggaagcctgagccgggaactggggaattccatgggagcggagcaggaaggcacccccatcagatgacggagtcgttcgtgtgccaggcactgttctaagcactttccatcttcacattcacccaccaactcatttaatactcacacatccccttcgaggaaaccccatttcacagatgaggaaaactggcccagagagatgaaatcacttggcaagatctcagagcgagggagagggccaggacttgaatcctgtctagtttcagagtcagaactctcgagccctaggatacacgacatactctgctactgaagcaagtcgtttcaccagagaactgatttgcctacattaaaagaaattttttttaattaaaaaaaactttttttcttttttttttcttcaagacggagttttgctcttgtcacccatgctggagtacagtggcgagatttcagctcactgcaacctccgcctcctgtgttcaagcgattctcctgccccagcctcccgagtagctgggattacaggcgcccaccactcggcctaaaaaaacctttttttgtagagatggggggtcttcctctgttgcccaggctggtctcaaacttctgggctcgaataatctgcctgcctcagcctcccaaagtgctgggattacagacgtgaaccaccgaatccagcctaatttgcctacattttgaatattttttttaaaacaagttttagttttgcttaggttttgtcccctgtgctgcccttgtccttttacatatgaaaggatgggctggccgggcccagtggctcatgcctgtaatcccagcactttgggaggccaaggcaggtagatcacctgaggtcaggagttcgagaccagcctggccaacatggcaaaactctgtctctattaaaaatacaaaaattagccgggcatggtggcacgtgcctgtaatcccagctactagggggctgaggcaggaggatcacttgaacctgggaggcggaggttgcagtgagccgagatcttgccactgcactccggcctgggcaacagactgacactctgtctcttaaaaaaaaaaaaaagaaagaaaggatgggctttccccgaacctagttcttgtttctctcagtggacttttgccccggcctgcccactcctgtctccgtttctgtttctggtggcaaaatgactctggttaagggttctagaccaggtttaaaggatgcgctatgactgtcttaaaagttttcagctcattgttatttggagaactgatctttgttgaaaacgcattgagcagcccggtgtggtggctcacatctgtaatcccagcattttgggaggccaaggaggatggagggcttgagcccaggagttcgtagaccagcccgggcaacaaagtgagacccccatctctacaaaaaaaatgtttttttgatttaaaaaacaatttcttttaatgtaggcaaatcagttctatggtgaaacctgctttaattagccaggcatggtggcgtgtgcctgtggtcccagctactcgggaggctaaggtggaaggattgcctgagtacaggaggtcaaggccgcagtgagctatgatagcaccactgcactccagcctaggtgacagagcaagaacttgtctcaacaaagaacaaaaaccaaaaaaaaaaaaaaaaaaaagacggggagactgaacactgtccaaacagccattgtatgatttcggcttatagaatggtcataggatgagcaggagatgaggggagagggagtctgggccttgactgctgaagggaaggtgtggagccttgggtagtggggagccatggcaggctgtagagcagaggagtggctcaatgtggtaagaacagtgagtaatttgggaagtgagtcacctggctgaggctgggtgtttgtggagaggaggcatatctgactgtgggtcacggtctcttccccactggctttctttttttttttttttcagcatggtctcactctgtggcccatgttggagtgaagtgaagcaatcatagctcactgcagcctcgacctcctggggtcaggcaatccttctgcctcagtttcctgagtagctgggaccacaggcgccaccatgcccagctaatttccttttttttttttttttttgatagaaacaaagtctcactatgttgcccaggctggcctcaaattcctgggctcaagtgatcctcctgccttggcctcccagagtactggggttacaggcctctccctactgactcttttttttttttttgagacggagtctcgctctgtggctcaggctggagtgcagtggcgcaatctcggctcactgcaagctccgcctcccgggttcacgccattctcctgcctcagactcccaagttgctgaaactacaggcgcccaccaccacacccggctaattttttgtatttttagtagagacggagtttcaccgcattagccaggatagtcttggtctgctgacctcgtgatctgcccgcttcagcctcccaaagttctgggattacaggcatgagctacctactgtgcccagccctgactctttttttttttttgagatggaatttcactcttgttgcccaggctggagtgcagtggcgtgatctcagctcactgcaacctctgcccccccgggttcaagcaattctcctgcctcagcctcctgagtagctatgattacaggtgcccaccaccacaccaggctaatttttatatttttagtagagacgaggtttcgccatgttggccaggctggtctcaaacttctgacctcaggtgatctacacacctcccaaagtgctgggattacaggtgtgagccatcgtgcctgaccaatgtgtacatattaactcactcagtcttcacaaccaccctgtgaggtgggcagtgttatgatccacattttctaggtggggaaactgaggccaagagcaggtgaataatgtgcctaaggtttcagctagtaaatgacaccggatttgaccctggccactccactgcggtggaggcgctcatggcggagaagggtgattgtagctctctccctcgtcaccctagatcaaaatggactcacagatgacgaagcaggcgctgaatgagattgagacgaggcacaatgagatcatcaagctggagaccagcatccgcgagctgcacgatatgtttgtggacatggccatgctcgtagagagccag

SEQ ID NO: 30649 - DNA, 514 bp, Homo sapiens
tgttccagaatgaagttttaggaacactacagcggggcaaagaggagaacatttcttgtgacaatctcgtcctggaaatcaactctctcaagtaagagcagcccctccctgttctcctcggggtgatcccgggaaggtagaggctttctcgtaagtgttttgtctccaaataggaacctattccttcgacatcccaaatggaaagaccagtagtatttggagcaaggagagcattattaagttctagcctcagcatagactttctccttcctaaaccctccccttccatattgttccatccagattcctctccaatgtctatcaaagtcatagttctaagcctgctgaaaggccagtgaaggccctggtgtcaccccagtctccccacaggtatgcctataacataagtctaaaggaggtgatgcaggtactgagccacgtggtcctggagttccccctgcaacagatggattccccgcttgactcaagccgctactgtgccctgctgcttcct

SEQ ID NO: 30650 - DNA, 2861 bp, Homo sapiens
gggccgcatgccttacctggacatgtatcagatgctgagacacatgtctccgcccctgggtctggggaagaagtgtccggccagagtggcttacaaggtagactacccttgccgaccaccgacgtccaggcactgggtttttttttcttcttcttcttctttttttttagtgctgaccagaaacacccggccgactctctttttccaacgtttctcttcttttttgtttttgattcttttttttcttttctcgagtcaactgatcatgaccatcccttgattctaagcagcacactgtgtccgtcctttctgatgagtgtcttcgtgttttgagactccattatggccgacatgccggggggagggggaggggagcgcccaggtccccttgcacctggtctcccaggtaccaaattggaaacaaacacgcttcttcagggagtcaaaacccatgcttcccacttctgcccacccagagcggcccccatgcccaggctggggcaggcgccttgcagagaggggctttagcccccgaaagcaggcgaggtcccgggtccccgcccctgccacgcacacctgaagctgatctctgacctagggccttggggattcgagaccttccaaggagcaccaagaacctctcttcccctcccttccttcccctggagtttcgtccccagcccccgtccctaatccccccaagacaccccaacatgcctctccattgttccagagtgggcaggcggccgcagctggacccctggacggtggcacactgatgcaggccatgcacgctgccttggcggggcctggggcgggcaggcaccatggccgacggggggtggtgcatgctggctgagagagcgagcgtcctgccgccaagcggctggcccgggccacccctccagatccctgtcctggaatctcccttggtgcccaaggacagatgctctgttccctccattcatccacaagaagttcagggatgacctttaaagattctccccacccaaaaagtattaccccatcatcctattctcccatccaccttgatcttccctgcgtccctatccatcaatgctatttgtacctgccccgtgttgccacctcattcctttccttcctctgtgcacccctcctcacctaacctatatgtctcccctccttctcaatcaaagccggggacaaggttgtcccaccagcatctcagacaatgagcctctcctggcacctgtcgctctgtgcccctccctgccgcccccccccccccccccggttttcctcaagtcgcttctctcagtctctgcttagatgaatgtgtgcgcatgtgcaagagagggagggcgagcccttcctctcctggtctttgtgcaggaccaccatgggtccataagacaactttgtgcaaatttgaaaaaggcaccctttccacagaacatgcctgttggaaaattgttgcaatctaccaatgtggtgagaacaagacactttttttctatcacctgggaagctgttatatttaatatacaaatcgggggctgggcgtggtggctcatgcctgtaatcctagtgctttgggaggctgagacgggaggatcacttgagcccagttcgagactagcctgggcaacatagcgagaccccatctctacaaaaagaaaaaatattttaattaataaataagtacataaatctatcatttccaagatgggagccctttgtgcggtgtacaacctgcacaactgtgcacagtggcccagtctatgtgtgtttctctatttcccacctccttccccaccctacccccagtgtcccctccagtgtcctgctctggatttaccatacccctccccatcttcaactctgtgtttcctgcccacttgtgtctgaatccccacccaagttgccctcaccccccttctctgtgccacttcagcctgggctggtgcacaccagcccagcatcctctcccatgccaccaagcatggtggacagagcccctgcctgggacatggggaatcttttcttccctgggctggaagggagtgcccctcaccccttccccctgccattgcacagagagccaagatctggacatgcccctgagatacacttcccacggagctatgaatgagtctcgagattccgtctgcatgcgcccctgtctgtgctgttctgtgtcacagcctcgctgcatgcctgcgaggggcctgccccgtcagtggggggctgcctgcctgctgcttctcagaggaatgatgtggtctgtgcccatctgctctgtcctggtctgggccaagccagggattgggtgtggggagccagtggcaccccccaccagcggctgtggtcctggccccctcagccttggctgttgcatgcactgctcaaatccagcttgtgctctttttctttggggtcagactgaaacggggccatccagaagaactctggggcagggcgggggtggggcaagggttgaggcaaaccctggaaatgccagctctcaggtcaagcaggtgggggaaaaaaggagagggcaggggaccagaagtacaagagagccttttgtgccctccctgcgggccaccaagagaaactgagtactgggacaggtaacctaagtaagagacacctcagccgccacagctttcagagttcttcctgggactccctgggtaggggcgggcgcggctcacgggagacccaggagggatgcctgggaatgactgcgcttgccttgggttttctgtagcggcttctgcggatggacctgcccgtcgcagatgacaacaccgtccacttcaattccaccctcatggctctgatccgcacagccctggacatcaagattgccaagg

SEQ ID NO: 30651 - DNA, 573 bp, Homo sapiens
ggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccaggtaggaaccacccgggccctcagccaccctcccacctcccaaagtcccccagcccttgatgctcccgcagccccacctgccagcccagccctcacggcagctgcccgcctcagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcac

SEQ ID NO: 30652 - DNA, 2175 bp, Homo sapiens
gtggggacccatcgtgaagatggcgtggccctgagaggcagccattctcttctgccaaaccaggttccggttccacagcttcctgtccagtctgcgacttcccctgacctgaacccaccccaggacccttacagaggtaggttggcctcaccagggcacttctgacctcactttcacaataggaccagtgttgatacccagcctcttggtgttcatccctcaagaagcactggcagaaacccaggaatcaaattgggcacaaaaatggtaaggaaatggcaaagtatttagaacttcgcccgctaattgtgtttctccagggactgttttcctcaaacatcctctgaaatcctggtcctatatcagcagggaatgaggccacagactgatgagaggaaattttattttagctatttccacatttttctcattcaggtcctctaatgtggttagttgtggcctgaaaatgatatttccaaatgaataggaaggaaggaaattgtttttgttgtttaagatggaaggaaatataggtgcatttaaaaaatggagcttggttgcatgattttcgctcttgagtcatctagccctctaatgattgcctcataccggtgattacgagcggcttttcatgaccccaggaagttgggctattgctggccagctgactaggagtcgcttagataacatcttctcagtcccttcacatttaatataaaaatgataacattgccacaggaatacatgtgggcattttttcagctgttcaacattgtacagatctgagtgtcaattatatgtatgggtatgtctgcccattttttatgaataataatcattttatggactttttttttttttttttttgacagagcctcactctgtcgcccaggctggagtacagtggtgcgatctcagctcactgcaacctccacctcccaggttcaagcgattctcctgcctcagcctcccagggggtagctaggattacagacatgcatcaccatgcctggctatttttcgtatttttagtagagacagggtttcaccacattagccaggctggtcttgaattcctgacctcaagtgatgcacccgcctcagcctcccgaagtgctgggattacaggtgtgaaccaccacaactggccaggacctttcttatcaggaggctttggattttgccctctttgtcctaaacctgtgcttctcaaactgcacataagcacaacctgagcatcttgttaaaatgcagattccacttctgtaggtctgggattgtccatttctaatgggctcacagatgatgaggccgcatggaccaaagtttgagtggcaaggttctagaatacacagattacaaataaagaggaatacttgacagatatgcttctacctttaaaaaaattactacattagggtcgtgttttaaaatgcagtgtgacttggaaagttgagcaatgataaagctagaaatttctaaaatgagtagcaaactgccttccatatgtaccattttaaaatgctgattacttcttgagaataagagaagcctaatttcagaatatcattagggtacctattgaagtcttgactgcacatatttagcatactccctgggaattatattttaaggacatttttctattaaatcattgcatatggaagaaactcaatataatagctgatatttacttgggttcttaatcagaacattggctgtgtgattttcatgattatgattttcattgcaattaagttgatgttttgtagacagtgaaattaccatctactccaaaagattgcaaaatagaatttaaccttagagccaatgcagggaaaacttgtttctgcaggtgcattttttgaaacttcaacagatagcagggggaaaaaaaagtgacagaaggatcacagttcagcagtatgaattgtctgctggcagccttgcaatctggtgtgcaggcagtgagattgtggtgtacatgtcacctgatttctctttttcggcaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactaggtcaagatctag

SEQ ID NO: 30653 - DNA, 1789 bp, Homo sapiens
gatggaagttccagctctgatagtgacctaagtctgtcttcaatggtctttcttaaccatagcagtggctctgacgattcagctggagatggagaatgtggcttagatcagtcccttgtttctttagagatgtccgagatccttccagatgaatcaaaattcaatatgtaccggctctactttggaagctcttatgaatcagaacttggaaatggaacctcttctgatttggtatcttgtgcagtcatcattatacagttctgaaatataaagctatatgttggtgtaaagttgcagtgatttctctcctaaccagccccacatattcttcctggttggttggttcttcagtaaaatagtcttgtttcttgcttacactaattggtaatttgcattccttgttaagattttcaagacagggctgggagcaaggaaccaaagtagcgcgtggttgtgattacctttggtttctttgaggtttctcttacctagtggctttaaaacatctttaggagcagttccattttatagtaaacttaaattctgttatcatgaacagttgaggataatgaataatttgatacaataatgtaagaaattcctgaaaacaaagtgttatctgtgatacttttgctgcatagtaagcacaatgaagtgtactgataatgtttcaacaggaaagtgttttgattaaatgtgggcagtatcactgttctactagcattcaacatctcttctaaaaattaatagtggttcactgtaattttattggtacatgtaacatctgtacatgtgtttggttatctatatgtttcctggttttttgtacatttgctttattaatttaggcttttttttttttttttttttgagacagtctcactctatcatccagactagagtgcagtggcacaattatggctcactgcagccttgacctcctgggcttaggtgattcttccacctcagcctcctgagtagctgggactacaggcacatgccaccatgcccagctaatttttgtatgttttgtagagacgaggtttcaccatattgcccaggctggtctcaaactcctgggctcaagctatctgcgtgccttgacctcccaaagtgctaggattacaggtgtgagccactatgcctagcctaactcagactttaaaaatataaaagcaattcatttttattcccaagaacagtaaggtggtggtttaattttagtctttaattctgtttttaatttattctatttagaaatgtcccagaaacttagtataactttactttctgaaaatgaagaaacctgtccttgggcattagtgtgttggatttaagcaacaaagttaaaaaaacctaccctgtgttatggcaattttcacttgatggtggttctataacacaggtatcagtgaacctttataaaagatgaacaacttttcagcttgcttaatttcagttaattaacatgtatacttatctatgttaatgttttattgcttaaaatgtttaatttttatatttggtaaacagatagttttttctctccccctcttccttccatctttcattactacaatttaccatgcagagctcacaatgtctctctgcaccaagctccatgactcaggatttgcctggagttcctgggaaagaccagttgttttcacagcctccagtgttaaggacagcttcacaagagggttgccaagaacttacacaagaacaaagagatcaactgagggcagatatcagtattatcaaaggcagataccggagccaaagtgga

SEQ ID NO: 30654 - DNA, 5684 bp, Homo sapiens
atgtgttccagctgccaagaagccggggccaccattgggtgctgccacaaaggatgcctccacacctaccactacccgtgtgccagcgatgcaggtacgagcccgcccaggaacaggagggcattggagcccatccaagcagtccagggggaccctccctgggcacagctccccaaacccaggccccatctcactcttcagtttccctcctctcttgccccagcaattcttttatccttctgtctgcctagacctctgctgggcaatgccagggacatggaaatgaggcattccccaggcacctgcttgaggagtgcccagagcagtgagggaagatagaagcataaattacaatgtggaatgctgtctgcggagccatcattgccaaggggcagggaggatctcaggcctcagagagaaaggggtattggaggttgggcctttgaaggataaataggagttcactcagcagagacaaggggaaaggcactactacaacagcaaaaaccaactgagttgggggtgatgaggttcaaaacagactgagacccatggagcaattgtggaagttttgaagcagggtaatggggtatggaggtaggcccaggctccccgcatcctctccccggtccttcctctcactcatgtattcatttgttccgcaagcatttgttgagcccctaccatcactgggcacacagaatgaccgtgcatgggctggagccacccaagagcccttacctttatcgaccaggtggggaaactgaggctcagagacattccttatttcatccagagaaagcaattgcttatggtacaatattagtcattggggacaacaatattttgggagatatggggccaactttggcctggattcaaaccctagtggtggggggtggggtggttttcgttcttgtttgagacagagttttgctctgtcacccaagctagagtgcaggggtgcagtcgtggctcactgcagccttaacctcctgggctcaatcatcctcccacctcagcctcctgagcagctgagaccacagatgtgcgcagccatgctggctcctagtagtgtttttatttttatttatttatttatttatttatttatttatttatttttgagacggagtctcactctgtcaccaggctggagtgcagtggtgcgatcttggctcactgcaacctccgcctcccgagttcaagcgattctcctgcctcagcctctcaagtagctgggactacaggcgtgcaccaccacgctcagctaatttttgtattttttgtagagatggggtttcactgctttggacaggatggtctccatctcttgacctcgtgatccgcccgcctcagctgcctaaagtgctgggattacaggcgtgagccactgtgcccggcccctagtagcgtttttaatgtgtggtcttgagcaagttggttgatacctctgcacacagtttccctacctgtatgatggagatgataatagccccttctctgcagagctgctgggaggagagtgaaataatgaacactacccacacggtgctgcctcagtcctattttgggtccagcctctgtgacctctccccacacggtgctgcctcagtcctattttgggtccagcctctgtgacctctccccgtcaccctcaatccctcccaactctggcctggaaagaggcgaagtcataacccacctcccagtggacagagtccaggcccccccaggctcccgtcgctctcctagcagccccagctactgcctcccgtcctcacctgatgccctgctggctttgcctggacaggggaccacagcctgtaccccacctgcctggtgggtccccagccagtgtcagcccagccaagctgccccagggaggacacagaggactctgagtgctgacagttgcttggcaggggctgagctgccgggacccagcggggaaggggcttgctggagcagggacgtggaggattctcactggcttcacgctcccactctgagcagtgtgagccagagtttaacatggaccctgccacttgcccaggcatgtggccgcactccccataatagctgccacgagtcacattcctccttccacagtgattaacttagcgcccgctccactcccagccctgctacagaaccatgttgtttccagccatcttcacagattggctgcctcacccacagcacacagcatggcgtggacagtcccaggacttaatgccttggctttcttgctccatgtcctatgttctttctcctaccccagcactgcccagccccccaaggggctcacccttgagtgggacggacagcaaaactgtggttcttggccacagttagggagaccagacgggaaggagagagtatgcactgtggaagaggttcatcctgtctgaacaagggagaaatctaggaagacttccaggaggaggtgacatttaagccaggcctcaaaagatcgggggagctttgtagcaactgtttagtggtgggacttgtatactaggctttgagcaagagaacttttatttcagataaaatcctagaaggattcctcatataacagggatccctgtagcaccgtgaagattgaggcaggaaagggactgggaatgctgcaaatggagacatacacctcagagactgagttggcacagaatccatgggacttgatgatgagggagagggaggtgacaagcctgatgcccagcttccccatgaaggggagaagtagggtgtggacgtgcaaatggagtattagctgctgctgcagagctactggcccttccaggcccagcttcatgtctccagcaccagcccttcattagttctcaaaagggcgtgagttggctgcaggctctgctgggagcaggatgatctagggtggccccagctgtgccagcttgtctttgctccatcaatctctcatcctccagcaggctggcctgggtgcgtcctcatggcagccccagggctttgagagagtggaggtcacagggccactcacagcctaggtcctggactttaccacgttctgttagccaaagcaggtcccaagtccagcacagagaagtgcaggccacctggggtgagctgcagagccacaccacaaaggacctgggtgcggggaggggactgggctgctctgccaggccatctacacacacggcagttccctttggccacacggcagtagaggcagctgtggacatacaaagtgtagatagctgggctcaggatcgagtctcgcccaccatcagcaggcgagggctcatcagagccctggaagggacaaaatagcagggttgtgttcaccatggaacagctggctgaggaggagggtggacccctgggaaactgaggaacagctgccagagaaggcgagggagaacaagtgagctcgagagtgaaggcggggaggacgggcgcttggggtgcagggagggcccccagcgtgactctgccagccaggcggtggggggggcgggggggtgggagtgagagggcactgagggagtgggctggtcaggctgatctgatgtctggccagggaggagccccaggcctctgtgtcaggcactgggactgcagggcaccagggctgcccactggctgccagcctctgccctgcactgcgctgtcctggcctactcatcctgcccccttccaattcttgttaaggaacccactttggagacaagcagtgactgaagagcaggcagaggctgctacaccacagtgtcctgtctcaacctttccccactcaggccctggggccaacctgtcagtgagtgcccaggttccccaggtgcaggcaccaggtcaggagccagatcactgaggactggccttgcccagtgactcccgccccgtgccccatgtggggtggtgctggggcagtgctgagggagccagtttggaagtggcgacctcctaccctcaacttcccttggtgggagtgcccgcagctacccaggcgtgccaggggcaggcctgggattttagcctagtgtctttggaatatctagttcagccccagaaccacatctggcttgcctgagccaagggaaggggaacagccgtggcacatctctagctgctggccctgaatggcagtttccaggtccgtggcactccagcttctggagacaagggcagatcgcctcagagaggcctgctaccacccagccctgccctcagggctgcagagctgtccctgccctgccttctggccaccaccctgtcatgatgccattgcacagagccacctccagtgtgaacaggaagattgtgttggagagagcaccagcctccagctacttttgggtctggggtttgttcagaacagtggctggtgaggctttgggggaggggagccgagaaggggactagagactggggggtccctgggggaaaagccagcttctccctaggtggcagtaggcaggggagtggagactccctgagatagcaacacctcctgggcctaggtgggcataagcactggccatgcttggttgtcctctctgcccctgcctcctgcgcccactgcatgccacacatgtgcagggtggtttatttttaaattttattttattttatattttattttattattttattttattttattttattttattattttattttattttattttattttattttattttattttatttcatctcagacagggcctggctgtgttgcccaggcaggggtgcagtggtacaatcacagctcactgcaacctccgcctcccaggctcaagtgatcctcccgccccagcctctcgagtagctgggactacaggcatgcgccaccatgctggctaatttttgtatttttgatagagatgaggttttgccatgttgcccaggctggtcttgaactcctgggctcaagcgattcattcacctcatcctcccaaagtgctgggattacagacatgagccactgctgctgccaagatggtttctatacactcccatcctcaatctccatgataggcatacagtaggtggcataatgcccattttacagatgtggagactgaggctcagagaagtagcagatgctcaaatccaggcttgcaacaccactaccagtccgtccacaggggttcatgacatgctcactggaagttagtgagctcttccaggggctgggcatacatccagggaagaagacagagctggtgccctctgggagcttgcctgccagtggggaagaaacaaggagcaagacaagatcacacaggccagtctcttaggaggcagtgacaagtgtggctggcagagtaaggcgggagggagggagggactgagggactgcctcaagtgaggaggggcggcacgtggaactcagggggaaaagctctccgcggaggaggtgaggtgagtcaagactgccaggccaggggccgcacccgcgccgtggagtggagtggagtgtggagggttttgtgcagaatctgattaactctttgaaaagagcccctgcagtctggagcctcgcgggcagtgcggctcccctcctggctgcagacaaaaccccacagctgtggggcccccaccctgtcctaaccaccgaaacttctctttggtcacaggttgcatattcatcgaagagaacttttctttgaaatgtcccaaacataag

SEQ ID NO: 30655 - DNA, 366 bp, Homo sapiens
gagcattgtccgtgatgccagccgtgcacaccttctctctctttgcgggattggcagtcttcattgactttcttctgcagattacctgtttcgtgagtctcttggggttagacattaaacgtcaagaggtaagttggtgccaggattatagtctatttaatttgagtctagaatctagaggaagcagctagcgggtataacctttgtttccctctgtcccctcagaaaaatcggctagacatcttttgctgtgtcagaggtgctgaagatggaacaagcgtccaggcctcagagagctgtttgtttcgcttcttcaaaaactcctattctccacttctgctaaaggactggatgagaccaattgtg

SEQ ID NO: 30656 - DNA, 4225 bp, Homo sapiens
gggtattccctcagcggatactacacccatccatttcaaggctatgagcacagacagctcaggtaccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcagaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccaaaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcggtaagagaccacccaggaactgtacctagggttggggtcaggtgcttttgctcctgacgcagtcttggctgatttgtgagcagtgctgtttggtggcgcctatcttttcctccttcccttctgccttttagctaaattccccttgattggccctttctccagatattgagcagggaatatagaccttggaccagccagaatcttggctgaacaagggggaggttgactctgttggctgtaatgaagcttctttagaaatgattggttttggccgtacgcggtggctcatgcctgtaatcccagcactttttgaggccgaggcaggcatatcacgaggtcaggagtttgagaccagcctggccaacatggtgaaaccctgtctctactaaaaatacaaaaattagctgggcgtggtggcgtgcacctgtagtcccagctactcaggaagctgagacaggagaatcacttgaacccaggaggcagaggttgcagtgaactgagattgcgccactgcactccagcctgggccacagagcaagactccatctcaaaaaaaaaaaagaaagaaatgattggtcttgggggccggggcggtggcttacgactgtaatcccagcactttgggaggccaaggcaggcagatcatgaggtgaggaattcgagaccagcctggccaacatggtgaaaccccatctctactaaaaatacaaaaattagctgggggtggtggtgcttgcctgtaatcccagctactcgggaggctgaggcaggagaatcacttgaacccaggaggtggaggttgtagtgagccgagattggcgccactgcactccagcctgggcgacagagtgagactccatcttggaaaaagaaagaaaaaagaaaaacatgattgatctccatgcatcaatatcatgcctgcctcctaaggcagaggtaatgaagacttaattcccttctgtaggccttcccctcctccctaagccgttttctgagagaggtgcaggagcaggtgggttggggcaggctgcatacacagtgggggtgggttgtgctgctaagcagcagcaggtccacaatcccccctctgcatagctcctggggggaaaggatggaggagcgtgtgcacggctgcctgcctgttgaaggtggtggttctaattttataaacctcctctgcacagatgggtaggctagcacttgctgccactcctgagctgtgaagtcagcctttacctcactcagatagctggtcaggccctgcactgtaggtcctaataggccagtggacagattgaggaaaacaggagcttctgaagggcataacagagagcaaaaccactgaagctgagtggctgcagctgcagccagggaaagagccagtaggatgggggagaattccactgacctttatgtttacctagcctggtttctaggggtgtagattcctggctagggcccttattccttgtcttgactgtcttcatgacaccaatttggcatttcaggagagcggttaagaaaaggagttgtgtctgtccaaaagctggcaaggccagagctggattgtttggggtagagactggatggccgtcattctcttttgcctccatccctcctccccagagttggaggaaagcagtggattttgtggttagtcattctttggactcacactaaaagaaacattggtgccatgttcaaatatatcagaagacctaggaaataagaaatttgacctacttttctaaatgaaatcccagactgagcaaagagctcaccacatttgaaagcttgaacaaagggggcctaggctaagtccagaggcctagaacaaatgcttttttattttctacataacaaggggaaattccttgttatgtagaaaatagctggagacaaatggtgctatagagtgactcataacaaactacggtgatataggtctagggacaaaagcaggccactgataagtggcagatgcctgatccccctaggtagtggggagtgtgagactgggttataagaagccttcactatcttttaggaccctcccttgaggaggccagtctaccacaattgctttagaatgaaggtcttttggttgctcacaagactataatggtaatttttggctcatcatttttgtgtgtgtgggttttatcttaattcattgttaaagagatagtgggtttcccctgagctagtttcctatcatctgtgcctatgtttgcttcactgagctatggggaaagagtcactggctgctttgtttacaaaaagaaaggacaggctgagccttaaggagtaggaaggagttccttggcctacccttcatctccacaagtgaaaagccccttagcgtagcagaaaattccaggttgaaggtctctttggagaaggcagaaggagtgacctagactcctgttcacacatctaatcactttccgtcaagatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaag

SEQ ID NO: 30657 - DNA, 2779 bp, Homo sapiens
atgctgaatctctttgtcgccgtcatcatggacaactttgagtacctcacccgagactcctccatcctgggcccccaccacctggatgagtacgtgcgtgtctgggccgagtatgaccccgcagcttggtaagaagtcaccccgaatcctccagccacaatactcacctctccctggaactggaacacgggctaggtcaggccccagactctggagcactgaactcctggggtcctagcaggggtctcacaggttcagtcaggagagaagatataagaatcatcacccttgcataccccagattaaacacgtagggtgccaaccctgcccaaaccctggactttctgggaaatgagggagggcgtcaaccatgagatgtcctgaagagccctctcctcctacgagtctctcctgtctctcactgtgaagtctccagatggtgaggatgcattagccaggctccagggagaaaaccaacagcatcccagcctcagttctcttgagagtgtggggaggagggctggcctacccttggcagacaggattggcagcaacatcagagtagcagaactcagctcccactgggacccgtgaacctgggagtgagaggacatacaggccaggggaggacgcagagcctcaggggcccatgcatctttgtggccacaaagggagtgggcgctcccatctgggtagacaccagaggggtccctctccactgacgggcaatggtttcagagggtgggttccaccttgtgcacgtgtattgagtgcccacccaacaccaagccttgaaggacactcagaggctttatctgaatacctggaacccaccagccactaactgaggatttagttcaggctggtcttggggcctgaagaagcattactggggggccctcagcagcctaagccccatcttcctctggcctcagcaccagagaggaggccgtcacgaggaaggtgggcaggaggtggtcttggctattcccatagcctcaaacaagtactccatgagaccgagaggctggggagagccgtgggtctggggctgggctttggctggttcctaactcttcctcttttgattttaggtcacagcaattggatgctgtccccaaggcctctattccacaagcccccccccacccctgtagcccatgtagactgtggaggaggcagatgcagagagagccccaggggaggtgccctgcagtcccgaactcgactgacatcctacacccctgggtctccccagtgtctgggaatgtactggggaccttcacttgtccccagtctctcccactccttcaagccagggacaccccagcctcgggcatcatgacctcgctgtgtgcccagggagcccgtgtgaacccattgcctgcactaaccccctttcttctcctttcagcggtcggattcattataaggatatgtacagtttattacgagtaatatctccccctctcggcttaggcaagaaatgtcctcatagggttgcttgcaaggtttgacttccactaaaacctgctagcatccatggaatgagtgtggcttggggttcttcaatatatatatttcatatatatatatatatatatctctctctctctctaaaaaaacagagccatctctctttcttgcattaaactagaaaactctcttagccaacagaatgcagtcatgtagactcgataaagcatggaacatatttcctccttcccttcagccttcagccatctttgcttgctcttagctgaagctgcccatcctggggtctccacggcaccccaaatcagatacatcccctgggggattgtaactttgcatttctcccccaaccatcacctccactctctccccctccacccctcacctcccaaagcccctagccctcctcccctccctggcactggcccctgctccccacctaggccccctcagagaccagcctcagccaaaccagagaacgtgacccaactgtagaaataacagtgatggccgggcgcagtggctcatgcctgtaatcccagcactttgggaggccaaagcaggaggatcgcttgagcccaggagtttgagaccagcctgggcaacatagcaagaacccccttctctataaaaaattagccaggcattgtggcgcatgcctgtagtcccagctacttgggaggctgaggcagaaggattgcttgagcccaggaggtggaggctgcagtgagctatgatcacaccactgcactccaacccaggcgacagagagagaccctgtctctttaaaaaaaaaaaaaaaaaaaaaaaaaggcaatgaacaaaagcatggctctacgtcttccaaagtgagaattctccctcccctccgcatccctccagaactgtagctcagagcccacgctgaatctgacttttctcttttctctctctctccctgctcccgagcagtgaagtaatctttttttactgaccttttcttccattttttttcctcctcttttccattgatttgaaatatctattttatcattctctgcatctttctctctctattttttcggctcgtgtggatttcttttttctttcttctgtttctccccacctctcttcctttggttctctgttcccattcccgttttgtttttttgtttttgtttttgtttttttcattttcggtgctgccaggggccgcatgccttacctggacatgtatcagatgctgagacacatgtctccgcccctgggtctggggaagaagtgtccggccagagtggcttacaag

SEQ ID NO: 30658 - DNA, 377 bp, Homo sapiens
cactccacactgtcccggaagttcgtggaggtaatgaccgaatataacgcgacccagtccaagtaccgggaccgctgcaaggaccggatccagcggcaactggagatcagtgcgtgtgccccccaccccaggaccccgaactccttgaggctgcccaagcccccttccaggcatttcctctctggagggggcccctggcttaaggcggcgtgggagggtgggccccaggtccccgccccatcaccccacctcaggcccccaggctgtcccagcccccgagcagggagtcctttcttcccgcagctggaaggaccaccaccaacgaagaactggaagacatgctggagagcgggaagctggccatcttcacagatgac

SEQ ID NO: 30659 - DNA, 641 bp, Homo sapiens
ccctgaatctgtggaggctagtccagcagttaatgagaagagcgtgtattccactcataattatgggaccactcagaggcatgggtgtcgaggactgccttatgctgtgagtatgcatttgtttctctccagaacagtgatcttcctggagtgtaatccattcttatacattgtgactttcttgaaatgtttatatgcagcatgacgaagttgccccttttgcacttccctgactccagcggacgtctagccctgcatcattgttcttgtttttatgtcccagttgaccttggcattttgttttatcactttcctggttgaagccaaaaaacaaagggtactactttcttctttctttccatatgtaccatactttaggggagagaggggccagtgtttggacactgttgatttaaaaaatcttattttcaggatcataattacggagcccctcctcctccgacacctcctgcttctccccctgtccagacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcag

SEQ ID NO: 30660 - RNA, 18 nt, Artificial Sequence
  Description of Artificial Sequence: Synthetic oligonucleotide
guaguccugguggcaugc

SEQ ID NO: 30661 - RNA, 18 nt, Artificial Sequence
  Description of Artificial Sequence: Synthetic oligonucleotide
ccccuguaguccuggugg

SEQ ID NO: 30662 - RNA, 18 nt, Artificial Sequence
  Description of Artificial Sequence: Synthetic oligonucleotide
cucugccccuguaguccu

SEQ ID NO: 30663 - RNA, 18 nt, Artificial Sequence
  Description of Artificial Sequence: Synthetic oligonucleotide
agacacucugccccugua

SEQ ID NO: 30664 - RNA, 18 nt, Artificial Sequence
  Description of Artificial Sequence: Synthetic oligonucleotide
agaggagacacucugccc

SEQ ID NO: 30665 - RNA, 18 nt, Artificial Sequence
  Description of Artificial Sequence: Synthetic oligonucleotide
cugccagaggagacacuc

SEQ ID NO: 30666 - RNA, 18 nt, Artificial Sequence
  Description of Artificial Sequence: Synthetic oligonucleotide
cagagcugccagaggaga

SEQ ID NO: 30667 - RNA, 18 nt, Artificial Sequence
  Description of Artificial Sequence: Synthetic oligonucleotide
gaucucagagcugccaga

SEQ ID NO: 30668 - RNA, 18 nt, Artificial Sequence
  Description of Artificial Sequence: Synthetic oligonucleotide
gauuugaucucagagcug

SEQ ID NO: 30669 - RNA, 18 nt, Artificial Sequence
  Description of Artificial Sequence: Synthetic oligonucleotide
caucggauuugaucucag

SEQ ID NO: 30670 - RNA, 18 nt, Artificial Sequence
  Description of Artificial Sequence: Synthetic oligonucleotide
cucgucaucggauuugau

SEQ ID NO: 30671 - RNA, 18 nt, Artificial Sequence
  Description of Artificial Sequence: Synthetic oligonucleotide
ucacccucgucaucggau

SEQ ID NO: 30672 - RNA, 18 nt, Artificial Sequence
  Description of Artificial Sequence: Synthetic oligonucleotide
ucucaucacccucgucau

SEQ ID NO: 30673 - RNA, 18 nt, Artificial Sequence
  Description of Artificial Sequence: Synthetic oligonucleotide
cagguucucaucacccuc

SEQ ID NO: 30674 - RNA, 18 nt, Artificial Sequence
  Description of Artificial Sequence: Synthetic oligonucleotide
ucuugcagguucucauca

SEQ ID NO: 30675 - RNA, 18 nt, Artificial Sequence
  Description of Artificial Sequence: Synthetic oligonucleotide
ucgugucuugcagguucu

SEQ ID NO: 30676 - RNA, 18 nt, Artificial Sequence
  Description of Artificial Sequence: Synthetic oligonucleotide
agauuucgugucuugcag

SEQ ID NO: 30677 - RNA, 18 nt, Artificial Sequence
  Description of Artificial Sequence: Synthetic oligonucleotide
uccgaagauuucgugucu

SEQ ID NO: 30678 - RNA, 18 nt, Artificial Sequence
  Description of Artificial Sequence: Synthetic oligonucleotide
uguccuccgaagauuucg

SEQ ID NO: 30679 - RNA, 18 nt, Artificial Sequence
  Description of Artificial Sequence: Synthetic oligonucleotide
uuucuuguccuccgaaga

SEQ ID NO: 30680 - RNA, 18 nt, Artificial Sequence
  Description of Artificial Sequence: Synthetic oligonucleotide
ucuaauuucuuguccucc

SEQ ID NO: 30681 - RNA, 18 nt, Artificial Sequence
  Description of Artificial Sequence: Synthetic oligonucleotide
cgucaucuaauuucuugu

SEQ ID NO: 30682 - RNA, 18 nt, Artificial Sequence
  Description of Artificial Sequence: Synthetic oligonucleotide
cuugucgucaucuaauuu

SEQ ID NO: 30683 - RNA, 18 nt, Artificial Sequence
  Description of Artificial Sequence: Synthetic oligonucleotide
uccuucuugucgucaucu

SEQ ID NO: 30684 - RNA, 18 nt, Artificial Sequence
  Description of Artificial Sequence: Synthetic oligonucleotide
ugauauccuucuugucgu

SEQ ID NO: 30685 - RNA, 18 nt, Artificial Sequence
  Description of Artificial Sequence: Synthetic oligonucleotide
ugauuugauauccuucuu

SEQ ID NO: 30686 - RNA, 18 nt, Artificial Sequence
  Description of Artificial Sequence: Synthetic oligonucleotide
guaauugauuugauaucc

SEQ ID NO: 30687 - RNA, 18 nt, Artificial Sequence
  Description of Artificial Sequence: Synthetic oligonucleotide
uauacuguuaccuagauc

SEQ ID NO: 30688 - RNA, 18 nt, Artificial Sequence
  Description of Artificial Sequence: Synthetic oligonucleotide
uauuauauacuguuaccu

SEQ ID NO: 30689 - RNA, 18 nt, Artificial Sequence
  Description of Artificial Sequence: Synthetic oligonucleotide
gacaguauuauauacugu

SEQ ID NO: 30690 - RNA, 18 nt, Artificial Sequence
  Description of Artificial Sequence: Synthetic oligonucleotide
gaagcgacaguauuauau

SEQ ID NO: 30691 - RNA, 18 nt, Artificial Sequence
  Description of Artificial Sequence: Synthetic oligonucleotide
uaaaugaagcgacaguau

SEQ ID NO: 30692 - RNA, 18 nt, Artificial Sequence
  Description of Artificial Sequence: Synthetic oligonucleotide
ggaauuaaaugaagcgac

SEQ ID NO: 30693 - RNA, 18 nt, Artificial Sequence
  Description of Artificial Sequence: Synthetic oligonucleotide
auaaaggaauuaaaugaa

SEQ ID NO: 30694 - RNA, 18 nt, Artificial Sequence
  Description of Artificial Sequence: Synthetic oligonucleotide
guccaauaaaggaauuaa

SEQ ID NO: 30695 - RNA, 18 nt, Artificial Sequence
  Description of Artificial Sequence: Synthetic oligonucleotide
ucaaaguccaauaaagga

SEQ ID NO: 30696 - RNA, 18 nt, Artificial Sequence
  Description of Artificial Sequence: Synthetic oligonucleotide
cuucaucaaaguccaaua

SEQ ID NO: 30697 - RNA, 18 nt, Artificial Sequence
  Description of Artificial Sequence: Synthetic oligonucleotide
guucacuucaucaaaguc

SEQ ID NO: 30698 - RNA, 18 nt, Artificial Sequence
  Description of Artificial Sequence: Synthetic oligonucleotide
guucuguucacuucauca

SEQ ID NO: 30699 - RNA, 18 nt, Artificial Sequence
  Description of Artificial Sequence: Synthetic oligonucleotide
uucccguucuguucacuu

SEQ ID NO: 30700 - RNA, 18 nt, Artificial Sequence
  Description of Artificial Sequence: Synthetic oligonucleotide
guuucuucccguucuguu

SEQ ID NO: 30701 - RNA, 18 nt, Artificial Sequence
  Description of Artificial Sequence: Synthetic oligonucleotide
gaauaguuucuucccguu

SEQ ID NO: 30702 - RNA, 18 nt, Artificial Sequence
  Description of Artificial Sequence: Synthetic oligonucleotide
aaacugaauaguuucuuc

SEQ ID NO: 30703 - RNA, 18 nt, Artificial Sequence
  Description of Artificial Sequence: Synthetic oligonucleotide
ggaaaaaacugaauaguu

SEQ ID NO: 30704 - RNA, 18 nt, Artificial Sequence
  Description of Artificial Sequence: Synthetic oligonucleotide
ugccaggaaaaaacugaa

SEQ ID NO: 30705 - RNA, 18 nt, Artificial Sequence
  Description of Artificial Sequence: Synthetic oligonucleotide
uuaccugccaggaaaaaa

SEQ ID NO: 30706 - RNA, 18 nt, Artificial Sequence
  Description of Artificial Sequence: Synthetic oligonucleotide
uaaauuuaccugccagga

SEQ ID NO: 30707 - RNA, 18 nt, Artificial Sequence
  Description of Artificial Sequence: Synthetic oligonucleotide
agcuguaaauuuaccugc

SEQ ID NO: 30708 - RNA, 18 nt, Artificial Sequence
  Description of Artificial Sequence: Synthetic oligonucleotide
uuuucagcuguaaauuua

SEQ ID NO: 30709 - RNA, 18 nt, Artificial Sequence
  Description of Artificial Sequence: Synthetic oligonucleotide
uuuucuuuucagcuguaa

SEQ ID NO: 30710 - RNA, 18 nt, Artificial Sequence
  Description of Artificial Sequence: Synthetic oligonucleotide
uuuaauuuucuuuucagc

SEQ ID NO: 30711 - RNA, 18 nt, Artificial Sequence
  Description of Artificial Sequence: Synthetic oligonucleotide
aggccuuuaauuuucuuu

SEQ ID NO: 30712 - RNA, 18 nt, Artificial Sequence
  Description of Artificial Sequence: Synthetic oligonucleotide
agaguaggccuuuaauuu

SEQ ID NO: 30713 - RNA, 18 nt, Artificial Sequence
  Description of Artificial Sequence: Synthetic oligonucleotide
cuucuagaguaggccuuu

SEQ ID NO: 30714 - RNA, 18 nt, Artificial Sequence
  Description of Artificial Sequence: Synthetic oligonucleotide
uaguacuucuagaguagg

SEQ ID NO: 30715 - RNA, 18 nt, Artificial Sequence
  Description of Artificial Sequence: Synthetic oligonucleotide
acuuuuaguacuucuaga

SEQ ID NO: 30716 - RNA, 18 nt, Artificial Sequence
  Description of Artificial Sequence: Synthetic oligonucleotide
acgauacuuuuaguacuu

SEQ ID NO: 30717 - RNA, 18 nt, Artificial Sequence
  Description of Artificial Sequence: Synthetic oligonucleotide
cugaaacgauacuuuuag

SEQ ID NO: 30718 - RNA, 18 nt, Artificial Sequence
  Description of Artificial Sequence: Synthetic oligonucleotide
gguaucugaaacgauacu

SEQ ID NO: 30719 - RNA, 18 nt, Artificial Sequence
  Description of Artificial Sequence: Synthetic oligonucleotide
guacagguaucugaaacg

SEQ ID NO: 30720 - RNA, 18 nt, Artificial Sequence
  Description of Artificial Sequence: Synthetic oligonucleotide
auagaguacagguaucug

SEQ ID NO: 30721 - RNA, 18 nt, Artificial Sequence
  Description of Artificial Sequence: Synthetic oligonucleotide
cuccaauagaguacaggu

SEQ ID NO: 30722 - RNA, 18 nt, Artificial Sequence
  Description of Artificial Sequence: Synthetic oligonucleotide
uuaggcuccaauagagua

SEQ ID NO: 30723 - RNA, 18 nt, Artificial Sequence
  Description of Artificial Sequence: Synthetic oligonucleotide
acaguuuaggcuccaaua

SEQ ID NO: 30724 - RNA, 18 nt, Artificial Sequence
  Description of Artificial Sequence: Synthetic oligonucleotide
ccaaaacaguuuaggcuc

SEQ ID NO: 30725 - RNA, 18 nt, Artificial Sequence
  Description of Artificial Sequence: Synthetic oligonucleotide
aaaugccaaaacaguuua

SEQ ID NO: 30726 - RNA, 18 nt, Artificial Sequence
  Description of Artificial Sequence: Synthetic oligonucleotide
uucauaaaugccaaaaca

SEQ ID NO: 30727 - RNA, 18 nt, Artificial Sequence
  Description of Artificial Sequence: Synthetic oligonucleotide
ccagauucauaaaugcca

SEQ ID NO: 30728 - RNA, 18 nt, Artificial Sequence
  Description of Artificial Sequence: Synthetic oligonucleotide
uggguccagauucauaaa

SEQ ID NO: 30729 - RNA, 18 nt, Artificial Sequence
  Description of Artificial Sequence: Synthetic oligonucleotide
agcauuggguccagauuc

SEQ ID NO: 30730 - RNA, 18 nt, Artificial Sequence
  Description of Artificial Sequence: Synthetic oligonucleotide
ucauuagcauugggucca

SEQ ID NO: 30731 - RNA, 18 nt, Artificial Sequence
  Description of Artificial Sequence: Synthetic oligonucleotide
gugugucauuagcauugg

SEQ ID NO: 30732 - RNA, 18 nt, Artificial Sequence
  Description of Artificial Sequence: Synthetic oligonucleotide
ucacugugugucauuagc

SEQ ID NO: 30733 - RNA, 18 nt, Artificial Sequence
  Description of Artificial Sequence: Synthetic oligonucleotide
uuuuuucacuguguguca

SEQ ID NO: 30734 - RNA, 18 nt, Artificial Sequence
  Description of Artificial Sequence: Synthetic oligonucleotide
acaaauuuuuucacugug

SEQ ID NO: 30735 - RNA, 18 nt, Artificial Sequence
  Description of Artificial Sequence: Synthetic oligonucleotide
cagagacaaauuuuuuca

SEQ ID NO: 30736 - RNA, 18 nt, Artificial Sequence
  Description of Artificial Sequence: Synthetic oligonucleotide
ugaaucagagacaaauuu

SEQ ID NO: 30737 - RNA, 18 nt, Artificial Sequence
  Description of Artificial Sequence: Synthetic oligonucleotide
guacuugaaucagagaca

SEQ ID NO: 30738 - RNA, 18 nt, Artificial Sequence
  Description of Artificial Sequence: Synthetic oligonucleotide
aaacuguacuugaaucag

SEQ ID NO: 30739 - RNA, 18 nt, Artificial Sequence
  Description of Artificial Sequence: Synthetic oligonucleotide
caaauaaacuguacuuga

SEQ ID NO: 30740 - RNA, 18 nt, Artificial Sequence
  Description of Artificial Sequence: Synthetic oligonucleotide
uuuuacaaauaaacugua

SEQ ID NO: 30741 - RNA, 18 nt, Artificial Sequence
  Description of Artificial Sequence: Synthetic oligonucleotide
uauaguuuuacaaauaaa

SEQ ID NO: 30742 - RNA, 18 nt, Artificial Sequence
  Description of Artificial Sequence: Synthetic oligonucleotide
auaaguauaguuuuacaa

SEQ ID NO: 30743 - RNA, 18 nt, Artificial Sequence
  Description of Artificial Sequence: Synthetic oligonucleotide
guagaauaaguauaguuu

SEQ ID NO: 30744 - RNA, 18 nt, Artificial Sequence
  Description of Artificial Sequence: Synthetic oligonucleotide
aauuuguagaauaaguau

SEQ ID NO: 30745 - RNA, 18 nt, Artificial Sequence
  Description of Artificial Sequence: Synthetic oligonucleotide
gaccaaauuuguagaaua

SEQ ID NO: 30746 - RNA, 18 nt, Artificial Sequence
  Description of Artificial Sequence: Synthetic oligonucleotide
uuucugaccaaauuugua

SEQ ID NO: 30747 - RNA, 18 nt, Artificial Sequence
  Description of Artificial Sequence: Synthetic oligonucleotide
caacauuucugaccaaau

SEQ ID NO: 30748 - RNA, 18 nt, Artificial Sequence
  Description of Artificial Sequence: Synthetic oligonucleotide
agacacaacauuucugac

SEQ ID NO: 30749 - RNA, 18 nt, Artificial Sequence
  Description of Artificial Sequence: Synthetic oligonucleotide
auuauagacacaacauuu

SEQ ID NO: 30750 - RNA, 18 nt, Artificial Sequence
  Description of Artificial Sequence: Synthetic oligonucleotide
gaaauauuauagacacaa

SEQ ID NO: 30751 - RNA, 18 nt, Artificial Sequence
  Description of Artificial Sequence: Synthetic oligonucleotide
uuuuagaaauauuauaga

SEQ ID NO: 30752 - RNA, 18 nt, Artificial Sequence
  Description of Artificial Sequence: Synthetic oligonucleotide
ucucuuuuuagaaauauu

SEQ ID NO: 30753 - RNA, 18 nt, Artificial Sequence
  Description of Artificial Sequence: Synthetic oligonucleotide
uacaaucucuuuuuagaa

SEQ ID NO: 30754 - RNA, 18 nt, Artificial Sequence
  Description of Artificial Sequence: Synthetic oligonucleotide
auggcuacaaucucuuuu

SEQ ID NO: 30755 - RNA, 18 nt, Artificial Sequence
  Description of Artificial Sequence: Synthetic oligonucleotide
uuaacauggcuacaaucu

SEQ ID NO: 30756 - RNA, 18 nt, Artificial Sequence
  Description of Artificial Sequence: Synthetic oligonucleotide
aguuuuuaacauggcuac

SEQ ID NO: 30757 - RNA, 18 nt, Artificial Sequence
  Description of Artificial Sequence: Synthetic oligonucleotide
aguugaguuuuuaacaug

SEQ ID NO: 30758 - RNA, 18 nt, Artificial Sequence
  Description of Artificial Sequence: Synthetic oligonucleotide
acaucaguugaguuuuua

SEQ ID NO: 30759 - RNA, 18 nt, Artificial Sequence
  Description of Artificial Sequence: Synthetic oligonucleotide
cacauacaucaguugagu

SEQ ID NO: 30760 - RNA, 18 nt, Artificial Sequence
  Description of Artificial Sequence: Synthetic oligonucleotide
guuggcacauacaucagu

SEQ ID NO: 30761 - RNA, 18 nt, Artificial Sequence
  Description of Artificial Sequence: Synthetic oligonucleotide
uuauaguuggcacauaca

SEQ ID NO: 30762 - RNA, 18 nt, Artificial Sequence
  Description of Artificial Sequence: Synthetic oligonucleotide
aagaguuauaguuggcac

SEQ ID NO: 30763 - RNA, 18 nt, Artificial Sequence
  Description of Artificial Sequence: Synthetic oligonucleotide
aagaaaagaguuauaguu

SEQ ID NO: 30764 - RNA, 18 nt, Artificial Sequence
  Description of Artificial Sequence: Synthetic oligonucleotide
gagguaagaaaagaguua

SEQ ID NO: 30765 - RNA, 18 nt, Artificial Sequence
  Description of Artificial Sequence: Synthetic oligonucleotide
cuuuagagguaagaaaag

SEQ ID NO: 30766 - RNA, 18 nt, Artificial Sequence
  Description of Artificial Sequence: Synthetic oligonucleotide
ucuuacuuuagagguaag

SEQ ID NO: 30767 - RNA, 18 nt, Artificial Sequence
  Description of Artificial Sequence: Synthetic oligonucleotide
uauuuucuuacuuuagag

SEQ ID NO: 30768 - RNA, 18 nt, Artificial Sequence
  Description of Artificial Sequence: Synthetic oligonucleotide
gaaauuauuuucuuacuu

SEQ ID NO: 30769 - RNA, 18 nt, Artificial Sequence
  Description of Artificial Sequence: Synthetic oligonucleotide
ucuaggaaauuauuuucu

SEQ ID NO: 30770 - RNA, 18 nt, Artificial Sequence
  Description of Artificial Sequence: Synthetic oligonucleotide
auaaaucuaggaaauuau

SEQ ID NO: 30771 - RNA, 18 nt, Artificial Sequence
  Description of Artificial Sequence: Synthetic oligonucleotide
uuaggauaaaucuaggaa

SEQ ID NO: 30772 - RNA, 18 nt, Artificial Sequence
  Description of Artificial Sequence: Synthetic oligonucleotide
cauguuuaggauaaaucu

SEQ ID NO: 30773 - RNA, 18 nt, Artificial Sequence
  Description of Artificial Sequence: Synthetic oligonucleotide
aucagcauguuuaggaua

SEQ ID NO: 30774 - RNA, 18 nt, Artificial Sequence
  Description of Artificial Sequence: Synthetic oligonucleotide
uauacaucagcauguuua

SEQ ID NO: 30775 - RNA, 18 nt, Artificial Sequence
  Description of Artificial Sequence: Synthetic oligonucleotide
ucuuauauacaucagcau

SEQ ID NO: 30776 - RNA, 18 nt, Artificial Sequence
  Description of Artificial Sequence: Synthetic oligonucleotide
auuacucuuauauacauc

SEQ ID NO: 30777 - RNA, 18 nt, Artificial Sequence
  Description of Artificial Sequence: Synthetic oligonucleotide
aagguauuacucuuauau

SEQ ID NO: 30778 - RNA, 18 nt, Artificial Sequence
  Description of Artificial Sequence: Synthetic oligonucleotide
caauuaagguauuacucu

SEQ ID NO: 30779 - RNA, 18 nt, Artificial Sequence
  Description of Artificial Sequence: Synthetic oligonucleotide
auaaacaauuaagguauu

SEQ ID NO: 30780 - RNA, 18 nt, Artificial Sequence
  Description of Artificial Sequence: Synthetic oligonucleotide
aaaccauaaacaauuaag

SEQ ID NO: 30781 - RNA, 18 nt, Artificial Sequence
  Description of Artificial Sequence: Synthetic oligonucleotide
aagaaaaaccauaaacaa

SEQ ID NO: 30782 - RNA, 18 nt, Artificial Sequence
  Description of Artificial Sequence: Synthetic oligonucleotide
ccaggaagaaaaaccaua

SEQ ID NO: 30783 - RNA, 18 nt, Artificial Sequence
  Description of Artificial Sequence: Synthetic oligonucleotide
aguguccaggaagaaaaa

SEQ ID NO: 30784 - RNA, 18 nt, Artificial Sequence
  Description of Artificial Sequence: Synthetic oligonucleotide
aaaagaguguccaggaag

SEQ ID NO: 30785 - RNA, 18 nt, Artificial Sequence
  Description of Artificial Sequence: Synthetic oligonucleotide
uguagaaaagagugucca

SEQ ID NO: 30786 - RNA, 18 nt, Artificial Sequence
  Description of Artificial Sequence: Synthetic oligonucleotide
caaaaaaauacaaggcag

SEQ ID NO: 30787 - RNA, 18 nt, Artificial Sequence
  Description of Artificial Sequence: Synthetic oligonucleotide
uaggucaaaaaaauacaa

SEQ ID NO: 30788 - RNA, 18 nt, Artificial Sequence
  Description of Artificial Sequence: Synthetic oligonucleotide
uuugauaggucaaaaaaa

SEQ ID NO: 30789 - RNA, 18 nt, Artificial Sequence
  Description of Artificial Sequence: Synthetic oligonucleotide
augauuuugauaggucaa

SEQ ID NO: 30790 - RNA, 18 nt, Artificial Sequence
  Description of Artificial Sequence: Synthetic oligonucleotide
gaaaaaugauuuugauag

SEQ ID NO: 30791 - RNA, 18 nt, Artificial Sequence
  Description of Artificial Sequence: Synthetic oligonucleotide
uaauugaaaaaugauuuu

SEQ ID NO: 30792 - RNA, 18 nt, Artificial Sequence
  Description of Artificial Sequence: Synthetic oligonucleotide
acaaguaauugaaaaaug

SEQ ID NO: 30793 - RNA, 18 nt, Artificial Sequence
  Description of Artificial Sequence: Synthetic oligonucleotide
gggaaacaaguaauugaa

SEQ ID NO: 30794 - RNA, 18 nt, Artificial Sequence
  Description of Artificial Sequence: Synthetic oligonucleotide
gacaucugaaaucuaggg

SEQ ID NO: 30795 - RNA, 18 nt, Artificial Sequence
  Description of Artificial Sequence: Synthetic oligonucleotide
ccgugacaucugaaaucu

SEQ ID NO: 30796 - RNA, 18 nt, Artificial Sequence
  Description of Artificial Sequence: Synthetic oligonucleotide
ucauaccgugacaucuga

SEQ ID NO: 30797 - RNA, 18 nt, Artificial Sequence
  Description of Artificial Sequence: Synthetic oligonucleotide
accuuucauaccgugaca

SEQ ID NO: 30798 - RNA, 18 nt, Artificial Sequence
  Description of Artificial Sequence: Synthetic oligonucleotide
auaaaaccuuucauaccg

SEQ ID NO: 30799 - RNA, 18 nt, Artificial Sequence
  Description of Artificial Sequence: Synthetic oligonucleotide
uauauauaaaaccuuuca

SEQ ID NO: 30800 - RNA, 18 nt, Artificial Sequence
  Description of Artificial Sequence: Synthetic oligonucleotide
uuaaauauauauaaaacc

SEQ ID NO: 30801 - RNA, 18 nt, Artificial Sequence
  Description of Artificial Sequence: Synthetic oligonucleotide
auuuuuuaaauauauaua

SEQ ID NO: 30802 - RNA, 18 nt, Artificial Sequence
  Description of Artificial Sequence: Synthetic oligonucleotide
acuuuauuuuuuaaauau

SEQ ID NO: 30803 - RNA, 18 nt, Artificial Sequence
  Description of Artificial Sequence: Synthetic oligonucleotide
uuuauacuuuauuuuuua

SEQ ID NO: 30804 - RNA, 18 nt, Artificial Sequence
  Description of Artificial Sequence: Synthetic oligonucleotide
uuauguuuauacuuuauu

SEQ ID NO: 30805 - RNA, 18 nt, Artificial Sequence
  Description of Artificial Sequence: Synthetic oligonucleotide
agacuuuauguuuauacu

SEQ ID NO: 30806 - RNA, 18 nt, Artificial Sequence
  Description of Artificial Sequence: Synthetic oligonucleotide
caaaaagacuuuauguuu

SEQ ID NO: 30807 - RNA, 18 nt, Artificial Sequence
  Description of Artificial Sequence: Synthetic oligonucleotide
cgcuucaaaaagacuuua

SEQ ID NO: 30808 - RNA, 18 nt, Artificial Sequence
  Description of Artificial Sequence: Synthetic oligonucleotide
aaccacgcuucaaaaaga

SEQ ID NO: 30809 - RNA, 18 nt, Artificial Sequence
  Description of Artificial Sequence: Synthetic oligonucleotide
ugcauaaccacgcuucaa

SEQ ID NO: 30810 - RNA, 18 nt, Artificial Sequence
  Description of Artificial Sequence: Synthetic oligonucleotide
uauguugcauaaccacgc

SEQ ID NO: 30811 - RNA, 18 nt, Artificial Sequence
  Description of Artificial Sequence: Synthetic oligonucleotide
uagcauauguugcauaac

SEQ ID NO: 30812 - RNA, 18 nt, Artificial Sequence
  Description of Artificial Sequence: Synthetic oligonucleotide
acgccuagcauauguugc

SEQ ID NO: 30813 - RNA, 18 nt, Artificial Sequence
  Description of Artificial Sequence: Synthetic oligonucleotide
aacuuacgccuagcauau

SEQ ID NO: 30814 - RNA, 18 nt, Artificial Sequence
  Description of Artificial Sequence: Synthetic oligonucleotide
ucaccaacuuacgccuag

SEQ ID NO: 30815 - RNA, 18 nt, Artificial Sequence
  Description of Artificial Sequence: Synthetic oligonucleotide
ggcauucaccaacuuacg

SEQ ID NO: 30816 - RNA, 18 nt, Artificial Sequence
  Description of Artificial Sequence: Synthetic oligonucleotide
aagcaggcauucaccaac

SEQ ID NO: 30817 - RNA, 18 nt, Artificial Sequence
  Description of Artificial Sequence: Synthetic oligonucleotide
cugcaaagcaggcauuca

SEQ ID NO: 30818 - RNA, 18 nt, Artificial Sequence
  Description of Artificial Sequence: Synthetic oligonucleotide
acacucugcaaagcaggc

SEQ ID NO: 30819 - RNA, 18 nt, Artificial Sequence
  Description of Artificial Sequence: Synthetic oligonucleotide
ggguuacacucugcaaag

SEQ ID NO: 30820 - RNA, 18 nt, Artificial Sequence
  Description of Artificial Sequence: Synthetic oligonucleotide
cuuuuuuuauucaauggg

SEQ ID NO: 30821 - RNA, 18 nt, Artificial Sequence
  Description of Artificial Sequence: Synthetic oligonucleotide
gcuuuuuuuauucaaugg

SEQ ID NO: 30822 - RNA, 18 nt, Artificial Sequence
  Description of Artificial Sequence: Synthetic oligonucleotide
acaaagcuuuuuuuauuc

SEQ ID NO: 30823 - RNA, 18 nt, Artificial Sequence
  Description of Artificial Sequence: Synthetic oligonucleotide
ggaaaacaaagcuuuuuu

SEQ ID NO: 30824 - RNA, 18 nt, Artificial Sequence
  Description of Artificial Sequence: Synthetic oligonucleotide
gaaagggaaaacaaagcu

SEQ ID NO: 30825 - RNA, 18 nt, Artificial Sequence
  Description of Artificial Sequence: Synthetic oligonucleotide
gggcagaaagggaaaaca

SEQ ID NO: 30826 - RNA, 18 nt, Artificial Sequence
  Description of Artificial Sequence: Synthetic oligonucleotide
gcccauacugauacaggg

SEQ ID NO: 30827 - RNA, 18 nt, Artificial Sequence
  Description of Artificial Sequence: Synthetic oligonucleotide
ugcccauacugauacagg

SEQ ID NO: 30828 - RNA, 18 nt, Artificial Sequence
  Description of Artificial Sequence: Synthetic oligonucleotide
gggugugcccauacugau

SEQ ID NO: 30829 - RNA, 18 nt, Artificial Sequence
  Description of Artificial Sequence: Synthetic oligonucleotide
gugcagggugugcccaua

SEQ ID NO: 30830 - RNA, 18 nt, Artificial Sequence
  Description of Artificial Sequence: Synthetic oligonucleotide
uuagagugcagggugugc

SEQ ID NO: 30831 - RNA, 18 nt, Artificial Sequence
  Description of Artificial Sequence: Synthetic oligonucleotide
uaaaguuagagugcaggg

SEQ ID NO: 30832 - RNA, 18 nt, Artificial Sequence
  Description of Artificial Sequence: Synthetic oligonucleotide
uagauuaaaguuagagug

SEQ ID NO: 30833 - RNA, 18 nt, Artificial Sequence
  Description of Artificial Sequence: Synthetic oligonucleotide
ugacguagauuaaaguua

SEQ ID NO: 30834 - RNA, 18 nt, Artificial Sequence
  Description of Artificial Sequence: Synthetic oligonucleotide
gagggugacguagauuaa

SEQ ID NO: 30835 - RNA, 18 nt, Artificial Sequence
  Description of Artificial Sequence: Synthetic oligonucleotide
caggugagggugacguag

SEQ ID NO: 30836 - RNA, 18 nt, Artificial Sequence
  Description of Artificial Sequence: Synthetic oligonucleotide
ccaaacaggugaggguga

SEQ ID NO: 30837 - RNA, 18 nt, Artificial Sequence
  Description of Artificial Sequence: Synthetic oligonucleotide
ccaaaccaaacaggugag

SEQ ID NO: 30838 - RNA, 18 nt, Artificial Sequence
  Description of Artificial Sequence: Synthetic oligonucleotide
uaaacccaaaccaaacag

SEQ ID NO: 30839 - RNA, 18 nt, Artificial Sequence
  Description of Artificial Sequence: Synthetic oligonucleotide
gacauuaaacccaaacca

SEQ ID NO: 30840 - RNA, 18 nt, Artificial Sequence
  Description of Artificial Sequence: Synthetic oligonucleotide
ucgcagacauuaaaccca

SEQ ID NO: 30841 - RNA, 18 nt, Artificial Sequence
  Description of Artificial Sequence: Synthetic oligonucleotide
uuuucucgcagacauuaa

SEQ ID NO: 30842 - RNA, 18 nt, Artificial Sequence
  Description of Artificial Sequence: Synthetic oligonucleotide
uuugguuuucucgcagac

SEQ ID NO: 30843 - RNA, 18 nt, Artificial Sequence
  Description of Artificial Sequence: Synthetic oligonucleotide
agauauuugguuuucucg

SEQ ID NO: 30844 - RNA, 18 nt, Artificial Sequence
  Description of Artificial Sequence: Synthetic oligonucleotide
acacaagauauuugguuu

SEQ ID NO: 30845 - RNA, 18 nt, Artificial Sequence
  Description of Artificial Sequence: Synthetic oligonucleotide
acaauacacaagauauuu

SEQ ID NO: 30846 - RNA, 18 nt, Artificial Sequence
  Description of Artificial Sequence: Synthetic oligonucleotide
aguucacaauacacaaga

SEQ ID NO: 30847 - RNA, 18 nt, Artificial Sequence
  Description of Artificial Sequence: Synthetic oligonucleotide
uugacaguucacaauaca

SEQ ID NO: 30848 - RNA, 18 nt, Artificial Sequence
  Description of Artificial Sequence: Synthetic oligonucleotide
uggcuuugacaguucaca

SEQ ID NO: 30849 - RNA, 18 nt, Artificial Sequence
  Description of Artificial Sequence: Synthetic oligonucleotide
uuagauggcuuugacagu

SEQ ID NO: 30850 - RNA, 18 nt, Artificial Sequence
  Description of Artificial Sequence: Synthetic oligonucleotide
uugguuuagauggcuuug

SEQ ID NO: 30851 - RNA, 18 nt, Artificial Sequence
  Description of Artificial Sequence: Synthetic oligonucleotide
ugggauugguuuagaugg

SEQ ID NO: 30852 - RNA, 18 nt, Artificial Sequence
  Description of Artificial Sequence: Synthetic oligonucleotide
gaccuugggauugguuua

SEQ ID NO: 30853 - RNA, 18 nt, Artificial Sequence
  Description of Artificial Sequence: Synthetic oligonucleotide
cacuugaccuugggauug

SEQ ID NO: 30854 - RNA, 18 nt, Artificial Sequence
  Description of Artificial Sequence: Synthetic oligonucleotide
auauccacuugaccuugg

SEQ ID NO: 30855 - RNA, 18 nt, Artificial Sequence
  Description of Artificial Sequence: Synthetic oligonucleotide
uuuuuauauccacuugac

SEQ ID NO: 30856 - RNA, 18 nt, Artificial Sequence
  Description of Artificial Sequence: Synthetic oligonucleotide
cagaauuuuuauauccac

SEQ ID NO: 30857 - RNA, 18 nt, Artificial Sequence
  Description of Artificial Sequence: Synthetic oligonucleotide
uuuggcagaauuuuuaua

SEQ ID NO: 30858 - RNA, 18 nt, Artificial Sequence
  Description of Artificial Sequence: Synthetic oligonucleotide
auguuuuuggcagaauuu

SEQ ID NO: 30859 - RNA, 18 nt, Artificial Sequence
  Description of Artificial Sequence: Synthetic oligonucleotide
augccauguuuuuggcag

SEQ ID NO: 30860 - RNA, 18 nt, Artificial Sequence
  Description of Artificial Sequence: Synthetic oligonucleotide
aucuuaugccauguuuuu

SEQ ID NO: 30861 - RNA, 18 nt, Artificial Sequence
  Description of Artificial Sequence: Synthetic oligonucleotide
uuuccaucuuaugccaug

SEQ ID NO: 30862 - RNA, 18 nt, Artificial Sequence
  Description of Artificial Sequence: Synthetic oligonucleotide
gaacuuuuccaucuuaug

SEQ ID NO: 30863 - RNA, 18 nt, Artificial Sequence
  Description of Artificial Sequence: Synthetic oligonucleotide
ucagggaacuuuuccauc

SEQ ID NO: 30864 - RNA, 18 nt, Artificial Sequence
  Description of Artificial Sequence: Synthetic oligonucleotide
aguuuucagggaacuuuu

SEQ ID NO: 30865 - RNA, 18 nt, Artificial Sequence
  Description of Artificial Sequence: Synthetic oligonucleotide
uccagaguuuucagggaa

SEQ ID NO: 30866 - RNA, 18 nt, Artificial Sequence
  Description of Artificial Sequence: Synthetic oligonucleotide
uuucuuccagaguuuuca

SEQ ID NO: 30867 - RNA, 18 nt, Artificial Sequence
  Description of Artificial Sequence: Synthetic oligonucleotide
uuuguuuucuuccagagu

SEQ ID NO: 30868 - RNA, 18 nt, Artificial Sequence
  Description of Artificial Sequence: Synthetic oligonucleotide
auuacuuuguuuucuucc

SEQ ID NO: 30869 - RNA, 18 nt, Artificial Sequence
  Description of Artificial Sequence: Synthetic oligonucleotide
ucuacauuacuuuguuuu

SEQ ID NO: 30870 - RNA, 18 nt, Artificial Sequence
  Description of Artificial Sequence: Synthetic oligonucleotide
aggugucuacauuacuuu

SEQ ID NO: 30871 - RNA, 18 nt, Artificial Sequence
  Description of Artificial Sequence: Synthetic oligonucleotide
aaagaaggugucuacauu

SEQ ID NO: 30872 - RNA, 18 nt, Artificial Sequence
  Description of Artificial Sequence: Synthetic oligonucleotide
gggaaaaagaaggugucu

SEQ ID NO: 30873 - RNA, 18 nt, Artificial Sequence
  Description of Artificial Sequence: Synthetic oligonucleotide
auuuucuaaugguguggg

SEQ ID NO: 30874 - RNA, 18 nt, Artificial Sequence
  Description of Artificial Sequence: Synthetic oligonucleotide
aacauuuucuaauggugu

SEQ ID NO: 30875 - RNA, 18 nt, Artificial Sequence
  Description of Artificial Sequence: Synthetic oligonucleotide
gaugcaacauuuucuaau

SEQ ID NO: 30876 - RNA, 18 nt, Artificial Sequence
  Description of Artificial Sequence: Synthetic oligonucleotide
guccucaucgucauuauu

SEQ ID NO: 30877 - RNA, 18 nt, Artificial Sequence
  Description of Artificial Sequence: Synthetic oligonucleotide
gucagguccucaucguca

SEQ ID NO: 30878 - RNA, 18 nt, Artificial Sequence
  Description of Artificial Sequence: Synthetic oligonucleotide
cuggugucagguccucau

SEQ ID NO: 30879 - RNA, 18 nt, Artificial Sequence
  Description of Artificial Sequence: Synthetic oligonucleotide
cugcucuggugucagguc

SEQ ID NO: 30880 - RNA, 18 nt, Artificial Sequence
  Description of Artificial Sequence: Synthetic oligonucleotide
gccuucugcucugguguc

SEQ ID NO: 30881 - RNA, 18 nt, Artificial Sequence
  Description of Artificial Sequence: Synthetic oligonucleotide
gcucugccuucugcucug

SEQ ID NO: 30882 - RNA, 18 nt, Artificial Sequence
  Description of Artificial Sequence: Synthetic oligonucleotide
cucacgcucugccuucug

SEQ ID NO: 30883 - RNA, 18 nt, Artificial Sequence
  Description of Artificial Sequence: Synthetic oligonucleotide
uccuucucacgcucugcc

SEQ ID NO: 30884 - RNA, 18 nt, Artificial Sequence
  Description of Artificial Sequence: Synthetic oligonucleotide
uccgcuccuucucacgcu

SEQ ID NO: 30885 - RNA, 18 nt, Artificial Sequence
  Description of Artificial Sequence: Synthetic oligonucleotide
cauccuccgcuccuucuc

SEQ ID NO: 30886 - RNA, 18 nt, Artificial Sequence
  Description of Artificial Sequence: Synthetic oligonucleotide
uuggccauccuccgcucc

SEQ ID NO: 30887 - RNA, 18 nt, Artificial Sequence
  Description of Artificial Sequence: Synthetic oligonucleotide
cauuguuggccauccucc

SEQ ID NO: 30888 - RNA, 18 nt, Artificial Sequence
  Description of Artificial Sequence: Synthetic oligonucleotide
ucgggcauuguuggccau

SEQ ID NO: 30889 - RNA, 18 nt, Artificial Sequence
  Description of Artificial Sequence: Synthetic oligonucleotide
cgcucucgggcauuguug

SEQ ID NO: 30890 - RNA, 18 nt, Artificial Sequence
  Description of Artificial Sequence: Synthetic oligonucleotide
gcagacgcucucgggcau

SEQ ID NO: 30891 - RNA, 18 nt, Artificial Sequence
  Description of Artificial Sequence: Synthetic oligonucleotide
gacccgcagacgcucucg

SEQ ID NO: 30892 - RNA, 18 nt, Artificial Sequence
  Description of Artificial Sequence: Synthetic oligonucleotide
ucacggacccgcagacgc

SEQ ID NO: 30893 - RNA, 18 nt, Artificial Sequence
  Description of Artificial Sequence: Synthetic oligonucleotide
ugaugucacggacccgca

SEQ ID NO: 30894 - RNA, 18 nt, Artificial Sequence
  Description of Artificial Sequence: Synthetic oligonucleotide
cucguugaugucacggac

SEQ ID NO: 30895 - RNA, 18 nt, Artificial Sequence
  Description of Artificial Sequence: Synthetic oligonucleotide
aaagccucguugauguca

SEQ ID NO: 30896 - RNA, 18 nt, Artificial Sequence
  Description of Artificial Sequence: Synthetic oligonucleotide
cuuugaaagccucguuga

SEQ ID NO: 30897 - RNA, 18 nt, Artificial Sequence
  Description of Artificial Sequence: Synthetic oligonucleotide
gagcucuuugaaagccuc

SEQ ID NO: 30898 - RNA, 18 nt, Artificial Sequence
  Description of Artificial Sequence: Synthetic oligonucleotide
cggccgagcucuuugaaa

SEQ ID NO: 30899 - RNA, 18 nt, Artificial Sequence
  Description of Artificial Sequence: Synthetic oligonucleotide
ccaugcggccgagcucuu

SEQ ID NO: 30900 - RNA, 18 nt, Artificial Sequence
  Description of Artificial Sequence: Synthetic oligonucleotide
cugcaccaugcggccgag

SEQ ID NO: 30901 - RNA, 18 nt, Artificial Sequence
  Description of Artificial Sequence: Synthetic oligonucleotide
uggagcugcaccaugcgg

SEQ ID NO: 30902 - RNA, 18 nt, Artificial Sequence
  Description of Artificial Sequence: Synthetic oligonucleotide
ugagguggagcugcacca

SEQ ID NO: 30903 - RNA, 18 nt, Artificial Sequence
  Description of Artificial Sequence: Synthetic oligonucleotide
acucuugagguggagcug

SEQ ID NO: 30904 - RNA, 18 nt, Artificial Sequence
  Description of Artificial Sequence: Synthetic oligonucleotide
uugucacucuugaggugg

SEQ ID NO: 30905 - RNA, 18 nt, Artificial Sequence
  Description of Artificial Sequence: Synthetic oligonucleotide
gggcuugucacucuugag

SEQ ID NO: 30906 - RNA, 18 nt, Artificial Sequence
  Description of Artificial Sequence: Synthetic oligonucleotide
ucaggagcuuggucuggg

SEQ ID NO: 30907 - RNA, 18 nt, Artificial Sequence
  Description of Artificial Sequence: Synthetic oligonucleotide
gaggaucaggagcuuggu

SEQ ID NO: 30908 - RNA, 18 nt, Artificial Sequence
  Description of Artificial Sequence: Synthetic oligonucleotide
ugguggaggaucaggagc

SEQ ID NO: 30909 - RNA, 18 nt, Artificial Sequence
  Description of Artificial Sequence: Synthetic oligonucleotide
ccgccugguggaggauca

SEQ ID NO: 30910 - RNA, 18 nt, Artificial Sequence
  Description of Artificial Sequence: Synthetic oligonucleotide
ggccaccgccugguggag

SEQ ID NO: 30911 - RNA, 18 nt, Artificial Sequence
  Description of Artificial Sequence: Synthetic oligonucleotide
augacggccaccgccugg

SEQ ID NO: 30912 - RNA, 18 nt, Artificial Sequence
  Description of Artificial Sequence: Synthetic oligonucleotide
ugaggaugacggccaccg

SEQ ID NO: 30913 - RNA, 18 nt, Artificial Sequence
  Description of Artificial Sequence: Synthetic oligonucleotide
cagacugaggaugacggc

SEQ ID NO: 30914 - RNA, 18 nt, Artificial Sequence
  Description of Artificial Sequence: Synthetic oligonucleotide
ugcuccagacugaggaug

SEQ ID NO: 30915 - RNA, 18 nt, Artificial Sequence
  Description of Artificial Sequence: Synthetic oligonucleotide
cuugcugcuccagacuga

SEQ ID NO: 30916 - RNA, 18 nt, Artificial Sequence
  Description of Artificial Sequence: Synthetic oligonucleotide
ucggacuugcugcuccag

SEQ ID NO: 30917 - RNA, 18 nt, Artificial Sequence
  Description of Artificial Sequence: Synthetic oligonucleotide
guaguccugguggcaugc

SEQ ID NO: 30918 - RNA, 18 nt, Artificial Sequence
  Description of Artificial Sequence: Synthetic oligonucleotide
ccccuguaguccuggugg

SEQ ID NO: 30919 - RNA, 18 nt, Artificial Sequence
  Description of Artificial Sequence: Synthetic oligonucleotide
cucugccccuguaguccu

SEQ ID NO: 30920 - RNA, 18 nt, Artificial Sequence
  Description of Artificial Sequence: Synthetic oligonucleotide
agacacucugccccugua

SEQ ID NO: 30921 - RNA, 18 nt, Artificial Sequence
  Description of Artificial Sequence: Synthetic oligonucleotide
agaggagacacucugccc

SEQ ID NO: 30922 - RNA, 18 nt, Artificial Sequence
  Description of Artificial Sequence: Synthetic oligonucleotide
cugccagaggagacacuc

SEQ ID NO: 30923 - RNA, 18 nt, Artificial Sequence
  Description of Artificial Sequence: Synthetic oligonucleotide
cagagcugccagaggaga

SEQ ID NO: 30924 - RNA, 18 nt, Artificial Sequence
  Description of Artificial Sequence: Synthetic oligonucleotide
gaucucagagcugccaga

SEQ ID NO: 30925 - RNA, 18 nt, Artificial Sequence
  Description of Artificial Sequence: Synthetic oligonucleotide
gauuugaucucagagcug

SEQ ID NO: 30926 - RNA, 18 nt, Artificial Sequence
  Description of Artificial Sequence: Synthetic oligonucleotide
caucggauuugaucucag

SEQ ID NO: 30927 - RNA, 18 nt, Artificial Sequence
  Description of Artificial Sequence: Synthetic oligonucleotide
cucgucaucggauuugau

SEQ ID NO: 30928 - RNA, 18 nt, Artificial Sequence
  Description of Artificial Sequence: Synthetic oligonucleotide
ucacccucgucaucggau

SEQ ID NO: 30929 - RNA, 18 nt, Artificial Sequence
  Description of Artificial Sequence: Synthetic oligonucleotide
ucucaucacccucgucau

SEQ ID NO: 30930 - RNA, 18 nt, Artificial Sequence
  Description of Artificial Sequence: Synthetic oligonucleotide
cagguucucaucacccuc

SEQ ID NO: 30931 - RNA, 18 nt, Artificial Sequence
  Description of Artificial Sequence: Synthetic oligonucleotide
ucuugcagguucucauca

SEQ ID NO: 30932 - RNA, 18 nt, Artificial Sequence
  Description of Artificial Sequence: Synthetic oligonucleotide
ucgugucuugcagguucu

SEQ ID NO: 30933 - RNA, 18 nt, Artificial Sequence
  Description of Artificial Sequence: Synthetic oligonucleotide
agauuucgugucuugcag

SEQ ID NO: 30934 - RNA, 18 nt, Artificial Sequence
  Description of Artificial Sequence: Synthetic oligonucleotide
uccgaagauuucgugucu

SEQ ID NO: 30935 - RNA, 18 nt, Artificial Sequence
  Description of Artificial Sequence: Synthetic oligonucleotide
uguccuccgaagauuucg

SEQ ID NO: 30936 - RNA, 18 nt, Artificial Sequence
  Description of Artificial Sequence: Synthetic oligonucleotide
uuucuuguccuccgaaga

SEQ ID NO: 30937 - RNA, 18 nt, Artificial Sequence
  Description of Artificial Sequence: Synthetic oligonucleotide
ucuaauuucuuguccucc

SEQ ID NO: 30938 - RNA, 18 nt, Artificial Sequence
  Description of Artificial Sequence: Synthetic oligonucleotide
cgucaucuaauuucuugu

SEQ ID NO: 30939 - RNA, 18 nt, Artificial Sequence
  Description of Artificial Sequence: Synthetic oligonucleotide
cuugucgucaucuaauuu

SEQ ID NO: 30940 - RNA, 18 nt, Artificial Sequence
  Description of Artificial Sequence: Synthetic oligonucleotide
uccuucuugucgucaucu

SEQ ID NO: 30941 - RNA, 18 nt, Artificial Sequence
  Description of Artificial Sequence: Synthetic oligonucleotide
ugauauccuucuugucgu

SEQ ID NO: 30942 - RNA, 18 nt, Artificial Sequence
  Description of Artificial Sequence: Synthetic oligonucleotide
ugauuugauauccuucuu

SEQ ID NO: 30943 - RNA, 18 nt, Artificial Sequence
  Description of Artificial Sequence: Synthetic oligonucleotide
guaauugauuugauaucc

SEQ ID NO: 30944 - RNA, 18 nt, Artificial Sequence
  Description of Artificial Sequence: Synthetic oligonucleotide
uauacuguuaccuagauc

SEQ ID NO: 30945 - RNA, 18 nt, Artificial Sequence
  Description of Artificial Sequence: Synthetic oligonucleotide
uauuauauacuguuaccu

SEQ ID NO: 30946 - RNA, 18 nt, Artificial Sequence
  Description of Artificial Sequence: Synthetic oligonucleotide
gacaguauuauauacugu

SEQ ID NO: 30947 - RNA, 18 nt, Artificial Sequence
  Description of Artificial Sequence: Synthetic oligonucleotide
gaagcgacaguauuauau

SEQ ID NO: 30948 - RNA, 18 nt, Artificial Sequence
  Description of Artificial Sequence: Synthetic oligonucleotide
uaaaugaagcgacaguau

SEQ ID NO: 30949 - RNA, 18 nt, Artificial Sequence
  Description of Artificial Sequence: Synthetic oligonucleotide
ggaauuaaaugaagcgac

SEQ ID NO: 30950 - RNA, 18 nt, Artificial Sequence
  Description of Artificial Sequence: Synthetic oligonucleotide
auaaaggaauuaaaugaa

SEQ ID NO: 30951 - RNA, 18 nt, Artificial Sequence
  Description of Artificial Sequence: Synthetic oligonucleotide
guccaauaaaggaauuaa

SEQ ID NO: 30952 - RNA, 18 nt, Artificial Sequence
  Description of Artificial Sequence: Synthetic oligonucleotide
ucaaaguccaauaaagga

SEQ ID NO: 30953 - RNA, 18 nt, Artificial Sequence
  Description of Artificial Sequence: Synthetic oligonucleotide
cuucaucaaaguccaaua

SEQ ID NO: 30954 - RNA, 18 nt, Artificial Sequence
  Description of Artificial Sequence: Synthetic oligonucleotide
guucacuucaucaaaguc

SEQ ID NO: 30955 - RNA, 18 nt, Artificial Sequence
  Description of Artificial Sequence: Synthetic oligonucleotide
guucuguucacuucauca

SEQ ID NO: 30956 - RNA, 18 nt, Artificial Sequence
  Description of Artificial Sequence: Synthetic oligonucleotide
uucccguucuguucacuu

SEQ ID NO: 30957 - RNA, 18 nt, Artificial Sequence
  Description of Artificial Sequence: Synthetic oligonucleotide
guuucuucccguucuguu

SEQ ID NO: 30958 - RNA, 18 nt, Artificial Sequence
  Description of Artificial Sequence: Synthetic oligonucleotide
gaauaguuucuucccguu

SEQ ID NO: 30959 - RNA, 18 nt, Artificial Sequence
  Description of Artificial Sequence: Synthetic oligonucleotide
aaacugaauaguuucuuc

SEQ ID NO: 30960 - RNA, 18 nt, Artificial Sequence
  Description of Artificial Sequence: Synthetic oligonucleotide
ggaaaaaacugaauaguu

SEQ ID NO: 30961 - RNA, 18 nt, Artificial Sequence
  Description of Artificial Sequence: Synthetic oligonucleotide
ugccaggaaaaaacugaa

SEQ ID NO: 30962 - RNA, 18 nt, Artificial Sequence
  Description of Artificial Sequence: Synthetic oligonucleotide
uuaccugccaggaaaaaa

SEQ ID NO: 30963 - RNA, 18 nt, Artificial Sequence
  Description of Artificial Sequence: Synthetic oligonucleotide
uaaauuuaccugccagga

SEQ ID NO: 30964 - RNA, 18 nt, Artificial Sequence
  Description of Artificial Sequence: Synthetic oligonucleotide
agcuguaaauuuaccugc

SEQ ID NO: 30965 - RNA, 18 nt, Artificial Sequence
  Description of Artificial Sequence: Synthetic oligonucleotide
uuuucagcuguaaauuua

SEQ ID NO: 30966 - RNA, 18 nt, Artificial Sequence
  Description of Artificial Sequence: Synthetic oligonucleotide
uuuucuuuucagcuguaa

SEQ ID NO: 30967 - RNA, 18 nt, Artificial Sequence
  Description of Artificial Sequence: Synthetic oligonucleotide
uuuaauuuucuuuucagc

SEQ ID NO: 30968 - RNA, 18 nt, Artificial Sequence
  Description of Artificial Sequence: Synthetic oligonucleotide
aggccuuuaauuuucuuu

SEQ ID NO: 30969 - RNA, 18 nt, Artificial Sequence
  Description of Artificial Sequence: Synthetic oligonucleotide
agaguaggccuuuaauuu

SEQ ID NO: 30970 - RNA, 18 nt, Artificial Sequence
  Description of Artificial Sequence: Synthetic oligonucleotide
cuucuagaguaggccuuu

SEQ ID NO: 30971 - RNA, 18 nt, Artificial Sequence
  Description of Artificial Sequence: Synthetic oligonucleotide
uaguacuucuagaguagg

SEQ ID NO: 30972 - RNA, 18 nt, Artificial Sequence
  Description of Artificial Sequence: Synthetic oligonucleotide
acuuuuaguacuucuaga

SEQ ID NO: 30973 - RNA, 18 nt, Artificial Sequence
  Description of Artificial Sequence: Synthetic oligonucleotide
acgauacuuuuaguacuu

SEQ ID NO: 30974 - RNA, 18 nt, Artificial Sequence
  Description of Artificial Sequence: Synthetic oligonucleotide
cugaaacgauacuuuuag

SEQ ID NO: 30975 - RNA, 18 nt, Artificial Sequence
  Description of Artificial Sequence: Synthetic oligonucleotide
gguaucugaaacgauacu

SEQ ID NO: 30976 - RNA, 18 nt, Artificial Sequence
  Description of Artificial Sequence: Synthetic oligonucleotide
guacagguaucugaaacg

SEQ ID NO: 30977 - RNA, 18 nt, Artificial Sequence
  Description of Artificial Sequence: Synthetic oligonucleotide
auagaguacagguaucug

SEQ ID NO: 30978 - RNA, 18 nt, Artificial Sequence
  Description of Artificial Sequence: Synthetic oligonucleotide
cuccaauagaguacaggu

SEQ ID NO: 30979 - RNA, 18 nt, Artificial Sequence
  Description of Artificial Sequence: Synthetic oligonucleotide
uuaggcuccaauagagua

SEQ ID NO: 30980 - RNA, 18 nt, Artificial Sequence
  Description of Artificial Sequence: Synthetic oligonucleotide
acaguuuaggcuccaaua

SEQ ID NO: 30981 - RNA, 18 nt, Artificial Sequence
  Description of Artificial Sequence: Synthetic oligonucleotide
ccaaaacaguuuaggcuc

SEQ ID NO: 30982 - RNA, 18 nt, Artificial Sequence
  Description of Artificial Sequence: Synthetic oligonucleotide
aaaugccaaaacaguuua

SEQ ID NO: 30983 - RNA, 18 nt, Artificial Sequence
  Description of Artificial Sequence: Synthetic oligonucleotide
uucauaaaugccaaaaca

SEQ ID NO: 30984 - RNA, 18 nt, Artificial Sequence
  Description of Artificial Sequence: Synthetic oligonucleotide
ccagauucauaaaugcca

SEQ ID NO: 30985 - RNA, 18 nt, Artificial Sequence
  Description of Artificial Sequence: Synthetic oligonucleotide
uggguccagauucauaaa

SEQ ID NO: 30986 - RNA, 18 nt, Artificial Sequence
  Description of Artificial Sequence: Synthetic oligonucleotide
agcauuggguccagauuc

SEQ ID NO: 30987 - RNA, 18 nt, Artificial Sequence
  Description of Artificial Sequence: Synthetic oligonucleotide
ucauuagcauugggucca

SEQ ID NO: 30988 - RNA, 18 nt, Artificial Sequence
  Description of Artificial Sequence: Synthetic oligonucleotide
gugugucauuagcauugg

SEQ ID NO: 30989 - RNA, 18 nt, Artificial Sequence
  Description of Artificial Sequence: Synthetic oligonucleotide
ucacugugugucauuagc

SEQ ID NO: 30990 - RNA, 18 nt, Artificial Sequence
  Description of Artificial Sequence: Synthetic oligonucleotide
uuuuuucacuguguguca

SEQ ID NO: 30991 - RNA, 18 nt, Artificial Sequence
  Description of Artificial Sequence: Synthetic oligonucleotide
acaaauuuuuucacugug

SEQ ID NO: 30992 - RNA, 18 nt, Artificial Sequence
  Description of Artificial Sequence: Synthetic oligonucleotide
cagagacaaauuuuuuca

SEQ ID NO: 30993 - RNA, 18 nt, Artificial Sequence
  Description of Artificial Sequence: Synthetic oligonucleotide
ugaaucagagacaaauuu

SEQ ID NO: 30994 - RNA, 18 nt, Artificial Sequence
  Description of Artificial Sequence: Synthetic oligonucleotide
guacuugaaucagagaca

SEQ ID NO: 30995 - RNA, 18 nt, Artificial Sequence
  Description of Artificial Sequence: Synthetic oligonucleotide
aaacuguacuugaaucag

SEQ ID NO: 30996 - RNA, 18 nt, Artificial Sequence
  Description of Artificial Sequence: Synthetic oligonucleotide
caaauaaacuguacuuga

SEQ ID NO: 30997 - RNA, 18 nt, Artificial Sequence
  Description of Artificial Sequence: Synthetic oligonucleotide
uuuuacaaauaaacugua

SEQ ID NO: 30998 - RNA, 18 nt, Artificial Sequence
  Description of Artificial Sequence: Synthetic oligonucleotide
uauaguuuuacaaauaaa

SEQ ID NO: 30999 - RNA, 18 nt, Artificial Sequence
  Description of Artificial Sequence: Synthetic oligonucleotide
auaaguauaguuuuacaa

SEQ ID NO: 31000 - RNA, 18 nt, Artificial Sequence
  Description of Artificial Sequence: Synthetic oligonucleotide
guagaauaaguauaguuu

SEQ ID NO: 31001 - RNA, 18 nt, Artificial Sequence
  Description of Artificial Sequence: Synthetic oligonucleotide
aauuuguagaauaaguau

SEQ ID NO: 31002 - RNA, 18 nt, Artificial Sequence
  Description of Artificial Sequence: Synthetic oligonucleotide
gaccaaauuuguagaaua

SEQ ID NO: 31003 - RNA, 18 nt, Artificial Sequence
  Description of Artificial Sequence: Synthetic oligonucleotide
uuucugaccaaauuugua

SEQ ID NO: 31004 - RNA, 18 nt, Artificial Sequence
  Description of Artificial Sequence: Synthetic oligonucleotide
caacauuucugaccaaau

SEQ ID NO: 31005 - RNA, 18 nt, Artificial Sequence
  Description of Artificial Sequence: Synthetic oligonucleotide
agacacaacauuucugac

SEQ ID NO: 31006 - RNA, 18 nt, Artificial Sequence
  Description of Artificial Sequence: Synthetic oligonucleotide
auuauagacacaacauuu

SEQ ID NO: 31007 - RNA, 18 nt, Artificial Sequence
  Description of Artificial Sequence: Synthetic oligonucleotide
gaaauauuauagacacaa

SEQ ID NO: 31008 - RNA, 18 nt, Artificial Sequence
  Description of Artificial Sequence: Synthetic oligonucleotide
uuuuagaaauauuauaga

SEQ ID NO: 31009 - RNA, 18 nt, Artificial Sequence
  Description of Artificial Sequence: Synthetic oligonucleotide
ucucuuuuuagaaauauu

SEQ ID NO: 31010 - RNA, 18 nt, Artificial Sequence
  Description of Artificial Sequence: Synthetic oligonucleotide
uacaaucucuuuuuagaa

SEQ ID NO: 31011 - RNA, 18 nt, Artificial Sequence
  Description of Artificial Sequence: Synthetic oligonucleotide
auggcuacaaucucuuuu

SEQ ID NO: 31012 - RNA, 18 nt, Artificial Sequence
  Description of Artificial Sequence: Synthetic oligonucleotide
uuaacauggcuacaaucu

SEQ ID NO: 31013 - RNA, 18 nt, Artificial Sequence
  Description of Artificial Sequence: Synthetic oligonucleotide
aguuuuuaacauggcuac

SEQ ID NO: 31014 - RNA, 18 nt, Artificial Sequence
  Description of Artificial Sequence: Synthetic oligonucleotide
aguugaguuuuuaacaug

SEQ ID NO: 31015 - RNA, 18 nt, Artificial Sequence
  Description of Artificial Sequence: Synthetic oligonucleotide
acaucaguugaguuuuua

SEQ ID NO: 31016 - RNA, 18 nt, Artificial Sequence
  Description of Artificial Sequence: Synthetic oligonucleotide
cacauacaucaguugagu

SEQ ID NO: 31017 - RNA, 18 nt, Artificial Sequence
  Description of Artificial Sequence: Synthetic oligonucleotide
guuggcacauacaucagu

SEQ ID NO: 31018 - RNA, 18 nt, Artificial Sequence
  Description of Artificial Sequence: Synthetic oligonucleotide
uuauaguuggcacauaca

SEQ ID NO: 31019 - RNA, 18 nt, Artificial Sequence
  Description of Artificial Sequence: Synthetic oligonucleotide
aagaguuauaguuggcac

SEQ ID NO: 31020 - RNA, 18 nt, Artificial Sequence
  Description of Artificial Sequence: Synthetic oligonucleotide
aagaaaagaguuauaguu

SEQ ID NO: 31021 - RNA, 18 nt, Artificial Sequence
  Description of Artificial Sequence: Synthetic oligonucleotide
gagguaagaaaagaguua

SEQ ID NO: 31022 - RNA, 18 nt, Artificial Sequence
  Description of Artificial Sequence: Synthetic oligonucleotide
cuuuagagguaagaaaag

SEQ ID NO: 31023 - RNA, 18 nt, Artificial Sequence
  Description of Artificial Sequence: Synthetic oligonucleotide
ucuuacuuuagagguaag

SEQ ID NO: 31024 - RNA, 18 nt, Artificial Sequence
  Description of Artificial Sequence: Synthetic oligonucleotide
uauuuucuuacuuuagag

SEQ ID NO: 31025 - RNA, 18 nt, Artificial Sequence
  Description of Artificial Sequence: Synthetic oligonucleotide
gaaauuauuuucuuacuu

SEQ ID NO: 31026 - RNA, 18 nt, Artificial Sequence
  Description of Artificial Sequence: Synthetic oligonucleotide
ucuaggaaauuauuuucu

SEQ ID NO: 31027 - RNA, 18 nt, Artificial Sequence
  Description of Artificial Sequence: Synthetic oligonucleotide
auaaaucuaggaaauuau

SEQ ID NO: 31028 - RNA, 18 nt, Artificial Sequence
  Description of Artificial Sequence: Synthetic oligonucleotide
uuaggauaaaucuaggaa

SEQ ID NO: 31029 - RNA, 18 nt, Artificial Sequence
  Description of Artificial Sequence: Synthetic oligonucleotide
cauguuuaggauaaaucu

SEQ ID NO: 31030 - RNA, 18 nt, Artificial Sequence
  Description of Artificial Sequence: Synthetic oligonucleotide
aucagcauguuuaggaua

SEQ ID NO: 31031 - RNA, 18 nt, Artificial Sequence
  Description of Artificial Sequence: Synthetic oligonucleotide
uauacaucagcauguuua

SEQ ID NO: 31032 - RNA, 18 nt, Artificial Sequence
  Description of Artificial Sequence: Synthetic oligonucleotide
ucuuauauacaucagcau

SEQ ID NO: 31033 - RNA, 18 nt, Artificial Sequence
  Description of Artificial Sequence: Synthetic oligonucleotide
auuacucuuauauacauc

SEQ ID NO: 31034 - RNA, 18 nt, Artificial Sequence
  Description of Artificial Sequence: Synthetic oligonucleotide
aagguauuacucuuauau

SEQ ID NO: 31035 - RNA, 18 nt, Artificial Sequence
  Description of Artificial Sequence: Synthetic oligonucleotide
caauuaagguauuacucu

SEQ ID NO: 31036 - RNA, 18 nt, Artificial Sequence
  Description of Artificial Sequence: Synthetic oligonucleotide
auaaacaauuaagguauu

SEQ ID NO: 31037 - RNA, 18 nt, Artificial Sequence
  Description of Artificial Sequence: Synthetic oligonucleotide
aaaccauaaacaauuaag

SEQ ID NO: 31038 - RNA, 18 nt, Artificial Sequence
  Description of Artificial Sequence: Synthetic oligonucleotide
aagaaaaaccauaaacaa

SEQ ID NO: 31039 - RNA, 18 nt, Artificial Sequence
  Description of Artificial Sequence: Synthetic oligonucleotide
ccaggaagaaaaaccaua

SEQ ID NO: 31040 - RNA, 18 nt, Artificial Sequence
  Description of Artificial Sequence: Synthetic oligonucleotide
aguguccaggaagaaaaa

SEQ ID NO: 31041 - RNA, 18 nt, Artificial Sequence
  Description of Artificial Sequence: Synthetic oligonucleotide
aaaagaguguccaggaag

SEQ ID NO: 31042 - RNA, 18 nt, Artificial Sequence
  Description of Artificial Sequence: Synthetic oligonucleotide
uguagaaaagagugucca

SEQ ID NO: 31043 - RNA, 18 nt, Artificial Sequence
  Description of Artificial Sequence: Synthetic oligonucleotide
caaaaaaauacaaggcag

SEQ ID NO: 31044 - RNA, 18 nt, Artificial Sequence
  Description of Artificial Sequence: Synthetic oligonucleotide
uaggucaaaaaaauacaa

SEQ ID NO: 31045 - RNA, 18 nt, Artificial Sequence
  Description of Artificial Sequence: Synthetic oligonucleotide
uuugauaggucaaaaaaa

SEQ ID NO: 31046 - RNA, 18 nt, Artificial Sequence
  Description of Artificial Sequence: Synthetic oligonucleotide
augauuuugauaggucaa

SEQ ID NO: 31047 - RNA, 18 nt, Artificial Sequence
  Description of Artificial Sequence: Synthetic oligonucleotide
gaaaaaugauuuugauag

SEQ ID NO: 31048 - RNA, 18 nt, Artificial Sequence
  Description of Artificial Sequence: Synthetic oligonucleotide
uaauugaaaaaugauuuu

SEQ ID NO: 31049 - RNA, 18 nt, Artificial Sequence
  Description of Artificial Sequence: Synthetic oligonucleotide
acaaguaauugaaaaaug

SEQ ID NO: 31050 - RNA, 18 nt, Artificial Sequence
  Description of Artificial Sequence: Synthetic oligonucleotide
gggaaacaaguaauugaa

SEQ ID NO: 31051 - RNA, 18 nt, Artificial Sequence
  Description of Artificial Sequence: Synthetic oligonucleotide
gacaucugaaaucuaggg

SEQ ID NO: 31052 - RNA, 18 nt, Artificial Sequence
  Description of Artificial Sequence: Synthetic oligonucleotide
ccgugacaucugaaaucu

SEQ ID NO: 31053 - RNA, 18 nt, Artificial Sequence
  Description of Artificial Sequence: Synthetic oligonucleotide
ucauaccgugacaucuga

SEQ ID NO: 31054 - RNA, 18 nt, Artificial Sequence
  Description of Artificial Sequence: Synthetic oligonucleotide
accuuucauaccgugaca

SEQ ID NO: 31055 - RNA, 18 nt, Artificial Sequence
  Description of Artificial Sequence: Synthetic oligonucleotide
auaaaaccuuucauaccg

SEQ ID NO: 31056 - RNA, 18 nt, Artificial Sequence
  Description of Artificial Sequence: Synthetic oligonucleotide
uauauauaaaaccuuuca

SEQ ID NO: 31057 - RNA, 18 nt, Artificial Sequence
  Description of Artificial Sequence: Synthetic oligonucleotide
uuaaauauauauaaaacc

SEQ ID NO: 31058 - RNA, 18 nt, Artificial Sequence
  Description of Artificial Sequence: Synthetic oligonucleotide
auuuuuuaaauauauaua

SEQ ID NO: 31059 - RNA, 18 nt, Artificial Sequence
  Description of Artificial Sequence: Synthetic oligonucleotide
acuuuauuuuuuaaauau

SEQ ID NO: 31060 - RNA, 18 nt, Artificial Sequence
  Description of Artificial Sequence: Synthetic oligonucleotide
uuuauacuuuauuuuuua

SEQ ID NO: 31061 - RNA, 18 nt, Artificial Sequence
  Description of Artificial Sequence: Synthetic oligonucleotide
uuauguuuauacuuuauu

SEQ ID NO: 31062 - RNA, 18 nt, Artificial Sequence
  Description of Artificial Sequence: Synthetic oligonucleotide
agacuuuauguuuauacu

SEQ ID NO: 31063 - RNA, 18 nt, Artificial Sequence
  Description of Artificial Sequence: Synthetic oligonucleotide
caaaaagacuuuauguuu

SEQ ID NO: 31064 - RNA, 18 nt, Artificial Sequence
  Description of Artificial Sequence: Synthetic oligonucleotide
cgcuucaaaaagacuuua

SEQ ID NO: 31065 - RNA, 18 nt, Artificial Sequence
  Description of Artificial Sequence: Synthetic oligonucleotide
aaccacgcuucaaaaaga

SEQ ID NO: 31066 - RNA, 18 nt, Artificial Sequence
  Description of Artificial Sequence: Synthetic oligonucleotide
ugcauaaccacgcuucaa

SEQ ID NO: 31067 - RNA, 18 nt, Artificial Sequence
  Description of Artificial Sequence: Synthetic oligonucleotide
uauguugcauaaccacgc

SEQ ID NO: 31068 - RNA, 18 nt, Artificial Sequence
  Description of Artificial Sequence: Synthetic oligonucleotide
uagcauauguugcauaac

SEQ ID NO: 31069 - RNA, 18 nt, Artificial Sequence
  Description of Artificial Sequence: Synthetic oligonucleotide
acgccuagcauauguugc

SEQ ID NO: 31070 - RNA, 18 nt, Artificial Sequence
  Description of Artificial Sequence: Synthetic oligonucleotide
aacuuacgccuagcauau

SEQ ID NO: 31071 - RNA, 18 nt, Artificial Sequence
  Description of Artificial Sequence: Synthetic oligonucleotide
ucaccaacuuacgccuag

SEQ ID NO: 31072 - RNA, 18 nt, Artificial Sequence
  Description of Artificial Sequence: Synthetic oligonucleotide
ggcauucaccaacuuacg

SEQ ID NO: 31073 - RNA, 18 nt, Artificial Sequence
  Description of Artificial Sequence: Synthetic oligonucleotide
aagcaggcauucaccaac

SEQ ID NO: 31074 - RNA, 18 nt, Artificial Sequence
  Description of Artificial Sequence: Synthetic oligonucleotide
cugcaaagcaggcauuca

SEQ ID NO: 31075 - RNA, 18 nt, Artificial Sequence
  Description of Artificial Sequence: Synthetic oligonucleotide
acacucugcaaagcaggc

SEQ ID NO: 31076 - RNA, 18 nt, Artificial Sequence
  Description of Artificial Sequence: Synthetic oligonucleotide
ggguuacacucugcaaag

SEQ ID NO: 31077 - RNA, 18 nt, Artificial Sequence
  Description of Artificial Sequence: Synthetic oligonucleotide
cuuuuuuuauucaauggg

SEQ ID NO: 31078 - RNA, 18 nt, Artificial Sequence
  Description of Artificial Sequence: Synthetic oligonucleotide
gcuuuuuuuauucaaugg

SEQ ID NO: 31079 - RNA, 18 nt, Artificial Sequence
  Description of Artificial Sequence: Synthetic oligonucleotide
acaaagcuuuuuuuauuc

SEQ ID NO: 31080 - RNA, 18 nt, Artificial Sequence
  Description of Artificial Sequence: Synthetic oligonucleotide
ggaaaacaaagcuuuuuu

SEQ ID NO: 31081 - RNA, 18 nt, Artificial Sequence
  Description of Artificial Sequence: Synthetic oligonucleotide
gaaagggaaaacaaagcu

SEQ ID NO: 31082 - RNA, 18 nt, Artificial Sequence
  Description of Artificial Sequence: Synthetic oligonucleotide
gggcagaaagggaaaaca

SEQ ID NO: 31083 - RNA, 18 nt, Artificial Sequence
  Description of Artificial Sequence: Synthetic oligonucleotide
gcccauacugauacaggg

SEQ ID NO: 31084 - RNA, 18 nt, Artificial Sequence
  Description of Artificial Sequence: Synthetic oligonucleotide
ugcccauacugauacagg

SEQ ID NO: 31085 - RNA, 18 nt, Artificial Sequence
  Description of Artificial Sequence: Synthetic oligonucleotide
gggugugcccauacugau

SEQ ID NO: 31086 - RNA, 18 nt, Artificial Sequence
  Description of Artificial Sequence: Synthetic oligonucleotide
gugcagggugugcccaua

SEQ ID NO: 31087 - RNA, 18 nt, Artificial Sequence
  Description of Artificial Sequence: Synthetic oligonucleotide
uuagagugcagggugugc

SEQ ID NO: 31088 - RNA, 18 nt, Artificial Sequence
  Description of Artificial Sequence: Synthetic oligonucleotide
uaaaguuagagugcaggg

SEQ ID NO: 31089 - RNA, 18 nt, Artificial Sequence
  Description of Artificial Sequence: Synthetic oligonucleotide
uagauuaaaguuagagug

SEQ ID NO: 31090 - RNA, 18 nt, Artificial Sequence
  Description of Artificial Sequence: Synthetic oligonucleotide
ugacguagauuaaaguua

SEQ ID NO: 31091 - RNA, 18 nt, Artificial Sequence
  Description of Artificial Sequence: Synthetic oligonucleotide
gagggugacguagauuaa

SEQ ID NO: 31092 - RNA, 18 nt, Artificial Sequence
  Description of Artificial Sequence: Synthetic oligonucleotide
caggugagggugacguag

SEQ ID NO: 31093 - RNA, 18 nt, Artificial Sequence
  Description of Artificial Sequence: Synthetic oligonucleotide
ccaaacaggugaggguga

SEQ ID NO: 31094 - RNA, 18 nt, Artificial Sequence
  Description of Artificial Sequence: Synthetic oligonucleotide
ccaaaccaaacaggugag

SEQ ID NO: 31095 - RNA, 18 nt, Artificial Sequence
  Description of Artificial Sequence: Synthetic oligonucleotide
uaaacccaaaccaaacag

SEQ ID NO: 31096 - RNA, 18 nt, Artificial Sequence
  Description of Artificial Sequence: Synthetic oligonucleotide
gacauuaaacccaaacca

SEQ ID NO: 31097 - RNA, 18 nt, Artificial Sequence
  Description of Artificial Sequence: Synthetic oligonucleotide
ucgcagacauuaaaccca

SEQ ID NO: 31098 - RNA, 18 nt, Artificial Sequence
  Description of Artificial Sequence: Synthetic oligonucleotide
uuuucucgcagacauuaa

SEQ ID NO: 31099 - RNA, 18 nt, Artificial Sequence
  Description of Artificial Sequence: Synthetic oligonucleotide
uuugguuuucucgcagac

SEQ ID NO: 31100 - RNA, 18 nt, Artificial Sequence
  Description of Artificial Sequence: Synthetic oligonucleotide
agauauuugguuuucucg

SEQ ID NO: 31101 - RNA, 18 nt, Artificial Sequence
  Description of Artificial Sequence: Synthetic oligonucleotide
acacaagauauuugguuu

SEQ ID NO: 31102 - RNA, 18 nt, Artificial Sequence
  Description of Artificial Sequence: Synthetic oligonucleotide
acaauacacaagauauuu

SEQ ID NO: 31103 - RNA, 18 nt, Artificial Sequence
  Description of Artificial Sequence: Synthetic oligonucleotide
aguucacaauacacaaga

SEQ ID NO: 31104 - RNA, 18 nt, Artificial Sequence
  Description of Artificial Sequence: Synthetic oligonucleotide
uugacaguucacaauaca

SEQ ID NO: 31105 - RNA, 18 nt, Artificial Sequence
  Description of Artificial Sequence: Synthetic oligonucleotide
uggcuuugacaguucaca

SEQ ID NO: 31106 - RNA, 18 nt, Artificial Sequence
  Description of Artificial Sequence: Synthetic oligonucleotide
uuagauggcuuugacagu

SEQ ID NO: 31107 - RNA, 18 nt, Artificial Sequence
  Description of Artificial Sequence: Synthetic oligonucleotide
uugguuuagauggcuuug

SEQ ID NO: 31108 - RNA, 18 nt, Artificial Sequence
  Description of Artificial Sequence: Synthetic oligonucleotide
ugggauugguuuagaugg

SEQ ID NO: 31109 - RNA, 18 nt, Artificial Sequence
  Description of Artificial Sequence: Synthetic oligonucleotide
gaccuugggauugguuua

SEQ ID NO: 31110 - RNA, 18 nt, Artificial Sequence
  Description of Artificial Sequence: Synthetic oligonucleotide
cacuugaccuugggauug

SEQ ID NO: 31111 - RNA, 18 nt, Artificial Sequence
  Description of Artificial Sequence: Synthetic oligonucleotide
auauccacuugaccuugg

SEQ ID NO: 31112 - RNA, 18 nt, Artificial Sequence
  Description of Artificial Sequence: Synthetic oligonucleotide
uuuuuauauccacuugac

SEQ ID NO: 31113 - RNA, 18 nt, Artificial Sequence
  Description of Artificial Sequence: Synthetic oligonucleotide
cagaauuuuuauauccac

SEQ ID NO: 31114 - RNA, 18 nt, Artificial Sequence
  Description of Artificial Sequence: Synthetic oligonucleotide
uuuggcagaauuuuuaua

SEQ ID NO: 31115 - RNA, 18 nt, Artificial Sequence
  Description of Artificial Sequence: Synthetic oligonucleotide
auguuuuuggcagaauuu

SEQ ID NO: 31116 - RNA, 18 nt, Artificial Sequence
  Description of Artificial Sequence: Synthetic oligonucleotide
augccauguuuuuggcag

SEQ ID NO: 31117 - RNA, 18 nt, Artificial Sequence
  Description of Artificial Sequence: Synthetic oligonucleotide
aucuuaugccauguuuuu

SEQ ID NO: 31118 - RNA, 18 nt, Artificial Sequence
  Description of Artificial Sequence: Synthetic oligonucleotide
uuuccaucuuaugccaug

SEQ ID NO: 31119 - RNA, 18 nt, Artificial Sequence
  Description of Artificial Sequence: Synthetic oligonucleotide
gaacuuuuccaucuuaug

SEQ ID NO: 31120 - RNA, 18 nt, Artificial Sequence
  Description of Artificial Sequence: Synthetic oligonucleotide
ucagggaacuuuuccauc

SEQ ID NO: 31121 - RNA, 18 nt, Artificial Sequence
  Description of Artificial Sequence: Synthetic oligonucleotide
aguuuucagggaacuuuu

SEQ ID NO: 31122 - RNA, 18 nt, Artificial Sequence
  Description of Artificial Sequence: Synthetic oligonucleotide
uccagaguuuucagggaa

SEQ ID NO: 31123 - RNA, 18 nt, Artificial Sequence
  Description of Artificial Sequence: Synthetic oligonucleotide
uuucuuccagaguuuuca

SEQ ID NO: 31124 - RNA, 18 nt, Artificial Sequence
  Description of Artificial Sequence: Synthetic oligonucleotide
uuuguuuucuuccagagu

SEQ ID NO: 31125 - RNA, 18 nt, Artificial Sequence
  Description of Artificial Sequence: Synthetic oligonucleotide
auuacuuuguuuucuucc

SEQ ID NO: 31126 - RNA, 18 nt, Artificial Sequence
  Description of Artificial Sequence: Synthetic oligonucleotide
ucuacauuacuuuguuuu

SEQ ID NO: 31127 - RNA, 18 nt, Artificial Sequence
  Description of Artificial Sequence: Synthetic oligonucleotide
aggugucuacauuacuuu

SEQ ID NO: 31128 - RNA, 18 nt, Artificial Sequence
  Description of Artificial Sequence: Synthetic oligonucleotide
aaagaaggugucuacauu

SEQ ID NO: 31129 - RNA, 18 nt, Artificial Sequence
  Description of Artificial Sequence: Synthetic oligonucleotide
gggaaaaagaaggugucu

SEQ ID NO: 31130 - RNA, 18 nt, Artificial Sequence
  Description of Artificial Sequence: Synthetic oligonucleotide
auuuucuaaugguguggg

SEQ ID NO: 31131 - RNA, 18 nt, Artificial Sequence
  Description of Artificial Sequence: Synthetic oligonucleotide
aacauuuucuaauggugu

SEQ ID NO: 31132 - RNA, 18 nt, Artificial Sequence
  Description of Artificial Sequence: Synthetic oligonucleotide
gaugcaacauuuucuaau

SEQ ID NO: 31133 - RNA, 18 nt, Artificial Sequence
  Description of Artificial Sequence: Synthetic oligonucleotide
guccucaucgucauuauu

SEQ ID NO: 31134 - RNA, 18 nt, Artificial Sequence
  Description of Artificial Sequence: Synthetic oligonucleotide
gucagguccucaucguca

SEQ ID NO: 31135 - RNA, 18 nt, Artificial Sequence
  Description of Artificial Sequence: Synthetic oligonucleotide
cuggugucagguccucau

SEQ ID NO: 31136 - RNA, 18 nt, Artificial Sequence
  Description of Artificial Sequence: Synthetic oligonucleotide
cugcucuggugucagguc

SEQ ID NO: 31137 - RNA, 18 nt, Artificial Sequence
  Description of Artificial Sequence: Synthetic oligonucleotide
gccuucugcucugguguc

SEQ ID NO: 31138 - RNA, 18 nt, Artificial Sequence
  Description of Artificial Sequence: Synthetic oligonucleotide
gcucugccuucugcucug

SEQ ID NO: 31139 - RNA, 18 nt, Artificial Sequence
  Description of Artificial Sequence: Synthetic oligonucleotide
cucacgcucugccuucug

SEQ ID NO: 31140 - RNA, 18 nt, Artificial Sequence
  Description of Artificial Sequence: Synthetic oligonucleotide
uccuucucacgcucugcc

SEQ ID NO: 31141 - RNA, 18 nt, Artificial Sequence
  Description of Artificial Sequence: Synthetic oligonucleotide
uccgcuccuucucacgcu

SEQ ID NO: 31142 - RNA, 18 nt, Artificial Sequence
  Description of Artificial Sequence: Synthetic oligonucleotide
cauccuccgcuccuucuc

SEQ ID NO: 31143 - RNA, 18 nt, Artificial Sequence
  Description of Artificial Sequence: Synthetic oligonucleotide
uuggccauccuccgcucc

SEQ ID NO: 31144 - RNA, 18 nt, Artificial Sequence
  Description of Artificial Sequence: Synthetic oligonucleotide
cauuguuggccauccucc

SEQ ID NO: 31145 - RNA, 18 nt, Artificial Sequence
  Description of Artificial Sequence: Synthetic oligonucleotide
ucgggcauuguuggccau

SEQ ID NO: 31146 - RNA, 18 nt, Artificial Sequence
  Description of Artificial Sequence: Synthetic oligonucleotide
cgcucucgggcauuguug

SEQ ID NO: 31147 - RNA, 18 nt, Artificial Sequence
  Description of Artificial Sequence: Synthetic oligonucleotide
gcagacgcucucgggcau

SEQ ID NO: 31148 - RNA, 18 nt, Artificial Sequence
  Description of Artificial Sequence: Synthetic oligonucleotide
gacccgcagacgcucucg

SEQ ID NO: 31149 - RNA, 18 nt, Artificial Sequence
  Description of Artificial Sequence: Synthetic oligonucleotide
ucacggacccgcagacgc

SEQ ID NO: 31150 - RNA, 18 nt, Artificial Sequence
  Description of Artificial Sequence: Synthetic oligonucleotide
ugaugucacggacccgca

SEQ ID NO: 31151 - RNA, 18 nt, Artificial Sequence
  Description of Artificial Sequence: Synthetic oligonucleotide
cucguugaugucacggac

SEQ ID NO: 31152 - RNA, 18 nt, Artificial Sequence
  Description of Artificial Sequence: Synthetic oligonucleotide
aaagccucguugauguca

SEQ ID NO: 31153 - RNA, 18 nt, Artificial Sequence
  Description of Artificial Sequence: Synthetic oligonucleotide
cuuugaaagccucguuga

SEQ ID NO: 31154 - RNA, 18 nt, Artificial Sequence
  Description of Artificial Sequence: Synthetic oligonucleotide
gagcucuuugaaagccuc

SEQ ID NO: 31155 - RNA, 18 nt, Artificial Sequence
  Description of Artificial Sequence: Synthetic oligonucleotide
cggccgagcucuuugaaa

SEQ ID NO: 31156 - RNA, 18 nt, Artificial Sequence
  Description of Artificial Sequence: Synthetic oligonucleotide
ccaugcggccgagcucuu

SEQ ID NO: 31157 - RNA, 18 nt, Artificial Sequence
  Description of Artificial Sequence: Synthetic oligonucleotide
cugcaccaugcggccgag

SEQ ID NO: 31158 - RNA, 18 nt, Artificial Sequence
  Description of Artificial Sequence: Synthetic oligonucleotide
uggagcugcaccaugcgg

SEQ ID NO: 31159 - RNA, 18 nt, Artificial Sequence
  Description of Artificial Sequence: Synthetic oligonucleotide
ugagguggagcugcacca

SEQ ID NO: 31160 - RNA, 18 nt, Artificial Sequence
  Description of Artificial Sequence: Synthetic oligonucleotide
acucuugagguggagcug

SEQ ID NO: 31161 - RNA, 18 nt, Artificial Sequence
  Description of Artificial Sequence: Synthetic oligonucleotide
uugucacucuugaggugg

SEQ ID NO: 31162 - RNA, 18 nt, Artificial Sequence
  Description of Artificial Sequence: Synthetic oligonucleotide
gggcuugucacucuugag

SEQ ID NO: 31163 - RNA, 18 nt, Artificial Sequence
  Description of Artificial Sequence: Synthetic oligonucleotide
ucaggagcuuggucuggg

SEQ ID NO: 31164 - RNA, 18 nt, Artificial Sequence
  Description of Artificial Sequence: Synthetic oligonucleotide
gaggaucaggagcuuggu

SEQ ID NO: 31165 - RNA, 18 nt, Artificial Sequence
  Description of Artificial Sequence: Synthetic oligonucleotide
ugguggaggaucaggagc

SEQ ID NO: 31166 - RNA, 18 nt, Artificial Sequence
  Description of Artificial Sequence: Synthetic oligonucleotide
ccgccugguggaggauca

SEQ ID NO: 31167 - RNA, 18 nt, Artificial Sequence
  Description of Artificial Sequence: Synthetic oligonucleotide
ggccaccgccugguggag

SEQ ID NO: 31168 - RNA, 18 nt, Artificial Sequence
  Description of Artificial Sequence: Synthetic oligonucleotide
augacggccaccgccugg

SEQ ID NO: 31169 - RNA, 18 nt, Artificial Sequence
  Description of Artificial Sequence: Synthetic oligonucleotide
ugaggaugacggccaccg

SEQ ID NO: 31170 - RNA, 18 nt, Artificial Sequence
  Description of Artificial Sequence: Synthetic oligonucleotide
cagacugaggaugacggc

SEQ ID NO: 31171 - RNA, 18 nt, Artificial Sequence
  Description of Artificial Sequence: Synthetic oligonucleotide
ugcuccagacugaggaug

SEQ ID NO: 31172 - RNA, 18 nt, Artificial Sequence
  Description of Artificial Sequence: Synthetic oligonucleotide
cuugcugcuccagacuga

SEQ ID NO: 31173 - RNA, 18 nt, Artificial Sequence
  Description of Artificial Sequence: Synthetic oligonucleotide
ucggacuugcugcuccag

SEQ ID NO: 31174 - RNA, 18 nt, Artificial Sequence
  Description of Artificial Sequence: Synthetic oligonucleotide
cuguaguccugguggcau

SEQ ID NO: 31175 - RNA, 18 nt, Artificial Sequence
  Description of Artificial Sequence: Synthetic oligonucleotide
ugccccuguaguccuggu

SEQ ID NO: 31176 - RNA, 18 nt, Artificial Sequence
  Description of Artificial Sequence: Synthetic oligonucleotide
cacucugccccuguaguc

SEQ ID NO: 31177 - RNA, 18 nt, Artificial Sequence
  Description of Artificial Sequence: Synthetic oligonucleotide
ggagacacucugccccug

SEQ ID NO: 31178 - RNA, 18 nt, Artificial Sequence
  Description of Artificial Sequence: Synthetic oligonucleotide
ccagaggagacacucugc

SEQ ID NO: 31179 - RNA, 18 nt, Artificial Sequence
  Description of Artificial Sequence: Synthetic oligonucleotide
agcugccagaggagacac

SEQ ID NO: 31180 - RNA, 18 nt, Artificial Sequence
  Description of Artificial Sequence: Synthetic oligonucleotide
cucagagcugccagagga

SEQ ID NO: 31181 - RNA, 18 nt, Artificial Sequence
  Description of Artificial Sequence: Synthetic oligonucleotide
uugaucucagagcugcca

SEQ ID NO: 31182 - RNA, 18 nt, Artificial Sequence
  Description of Artificial Sequence: Synthetic oligonucleotide
cggauuugaucucagagc

SEQ ID NO: 31183 - RNA, 18 nt, Artificial Sequence
  Description of Artificial Sequence: Synthetic oligonucleotide
gucaucggauuugaucuc

SEQ ID NO: 31184 - RNA, 18 nt, Artificial Sequence
  Description of Artificial Sequence: Synthetic oligonucleotide
cccucgucaucggauuug

SEQ ID NO: 31185 - RNA, 18 nt, Artificial Sequence
  Description of Artificial Sequence: Synthetic oligonucleotide
caucacccucgucaucgg

SEQ ID NO: 31186 - RNA, 18 nt, Artificial Sequence
  Description of Artificial Sequence: Synthetic oligonucleotide
guucucaucacccucguc

SEQ ID NO: 31187 - RNA, 18 nt, Artificial Sequence
  Description of Artificial Sequence: Synthetic oligonucleotide
ugcagguucucaucaccc

SEQ ID NO: 31188 - RNA, 18 nt, Artificial Sequence
  Description of Artificial Sequence: Synthetic oligonucleotide
ugucuugcagguucucau

SEQ ID NO: 31189 - RNA, 18 nt, Artificial Sequence
  Description of Artificial Sequence: Synthetic oligonucleotide
uuucgugucuugcagguu

SEQ ID NO: 31190 - RNA, 18 nt, Artificial Sequence
  Description of Artificial Sequence: Synthetic oligonucleotide
gaagauuucgugucuugc

SEQ ID NO: 31191 - RNA, 18 nt, Artificial Sequence
  Description of Artificial Sequence: Synthetic oligonucleotide
ccuccgaagauuucgugu

SEQ ID NO: 31192 - RNA, 18 nt, Artificial Sequence
  Description of Artificial Sequence: Synthetic oligonucleotide
cuuguccuccgaagauuu

SEQ ID NO: 31193 - RNA, 18 nt, Artificial Sequence
  Description of Artificial Sequence: Synthetic oligonucleotide
aauuucuuguccuccgaa

SEQ ID NO: 31194 - RNA, 18 nt, Artificial Sequence
  Description of Artificial Sequence: Synthetic oligonucleotide
caucuaauuucuuguccu

SEQ ID NO: 31195 - RNA, 18 nt, Artificial Sequence
  Description of Artificial Sequence: Synthetic oligonucleotide
gucgucaucuaauuucuu

SEQ ID NO: 31196 - RNA, 18 nt, Artificial Sequence
  Description of Artificial Sequence: Synthetic oligonucleotide
uucuugucgucaucuaau

SEQ ID NO: 31197 - RNA, 18 nt, Artificial Sequence
  Description of Artificial Sequence: Synthetic oligonucleotide
uauccuucuugucgucau

SEQ ID NO: 31198 - RNA, 18 nt, Artificial Sequence
  Description of Artificial Sequence: Synthetic oligonucleotide
uuugauauccuucuuguc

SEQ ID NO: 31199 - RNA, 18 nt, Artificial Sequence
  Description of Artificial Sequence: Synthetic oligonucleotide
auugauuugauauccuuc

SEQ ID NO: 31200 - RNA, 18 nt, Artificial Sequence
  Description of Artificial Sequence: Synthetic oligonucleotide
uaguaauugauuugauau

SEQ ID NO: 31201 - RNA, 18 nt, Artificial Sequence
  Description of Artificial Sequence: Synthetic oligonucleotide
ugaccuaguaauugauuu

SEQ ID NO: 31202 - RNA, 18 nt, Artificial Sequence
  Description of Artificial Sequence: Synthetic oligonucleotide
gaucuugaccuaguaauu

SEQ ID NO: 31203 - RNA, 18 nt, Artificial Sequence
  Description of Artificial Sequence: Synthetic oligonucleotide
gcgacaguauuauauacu

SEQ ID NO: 31204 - RNA, 18 nt, Artificial Sequence
  Description of Artificial Sequence: Synthetic oligonucleotide
augaagcgacaguauuau

SEQ ID NO: 31205 - RNA, 18 nt, Artificial Sequence
  Description of Artificial Sequence: Synthetic oligonucleotide
auuaaaugaagcgacagu

SEQ ID NO: 31206 - RNA, 18 nt, Artificial Sequence
  Description of Artificial Sequence: Synthetic oligonucleotide
aaggaauuaaaugaagcg

SEQ ID NO: 31207 - RNA, 18 nt, Artificial Sequence
  Description of Artificial Sequence: Synthetic oligonucleotide
caauaaaggaauuaaaug

SEQ ID NO: 31208 - RNA, 18 nt, Artificial Sequence
  Description of Artificial Sequence: Synthetic oligonucleotide
aaguccaauaaaggaauu

SEQ ID NO: 31209 - RNA, 18 nt, Artificial Sequence
  Description of Artificial Sequence: Synthetic oligonucleotide
caucaaaguccaauaaag

SEQ ID NO: 31210 - RNA, 18 nt, Artificial Sequence
  Description of Artificial Sequence: Synthetic oligonucleotide
cacuucaucaaaguccaa

SEQ ID NO: 31211 - RNA, 18 nt, Artificial Sequence
  Description of Artificial Sequence: Synthetic oligonucleotide
cuguucacuucaucaaag

SEQ ID NO: 31212 - RNA, 18 nt, Artificial Sequence
  Description of Artificial Sequence: Synthetic oligonucleotide
ccguucuguucacuucau

SEQ ID NO: 31213 - RNA, 18 nt, Artificial Sequence
  Description of Artificial Sequence: Synthetic oligonucleotide
ucuucccguucuguucac

SEQ ID NO: 31214 - RNA, 18 nt, Artificial Sequence
  Description of Artificial Sequence: Synthetic oligonucleotide
uaguuucuucccguucug

SEQ ID NO: 31215 - RNA, 18 nt, Artificial Sequence
  Description of Artificial Sequence: Synthetic oligonucleotide
cugaauaguuucuucccg

SEQ ID NO: 31216 - RNA, 18 nt, Artificial Sequence
  Description of Artificial Sequence: Synthetic oligonucleotide
aaaaacugaauaguuucu

SEQ ID NO: 31217 - RNA, 18 nt, Artificial Sequence
  Description of Artificial Sequence: Synthetic oligonucleotide
caggaaaaaacugaauag

SEQ ID NO: 31218 - RNA, 18 nt, Artificial Sequence
  Description of Artificial Sequence: Synthetic oligonucleotide
ccugccaggaaaaaacug

SEQ ID NO: 31219 - RNA, 18 nt, Artificial Sequence
  Description of Artificial Sequence: Synthetic oligonucleotide
auuuaccugccaggaaaa

SEQ ID NO: 31220 - RNA, 18 nt, Artificial Sequence
  Description of Artificial Sequence: Synthetic oligonucleotide
uguaaauuuaccugccag

SEQ ID NO: 31221 - RNA, 18 nt, Artificial Sequence
  Description of Artificial Sequence: Synthetic oligonucleotide
ucagcuguaaauuuaccu

SEQ ID NO: 31222 - RNA, 18 nt, Artificial Sequence
  Description of Artificial Sequence: Synthetic oligonucleotide
ucuuuucagcuguaaauu

SEQ ID NO: 31223 - RNA, 18 nt, Artificial Sequence
  Description of Artificial Sequence: Synthetic oligonucleotide
aauuuucuuuucagcugu

SEQ ID NO: 31224 - RNA, 18 nt, Artificial Sequence
  Description of Artificial Sequence: Synthetic oligonucleotide
ccuuuaauuuucuuuuca

SEQ ID NO: 31225 - RNA, 18 nt, Artificial Sequence
  Description of Artificial Sequence: Synthetic oligonucleotide
guaggccuuuaauuuucu

SEQ ID NO: 31226 - RNA, 18 nt, Artificial Sequence
  Description of Artificial Sequence: Synthetic oligonucleotide
cuagaguaggccuuuaau

SEQ ID NO: 31227 - RNA, 18 nt, Artificial Sequence
  Description of Artificial Sequence: Synthetic oligonucleotide
uacuucuagaguaggccu

SEQ ID NO: 31228 - RNA, 18 nt, Artificial Sequence
  Description of Artificial Sequence: Synthetic oligonucleotide
uuuaguacuucuagagua

SEQ ID NO: 31229 - RNA, 18 nt, Artificial Sequence
  Description of Artificial Sequence: Synthetic oligonucleotide
auacuuuuaguacuucua

SEQ ID NO: 31230 - RNA, 18 nt, Artificial Sequence
  Description of Artificial Sequence: Synthetic oligonucleotide
aaacgauacuuuuaguac

SEQ ID NO: 31231 - RNA, 18 nt, Artificial Sequence
  Description of Artificial Sequence: Synthetic oligonucleotide
aucugaaacgauacuuuu

SEQ ID NO: 31232 - RNA, 18 nt, Artificial Sequence
  Description of Artificial Sequence: Synthetic oligonucleotide
cagguaucugaaacgaua

SEQ ID NO: 31233 - RNA, 18 nt, Artificial Sequence
  Description of Artificial Sequence: Synthetic oligonucleotide
gaguacagguaucugaaa

SEQ ID NO: 31234 - RNA, 18 nt, Artificial Sequence
  Description of Artificial Sequence: Synthetic oligonucleotide
caauagaguacagguauc

SEQ ID NO: 31235 - RNA, 18 nt, Artificial Sequence
  Description of Artificial Sequence: Synthetic oligonucleotide
ggcuccaauagaguacag

SEQ ID NO: 31236 - RNA, 18 nt, Artificial Sequence
  Description of Artificial Sequence: Synthetic oligonucleotide
guuuaggcuccaauagag

SEQ ID NO: 31237 - RNA, 18 nt, Artificial Sequence
  Description of Artificial Sequence: Synthetic oligonucleotide
aaacaguuuaggcuccaa

SEQ ID NO: 31238 - RNA, 18 nt, Artificial Sequence
  Description of Artificial Sequence: Synthetic oligonucleotide
ugccaaaacaguuuaggc

SEQ ID NO: 31239 - RNA, 18 nt, Artificial Sequence
  Description of Artificial Sequence: Synthetic oligonucleotide
auaaaugccaaaacaguu

SEQ ID NO: 31240 - RNA, 18 nt, Artificial Sequence
  Description of Artificial Sequence: Synthetic oligonucleotide
gauucauaaaugccaaaa

SEQ ID NO: 31241 - RNA, 18 nt, Artificial Sequence
  Description of Artificial Sequence: Synthetic oligonucleotide
guccagauucauaaaugc

SEQ ID NO: 31242 - RNA, 18 nt, Artificial Sequence
  Description of Artificial Sequence: Synthetic oligonucleotide
auuggguccagauucaua

SEQ ID NO: 31243 - RNA, 18 nt, Artificial Sequence
  Description of Artificial Sequence: Synthetic oligonucleotide
uuagcauuggguccagau

SEQ ID NO: 31244 - RNA, 18 nt, Artificial Sequence
  Description of Artificial Sequence: Synthetic oligonucleotide
ugucauuagcauuggguc

SEQ ID NO: 31245 - RNA, 18 nt, Artificial Sequence
  Description of Artificial Sequence: Synthetic oligonucleotide
cugugugucauuagcauu

SEQ ID NO: 31246 - RNA, 18 nt, Artificial Sequence
  Description of Artificial Sequence: Synthetic oligonucleotide
uuucacugugugucauua

SEQ ID NO: 31247 - RNA, 18 nt, Artificial Sequence
  Description of Artificial Sequence: Synthetic oligonucleotide
aauuuuuucacugugugu

SEQ ID NO: 31248 - RNA, 18 nt, Artificial Sequence
  Description of Artificial Sequence: Synthetic oligonucleotide
agacaaauuuuuucacug

SEQ ID NO: 31249 - RNA, 18 nt, Artificial Sequence
  Description of Artificial Sequence: Synthetic oligonucleotide
aucagagacaaauuuuuu

SEQ ID NO: 31250 - RNA, 18 nt, Artificial Sequence
  Description of Artificial Sequence: Synthetic oligonucleotide
cuugaaucagagacaaau

SEQ ID NO: 31251 - RNA, 18 nt, Artificial Sequence
  Description of Artificial Sequence: Synthetic oligonucleotide
cuguacuugaaucagaga

SEQ ID NO: 31252 - RNA, 18 nt, Artificial Sequence
  Description of Artificial Sequence: Synthetic oligonucleotide
auaaacuguacuugaauc

SEQ ID NO: 31253 - RNA, 18 nt, Artificial Sequence
  Description of Artificial Sequence: Synthetic oligonucleotide
uacaaauaaacuguacuu

SEQ ID NO: 31254 - RNA, 18 nt, Artificial Sequence
  Description of Artificial Sequence: Synthetic oligonucleotide
aguuuuacaaauaaacug

SEQ ID NO: 31255 - RNA, 18 nt, Artificial Sequence
  Description of Artificial Sequence: Synthetic oligonucleotide
aguauaguuuuacaaaua

SEQ ID NO: 31256 - RNA, 18 nt, Artificial Sequence
  Description of Artificial Sequence: Synthetic oligonucleotide
gaauaaguauaguuuuac

SEQ ID NO: 31257 - RNA, 18 nt, Artificial Sequence
  Description of Artificial Sequence: Synthetic oligonucleotide
uuguagaauaaguauagu

SEQ ID NO: 31258 - RNA, 18 nt, Artificial Sequence
  Description of Artificial Sequence: Synthetic oligonucleotide
caaauuuguagaauaagu

SEQ ID NO: 31259 - RNA, 18 nt, Artificial Sequence
  Description of Artificial Sequence: Synthetic oligonucleotide
cugaccaaauuuguagaa

SEQ ID NO: 31260 - RNA, 18 nt, Artificial Sequence
  Description of Artificial Sequence: Synthetic oligonucleotide
cauuucugaccaaauuug

SEQ ID NO: 31261 - RNA, 18 nt, Artificial Sequence
  Description of Artificial Sequence: Synthetic oligonucleotide
cacaacauuucugaccaa

SEQ ID NO: 31262 - RNA, 18 nt, Artificial Sequence
  Description of Artificial Sequence: Synthetic oligonucleotide
auagacacaacauuucug

SEQ ID NO: 31263 - RNA, 18 nt, Artificial Sequence
  Description of Artificial Sequence: Synthetic oligonucleotide
auauuauagacacaacau

SEQ ID NO: 31264 - RNA, 18 nt, Artificial Sequence
  Description of Artificial Sequence: Synthetic oligonucleotide
uagaaauauuauagacac

SEQ ID NO: 31265 - RNA, 18 nt, Artificial Sequence
  Description of Artificial Sequence: Synthetic oligonucleotide
cuuuuuagaaauauuaua

SEQ ID NO: 31266 - RNA, 18 nt, Artificial Sequence
  Description of Artificial Sequence: Synthetic oligonucleotide
aaucucuuuuuagaaaua

SEQ ID NO: 31267 - RNA, 18 nt, Artificial Sequence
  Description of Artificial Sequence: Synthetic oligonucleotide
gcuacaaucucuuuuuag

SEQ ID NO: 31268 - RNA, 18 nt, Artificial Sequence
  Description of Artificial Sequence: Synthetic oligonucleotide
acauggcuacaaucucuu

SEQ ID NO: 31269 - RNA, 18 nt, Artificial Sequence
  Description of Artificial Sequence: Synthetic oligonucleotide
uuuuaacauggcuacaau

SEQ ID NO: 31270 - RNA, 18 nt, Artificial Sequence
  Description of Artificial Sequence: Synthetic oligonucleotide
ugaguuuuuaacauggcu

SEQ ID NO: 31271 - RNA, 18 nt, Artificial Sequence
  Description of Artificial Sequence: Synthetic oligonucleotide
ucaguugaguuuuuaaca

SEQ ID NO: 31272 - RNA, 18 nt, Artificial Sequence
  Description of Artificial Sequence: Synthetic oligonucleotide
auacaucaguugaguuuu

SEQ ID NO: 31273 - RNA, 18 nt, Artificial Sequence
  Description of Artificial Sequence: Synthetic oligonucleotide
ggcacauacaucaguuga

SEQ ID NO: 31274 - RNA, 18 nt, Artificial Sequence
  Description of Artificial Sequence: Synthetic oligonucleotide
uaguuggcacauacauca

SEQ ID NO: 31275 - RNA, 18 nt, Artificial Sequence
  Description of Artificial Sequence: Synthetic oligonucleotide
aguuauaguuggcacaua

SEQ ID NO: 31276 - RNA, 18 nt, Artificial Sequence
  Description of Artificial Sequence: Synthetic oligonucleotide
aaaagaguuauaguuggc

SEQ ID NO: 31277 - RNA, 18 nt, Artificial Sequence
  Description of Artificial Sequence: Synthetic oligonucleotide
guaagaaaagaguuauag

SEQ ID NO: 31278 - RNA, 18 nt, Artificial Sequence
  Description of Artificial Sequence: Synthetic oligonucleotide
uagagguaagaaaagagu

SEQ ID NO: 31279 - RNA, 18 nt, Artificial Sequence
  Description of Artificial Sequence: Synthetic oligonucleotide
uacuuuagagguaagaaa

SEQ ID NO: 31280 - RNA, 18 nt, Artificial Sequence
  Description of Artificial Sequence: Synthetic oligonucleotide
uuucuuacuuuagaggua

SEQ ID NO: 31281 - RNA, 18 nt, Artificial Sequence
  Description of Artificial Sequence: Synthetic oligonucleotide
auuauuuucuuacuuuag

SEQ ID NO: 31282 - RNA, 18 nt, Artificial Sequence
  Description of Artificial Sequence: Synthetic oligonucleotide
aggaaauuauuuucuuac

SEQ ID NO: 31283 - RNA, 18 nt, Artificial Sequence
  Description of Artificial Sequence: Synthetic oligonucleotide
aaucuaggaaauuauuuu

SEQ ID NO: 31284 - RNA, 18 nt, Artificial Sequence
  Description of Artificial Sequence: Synthetic oligonucleotide
ggauaaaucuaggaaauu

SEQ ID NO: 31285 - RNA, 18 nt, Artificial Sequence
  Description of Artificial Sequence: Synthetic oligonucleotide
guuuaggauaaaucuagg

SEQ ID NO: 31286 - RNA, 18 nt, Artificial Sequence
  Description of Artificial Sequence: Synthetic oligonucleotide
agcauguuuaggauaaau

SEQ ID NO: 31287 - RNA, 18 nt, Artificial Sequence
  Description of Artificial Sequence: Synthetic oligonucleotide
acaucagcauguuuagga

SEQ ID NO: 31288 - RNA, 18 nt, Artificial Sequence
  Description of Artificial Sequence: Synthetic oligonucleotide
uauauacaucagcauguu

SEQ ID NO: 31289 - RNA, 18 nt, Artificial Sequence
  Description of Artificial Sequence: Synthetic oligonucleotide
acucuuauauacaucagc

SEQ ID NO: 31290 - RNA, 18 nt, Artificial Sequence
  Description of Artificial Sequence: Synthetic oligonucleotide
guauuacucuuauauaca

SEQ ID NO: 31291 - RNA, 18 nt, Artificial Sequence
  Description of Artificial Sequence: Synthetic oligonucleotide
uuaagguauuacucuuau

SEQ ID NO: 31292 - RNA, 18 nt, Artificial Sequence
  Description of Artificial Sequence: Synthetic oligonucleotide
aacaauuaagguauuacu

SEQ ID NO: 31293 - RNA, 18 nt, Artificial Sequence
  Description of Artificial Sequence: Synthetic oligonucleotide
ccauaaacaauuaaggua

SEQ ID NO: 31294 - RNA, 18 nt, Artificial Sequence
  Description of Artificial Sequence: Synthetic oligonucleotide
aaaaaccauaaacaauua

SEQ ID NO: 31295 - RNA, 18 nt, Artificial Sequence
  Description of Artificial Sequence: Synthetic oligonucleotide
ggaagaaaaaccauaaac

SEQ ID NO: 31296 - RNA, 18 nt, Artificial Sequence
  Description of Artificial Sequence: Synthetic oligonucleotide
guccaggaagaaaaacca

SEQ ID NO: 31297 - RNA, 18 nt, Artificial Sequence
  Description of Artificial Sequence: Synthetic oligonucleotide
agaguguccaggaagaaa

SEQ ID NO: 31298 - RNA, 18 nt, Artificial Sequence
  Description of Artificial Sequence: Synthetic oligonucleotide
agaaaagaguguccagga

SEQ ID NO: 31299 - RNA, 18 nt, Artificial Sequence
  Description of Artificial Sequence: Synthetic oligonucleotide
ucuguagaaaagaguguc

SEQ ID NO: 31300 - RNA, 18 nt, Artificial Sequence
  Description of Artificial Sequence: Synthetic oligonucleotide
uguuuucuguagaaaaga

SEQ ID NO: 31301 - RNA, 18 nt, Artificial Sequence
  Description of Artificial Sequence: Synthetic oligonucleotide
aguuguguuuucuguaga

SEQ ID NO: 31302 - RNA, 18 nt, Artificial Sequence
  Description of Artificial Sequence: Synthetic oligonucleotide
caaaaaaauacaaggcag

SEQ ID NO: 31303 - RNA, 18 nt, Artificial Sequence
  Description of Artificial Sequence: Synthetic oligonucleotide
uaggucaaaaaaauacaa

SEQ ID NO: 31304 - RNA, 18 nt, Artificial Sequence
  Description of Artificial Sequence: Synthetic oligonucleotide
uuugauaggucaaaaaaa

SEQ ID NO: 31305 - RNA, 18 nt, Artificial Sequence
  Description of Artificial Sequence: Synthetic oligonucleotide
augauuuugauaggucaa

SEQ ID NO: 31306 - RNA, 18 nt, Artificial Sequence
  Description of Artificial Sequence: Synthetic oligonucleotide
gaaaaaugauuuugauag

SEQ ID NO: 31307 - RNA, 18 nt, Artificial Sequence
  Description of Artificial Sequence: Synthetic oligonucleotide
uaauugaaaaaugauuuu

SEQ ID NO: 31308 - RNA, 18 nt, Artificial Sequence
  Description of Artificial Sequence: Synthetic oligonucleotide
acaaguaauugaaaaaug

SEQ ID NO: 31309 - RNA, 18 nt, Artificial Sequence
  Description of Artificial Sequence: Synthetic oligonucleotide
gggaaacaaguaauugaa

SEQ ID NO: 31310 - RNA, 18 nt, Artificial Sequence
  Description of Artificial Sequence: Synthetic oligonucleotide
gacaucugaaaucuaggg

SEQ ID NO: 31311 - RNA, 18 nt, Artificial Sequence
  Description of Artificial Sequence: Synthetic oligonucleotide
ccgugacaucugaaaucu

SEQ ID NO: 31312 - RNA, 18 nt, Artificial Sequence
  Description of Artificial Sequence: Synthetic oligonucleotide
ucauaccgugacaucuga

SEQ ID NO: 31313 - RNA, 18 nt, Artificial Sequence
  Description of Artificial Sequence: Synthetic oligonucleotide
accuuucauaccgugaca

SEQ ID NO: 31314 - RNA, 18 nt, Artificial Sequence
  Description of Artificial Sequence: Synthetic oligonucleotide
auaaaaccuuucauaccg

SEQ ID NO: 31315 - RNA, 18 nt, Artificial Sequence
  Description of Artificial Sequence: Synthetic oligonucleotide
uauauauaaaaccuuuca

SEQ ID NO: 31316 - RNA, 18 nt, Artificial Sequence
  Description of Artificial Sequence: Synthetic oligonucleotide
uuaaauauauauaaaacc

SEQ ID NO: 31317 - RNA, 18 nt, Artificial Sequence
  Description of Artificial Sequence: Synthetic oligonucleotide
auuuuuuaaauauauaua

SEQ ID NO: 31318 - RNA, 18 nt, Artificial Sequence
  Description of Artificial Sequence: Synthetic oligonucleotide
acuuuauuuuuuaaauau

SEQ ID NO: 31319 - RNA, 18 nt, Artificial Sequence
  Description of Artificial Sequence: Synthetic oligonucleotide
uuuauacuuuauuuuuua

SEQ ID NO: 31320 - RNA, 18 nt, Artificial Sequence
  Description of Artificial Sequence: Synthetic oligonucleotide
uuauguuuauacuuuauu

SEQ ID NO: 31321 - RNA, 18 nt, Artificial Sequence
  Description of Artificial Sequence: Synthetic oligonucleotide
agacuuuauguuuauacu

SEQ ID NO: 31322 - RNA, 18 nt, Artificial Sequence
  Description of Artificial Sequence: Synthetic oligonucleotide
caaaaagacuuuauguuu

SEQ ID NO: 31323 - RNA, 18 nt, Artificial Sequence
  Description of Artificial Sequence: Synthetic oligonucleotide
cgcuucaaaaagacuuua

SEQ ID NO: 31324 - RNA, 18 nt, Artificial Sequence
  Description of Artificial Sequence: Synthetic oligonucleotide
aaccacgcuucaaaaaga

SEQ ID NO: 31325 - RNA, 18 nt, Artificial Sequence
  Description of Artificial Sequence: Synthetic oligonucleotide
ugcauaaccacgcuucaa

SEQ ID NO: 31326 - RNA, 18 nt, Artificial Sequence
  Description of Artificial Sequence: Synthetic oligonucleotide
uauguugcauaaccacgc

SEQ ID NO: 31327 - RNA, 18 nt, Artificial Sequence
  Description of Artificial Sequence: Synthetic oligonucleotide
uagcauauguugcauaac

SEQ ID NO: 31328 - RNA, 18 nt, Artificial Sequence
  Description of Artificial Sequence: Synthetic oligonucleotide
acgccuagcauauguugc

SEQ ID NO: 31329 - RNA, 18 nt, Artificial Sequence
  Description of Artificial Sequence: Synthetic oligonucleotide
aacuuacgccuagcauau

SEQ ID NO: 31330 - RNA, 18 nt, Artificial Sequence
  Description of Artificial Sequence: Synthetic oligonucleotide
ucaccaacuuacgccuag

SEQ ID NO: 31331 - RNA, 18 nt, Artificial Sequence
  Description of Artificial Sequence: Synthetic oligonucleotide
ggcauucaccaacuuacg

SEQ ID NO: 31332 - RNA, 18 nt, Artificial Sequence
  Description of Artificial Sequence: Synthetic oligonucleotide
aagcaggcauucaccaac

SEQ ID NO: 31333 - RNA, 18 nt, Artificial Sequence
  Description of Artificial Sequence: Synthetic oligonucleotide
cugcaaagcaggcauuca

SEQ ID NO: 31334 - RNA, 18 nt, Artificial Sequence
  Description of Artificial Sequence: Synthetic oligonucleotide
acacucugcaaagcaggc

SEQ ID NO: 31335 - RNA, 18 nt, Artificial Sequence
  Description of Artificial Sequence: Synthetic oligonucleotide
ggguuacacucugcaaag

SEQ ID NO: 31336 - RNA, 18 nt, Artificial Sequence
  Description of Artificial Sequence: Synthetic oligonucleotide
cuuuuuuuauucaauggg

SEQ ID NO: 31337 - RNA, 18 nt, Artificial Sequence
  Description of Artificial Sequence: Synthetic oligonucleotide
gcuuuuuuuauucaaugg

SEQ ID NO: 31338 - RNA, 18 nt, Artificial Sequence
  Description of Artificial Sequence: Synthetic oligonucleotide
acaaagcuuuuuuuauuc

SEQ ID NO: 31339 - RNA, 18 nt, Artificial Sequence
  Description of Artificial Sequence: Synthetic oligonucleotide
ggaaaacaaagcuuuuuu

SEQ ID NO: 31340 - RNA, 18 nt, Artificial Sequence
  Description of Artificial Sequence: Synthetic oligonucleotide
gaaagggaaaacaaagcu

SEQ ID NO: 31341 - RNA, 18 nt, Artificial Sequence
  Description of Artificial Sequence: Synthetic oligonucleotide
gggcagaaagggaaaaca

SEQ ID NO: 31342 - RNA, 18 nt, Artificial Sequence
  Description of Artificial Sequence: Synthetic oligonucleotide
gcccauacugauacaggg

SEQ ID NO: 31343 - RNA, 18 nt, Artificial Sequence
  Description of Artificial Sequence: Synthetic oligonucleotide
ugcccauacugauacagg

SEQ ID NO: 31344 - RNA, 18 nt, Artificial Sequence
  Description of Artificial Sequence: Synthetic oligonucleotide
gggugugcccauacugau

SEQ ID NO: 31345 - RNA, 18 nt, Artificial Sequence
  Description of Artificial Sequence: Synthetic oligonucleotide
gugcagggugugcccaua

SEQ ID NO: 31346 - RNA, 18 nt, Artificial Sequence
  Description of Artificial Sequence: Synthetic oligonucleotide
uuagagugcagggugugc

SEQ ID NO: 31347 - RNA, 18 nt, Artificial Sequence
  Description of Artificial Sequence: Synthetic oligonucleotide
uaaaguuagagugcaggg

SEQ ID NO: 31348 - RNA, 18 nt, Artificial Sequence
  Description of Artificial Sequence: Synthetic oligonucleotide
uagauuaaaguuagagug

SEQ ID NO: 31349 - RNA, 18 nt, Artificial Sequence
  Description of Artificial Sequence: Synthetic oligonucleotide
ugacguagauuaaaguua

SEQ ID NO: 31350 - RNA, 18 nt, Artificial Sequence
  Description of Artificial Sequence: Synthetic oligonucleotide
gagggugacguagauuaa

SEQ ID NO: 31351 - RNA, 18 nt, Artificial Sequence
  Description of Artificial Sequence: Synthetic oligonucleotide
caggugagggugacguag

SEQ ID NO: 31352 - RNA, 18 nt, Artificial Sequence
  Description of Artificial Sequence: Synthetic oligonucleotide
ccaaacaggugaggguga

SEQ ID NO: 31353 - RNA, 18 nt, Artificial Sequence
  Description of Artificial Sequence: Synthetic oligonucleotide
ccaaaccaaacaggugag

SEQ ID NO: 31354 - RNA, 18 nt, Artificial Sequence
  Description of Artificial Sequence: Synthetic oligonucleotide
uaaacccaaaccaaacag

SEQ ID NO: 31355 - RNA, 18 nt, Artificial Sequence
  Description of Artificial Sequence: Synthetic oligonucleotide
gacauuaaacccaaacca

SEQ ID NO: 31356 - RNA, 18 nt, Artificial Sequence
  Description of Artificial Sequence: Synthetic oligonucleotide
ucgcagacauuaaaccca

SEQ ID NO: 31357 - RNA, 18 nt, Artificial Sequence
  Description of Artificial Sequence: Synthetic oligonucleotide
uuuucucgcagacauuaa

SEQ ID NO: 31358 - RNA, 18 nt, Artificial Sequence
  Description of Artificial Sequence: Synthetic oligonucleotide
uuugguuuucucgcagac

SEQ ID NO: 31359 - RNA, 18 nt, Artificial Sequence
  Description of Artificial Sequence: Synthetic oligonucleotide
agauauuugguuuucucg

SEQ ID NO: 31360 - RNA, 18 nt, Artificial Sequence
  Description of Artificial Sequence: Synthetic oligonucleotide
acacaagauauuugguuu

SEQ ID NO: 31361 - RNA, 18 nt, Artificial Sequence
  Description of Artificial Sequence: Synthetic oligonucleotide
acaauacacaagauauuu

SEQ ID NO: 31362 - RNA, 18 nt, Artificial Sequence
  Description of Artificial Sequence: Synthetic oligonucleotide
aguucacaauacacaaga

SEQ ID NO: 31363 - RNA, 18 nt, Artificial Sequence
  Description of Artificial Sequence: Synthetic oligonucleotide
uugacaguucacaauaca

SEQ ID NO: 31364 - RNA, 18 nt, Artificial Sequence
  Description of Artificial Sequence: Synthetic oligonucleotide
uggcuuugacaguucaca

SEQ ID NO: 31365 - RNA, 18 nt, Artificial Sequence
  Description of Artificial Sequence: Synthetic oligonucleotide
uuagauggcuuugacagu

SEQ ID NO: 31366 - RNA, 18 nt, Artificial Sequence
  Description of Artificial Sequence: Synthetic oligonucleotide
uugguuuagauggcuuug

SEQ ID NO: 31367 - RNA, 18 nt, Artificial Sequence
  Description of Artificial Sequence: Synthetic oligonucleotide
ugggauugguuuagaugg

SEQ ID NO: 31368 - RNA, 18 nt, Artificial Sequence
  Description of Artificial Sequence: Synthetic oligonucleotide
gaccuugggauugguuua

SEQ ID NO: 31369 - RNA, 18 nt, Artificial Sequence
  Description of Artificial Sequence: Synthetic oligonucleotide
cacuugaccuugggauug

SEQ ID NO: 31370 - RNA, 18 nt, Artificial Sequence
  Description of Artificial Sequence: Synthetic oligonucleotide
auauccacuugaccuugg

SEQ ID NO: 31371 - RNA, 18 nt, Artificial Sequence
  Description of Artificial Sequence: Synthetic oligonucleotide
uuuuuauauccacuugac

SEQ ID NO: 31372 - RNA, 18 nt, Artificial Sequence
  Description of Artificial Sequence: Synthetic oligonucleotide
cagaauuuuuauauccac

SEQ ID NO: 31373 - RNA, 18 nt, Artificial Sequence
  Description of Artificial Sequence: Synthetic oligonucleotide
uuuggcagaauuuuuaua

SEQ ID NO: 31374 - RNA, 18 nt, Artificial Sequence
  Description of Artificial Sequence: Synthetic oligonucleotide
auguuuuuggcagaauuu

SEQ ID NO: 31375 - RNA, 18 nt, Artificial Sequence
  Description of Artificial Sequence: Synthetic oligonucleotide
augccauguuuuuggcag

SEQ ID NO: 31376 - RNA, 18 nt, Artificial Sequence
  Description of Artificial Sequence: Synthetic oligonucleotide
aucuuaugccauguuuuu

SEQ ID NO: 31377 - RNA, 18 nt, Artificial Sequence
  Description of Artificial Sequence: Synthetic oligonucleotide
uuuccaucuuaugccaug

SEQ ID NO: 31378 - RNA, 18 nt, Artificial Sequence
  Description of Artificial Sequence: Synthetic oligonucleotide
gaacuuuuccaucuuaug

SEQ ID NO: 31379 - RNA, 18 nt, Artificial Sequence
  Description of Artificial Sequence: Synthetic oligonucleotide
ucagggaacuuuuccauc

SEQ ID NO: 31380 - RNA, 18 nt, Artificial Sequence
  Description of Artificial Sequence: Synthetic oligonucleotide
aguuuucagggaacuuuu

SEQ ID NO: 31381 - RNA, 18 nt, Artificial Sequence
  Description of Artificial Sequence: Synthetic oligonucleotide
uccagaguuuucagggaa

SEQ ID NO: 31382 - RNA, 18 nt, Artificial Sequence
  Description of Artificial Sequence: Synthetic oligonucleotide
uuucuuccagaguuuuca

SEQ ID NO: 31383 - RNA, 18 nt, Artificial Sequence
  Description of Artificial Sequence: Synthetic oligonucleotide
uuuguuuucuuccagagu

SEQ ID NO: 31384 - RNA, 18 nt, Artificial Sequence
  Description of Artificial Sequence: Synthetic oligonucleotide
auuacuuuguuuucuucc

SEQ ID NO: 31385 - RNA, 18 nt, Artificial Sequence
  Description of Artificial Sequence: Synthetic oligonucleotide
ucuacauuacuuuguuuu

SEQ ID NO: 31386 - RNA, 18 nt, Artificial Sequence
  Description of Artificial Sequence: Synthetic oligonucleotide
aggugucuacauuacuuu

SEQ ID NO: 31387 - RNA, 18 nt, Artificial Sequence
  Description of Artificial Sequence: Synthetic oligonucleotide
aaagaaggugucuacauu

SEQ ID NO: 31388 - RNA, 18 nt, Artificial Sequence
  Description of Artificial Sequence: Synthetic oligonucleotide
gggaaaaagaaggugucu

SEQ ID NO: 31389 - RNA, 18 nt, Artificial Sequence
  Description of Artificial Sequence: Synthetic oligonucleotide
auuuucuaaugguguggg

SEQ ID NO: 31390 - RNA, 18 nt, Artificial Sequence
  Description of Artificial Sequence: Synthetic oligonucleotide
aacauuuucuaauggugu

SEQ ID NO: 31391 - RNA, 18 nt, Artificial Sequence
  Description of Artificial Sequence: Synthetic oligonucleotide
gaugcaacauuuucuaau

SEQ ID NO: 31392 - RNA, 18 nt, Artificial Sequence
  Description of Artificial Sequence: Synthetic oligonucleotide
guccucaucgucauuauu

SEQ ID NO: 31393 - RNA, 18 nt, Artificial Sequence
  Description of Artificial Sequence: Synthetic oligonucleotide
gucagguccucaucguca

SEQ ID NO: 31394 - RNA, 18 nt, Artificial Sequence
  Description of Artificial Sequence: Synthetic oligonucleotide
cuggugucagguccucau

SEQ ID NO: 31395 - RNA, 18 nt, Artificial Sequence
  Description of Artificial Sequence: Synthetic oligonucleotide
cugcucuggugucagguc

SEQ ID NO: 31396 - RNA, 18 nt, Artificial Sequence
  Description of Artificial Sequence: Synthetic oligonucleotide
gccuucugcucugguguc

SEQ ID NO: 31397 - RNA, 18 nt, Artificial Sequence
  Description of Artificial Sequence: Synthetic oligonucleotide
gcucugccuucugcucug

SEQ ID NO: 31398 - RNA, 18 nt, Artificial Sequence
  Description of Artificial Sequence: Synthetic oligonucleotide
cucacgcucugccuucug

SEQ ID NO: 31399 - RNA, 18 nt, Artificial Sequence
  Description of Artificial Sequence: Synthetic oligonucleotide
uccuucucacgcucugcc

SEQ ID NO: 31400 - RNA, 18 nt, Artificial Sequence
  Description of Artificial Sequence: Synthetic oligonucleotide
uccgcuccuucucacgcu

SEQ ID NO: 31401 - RNA, 18 nt, Artificial Sequence
  Description of Artificial Sequence: Synthetic oligonucleotide
cauccuccgcuccuucuc

SEQ ID NO: 31402 - RNA, 18 nt, Artificial Sequence
  Description of Artificial Sequence: Synthetic oligonucleotide
uuggccauccuccgcucc

SEQ ID NO: 31403 - RNA, 18 nt, Artificial Sequence
  Description of Artificial Sequence: Synthetic oligonucleotide
cauuguuggccauccucc

SEQ ID NO: 31404 - RNA, 18 nt, Artificial Sequence
  Description of Artificial Sequence: Synthetic oligonucleotide
ucgggcauuguuggccau

SEQ ID NO: 31405 - RNA, 18 nt, Artificial Sequence
  Description of Artificial Sequence: Synthetic oligonucleotide
cgcucucgggcauuguug

SEQ ID NO: 31406 - RNA, 18 nt, Artificial Sequence
  Description of Artificial Sequence: Synthetic oligonucleotide
gcagacgcucucgggcau

SEQ ID NO: 31407 - RNA, 18 nt, Artificial Sequence
  Description of Artificial Sequence: Synthetic oligonucleotide
gacccgcagacgcucucg

SEQ ID NO: 31408 - RNA, 18 nt, Artificial Sequence
  Description of Artificial Sequence: Synthetic oligonucleotide
ucacggacccgcagacgc

SEQ ID NO: 31409 - RNA, 18 nt, Artificial Sequence
  Description of Artificial Sequence: Synthetic oligonucleotide
ugaugucacggacccgca

SEQ ID NO: 31410 - RNA, 18 nt, Artificial Sequence
  Description of Artificial Sequence: Synthetic oligonucleotide
cucguugaugucacggac

SEQ ID NO: 31411 - RNA, 18 nt, Artificial Sequence
  Description of Artificial Sequence: Synthetic oligonucleotide
aaagccucguugauguca

SEQ ID NO: 31412 - RNA, 18 nt, Artificial Sequence
  Description of Artificial Sequence: Synthetic oligonucleotide
cuuugaaagccucguuga

SEQ ID NO: 31413 - RNA, 18 nt, Artificial Sequence
  Description of Artificial Sequence: Synthetic oligonucleotide
gagcucuuugaaagccuc

SEQ ID NO: 31414 - RNA, 18 nt, Artificial Sequence
  Description of Artificial Sequence: Synthetic oligonucleotide
cggccgagcucuuugaaa

SEQ ID NO: 31415 - RNA, 18 nt, Artificial Sequence
  Description of Artificial Sequence: Synthetic oligonucleotide
ccaugcggccgagcucuu

SEQ ID NO: 31416 - RNA, 18 nt, Artificial Sequence
  Description of Artificial Sequence: Synthetic oligonucleotide
cugcaccaugcggccgag

SEQ ID NO: 31417 - RNA, 18 nt, Artificial Sequence
  Description of Artificial Sequence: Synthetic oligonucleotide
uggagcugcaccaugcgg

SEQ ID NO: 31418 - RNA, 18 nt, Artificial Sequence
  Description of Artificial Sequence: Synthetic oligonucleotide
ugagguggagcugcacca

SEQ ID NO: 31419 - RNA, 18 nt, Artificial Sequence
  Description of Artificial Sequence: Synthetic oligonucleotide
acucuugagguggagcug

SEQ ID NO: 31420 - RNA, 18 nt, Artificial Sequence
  Description of Artificial Sequence: Synthetic oligonucleotide
uugucacucuugaggugg

SEQ ID NO: 31421 - RNA, 18 nt, Artificial Sequence
  Description of Artificial Sequence: Synthetic oligonucleotide
gggcuugucacucuugag

SEQ ID NO: 31422 - RNA, 18 nt, Artificial Sequence
  Description of Artificial Sequence: Synthetic oligonucleotide
ucaggagcuuggucuggg

SEQ ID NO: 31423 - RNA, 18 nt, Artificial Sequence
  Description of Artificial Sequence: Synthetic oligonucleotide
gaggaucaggagcuuggu

SEQ ID NO: 31424 - RNA, 18 nt, Artificial Sequence
  Description of Artificial Sequence: Synthetic oligonucleotide
ugguggaggaucaggagc

SEQ ID NO: 31425 - RNA, 18 nt, Artificial Sequence
  Description of Artificial Sequence: Synthetic oligonucleotide
ccgccugguggaggauca

SEQ ID NO: 31426 - RNA, 18 nt, Artificial Sequence
  Description of Artificial Sequence: Synthetic oligonucleotide
ggccaccgccugguggag

SEQ ID NO: 31427 - RNA, 18 nt, Artificial Sequence
  Description of Artificial Sequence: Synthetic oligonucleotide
augacggccaccgccugg

SEQ ID NO: 31428 - RNA, 18 nt, Artificial Sequence
  Description of Artificial Sequence: Synthetic oligonucleotide
ugaggaugacggccaccg

SEQ ID NO: 31429 - RNA, 18 nt, Artificial Sequence
  Description of Artificial Sequence: Synthetic oligonucleotide
cagacugaggaugacggc

SEQ ID NO: 31430 - RNA, 18 nt, Artificial Sequence
  Description of Artificial Sequence: Synthetic oligonucleotide
ugcuccagacugaggaug

SEQ ID NO: 31431 - RNA, 18 nt, Artificial Sequence
  Description of Artificial Sequence: Synthetic oligonucleotide
cuugcugcuccagacuga

SEQ ID NO: 31432 - RNA, 18 nt, Artificial Sequence
  Description of Artificial Sequence: Synthetic oligonucleotide
ucggacuugcugcuccag

SEQ ID NO: 31433 - RNA, 18 nt, Artificial Sequence
  Description of Artificial Sequence: Synthetic oligonucleotide
guaguccugguggcaugc

SEQ ID NO: 31434 - RNA, 18 nt, Artificial Sequence
  Description of Artificial Sequence: Synthetic oligonucleotide
ccccuguaguccuggugg

SEQ ID NO: 31435 - RNA, 18 nt, Artificial Sequence
  Description of Artificial Sequence: Synthetic oligonucleotide
cucugccccuguaguccu

SEQ ID NO: 31436 - RNA, 18 nt, Artificial Sequence
  Description of Artificial Sequence: Synthetic oligonucleotide
agacacucugccccugua

SEQ ID NO: 31437 - RNA, 18 nt, Artificial Sequence
  Description of Artificial Sequence: Synthetic oligonucleotide
agaggagacacucugccc

SEQ ID NO: 31438 - RNA, 18 nt, Artificial Sequence
  Description of Artificial Sequence: Synthetic oligonucleotide
cugccagaggagacacuc

SEQ ID NO: 31439 - RNA, 18 nt, Artificial Sequence
  Description of Artificial Sequence: Synthetic oligonucleotide
cagagcugccagaggaga

SEQ ID NO: 31440 - RNA, 18 nt, Artificial Sequence
  Description of Artificial Sequence: Synthetic oligonucleotide
gaucucagagcugccaga

SEQ ID NO: 31441 - RNA, 18 nt, Artificial Sequence
  Description of Artificial Sequence: Synthetic oligonucleotide
gauuugaucucagagcug

SEQ ID NO: 31442 - RNA, 18 nt, Artificial Sequence
  Description of Artificial Sequence: Synthetic oligonucleotide
caucggauuugaucucag

SEQ ID NO: 31443 - RNA, 18 nt, Artificial Sequence
  Description of Artificial Sequence: Synthetic oligonucleotide
cucgucaucggauuugau

SEQ ID NO: 31444 - RNA, 18 nt, Artificial Sequence
  Description of Artificial Sequence: Synthetic oligonucleotide
ucacccucgucaucggau

SEQ ID NO: 31445 - RNA, 18 nt, Artificial Sequence
  Description of Artificial Sequence: Synthetic oligonucleotide
ucucaucacccucgucau

SEQ ID NO: 31446 - RNA, 18 nt, Artificial Sequence
  Description of Artificial Sequence: Synthetic oligonucleotide
cagguucucaucacccuc

SEQ ID NO: 31447 - RNA, 18 nt, Artificial Sequence
  Description of Artificial Sequence: Synthetic oligonucleotide
ucuugcagguucucauca

SEQ ID NO: 31448 - RNA, 18 nt, Artificial Sequence
  Description of Artificial Sequence: Synthetic oligonucleotide
ucgugucuugcagguucu

SEQ ID NO: 31449 - RNA, 18 nt, Artificial Sequence
  Description of Artificial Sequence: Synthetic oligonucleotide
agauuucgugucuugcag

SEQ ID NO: 31450 - RNA, 18 nt, Artificial Sequence
  Description of Artificial Sequence: Synthetic oligonucleotide
uccgaagauuucgugucu

SEQ ID NO: 31451 - RNA, 18 nt, Artificial Sequence
  Description of Artificial Sequence: Synthetic oligonucleotide
uguccuccgaagauuucg

SEQ ID NO: 31452 - RNA, 18 nt, Artificial Sequence
  Description of Artificial Sequence: Synthetic oligonucleotide
uuucuuguccuccgaaga

SEQ ID NO: 31453 - RNA, 18 nt, Artificial Sequence
  Description of Artificial Sequence: Synthetic oligonucleotide
ucuaauuucuuguccucc

SEQ ID NO: 31454 - RNA, 18 nt, Artificial Sequence
  Description of Artificial Sequence: Synthetic oligonucleotide
cgucaucuaauuucuugu

SEQ ID NO: 31455 - RNA, 18 nt, Artificial Sequence
  Description of Artificial Sequence: Synthetic oligonucleotide
cuugucgucaucuaauuu

SEQ ID NO: 31456 - RNA, 18 nt, Artificial Sequence
  Description of Artificial Sequence: Synthetic oligonucleotide
uccuucuugucgucaucu

SEQ ID NO: 31457 - RNA, 18 nt, Artificial Sequence
  Description of Artificial Sequence: Synthetic oligonucleotide
ugauauccuucuugucgu

SEQ ID NO: 31458 - RNA, 18 nt, Artificial Sequence
  Description of Artificial Sequence: Synthetic oligonucleotide
ugauuugauauccuucuu

SEQ ID NO: 31459 - RNA, 18 nt, Artificial Sequence
  Description of Artificial Sequence: Synthetic oligonucleotide
guaauugauuugauaucc

SEQ ID NO: 31460 - RNA, 18 nt, Artificial Sequence
  Description of Artificial Sequence: Synthetic oligonucleotide
uauacuguuaccuagauc

SEQ ID NO: 31461 - RNA, 18 nt, Artificial Sequence
  Description of Artificial Sequence: Synthetic oligonucleotide
uauuauauacuguuaccu

SEQ ID NO: 31462 - RNA, 18 nt, Artificial Sequence
  Description of Artificial Sequence: Synthetic oligonucleotide
gacaguauuauauacugu

SEQ ID NO: 31463 - RNA, 18 nt, Artificial Sequence
  Description of Artificial Sequence: Synthetic oligonucleotide
gaagcgacaguauuauau

SEQ ID NO: 31464 - RNA, 18 nt, Artificial Sequence
  Description of Artificial Sequence: Synthetic oligonucleotide
uaaaugaagcgacaguau

SEQ ID NO: 31465 - RNA, 18 nt, Artificial Sequence
  Description of Artificial Sequence: Synthetic oligonucleotide
ggaauuaaaugaagcgac

SEQ ID NO: 31466 - RNA, 18 nt, Artificial Sequence
  Description of Artificial Sequence: Synthetic oligonucleotide
auaaaggaauuaaaugaa

SEQ ID NO: 31467 - RNA, 18 nt, Artificial Sequence
  Description of Artificial Sequence: Synthetic oligonucleotide
guccaauaaaggaauuaa

SEQ ID NO: 31468 - RNA, 18 nt, Artificial Sequence
  Description of Artificial Sequence: Synthetic oligonucleotide
ucaaaguccaauaaagga

SEQ ID NO: 31469 - RNA, 18 nt, Artificial Sequence
  Description of Artificial Sequence: Synthetic oligonucleotide
cuucaucaaaguccaaua

SEQ ID NO: 31470 - RNA, 18 nt, Artificial Sequence
  Description of Artificial Sequence: Synthetic oligonucleotide
guucacuucaucaaaguc

SEQ ID NO: 31471 - RNA, 18 nt, Artificial Sequence
  Description of Artificial Sequence: Synthetic oligonucleotide
guucuguucacuucauca

SEQ ID NO: 31472 - RNA, 18 nt, Artificial Sequence
  Description of Artificial Sequence: Synthetic oligonucleotide
uucccguucuguucacuu

SEQ ID NO: 31473 - RNA, 18 nt, Artificial Sequence
  Description of Artificial Sequence: Synthetic oligonucleotide
guuucuucccguucuguu

SEQ ID NO: 31474 - RNA, 18 nt, Artificial Sequence
  Description of Artificial Sequence: Synthetic oligonucleotide
gaauaguuucuucccguu

SEQ ID NO: 31475 - RNA, 18 nt, Artificial Sequence
  Description of Artificial Sequence: Synthetic oligonucleotide
aaacugaauaguuucuuc

SEQ ID NO: 31476 - RNA, 18 nt, Artificial Sequence
  Description of Artificial Sequence: Synthetic oligonucleotide
ggaaaaaacugaauaguu

SEQ ID NO: 31477 - RNA, 18 nt, Artificial Sequence
  Description of Artificial Sequence: Synthetic oligonucleotide
ugccaggaaaaaacugaa

SEQ ID NO: 31478 - RNA, 18 nt, Artificial Sequence
  Description of Artificial Sequence: Synthetic oligonucleotide
uuaccugccaggaaaaaa

SEQ ID NO: 31479 - RNA, 18 nt, Artificial Sequence
  Description of Artificial Sequence: Synthetic oligonucleotide
uaaauuuaccugccagga

SEQ ID NO: 31480 - RNA, 18 nt, Artificial Sequence
  Description of Artificial Sequence: Synthetic oligonucleotide
agcuguaaauuuaccugc

SEQ ID NO: 31481 - RNA, 18 nt, Artificial Sequence
  Description of Artificial Sequence: Synthetic oligonucleotide
uuuucagcuguaaauuua

SEQ ID NO: 31482 - RNA, 18 nt, Artificial Sequence
  Description of Artificial Sequence: Synthetic oligonucleotide
uuuucuuuucagcuguaa

SEQ ID NO: 31483 - RNA, 18 nt, Artificial Sequence
  Description of Artificial Sequence: Synthetic oligonucleotide
uuuaauuuucuuuucagc

SEQ ID NO: 31484 - RNA, 18 nt, Artificial Sequence
  Description of Artificial Sequence: Synthetic oligonucleotide
aggccuuuaauuuucuuu

SEQ ID NO: 31485 - RNA, 18 nt, Artificial Sequence
  Description of Artificial Sequence: Synthetic oligonucleotide
agaguaggccuuuaauuu

SEQ ID NO: 31486 - RNA, 18 nt, Artificial Sequence
  Description of Artificial Sequence: Synthetic oligonucleotide
cuucuagaguaggccuuu

SEQ ID NO: 31487 - RNA, 18 nt, Artificial Sequence
  Description of Artificial Sequence: Synthetic oligonucleotide
uaguacuucuagaguagg

SEQ ID NO: 31488 - RNA, 18 nt, Artificial Sequence
  Description of Artificial Sequence: Synthetic oligonucleotide
acuuuuaguacuucuaga

SEQ ID NO: 31489 - RNA, 18 nt, Artificial Sequence
  Description of Artificial Sequence: Synthetic oligonucleotide
acgauacuuuuaguacuu

SEQ ID NO: 31490 - RNA, 18 nt, Artificial Sequence
  Description of Artificial Sequence: Synthetic oligonucleotide
cugaaacgauacuuuuag

SEQ ID NO: 31491 - RNA, 18 nt, Artificial Sequence
  Description of Artificial Sequence: Synthetic oligonucleotide
gguaucugaaacgauacu

SEQ ID NO: 31492 - RNA, 18 nt, Artificial Sequence
  Description of Artificial Sequence: Synthetic oligonucleotide
guacagguaucugaaacg

SEQ ID NO: 31493 - RNA, 18 nt, Artificial Sequence
  Description of Artificial Sequence: Synthetic oligonucleotide
auagaguacagguaucug

SEQ ID NO: 31494 - RNA, 18 nt, Artificial Sequence
  Description of Artificial Sequence: Synthetic oligonucleotide
cuccaauagaguacaggu

SEQ ID NO: 31495 - RNA, 18 nt, Artificial Sequence
  Description of Artificial Sequence: Synthetic oligonucleotide
uuaggcuccaauagagua

SEQ ID NO: 31496 - RNA, 18 nt, Artificial Sequence
  Description of Artificial Sequence: Synthetic oligonucleotide
acaguuuaggcuccaaua

SEQ ID NO: 31497 - RNA, 18 nt, Artificial Sequence
  Description of Artificial Sequence: Synthetic oligonucleotide
ccaaaacaguuuaggcuc

SEQ ID NO: 31498 - RNA, 18 nt, Artificial Sequence
  Description of Artificial Sequence: Synthetic oligonucleotide
aaaugccaaaacaguuua

SEQ ID NO: 31499 - RNA, 18 nt, Artificial Sequence
  Description of Artificial Sequence: Synthetic oligonucleotide
uucauaaaugccaaaaca

SEQ ID NO: 31500 - RNA, 18 nt, Artificial Sequence
  Description of Artificial Sequence: Synthetic oligonucleotide
ccagauucauaaaugcca

SEQ ID NO: 31501 - RNA, 18 nt, Artificial Sequence
  Description of Artificial Sequence: Synthetic oligonucleotide
uggguccagauucauaaa

SEQ ID NO: 31502 - RNA, 18 nt, Artificial Sequence
  Description of Artificial Sequence: Synthetic oligonucleotide
agcauuggguccagauuc

SEQ ID NO: 31503 - RNA, 18 nt, Artificial Sequence
  Description of Artificial Sequence: Synthetic oligonucleotide
ucauuagcauugggucca

SEQ ID NO: 31504 - RNA, 18 nt, Artificial Sequence
  Description of Artificial Sequence: Synthetic oligonucleotide
gugugucauuagcauugg

SEQ ID NO: 31505 - RNA, 18 nt, Artificial Sequence
  Description of Artificial Sequence: Synthetic oligonucleotide
ucacugugugucauuagc

SEQ ID NO: 31506 - RNA, 18 nt, Artificial Sequence
  Description of Artificial Sequence: Synthetic oligonucleotide
uuuuuucacuguguguca

SEQ ID NO: 31507 - RNA, 18 nt, Artificial Sequence
  Description of Artificial Sequence: Synthetic oligonucleotide
acaaauuuuuucacugug

SEQ ID NO: 31508 - RNA, 18 nt, Artificial Sequence
  Description of Artificial Sequence: Synthetic oligonucleotide
cagagacaaauuuuuuca

SEQ ID NO: 31509 - RNA, 18 nt, Artificial Sequence
  Description of Artificial Sequence: Synthetic oligonucleotide
ugaaucagagacaaauuu

SEQ ID NO: 31510 - RNA, 18 nt, Artificial Sequence
  Description of Artificial Sequence: Synthetic oligonucleotide
guacuugaaucagagaca

SEQ ID NO: 31511 - RNA, 18 nt, Artificial Sequence
  Description of Artificial Sequence: Synthetic oligonucleotide
aaacuguacuugaaucag

SEQ ID NO: 31512 - RNA, 18 nt, Artificial Sequence
  Description of Artificial Sequence: Synthetic oligonucleotide
caaauaaacuguacuuga

SEQ ID NO: 31513 - RNA, 18 nt, Artificial Sequence
  Description of Artificial Sequence: Synthetic oligonucleotide
uuuuacaaauaaacugua

SEQ ID NO: 31514 - RNA, 18 nt, Artificial Sequence
  Description of Artificial Sequence: Synthetic oligonucleotide
uauaguuuuacaaauaaa

SEQ ID NO: 31515 - RNA, 18 nt, Artificial Sequence
  Description of Artificial Sequence: Synthetic oligonucleotide
auaaguauaguuuuacaa

SEQ ID NO: 31516 - RNA, 18 nt, Artificial Sequence
  Description of Artificial Sequence: Synthetic oligonucleotide
guagaauaaguauaguuu

SEQ ID NO: 31517 - RNA, 18 nt, Artificial Sequence
  Description of Artificial Sequence: Synthetic oligonucleotide
aauuuguagaauaaguau

SEQ ID NO: 31518 - RNA, 18 nt, Artificial Sequence
  Description of Artificial Sequence: Synthetic oligonucleotide
gaccaaauuuguagaaua

SEQ ID NO: 31519 - RNA, 18 nt, Artificial Sequence
  Description of Artificial Sequence: Synthetic oligonucleotide
uuucugaccaaauuugua

SEQ ID NO: 31520 - RNA, 18 nt, Artificial Sequence
  Description of Artificial Sequence: Synthetic oligonucleotide
caacauuucugaccaaau

SEQ ID NO: 31521 - RNA, 18 nt, Artificial Sequence
  Description of Artificial Sequence: Synthetic oligonucleotide
agacacaacauuucugac

SEQ ID NO: 31522 - RNA, 18 nt, Artificial Sequence
  Description of Artificial Sequence: Synthetic oligonucleotide
auuauagacacaacauuu

SEQ ID NO: 31523 - RNA, 18 nt, Artificial Sequence
  Description of Artificial Sequence: Synthetic oligonucleotide
gaaauauuauagacacaa

SEQ ID NO: 31524 - RNA, 18 nt, Artificial Sequence
  Description of Artificial Sequence: Synthetic oligonucleotide
uuuuagaaauauuauaga

SEQ ID NO: 31525 - RNA, 18 nt, Artificial Sequence
  Description of Artificial Sequence: Synthetic oligonucleotide
ucucuuuuuagaaauauu

SEQ ID NO: 31526 - RNA, 18 nt, Artificial Sequence
  Description of Artificial Sequence: Synthetic oligonucleotide
uacaaucucuuuuuagaa

SEQ ID NO: 31527 - RNA, 18 nt, Artificial Sequence
  Description of Artificial Sequence: Synthetic oligonucleotide
auggcuacaaucucuuuu

SEQ ID NO: 31528 - RNA, 18 nt, Artificial Sequence
  Description of Artificial Sequence: Synthetic oligonucleotide
uuaacauggcuacaaucu

SEQ ID NO: 31529 - RNA, 18 nt, Artificial Sequence
  Description of Artificial Sequence: Synthetic oligonucleotide
aguuuuuaacauggcuac

SEQ ID NO: 31530 - RNA, 18 nt, Artificial Sequence
  Description of Artificial Sequence: Synthetic oligonucleotide
aguugaguuuuuaacaug

SEQ ID NO: 31531 - RNA, 18 nt, Artificial Sequence
  Description of Artificial Sequence: Synthetic oligonucleotide
acaucaguugaguuuuua

SEQ ID NO: 31532 - RNA, 18 nt, Artificial Sequence
  Description of Artificial Sequence: Synthetic oligonucleotide
cacauacaucaguugagu

SEQ ID NO: 31533 - RNA, 18 nt, Artificial Sequence
  Description of Artificial Sequence: Synthetic oligonucleotide
guuggcacauacaucagu

SEQ ID NO: 31534 - RNA, 18 nt, Artificial Sequence
  Description of Artificial Sequence: Synthetic oligonucleotide
uuauaguuggcacauaca

SEQ ID NO: 31535 - RNA, 18 nt, Artificial Sequence
  Description of Artificial Sequence: Synthetic oligonucleotide
aagaguuauaguuggcac

SEQ ID NO: 31536 - RNA, 18 nt, Artificial Sequence
  Description of Artificial Sequence: Synthetic oligonucleotide
aagaaaagaguuauaguu

SEQ ID NO: 31537 - RNA, 18 nt, Artificial Sequence
  Description of Artificial Sequence: Synthetic oligonucleotide
gagguaagaaaagaguua

SEQ ID NO: 31538 - RNA, 18 nt, Artificial Sequence
  Description of Artificial Sequence: Synthetic oligonucleotide
cuuuagagguaagaaaag

SEQ ID NO: 31539 - RNA, 18 nt, Artificial Sequence
  Description of Artificial Sequence: Synthetic oligonucleotide
ucuuacuuuagagguaag

SEQ ID NO: 31540 - RNA, 18 nt, Artificial Sequence
  Description of Artificial Sequence: Synthetic oligonucleotide
uauuuucuuacuuuagag

SEQ ID NO: 31541 - RNA, 18 nt, Artificial Sequence
  Description of Artificial Sequence: Synthetic oligonucleotide
gaaauuauuuucuuacuu

SEQ ID NO: 31542 - RNA, 18 nt, Artificial Sequence
  Description of Artificial Sequence: Synthetic oligonucleotide
ucuaggaaauuauuuucu

SEQ ID NO: 31543 - RNA, 18 nt, Artificial Sequence
  Description of Artificial Sequence: Synthetic oligonucleotide
auaaaucuaggaaauuau

SEQ ID NO: 31544 - RNA, 18 nt, Artificial Sequence
  Description of Artificial Sequence: Synthetic oligonucleotide
uuaggauaaaucuaggaa

SEQ ID NO: 31545 - RNA, 18 nt, Artificial Sequence
  Description of Artificial Sequence: Synthetic oligonucleotide
cauguuuaggauaaaucu

SEQ ID NO: 31546 - RNA, 18 nt, Artificial Sequence
  Description of Artificial Sequence: Synthetic oligonucleotide
aucagcauguuuaggaua

SEQ ID NO: 31547 - RNA, 18 nt, Artificial Sequence
  Description of Artificial Sequence: Synthetic oligonucleotide
uauacaucagcauguuua

SEQ ID NO: 31548 - RNA, 18 nt, Artificial Sequence
  Description of Artificial Sequence: Synthetic oligonucleotide
ucuuauauacaucagcau

SEQ ID NO: 31549 - RNA, 18 nt, Artificial Sequence
  Description of Artificial Sequence: Synthetic oligonucleotide
auuacucuuauauacauc

SEQ ID NO: 31550 - RNA, 18 nt, Artificial Sequence
  Description of Artificial Sequence: Synthetic oligonucleotide
aagguauuacucuuauau

SEQ ID NO: 31551 - RNA, 18 nt, Artificial Sequence
  Description of Artificial Sequence: Synthetic oligonucleotide
caauuaagguauuacucu

SEQ ID NO: 31552 - RNA, 18 nt, Artificial Sequence
  Description of Artificial Sequence: Synthetic oligonucleotide
auaaacaauuaagguauu

SEQ ID NO: 31553 - RNA, 18 nt, Artificial Sequence
  Description of Artificial Sequence: Synthetic oligonucleotide
aaaccauaaacaauuaag

SEQ ID NO: 31554 - RNA, 18 nt, Artificial Sequence
  Description of Artificial Sequence: Synthetic oligonucleotide
aagaaaaaccauaaacaa

SEQ ID NO: 31555 - RNA, 18 nt, Artificial Sequence
  Description of Artificial Sequence: Synthetic oligonucleotide
ccaggaagaaaaaccaua

SEQ ID NO: 31556 - RNA, 18 nt, Artificial Sequence
  Description of Artificial Sequence: Synthetic oligonucleotide
aguguccaggaagaaaaa

SEQ ID NO: 31557 - RNA, 18 nt, Artificial Sequence
  Description of Artificial Sequence: Synthetic oligonucleotide
aaaagaguguccaggaag

SEQ ID NO: 31558 - RNA, 18 nt, Artificial Sequence
  Description of Artificial Sequence: Synthetic oligonucleotide
uguagaaaagagugucca

SEQ ID NO: 31559 - RNA, 18 nt, Artificial Sequence
  Description of Artificial Sequence: Synthetic oligonucleotide
caaaaaaauacaaggcag

SEQ ID NO: 31560 - RNA, 18 nt, Artificial Sequence
  Description of Artificial Sequence: Synthetic oligonucleotide
uaggucaaaaaaauacaa

SEQ ID NO: 31561 - RNA, 18 nt, Artificial Sequence
  Description of Artificial Sequence: Synthetic oligonucleotide
uuugauaggucaaaaaaa

SEQ ID NO: 31562 - RNA, 18 nt, Artificial Sequence
  Description of Artificial Sequence: Synthetic oligonucleotide
augauuuugauaggucaa

SEQ ID NO: 31563 - RNA, 18 nt, Artificial Sequence
  Description of Artificial Sequence: Synthetic oligonucleotide
gaaaaaugauuuugauag

SEQ ID NO: 31564 - RNA, 18 nt, Artificial Sequence
  Description of Artificial Sequence: Synthetic oligonucleotide
uaauugaaaaaugauuuu

SEQ ID NO: 31565 - RNA, 18 nt, Artificial Sequence
  Description of Artificial Sequence: Synthetic oligonucleotide
acaaguaauugaaaaaug

SEQ ID NO: 31566 - RNA, 18 nt, Artificial Sequence
  Description of Artificial Sequence: Synthetic oligonucleotide
gggaaacaaguaauugaa

SEQ ID NO: 31567 - RNA, 18 nt, Artificial Sequence
  Description of Artificial Sequence: Synthetic oligonucleotide
gacaucugaaaucuaggg

SEQ ID NO: 31568 - RNA, 18 nt, Artificial Sequence
  Description of Artificial Sequence: Synthetic oligonucleotide
ccgugacaucugaaaucu

SEQ ID NO: 31569 - RNA, 18 nt, Artificial Sequence
  Description of Artificial Sequence: Synthetic oligonucleotide
ucauaccgugacaucuga

SEQ ID NO: 31570 - RNA, 18 nt, Artificial Sequence
  Description of Artificial Sequence: Synthetic oligonucleotide
accuuucauaccgugaca

SEQ ID NO: 31571 - RNA, 18 nt, Artificial Sequence
  Description of Artificial Sequence: Synthetic oligonucleotide
auaaaaccuuucauaccg

SEQ ID NO: 31572 - RNA, 18 nt, Artificial Sequence
  Description of Artificial Sequence: Synthetic oligonucleotide
uauauauaaaaccuuuca

SEQ ID NO: 31573 - RNA, 18 nt, Artificial Sequence
  Description of Artificial Sequence: Synthetic oligonucleotide
uuaaauauauauaaaacc

SEQ ID NO: 31574 - RNA, 18 nt, Artificial Sequence
  Description of Artificial Sequence: Synthetic oligonucleotide
auuuuuuaaauauauaua

SEQ ID NO: 31575 - RNA, 18 nt, Artificial Sequence
  Description of Artificial Sequence: Synthetic oligonucleotide
acuuuauuuuuuaaauau

SEQ ID NO: 31576 - RNA, 18 nt, Artificial Sequence
  Description of Artificial Sequence: Synthetic oligonucleotide
uuuauacuuuauuuuuua

SEQ ID NO: 31577 - RNA, 18 nt, Artificial Sequence
  Description of Artificial Sequence: Synthetic oligonucleotide
uuauguuuauacuuuauu

SEQ ID NO: 31578 - RNA, 18 nt, Artificial Sequence
  Description of Artificial Sequence: Synthetic oligonucleotide
agacuuuauguuuauacu

SEQ ID NO: 31579 - RNA, 18 nt, Artificial Sequence
  Description of Artificial Sequence: Synthetic oligonucleotide
caaaaagacuuuauguuu

SEQ ID NO: 31580 - RNA, 18 nt, Artificial Sequence
  Description of Artificial Sequence: Synthetic oligonucleotide
cgcuucaaaaagacuuua

SEQ ID NO: 31581 - RNA, 18 nt, Artificial Sequence
  Description of Artificial Sequence: Synthetic oligonucleotide
aaccacgcuucaaaaaga

SEQ ID NO: 31582 - RNA, 18 nt, Artificial Sequence
  Description of Artificial Sequence: Synthetic oligonucleotide
ugcauaaccacgcuucaa

SEQ ID NO: 31583 - RNA, 18 nt, Artificial Sequence
  Description of Artificial Sequence: Synthetic oligonucleotide
uauguugcauaaccacgc

SEQ ID NO: 31584 - RNA, 18 nt, Artificial Sequence
  Description of Artificial Sequence: Synthetic oligonucleotide
uagcauauguugcauaac

SEQ ID NO: 31585 - RNA, 18 nt, Artificial Sequence
  Description of Artificial Sequence: Synthetic oligonucleotide
acgccuagcauauguugc

SEQ ID NO: 31586 - RNA, 18 nt, Artificial Sequence
  Description of Artificial Sequence: Synthetic oligonucleotide
aacuuacgccuagcauau

SEQ ID NO: 31587 - RNA, 18 nt, Artificial Sequence
  Description of Artificial Sequence: Synthetic oligonucleotide
ucaccaacuuacgccuag

SEQ ID NO: 31588 - RNA, 18 nt, Artificial Sequence
  Description of Artificial Sequence: Synthetic oligonucleotide
ggcauucaccaacuuacg

SEQ ID NO: 31589 - RNA, 18 nt, Artificial Sequence
  Description of Artificial Sequence: Synthetic oligonucleotide
aagcaggcauucaccaac

SEQ ID NO: 31590 - RNA, 18 nt, Artificial Sequence
  Description of Artificial Sequence: Synthetic oligonucleotide
cugcaaagcaggcauuca

SEQ ID NO: 31591 - RNA, 18 nt, Artificial Sequence
  Description of Artificial Sequence: Synthetic oligonucleotide
acacucugcaaagcaggc

SEQ ID NO: 31592 - RNA, 18 nt, Artificial Sequence
  Description of Artificial Sequence: Synthetic oligonucleotide
ggguuacacucugcaaag

SEQ ID NO: 31593 - RNA, 18 nt, Artificial Sequence
  Description of Artificial Sequence: Synthetic oligonucleotide
cuuuuuuuauucaauggg

SEQ ID NO: 31594 - RNA, 18 nt, Artificial Sequence
  Description of Artificial Sequence: Synthetic oligonucleotide
gcuuuuuuuauucaaugg

SEQ ID NO: 31595 - RNA, 18 nt, Artificial Sequence
  Description of Artificial Sequence: Synthetic oligonucleotide
acaaagcuuuuuuuauuc

SEQ ID NO: 31596 - RNA, 18 nt, Artificial Sequence
  Description of Artificial Sequence: Synthetic oligonucleotide
ggaaaacaaagcuuuuuu

SEQ ID NO: 31597 - RNA, 18 nt, Artificial Sequence
  Description of Artificial Sequence: Synthetic oligonucleotide
gaaagggaaaacaaagcu

SEQ ID NO: 31598 - RNA, 18 nt, Artificial Sequence
  Description of Artificial Sequence: Synthetic oligonucleotide
gggcagaaagggaaaaca

SEQ ID NO: 31599 - RNA, 18 nt, Artificial Sequence
  Description of Artificial Sequence: Synthetic oligonucleotide
gcccauacugauacaggg

SEQ ID NO: 31600 - RNA, 18 nt, Artificial Sequence
  Description of Artificial Sequence: Synthetic oligonucleotide
ugcccauacugauacagg

SEQ ID NO: 31601 - RNA, 18 nt, Artificial Sequence
  Description of Artificial Sequence: Synthetic oligonucleotide
gggugugcccauacugau

SEQ ID NO: 31602 - RNA, 18 nt, Artificial Sequence
  Description of Artificial Sequence: Synthetic oligonucleotide
gugcagggugugcccaua

SEQ ID NO: 31603 - RNA, 18 nt, Artificial Sequence
  Description of Artificial Sequence: Synthetic oligonucleotide
uuagagugcagggugugc

SEQ ID NO: 31604 - RNA, 18 nt, Artificial Sequence
  Description of Artificial Sequence: Synthetic oligonucleotide
uaaaguuagagugcaggg

SEQ ID NO: 31605 - RNA, 18 nt, Artificial Sequence
  Description of Artificial Sequence: Synthetic oligonucleotide
uagauuaaaguuagagug

SEQ ID NO: 31606 - RNA, 18 nt, Artificial Sequence
  Description of Artificial Sequence: Synthetic oligonucleotide
ugacguagauuaaaguua

SEQ ID NO: 31607 - RNA, 18 nt, Artificial Sequence
  Description of Artificial Sequence: Synthetic oligonucleotide
gagggugacguagauuaa

SEQ ID NO: 31608 - RNA, 18 nt, Artificial Sequence
  Description of Artificial Sequence: Synthetic oligonucleotide
caggugagggugacguag

SEQ ID NO: 31609 - RNA, 18 nt, Artificial Sequence
  Description of Artificial Sequence: Synthetic oligonucleotide
ccaaacaggugaggguga

SEQ ID NO: 31610 - RNA, 18 nt, Artificial Sequence
  Description of Artificial Sequence: Synthetic oligonucleotide
ccaaaccaaacaggugag

SEQ ID NO: 31611 - RNA, 18 nt, Artificial Sequence
  Description of Artificial Sequence: Synthetic oligonucleotide
uaaacccaaaccaaacag

SEQ ID NO: 31612 - RNA, 18 nt, Artificial Sequence
  Description of Artificial Sequence: Synthetic oligonucleotide
gacauuaaacccaaacca

SEQ ID NO: 31613 - RNA, 18 nt, Artificial Sequence
  Description of Artificial Sequence: Synthetic oligonucleotide
ucgcagacauuaaaccca

SEQ ID NO: 31614 - RNA, 18 nt, Artificial Sequence
  Description of Artificial Sequence: Synthetic oligonucleotide
uuuucucgcagacauuaa

SEQ ID NO: 31615 - RNA, 18 nt, Artificial Sequence
  Description of Artificial Sequence: Synthetic oligonucleotide
uuugguuuucucgcagac

SEQ ID NO: 31616 - RNA, 18 nt, Artificial Sequence
  Description of Artificial Sequence: Synthetic oligonucleotide
agauauuugguuuucucg

SEQ ID NO: 31617 - RNA, 18 nt, Artificial Sequence
  Description of Artificial Sequence: Synthetic oligonucleotide
acacaagauauuugguuu

SEQ ID NO: 31618 - RNA, 18 nt, Artificial Sequence
  Description of Artificial Sequence: Synthetic oligonucleotide
acaauacacaagauauuu

SEQ ID NO: 31619 - RNA, 18 nt, Artificial Sequence
  Description of Artificial Sequence: Synthetic oligonucleotide
aguucacaauacacaaga

SEQ ID NO: 31620 - RNA, 18 nt, Artificial Sequence
  Description of Artificial Sequence: Synthetic oligonucleotide
uugacaguucacaauaca

SEQ ID NO: 31621 - RNA, 18 nt, Artificial Sequence
  Description of Artificial Sequence: Synthetic oligonucleotide
uggcuuugacaguucaca

SEQ ID NO: 31622 - RNA, 18 nt, Artificial Sequence
  Description of Artificial Sequence: Synthetic oligonucleotide
uuagauggcuuugacagu

SEQ ID NO: 31623 - RNA, 18 nt, Artificial Sequence
  Description of Artificial Sequence: Synthetic oligonucleotide
uugguuuagauggcuuug

SEQ ID NO: 31624 - RNA, 18 nt, Artificial Sequence
  Description of Artificial Sequence: Synthetic oligonucleotide
ugggauugguuuagaugg

SEQ ID NO: 31625 - RNA, 18 nt, Artificial Sequence
  Description of Artificial Sequence: Synthetic oligonucleotide
gaccuugggauugguuua

SEQ ID NO: 31626 - RNA, 18 nt, Artificial Sequence
  Description of Artificial Sequence: Synthetic oligonucleotide
cacuugaccuugggauug

SEQ ID NO: 31627 - RNA, 18 nt, Artificial Sequence
  Description of Artificial Sequence: Synthetic oligonucleotide
auauccacuugaccuugg

SEQ ID NO: 31628 - RNA, 18 nt, Artificial Sequence
  Description of Artificial Sequence: Synthetic oligonucleotide
uuuuuauauccacuugac

SEQ ID NO: 31629 - RNA, 18 nt, Artificial Sequence
  Description of Artificial Sequence: Synthetic oligonucleotide
cagaauuuuuauauccac

SEQ ID NO: 31630 - RNA, 18 nt, Artificial Sequence
  Description of Artificial Sequence: Synthetic oligonucleotide
uuuggcagaauuuuuaua

SEQ ID NO: 31631 - RNA, 18 nt, Artificial Sequence
  Description of Artificial Sequence: Synthetic oligonucleotide
auguuuuuggcagaauuu

SEQ ID NO: 31632 - RNA, 18 nt, Artificial Sequence
  Description of Artificial Sequence: Synthetic oligonucleotide
augccauguuuuuggcag

SEQ ID NO: 31633 - RNA, 18 nt, Artificial Sequence
  Description of Artificial Sequence: Synthetic oligonucleotide
aucuuaugccauguuuuu

SEQ ID NO: 31634 - RNA, 18 nt, Artificial Sequence
  Description of Artificial Sequence: Synthetic oligonucleotide
uuuccaucuuaugccaug

SEQ ID NO: 31635 - RNA, 18 nt, Artificial Sequence
  Description of Artificial Sequence: Synthetic oligonucleotide
gaacuuuuccaucuuaug

SEQ ID NO: 31636 - RNA, 18 nt, Artificial Sequence
  Description of Artificial Sequence: Synthetic oligonucleotide
ucagggaacuuuuccauc

SEQ ID NO: 31637 - RNA, 18 nt, Artificial Sequence
  Description of Artificial Sequence: Synthetic oligonucleotide
aguuuucagggaacuuuu

SEQ ID NO: 31638 - RNA, 18 nt, Artificial Sequence
  Description of Artificial Sequence: Synthetic oligonucleotide
uccagaguuuucagggaa

SEQ ID NO: 31639 - RNA, 18 nt, Artificial Sequence
  Description of Artificial Sequence: Synthetic oligonucleotide
uuucuuccagaguuuuca

SEQ ID NO: 31640 - RNA, 18 nt, Artificial Sequence
  Description of Artificial Sequence: Synthetic oligonucleotide
uuuguuuucuuccagagu

SEQ ID NO: 31641 - RNA, 18 nt, Artificial Sequence
  Description of Artificial Sequence: Synthetic oligonucleotide
auuacuuuguuuucuucc

SEQ ID NO: 31642 - RNA, 18 nt, Artificial Sequence
  Description of Artificial Sequence: Synthetic oligonucleotide
ucuacauuacuuuguuuu

SEQ ID NO: 31643 - RNA, 18 nt, Artificial Sequence
  Description of Artificial Sequence: Synthetic oligonucleotide
aggugucuacauuacuuu

SEQ ID NO: 31644 - RNA, 18 nt, Artificial Sequence
  Description of Artificial Sequence: Synthetic oligonucleotide
aaagaaggugucuacauu

SEQ ID NO: 31645 - RNA, 18 nt, Artificial Sequence
  Description of Artificial Sequence: Synthetic oligonucleotide
gggaaaaagaaggugucu

SEQ ID NO: 31646 - RNA, 18 nt, Artificial Sequence
  Description of Artificial Sequence: Synthetic oligonucleotide
auuuucuaaugguguggg

SEQ ID NO: 31647 - RNA, 18 nt, Artificial Sequence
  Description of Artificial Sequence: Synthetic oligonucleotide
aacauuuucuaauggugu

SEQ ID NO: 31648 - RNA, 18 nt, Artificial Sequence
  Description of Artificial Sequence: Synthetic oligonucleotide
gaugcaacauuuucuaau

SEQ ID NO: 31649 - RNA, 18 nt, Artificial Sequence
  Description of Artificial Sequence: Synthetic oligonucleotide
guccucaucgucauuauu

SEQ ID NO: 31650 - RNA, 18 nt, Artificial Sequence
  Description of Artificial Sequence: Synthetic oligonucleotide
gucagguccucaucguca

SEQ ID NO: 31651 - RNA, 18 nt, Artificial Sequence
  Description of Artificial Sequence: Synthetic oligonucleotide
cuggugucagguccucau

SEQ ID NO: 31652 - RNA, 18 nt, Artificial Sequence
  Description of Artificial Sequence: Synthetic oligonucleotide
cugcucuggugucagguc

SEQ ID NO: 31653 - RNA, 18 nt, Artificial Sequence
  Description of Artificial Sequence: Synthetic oligonucleotide
gccuucugcucugguguc

SEQ ID NO: 31654 - RNA, 18 nt, Artificial Sequence
  Description of Artificial Sequence: Synthetic oligonucleotide
gcucugccuucugcucug

SEQ ID NO: 31655 - RNA, 18 nt, Artificial Sequence
  Description of Artificial Sequence: Synthetic oligonucleotide
cucacgcucugccuucug

SEQ ID NO: 31656 - RNA, 18 nt, Artificial Sequence
  Description of Artificial Sequence: Synthetic oligonucleotide
uccuucucacgcucugcc

SEQ ID NO: 31657 - RNA, 18 nt, Artificial Sequence
  Description of Artificial Sequence: Synthetic oligonucleotide
uccgcuccuucucacgcu

SEQ ID NO: 31658 - RNA, 18 nt, Artificial Sequence
  Description of Artificial Sequence: Synthetic oligonucleotide
cauccuccgcuccuucuc

SEQ ID NO: 31659 - RNA, 18 nt, Artificial Sequence
  Description of Artificial Sequence: Synthetic oligonucleotide
uuggccauccuccgcucc

SEQ ID NO: 31660 - RNA, 18 nt, Artificial Sequence
  Description of Artificial Sequence: Synthetic oligonucleotide
cauuguuggccauccucc

SEQ ID NO: 31661 - RNA, 18 nt, Artificial Sequence
  Description of Artificial Sequence: Synthetic oligonucleotide
ucgggcauuguuggccau

SEQ ID NO: 31662 - RNA, 18 nt, Artificial Sequence
  Description of Artificial Sequence: Synthetic oligonucleotide
cgcucucgggcauuguug

SEQ ID NO: 31663 - RNA, 18 nt, Artificial Sequence
  Description of Artificial Sequence: Synthetic oligonucleotide
gcagacgcucucgggcau

SEQ ID NO: 31664 - RNA, 18 nt, Artificial Sequence
  Description of Artificial Sequence: Synthetic oligonucleotide
gacccgcagacgcucucg

SEQ ID NO: 31665 - RNA, 18 nt, Artificial Sequence
  Description of Artificial Sequence: Synthetic oligonucleotide
ucacggacccgcagacgc

SEQ ID NO: 31666 - RNA, 18 nt, Artificial Sequence
  Description of Artificial Sequence: Synthetic oligonucleotide
ugaugucacggacccgca

SEQ ID NO: 31667 - RNA, 18 nt, Artificial Sequence
  Description of Artificial Sequence: Synthetic oligonucleotide
cucguugaugucacggac

SEQ ID NO: 31668 - RNA, 18 nt, Artificial Sequence
  Description of Artificial Sequence: Synthetic oligonucleotide
aaagccucguugauguca

SEQ ID NO: 31669 - RNA, 18 nt, Artificial Sequence
  Description of Artificial Sequence: Synthetic oligonucleotide
cuuugaaagccucguuga

SEQ ID NO: 31670 - RNA, 18 nt, Artificial Sequence
  Description of Artificial Sequence: Synthetic oligonucleotide
gagcucuuugaaagccuc

SEQ ID NO: 31671 - RNA, 18 nt, Artificial Sequence
  Description of Artificial Sequence: Synthetic oligonucleotide
cggccgagcucuuugaaa

SEQ ID NO: 31672 - RNA, 18 nt, Artificial Sequence
  Description of Artificial Sequence: Synthetic oligonucleotide
ccaugcggccgagcucuu

SEQ ID NO: 31673 - RNA, 18 nt, Artificial Sequence
  Description of Artificial Sequence: Synthetic oligonucleotide
cugcaccaugcggccgag

SEQ ID NO: 31674 - RNA, 18 nt, Artificial Sequence
  Description of Artificial Sequence: Synthetic oligonucleotide
uggagcugcaccaugcgg

SEQ ID NO: 31675 - RNA, 18 nt, Artificial Sequence
  Description of Artificial Sequence: Synthetic oligonucleotide
ugagguggagcugcacca

SEQ ID NO: 31676 - RNA, 18 nt, Artificial Sequence
  Description of Artificial Sequence: Synthetic oligonucleotide
acucuugagguggagcug

SEQ ID NO: 31677 - RNA, 18 nt, Artificial Sequence
  Description of Artificial Sequence: Synthetic oligonucleotide
uugucacucuugaggugg

SEQ ID NO: 31678 - RNA, 18 nt, Artificial Sequence
  Description of Artificial Sequence: Synthetic oligonucleotide
gggcuugucacucuugag

SEQ ID NO: 31679 - RNA, 18 nt, Artificial Sequence
  Description of Artificial Sequence: Synthetic oligonucleotide
ucaggagcuuggucuggg

SEQ ID NO: 31680 - RNA, 18 nt, Artificial Sequence
  Description of Artificial Sequence: Synthetic oligonucleotide
gaggaucaggagcuuggu

SEQ ID NO: 31681 - RNA, 18 nt, Artificial Sequence
  Description of Artificial Sequence: Synthetic oligonucleotide
ugguggaggaucaggagc

SEQ ID NO: 31682 - RNA, 18 nt, Artificial Sequence
  Description of Artificial Sequence: Synthetic oligonucleotide
ccgccugguggaggauca

SEQ ID NO: 31683 - RNA, 18 nt, Artificial Sequence
  Description of Artificial Sequence: Synthetic oligonucleotide
ggccaccgccugguggag

SEQ ID NO: 31684 - RNA, 18 nt, Artificial Sequence
  Description of Artificial Sequence: Synthetic oligonucleotide
augacggccaccgccugg

SEQ ID NO: 31685 - RNA, 18 nt, Artificial Sequence
  Description of Artificial Sequence: Synthetic oligonucleotide
ugaggaugacggccaccg

SEQ ID NO: 31686 - RNA, 18 nt, Artificial Sequence
  Description of Artificial Sequence: Synthetic oligonucleotide
cagacugaggaugacggc

SEQ ID NO: 31687 - RNA, 18 nt, Artificial Sequence
  Description of Artificial Sequence: Synthetic oligonucleotide
ugcuccagacugaggaug

SEQ ID NO: 31688 - RNA, 18 nt, Artificial Sequence
  Description of Artificial Sequence: Synthetic oligonucleotide
cuugcugcuccagacuga

SEQ ID NO: 31689 - RNA, 18 nt, Artificial Sequence
  Description of Artificial Sequence: Synthetic oligonucleotide
ucggacuugcugcuccag

SEQ ID NO: 31690 - RNA, 18 nt, Artificial Sequence
  Description of Artificial Sequence: Synthetic oligonucleotide
cuguaguccugguggcau

SEQ ID NO: 31691 - RNA, 18 nt, Artificial Sequence
  Description of Artificial Sequence: Synthetic oligonucleotide
ugccccuguaguccuggu

SEQ ID NO: 31692 - RNA, 18 nt, Artificial Sequence
  Description of Artificial Sequence: Synthetic oligonucleotide
cacucugccccuguaguc

SEQ ID NO: 31693 - RNA, 18 nt, Artificial Sequence
  Description of Artificial Sequence: Synthetic oligonucleotide
ggagacacucugccccug

SEQ ID NO: 31694 - RNA, 18 nt, Artificial Sequence
  Description of Artificial Sequence: Synthetic oligonucleotide
ccagaggagacacucugc

SEQ ID NO: 31695 - RNA, 18 nt, Artificial Sequence
  Description of Artificial Sequence: Synthetic oligonucleotide
agcugccagaggagacac

SEQ ID NO: 31696 - RNA, 18 nt, Artificial Sequence
  Description of Artificial Sequence: Synthetic oligonucleotide
cucagagcugccagagga

SEQ ID NO: 31697 - RNA, 18 nt, Artificial Sequence
  Description of Artificial Sequence: Synthetic oligonucleotide
uugaucucagagcugcca

SEQ ID NO: 31698 - RNA, 18 nt, Artificial Sequence
  Description of Artificial Sequence: Synthetic oligonucleotide
cggauuugaucucagagc

SEQ ID NO: 31699 - RNA, 18 nt, Artificial Sequence
  Description of Artificial Sequence: Synthetic oligonucleotide
gucaucggauuugaucuc

SEQ ID NO: 31700 - RNA, 18 nt, Artificial Sequence
  Description of Artificial Sequence: Synthetic oligonucleotide
cccucgucaucggauuug

SEQ ID NO: 31701 - RNA, 18 nt, Artificial Sequence
  Description of Artificial Sequence: Synthetic oligonucleotide
caucacccucgucaucgg

SEQ ID NO: 31702 - RNA, 18 nt, Artificial Sequence
  Description of Artificial Sequence: Synthetic oligonucleotide
guucucaucacccucguc

SEQ ID NO: 31703 - RNA, 18 nt, Artificial Sequence
  Description of Artificial Sequence: Synthetic oligonucleotide
ugcagguucucaucaccc

SEQ ID NO: 31704 - RNA, 18 nt, Artificial Sequence
  Description of Artificial Sequence: Synthetic oligonucleotide
ugucuugcagguucucau

SEQ ID NO: 31705 - RNA, 18 nt, Artificial Sequence
  Description of Artificial Sequence: Synthetic oligonucleotide
uuucgugucuugcagguu

SEQ ID NO: 31706 - RNA, 18 nt, Artificial Sequence
  Description of Artificial Sequence: Synthetic oligonucleotide
gaagauuucgugucuugc

SEQ ID NO: 31707 - RNA, 18 nt, Artificial Sequence
  Description of Artificial Sequence: Synthetic oligonucleotide
ccuccgaagauuucgugu

SEQ ID NO: 31708 - RNA, 18 nt, Artificial Sequence
  Description of Artificial Sequence: Synthetic oligonucleotide
cuuguccuccgaagauuu

SEQ ID NO: 31709 - RNA, 18 nt, Artificial Sequence
  Description of Artificial Sequence: Synthetic oligonucleotide
aauuucuuguccuccgaa

SEQ ID NO: 31710 - RNA, 18 nt, Artificial Sequence
  Description of Artificial Sequence: Synthetic oligonucleotide
caucuaauuucuuguccu

SEQ ID NO: 31711 - RNA, 18 nt, Artificial Sequence
  Description of Artificial Sequence: Synthetic oligonucleotide
gucgucaucuaauuucuu

SEQ ID NO: 31712 - RNA, 18 nt, Artificial Sequence
  Description of Artificial Sequence: Synthetic oligonucleotide
uucuugucgucaucuaau

SEQ ID NO: 31713 - RNA, 18 nt, Artificial Sequence
  Description of Artificial Sequence: Synthetic oligonucleotide
uauccuucuugucgucau

SEQ ID NO: 31714 - RNA, 18 nt, Artificial Sequence
  Description of Artificial Sequence: Synthetic oligonucleotide
uuugauauccuucuuguc

SEQ ID NO: 31715 - RNA, 18 nt, Artificial Sequence
  Description of Artificial Sequence: Synthetic oligonucleotide
auugauuugauauccuuc

SEQ ID NO: 31716 - RNA, 18 nt, Artificial Sequence
  Description of Artificial Sequence: Synthetic oligonucleotide
uaguaauugauuugauau

SEQ ID NO: 31717 - RNA, 18 nt, Artificial Sequence
  Description of Artificial Sequence: Synthetic oligonucleotide
ugaccuaguaauugauuu

SEQ ID NO: 31718 - RNA, 18 nt, Artificial Sequence
  Description of Artificial Sequence: Synthetic oligonucleotide
gaucuugaccuaguaauu

SEQ ID NO: 31719 - RNA, 18 nt, Artificial Sequence
  Description of Artificial Sequence: Synthetic oligonucleotide
gcgacaguauuauauacu

SEQ ID NO: 31720 - RNA, 18 nt, Artificial Sequence
  Description of Artificial Sequence: Synthetic oligonucleotide
augaagcgacaguauuau

SEQ ID NO: 31721 - RNA, 18 nt, Artificial Sequence
  Description of Artificial Sequence: Synthetic oligonucleotide
auuaaaugaagcgacagu

SEQ ID NO: 31722 - RNA, 18 nt, Artificial Sequence
  Description of Artificial Sequence: Synthetic oligonucleotide
aaggaauuaaaugaagcg

SEQ ID NO: 31723 - RNA, 18 nt, Artificial Sequence
  Description of Artificial Sequence: Synthetic oligonucleotide
caauaaaggaauuaaaug

SEQ ID NO: 31724 - RNA, 18 nt, Artificial Sequence
  Description of Artificial Sequence: Synthetic oligonucleotide
aaguccaauaaaggaauu

SEQ ID NO: 31725 - RNA, 18 nt, Artificial Sequence
  Description of Artificial Sequence: Synthetic oligonucleotide
caucaaaguccaauaaag

SEQ ID NO: 31726 - RNA, 18 nt, Artificial Sequence
  Description of Artificial Sequence: Synthetic oligonucleotide
cacuucaucaaaguccaa

SEQ ID NO: 31727 - RNA, 18 nt, Artificial Sequence
  Description of Artificial Sequence: Synthetic oligonucleotide
cuguucacuucaucaaag

SEQ ID NO: 31728 - RNA, 18 nt, Artificial Sequence
  Description of Artificial Sequence: Synthetic oligonucleotide
ccguucuguucacuucau

SEQ ID NO: 31729 - RNA, 18 nt, Artificial Sequence
  Description of Artificial Sequence: Synthetic oligonucleotide
ucuucccguucuguucac

SEQ ID NO: 31730 - RNA, 18 nt, Artificial Sequence
  Description of Artificial Sequence: Synthetic oligonucleotide
uaguuucuucccguucug

SEQ ID NO: 31731 - RNA, 18 nt, Artificial Sequence
  Description of Artificial Sequence: Synthetic oligonucleotide
cugaauaguuucuucccg

SEQ ID NO: 31732 - RNA, 18 nt, Artificial Sequence
  Description of Artificial Sequence: Synthetic oligonucleotide
aaaaacugaauaguuucu

SEQ ID NO: 31733 - RNA, 18 nt, Artificial Sequence
  Description of Artificial Sequence: Synthetic oligonucleotide
caggaaaaaacugaauag

SEQ ID NO: 31734 - RNA, 18 nt, Artificial Sequence
  Description of Artificial Sequence: Synthetic oligonucleotide
ccugccaggaaaaaacug

SEQ ID NO: 31735 - RNA, 18 nt, Artificial Sequence
  Description of Artificial Sequence: Synthetic oligonucleotide
auuuaccugccaggaaaa

SEQ ID NO: 31736 - RNA, 18 nt, Artificial Sequence
  Description of Artificial Sequence: Synthetic oligonucleotide
uguaaauuuaccugccag

SEQ ID NO: 31737 - RNA, 18 nt, Artificial Sequence
  Description of Artificial Sequence: Synthetic oligonucleotide
ucagcuguaaauuuaccu

SEQ ID NO: 31738 - RNA, 18 nt, Artificial Sequence
  Description of Artificial Sequence: Synthetic oligonucleotide
ucuuuucagcuguaaauu

SEQ ID NO: 31739 - RNA, 18 nt, Artificial Sequence
  Description of Artificial Sequence: Synthetic oligonucleotide
aauuuucuuuucagcugu

SEQ ID NO: 31740 - RNA, 18 nt, Artificial Sequence
  Description of Artificial Sequence: Synthetic oligonucleotide
ccuuuaauuuucuuuuca

SEQ ID NO: 31741 - RNA, 18 nt, Artificial Sequence
  Description of Artificial Sequence: Synthetic oligonucleotide
guaggccuuuaauuuucu

SEQ ID NO: 31742 - RNA, 18 nt, Artificial Sequence
  Description of Artificial Sequence: Synthetic oligonucleotide
cuagaguaggccuuuaau

SEQ ID NO: 31743 - RNA, 18 nt, Artificial Sequence
  Description of Artificial Sequence: Synthetic oligonucleotide
uacuucuagaguaggccu

SEQ ID NO: 31744 - RNA, 18 nt, Artificial Sequence
  Description of Artificial Sequence: Synthetic oligonucleotide
uuuaguacuucuagagua

SEQ ID NO: 31745 - RNA, 18 nt, Artificial Sequence
  Description of Artificial Sequence: Synthetic oligonucleotide
auacuuuuaguacuucua

SEQ ID NO: 31746 - RNA, 18 nt, Artificial Sequence
  Description of Artificial Sequence: Synthetic oligonucleotide
aaacgauacuuuuaguac

SEQ ID NO: 31747 - RNA, 18 nt, Artificial Sequence
  Description of Artificial Sequence: Synthetic oligonucleotide
aucugaaacgauacuuuu

SEQ ID NO: 31748 - RNA, 18 nt, Artificial Sequence
  Description of Artificial Sequence: Synthetic oligonucleotide
cagguaucugaaacgaua

SEQ ID NO: 31749 - RNA, 18 nt, Artificial Sequence
  Description of Artificial Sequence: Synthetic oligonucleotide
gaguacagguaucugaaa

SEQ ID NO: 31750 - RNA, 18 nt, Artificial Sequence
  Description of Artificial Sequence: Synthetic oligonucleotide
caauagaguacagguauc

SEQ ID NO: 31751 - RNA, 18 nt, Artificial Sequence
  Description of Artificial Sequence: Synthetic oligonucleotide
ggcuccaauagaguacag

SEQ ID NO: 31752 - RNA, 18 nt, Artificial Sequence
  Description of Artificial Sequence: Synthetic oligonucleotide
guuuaggcuccaauagag

SEQ ID NO: 31753 - RNA, 18 nt, Artificial Sequence
  Description of Artificial Sequence: Synthetic oligonucleotide
aaacaguuuaggcuccaa

SEQ ID NO: 31754 - RNA, 18 nt, Artificial Sequence
  Description of Artificial Sequence: Synthetic oligonucleotide
ugccaaaacaguuuaggc

SEQ ID NO: 31755 - RNA, 18 nt, Artificial Sequence
  Description of Artificial Sequence: Synthetic oligonucleotide
auaaaugccaaaacaguu

SEQ ID NO: 31756 - RNA, 18 nt, Artificial Sequence
  Description of Artificial Sequence: Synthetic oligonucleotide
gauucauaaaugccaaaa

SEQ ID NO: 31757 - RNA, 18 nt, Artificial Sequence
  Description of Artificial Sequence: Synthetic oligonucleotide
guccagauucauaaaugc

SEQ ID NO: 31758 - RNA, 18 nt, Artificial Sequence
  Description of Artificial Sequence: Synthetic oligonucleotide
auuggguccagauucaua

SEQ ID NO: 31759 - RNA, 18 nt, Artificial Sequence
  Description of Artificial Sequence: Synthetic oligonucleotide
uuagcauuggguccagau

SEQ ID NO: 31760 - RNA, 18 nt, Artificial Sequence
  Description of Artificial Sequence: Synthetic oligonucleotide
ugucauuagcauuggguc

SEQ ID NO: 31761 - RNA, 18 nt, Artificial Sequence
  Description of Artificial Sequence: Synthetic oligonucleotide
cugugugucauuagcauu

SEQ ID NO: 31762 - RNA, 18 nt, Artificial Sequence
  Description of Artificial Sequence: Synthetic oligonucleotide
uuucacugugugucauua

SEQ ID NO: 31763 - RNA, 18 nt, Artificial Sequence
  Description of Artificial Sequence: Synthetic oligonucleotide
aauuuuuucacugugugu

SEQ ID NO: 31764 - RNA, 18 nt, Artificial Sequence
  Description of Artificial Sequence: Synthetic oligonucleotide
agacaaauuuuuucacug

SEQ ID NO: 31765 - RNA, 18 nt, Artificial Sequence
  Description of Artificial Sequence: Synthetic oligonucleotide
aucagagacaaauuuuuu

SEQ ID NO: 31766 - RNA, 18 nt, Artificial Sequence
  Description of Artificial Sequence: Synthetic oligonucleotide
cuugaaucagagacaaau

SEQ ID NO: 31767 - RNA, 18 nt, Artificial Sequence
  Description of Artificial Sequence: Synthetic oligonucleotide
cuguacuugaaucagaga

SEQ ID NO: 31768 - RNA, 18 nt, Artificial Sequence
  Description of Artificial Sequence: Synthetic oligonucleotide
auaaacuguacuugaauc

SEQ ID NO: 31769 - RNA, 18 nt, Artificial Sequence
  Description of Artificial Sequence: Synthetic oligonucleotide
uacaaauaaacuguacuu

SEQ ID NO: 31770 - RNA, 18 nt, Artificial Sequence
  Description of Artificial Sequence: Synthetic oligonucleotide
aguuuuacaaauaaacug

SEQ ID NO: 31771 - RNA, 18 nt, Artificial Sequence
  Description of Artificial Sequence: Synthetic oligonucleotide
aguauaguuuuacaaaua

SEQ ID NO: 31772 - RNA, 18 nt, Artificial Sequence
  Description of Artificial Sequence: Synthetic oligonucleotide
gaauaaguauaguuuuac

SEQ ID NO: 31773 - RNA, 18 nt, Artificial Sequence
  Description of Artificial Sequence: Synthetic oligonucleotide
uuguagaauaaguauagu

SEQ ID NO: 31774 - RNA, 18 nt, Artificial Sequence
  Description of Artificial Sequence: Synthetic oligonucleotide
caaauuuguagaauaagu

SEQ ID NO: 31775 - RNA, 18 nt, Artificial Sequence
  Description of Artificial Sequence: Synthetic oligonucleotide
cugaccaaauuuguagaa

SEQ ID NO: 31776 - RNA, 18 nt, Artificial Sequence
  Description of Artificial Sequence: Synthetic oligonucleotide
cauuucugaccaaauuug

SEQ ID NO: 31777 - RNA, 18 nt, Artificial Sequence
  Description of Artificial Sequence: Synthetic oligonucleotide
cacaacauuucugaccaa

SEQ ID NO: 31778 - RNA, 18 nt, Artificial Sequence
  Description of Artificial Sequence: Synthetic oligonucleotide
auagacacaacauuucug

SEQ ID NO: 31779 - RNA, 18 nt, Artificial Sequence
  Description of Artificial Sequence: Synthetic oligonucleotide
auauuauagacacaacau

SEQ ID NO: 31780 - RNA, 18 nt, Artificial Sequence
  Description of Artificial Sequence: Synthetic oligonucleotide
uagaaauauuauagacac

SEQ ID NO: 31781 - RNA, 18 nt, Artificial Sequence
  Description of Artificial Sequence: Synthetic oligonucleotide
cuuuuuagaaauauuaua

SEQ ID NO: 31782 - RNA, 18 nt, Artificial Sequence
  Description of Artificial Sequence: Synthetic oligonucleotide
aaucucuuuuuagaaaua

SEQ ID NO: 31783 - RNA, 18 nt, Artificial Sequence
  Description of Artificial Sequence: Synthetic oligonucleotide
gcuacaaucucuuuuuag

SEQ ID NO: 31784 - RNA, 18 nt, Artificial Sequence
  Description of Artificial Sequence: Synthetic oligonucleotide
acauggcuacaaucucuu

SEQ ID NO: 31785 - RNA, 18 nt, Artificial Sequence
  Description of Artificial Sequence: Synthetic oligonucleotide
uuuuaacauggcuacaau

SEQ ID NO: 31786 - RNA, 18 nt, Artificial Sequence
  Description of Artificial Sequence: Synthetic oligonucleotide
ugaguuuuuaacauggcu

SEQ ID NO: 31787 - RNA, 18 nt, Artificial Sequence
  Description of Artificial Sequence: Synthetic oligonucleotide
ucaguugaguuuuuaaca

SEQ ID NO: 31788 - RNA, 18 nt, Artificial Sequence
  Description of Artificial Sequence: Synthetic oligonucleotide
auacaucaguugaguuuu

SEQ ID NO: 31789 - RNA, 18 nt, Artificial Sequence
  Description of Artificial Sequence: Synthetic oligonucleotide
ggcacauacaucaguuga

SEQ ID NO: 31790 - RNA, 18 nt, Artificial Sequence
  Description of Artificial Sequence: Synthetic oligonucleotide
uaguuggcacauacauca

SEQ ID NO: 31791 - RNA, 18 nt, Artificial Sequence
  Description of Artificial Sequence: Synthetic oligonucleotide
aguuauaguuggcacaua

SEQ ID NO: 31792 - RNA, 18 nt, Artificial Sequence
  Description of Artificial Sequence: Synthetic oligonucleotide
aaaagaguuauaguuggc

SEQ ID NO: 31793 - RNA, 18 nt, Artificial Sequence
  Description of Artificial Sequence: Synthetic oligonucleotide
guaagaaaagaguuauag

SEQ ID NO: 31794 - RNA, 18 nt, Artificial Sequence
  Description of Artificial Sequence: Synthetic oligonucleotide
uagagguaagaaaagagu

SEQ ID NO: 31795 - RNA, 18 nt, Artificial Sequence
  Description of Artificial Sequence: Synthetic oligonucleotide
uacuuuagagguaagaaa

SEQ ID NO: 31796 - RNA, 18 nt, Artificial Sequence
  Description of Artificial Sequence: Synthetic oligonucleotide
uuucuuacuuuagaggua

SEQ ID NO: 31797 - RNA, 18 nt, Artificial Sequence
  Description of Artificial Sequence: Synthetic oligonucleotide
auuauuuucuuacuuuag

SEQ ID NO: 31798 - RNA, 18 nt, Artificial Sequence
  Description of Artificial Sequence: Synthetic oligonucleotide
aggaaauuauuuucuuac

SEQ ID NO: 31799 - RNA, 18 nt, Artificial Sequence
  Description of Artificial Sequence: Synthetic oligonucleotide
aaucuaggaaauuauuuu

SEQ ID NO: 31800 - RNA, 18 nt, Artificial Sequence
  Description of Artificial Sequence: Synthetic oligonucleotide
ggauaaaucuaggaaauu

SEQ ID NO: 31801 - RNA, 18 nt, Artificial Sequence
  Description of Artificial Sequence: Synthetic oligonucleotide
guuuaggauaaaucuagg

SEQ ID NO: 31802 - RNA, 18 nt, Artificial Sequence
  Description of Artificial Sequence: Synthetic oligonucleotide
agcauguuuaggauaaau

SEQ ID NO: 31803 - RNA, 18 nt, Artificial Sequence
  Description of Artificial Sequence: Synthetic oligonucleotide
acaucagcauguuuagga

SEQ ID NO: 31804 - RNA, 18 nt, Artificial Sequence
  Description of Artificial Sequence: Synthetic oligonucleotide
uauauacaucagcauguu

SEQ ID NO: 31805 - RNA, 18 nt, Artificial Sequence
  Description of Artificial Sequence: Synthetic oligonucleotide
acucuuauauacaucagc

SEQ ID NO: 31806 - RNA, 18 nt, Artificial Sequence
  Description of Artificial Sequence: Synthetic oligonucleotide
guauuacucuuauauaca

SEQ ID NO: 31807 - RNA, 18 nt, Artificial Sequence
  Description of Artificial Sequence: Synthetic oligonucleotide
uuaagguauuacucuuau

SEQ ID NO: 31808 - RNA, 18 nt, Artificial Sequence
  Description of Artificial Sequence: Synthetic oligonucleotide
aacaauuaagguauuacu

SEQ ID NO: 31809 - RNA, 18 nt, Artificial Sequence
  Description of Artificial Sequence: Synthetic oligonucleotide
ccauaaacaauuaaggua

SEQ ID NO: 31810 - RNA, 18 nt, Artificial Sequence
  Description of Artificial Sequence: Synthetic oligonucleotide
aaaaaccauaaacaauua

SEQ ID NO: 31811 - RNA, 18 nt, Artificial Sequence
  Description of Artificial Sequence: Synthetic oligonucleotide
ggaagaaaaaccauaaac

SEQ ID NO: 31812 - RNA, 18 nt, Artificial Sequence
  Description of Artificial Sequence: Synthetic oligonucleotide
guccaggaagaaaaacca

SEQ ID NO: 31813 - RNA, 18 nt, Artificial Sequence
  Description of Artificial Sequence: Synthetic oligonucleotide
agaguguccaggaagaaa

SEQ ID NO: 31814 - RNA, 18 nt, Artificial Sequence
  Description of Artificial Sequence: Synthetic oligonucleotide
agaaaagaguguccagga

SEQ ID NO: 31815 - RNA, 18 nt, Artificial Sequence
  Description of Artificial Sequence: Synthetic oligonucleotide
ucuguagaaaagaguguc

SEQ ID NO: 31816 - RNA, 18 nt, Artificial Sequence
  Description of Artificial Sequence: Synthetic oligonucleotide
uguuuucuguagaaaaga

SEQ ID NO: 31817 - RNA, 18 nt, Artificial Sequence
  Description of Artificial Sequence: Synthetic oligonucleotide
aguuguguuuucuguaga

SEQ ID NO: 31818 - RNA, 18 nt, Artificial Sequence
  Description of Artificial Sequence: Synthetic oligonucleotide
caaaaaaauacaaggcag

SEQ ID NO: 31819 - RNA, 18 nt, Artificial Sequence
  Description of Artificial Sequence: Synthetic oligonucleotide
uaggucaaaaaaauacaa

SEQ ID NO: 31820 - RNA, 18 nt, Artificial Sequence
  Description of Artificial Sequence: Synthetic oligonucleotide
uuugauaggucaaaaaaa

SEQ ID NO: 31821 - RNA, 18 nt, Artificial Sequence
  Description of Artificial Sequence: Synthetic oligonucleotide
augauuuugauaggucaa

SEQ ID NO: 31822 - RNA, 18 nt, Artificial Sequence
  Description of Artificial Sequence: Synthetic oligonucleotide
gaaaaaugauuuugauag

SEQ ID NO: 31823 - RNA, 18 nt, Artificial Sequence
  Description of Artificial Sequence: Synthetic oligonucleotide
uaauugaaaaaugauuuu

SEQ ID NO: 31824 - RNA, 18 nt, Artificial Sequence
  Description of Artificial Sequence: Synthetic oligonucleotide
acaaguaauugaaaaaug

SEQ ID NO: 31825 - RNA, 18 nt, Artificial Sequence
  Description of Artificial Sequence: Synthetic oligonucleotide
gggaaacaaguaauugaa

SEQ ID NO: 31826 - RNA, 18 nt, Artificial Sequence
  Description of Artificial Sequence: Synthetic oligonucleotide
gacaucugaaaucuaggg

SEQ ID NO: 31827 - RNA, 18 nt, Artificial Sequence
  Description of Artificial Sequence: Synthetic oligonucleotide
ccgugacaucugaaaucu

SEQ ID NO: 31828 - RNA, 18 nt, Artificial Sequence
  Description of Artificial Sequence: Synthetic oligonucleotide
ucauaccgugacaucuga

SEQ ID NO: 31829 - RNA, 18 nt, Artificial Sequence
  Description of Artificial Sequence: Synthetic oligonucleotide
accuuucauaccgugaca

SEQ ID NO: 31830 - RNA, 18 nt, Artificial Sequence
  Description of Artificial Sequence: Synthetic oligonucleotide
auaaaaccuuucauaccg

SEQ ID NO: 31831 - RNA, 18 nt, Artificial Sequence
  Description of Artificial Sequence: Synthetic oligonucleotide
uauauauaaaaccuuuca

SEQ ID NO: 31832 - RNA, 18 nt, Artificial Sequence
  Description of Artificial Sequence: Synthetic oligonucleotide
uuaaauauauauaaaacc

SEQ ID NO: 31833 - RNA, 18 nt, Artificial Sequence
  Description of Artificial Sequence: Synthetic oligonucleotide
auuuuuuaaauauauaua

SEQ ID NO: 31834 - RNA, 18 nt, Artificial Sequence
  Description of Artificial Sequence: Synthetic oligonucleotide
acuuuauuuuuuaaauau

SEQ ID NO: 31835 - RNA, 18 nt, Artificial Sequence
  Description of Artificial Sequence: Synthetic oligonucleotide
uuuauacuuuauuuuuua

SEQ ID NO: 31836 - RNA, 18 nt, Artificial Sequence
  Description of Artificial Sequence: Synthetic oligonucleotide
uuauguuuauacuuuauu

SEQ ID NO: 31837 - RNA, 18 nt, Artificial Sequence
  Description of Artificial Sequence: Synthetic oligonucleotide
agacuuuauguuuauacu

SEQ ID NO: 31838 - RNA, 18 nt, Artificial Sequence
  Description of Artificial Sequence: Synthetic oligonucleotide
caaaaagacuuuauguuu

SEQ ID NO: 31839 - RNA, 18 nt, Artificial Sequence
  Description of Artificial Sequence: Synthetic oligonucleotide
cgcuucaaaaagacuuua

SEQ ID NO: 31840 - RNA, 18 nt, Artificial Sequence
  Description of Artificial Sequence: Synthetic oligonucleotide
aaccacgcuucaaaaaga

SEQ ID NO: 31841 - RNA, 18 nt, Artificial Sequence
  Description of Artificial Sequence: Synthetic oligonucleotide
ugcauaaccacgcuucaa

SEQ ID NO: 31842 - RNA, 18 nt, Artificial Sequence
  Description of Artificial Sequence: Synthetic oligonucleotide
uauguugcauaaccacgc

SEQ ID NO: 31843 - RNA, 18 nt, Artificial Sequence
  Description of Artificial Sequence: Synthetic oligonucleotide
uagcauauguugcauaac

SEQ ID NO: 31844 - RNA, 18 nt, Artificial Sequence
  Description of Artificial Sequence: Synthetic oligonucleotide
acgccuagcauauguugc

SEQ ID NO: 31845 - RNA, 18 nt, Artificial Sequence
  Description of Artificial Sequence: Synthetic oligonucleotide
aacuuacgccuagcauau

SEQ ID NO: 31846 - RNA, 18 nt, Artificial Sequence
  Description of Artificial Sequence: Synthetic oligonucleotide
ucaccaacuuacgccuag

SEQ ID NO: 31847 - RNA, 18 nt, Artificial Sequence
  Description of Artificial Sequence: Synthetic oligonucleotide
ggcauucaccaacuuacg

SEQ ID NO: 31848 - RNA, 18 nt, Artificial Sequence
  Description of Artificial Sequence: Synthetic oligonucleotide
aagcaggcauucaccaac

SEQ ID NO: 31849 - RNA, 18 nt, Artificial Sequence
  Description of Artificial Sequence: Synthetic oligonucleotide
cugcaaagcaggcauuca

SEQ ID NO: 31850 - RNA, 18 nt, Artificial Sequence
  Description of Artificial Sequence: Synthetic oligonucleotide
acacucugcaaagcaggc

SEQ ID NO: 31851 - RNA, 18 nt, Artificial Sequence
  Description of Artificial Sequence: Synthetic oligonucleotide
ggguuacacucugcaaag

SEQ ID NO: 31852 - RNA, 18 nt, Artificial Sequence
  Description of Artificial Sequence: Synthetic oligonucleotide
cuuuuuuuauucaauggg

SEQ ID NO: 31853 - RNA, 18 nt, Artificial Sequence
  Description of Artificial Sequence: Synthetic oligonucleotide
gcuuuuuuuauucaaugg

SEQ ID NO: 31854 - RNA, 18 nt, Artificial Sequence
  Description of Artificial Sequence: Synthetic oligonucleotide
acaaagcuuuuuuuauuc

SEQ ID NO: 31855 - RNA, 18 nt, Artificial Sequence
  Description of Artificial Sequence: Synthetic oligonucleotide
ggaaaacaaagcuuuuuu

SEQ ID NO: 31856 - RNA, 18 nt, Artificial Sequence
  Description of Artificial Sequence: Synthetic oligonucleotide
gaaagggaaaacaaagcu

SEQ ID NO: 31857 - RNA, 18 nt, Artificial Sequence
  Description of Artificial Sequence: Synthetic oligonucleotide
gggcagaaagggaaaaca

SEQ ID NO: 31858 - RNA, 18 nt, Artificial Sequence
  Description of Artificial Sequence: Synthetic oligonucleotide
gcccauacugauacaggg

SEQ ID NO: 31859 - RNA, 18 nt, Artificial Sequence
  Description of Artificial Sequence: Synthetic oligonucleotide
ugcccauacugauacagg

SEQ ID NO: 31860 - RNA, 18 nt, Artificial Sequence
  Description of Artificial Sequence: Synthetic oligonucleotide
gggugugcccauacugau

SEQ ID NO: 31861 - RNA, 18 nt, Artificial Sequence
  Description of Artificial Sequence: Synthetic oligonucleotide
gugcagggugugcccaua

SEQ ID NO: 31862 - RNA, 18 nt, Artificial Sequence
  Description of Artificial Sequence: Synthetic oligonucleotide
uuagagugcagggugugc

SEQ ID NO: 31863 - RNA, 18 nt, Artificial Sequence
  Description of Artificial Sequence: Synthetic oligonucleotide
uaaaguuagagugcaggg

SEQ ID NO: 31864 - RNA, 18 nt, Artificial Sequence
  Description of Artificial Sequence: Synthetic oligonucleotide
uagauuaaaguuagagug

SEQ ID NO: 31865 - RNA, 18 nt, Artificial Sequence
  Description of Artificial Sequence: Synthetic oligonucleotide
ugacguagauuaaaguua

SEQ ID NO: 31866 - RNA, 18 nt, Artificial Sequence
  Description of Artificial Sequence: Synthetic oligonucleotide
gagggugacguagauuaa

SEQ ID NO: 31867 - RNA, 18 nt, Artificial Sequence
  Description of Artificial Sequence: Synthetic oligonucleotide
caggugagggugacguag

SEQ ID NO: 31868 - RNA, 18 nt, Artificial Sequence
  Description of Artificial Sequence: Synthetic oligonucleotide
ccaaacaggugaggguga

SEQ ID NO: 31869 - RNA, 18 nt, Artificial Sequence
  Description of Artificial Sequence: Synthetic oligonucleotide
ccaaaccaaacaggugag

SEQ ID NO: 31870 - RNA, 18 nt, Artificial Sequence
  Description of Artificial Sequence: Synthetic oligonucleotide
uaaacccaaaccaaacag

SEQ ID NO: 31871 - RNA, 18 nt, Artificial Sequence
  Description of Artificial Sequence: Synthetic oligonucleotide
gacauuaaacccaaacca

SEQ ID NO: 31872 - RNA, 18 nt, Artificial Sequence
  Description of Artificial Sequence: Synthetic oligonucleotide
ucgcagacauuaaaccca

SEQ ID NO: 31873 - RNA, 18 nt, Artificial Sequence
  Description of Artificial Sequence: Synthetic oligonucleotide
uuuucucgcagacauuaa

SEQ ID NO: 31874 - RNA, 18 nt, Artificial Sequence
  Description of Artificial Sequence: Synthetic oligonucleotide
uuugguuuucucgcagac

SEQ ID NO: 31875 - RNA, 18 nt, Artificial Sequence
  Description of Artificial Sequence: Synthetic oligonucleotide
agauauuugguuuucucg

SEQ ID NO: 31876 - RNA, 18 nt, Artificial Sequence
  Description of Artificial Sequence: Synthetic oligonucleotide
acacaagauauuugguuu

SEQ ID NO: 31877 - RNA, 18 nt, Artificial Sequence
  Description of Artificial Sequence: Synthetic oligonucleotide
acaauacacaagauauuu

SEQ ID NO: 31878 - RNA, 18 nt, Artificial Sequence
  Description of Artificial Sequence: Synthetic oligonucleotide
aguucacaauacacaaga

SEQ ID NO: 31879 - RNA, 18 nt, Artificial Sequence
  Description of Artificial Sequence: Synthetic oligonucleotide
uugacaguucacaauaca

SEQ ID NO: 31880 - RNA, 18 nt, Artificial Sequence
  Description of Artificial Sequence: Synthetic oligonucleotide
uggcuuugacaguucaca

SEQ ID NO: 31881 - RNA, 18 nt, Artificial Sequence
  Description of Artificial Sequence: Synthetic oligonucleotide
uuagauggcuuugacagu

SEQ ID NO: 31882 - RNA, 18 nt, Artificial Sequence
  Description of Artificial Sequence: Synthetic oligonucleotide
uugguuuagauggcuuug

SEQ ID NO: 31883 - RNA, 18 nt, Artificial Sequence
  Description of Artificial Sequence: Synthetic oligonucleotide
ugggauugguuuagaugg

SEQ ID NO: 31884 - RNA, 18 nt, Artificial Sequence
  Description of Artificial Sequence: Synthetic oligonucleotide
gaccuugggauugguuua

SEQ ID NO: 31885 - RNA, 18 nt, Artificial Sequence
  Description of Artificial Sequence: Synthetic oligonucleotide
cacuugaccuugggauug

SEQ ID NO: 31886 - RNA, 18 nt, Artificial Sequence
  Description of Artificial Sequence: Synthetic oligonucleotide
auauccacuugaccuugg

SEQ ID NO: 31887 - RNA, 18 nt, Artificial Sequence
  Description of Artificial Sequence: Synthetic oligonucleotide
uuuuuauauccacuugac

SEQ ID NO: 31888 - RNA, 18 nt, Artificial Sequence
  Description of Artificial Sequence: Synthetic oligonucleotide
cagaauuuuuauauccac

SEQ ID NO: 31889 - RNA, 18 nt, Artificial Sequence
  Description of Artificial Sequence: Synthetic oligonucleotide
uuuggcagaauuuuuaua

SEQ ID NO: 31890 - RNA, 18 nt, Artificial Sequence
  Description of Artificial Sequence: Synthetic oligonucleotide
auguuuuuggcagaauuu

SEQ ID NO: 31891 - RNA, 18 nt, Artificial Sequence
  Description of Artificial Sequence: Synthetic oligonucleotide
augccauguuuuuggcag

SEQ ID NO: 31892 - RNA, 18 nt, Artificial Sequence
  Description of Artificial Sequence: Synthetic oligonucleotide
aucuuaugccauguuuuu

SEQ ID NO: 31893 - RNA, 18 nt, Artificial Sequence
  Description of Artificial Sequence: Synthetic oligonucleotide
uuuccaucuuaugccaug

SEQ ID NO: 31894 - RNA, 18 nt, Artificial Sequence
  Description of Artificial Sequence: Synthetic oligonucleotide
gaacuuuuccaucuuaug

SEQ ID NO: 31895 - RNA, 18 nt, Artificial Sequence
  Description of Artificial Sequence: Synthetic oligonucleotide
ucagggaacuuuuccauc

SEQ ID NO: 31896 - RNA, 18 nt, Artificial Sequence
  Description of Artificial Sequence: Synthetic oligonucleotide
aguuuucagggaacuuuu

SEQ ID NO: 31897 - RNA, 18 nt, Artificial Sequence
  Description of Artificial Sequence: Synthetic oligonucleotide
uccagaguuuucagggaa

SEQ ID NO: 31898 - RNA, 18 nt, Artificial Sequence
  Description of Artificial Sequence: Synthetic oligonucleotide
uuucuuccagaguuuuca

SEQ ID NO: 31899 - RNA, 18 nt, Artificial Sequence
  Description of Artificial Sequence: Synthetic oligonucleotide
uuuguuuucuuccagagu

SEQ ID NO: 31900 - RNA, 18 nt, Artificial Sequence
  Description of Artificial Sequence: Synthetic oligonucleotide
auuacuuuguuuucuucc

SEQ ID NO: 31901 - RNA, 18 nt, Artificial Sequence
  Description of Artificial Sequence: Synthetic oligonucleotide
ucuacauuacuuuguuuu

SEQ ID NO: 31902 - RNA, 18 nt, Artificial Sequence
  Description of Artificial Sequence: Synthetic oligonucleotide
aggugucuacauuacuuu

SEQ ID NO: 31903 - RNA, 18 nt, Artificial Sequence
  Description of Artificial Sequence: Synthetic oligonucleotide
aaagaaggugucuacauu

SEQ ID NO: 31904 - RNA, 18 nt, Artificial Sequence
  Description of Artificial Sequence: Synthetic oligonucleotide
gggaaaaagaaggugucu

SEQ ID NO: 31905 - RNA, 18 nt, Artificial Sequence
  Description of Artificial Sequence: Synthetic oligonucleotide
auuuucuaaugguguggg

SEQ ID NO: 31906 - RNA, 18 nt, Artificial Sequence
  Description of Artificial Sequence: Synthetic oligonucleotide
aacauuuucuaauggugu

SEQ ID NO: 31907 - RNA, 18 nt, Artificial Sequence
  Description of Artificial Sequence: Synthetic oligonucleotide
gaugcaacauuuucuaau

SEQ ID NO: 31908 - RNA, 18 nt, Artificial Sequence
  Description of Artificial Sequence: Synthetic oligonucleotide
guccucaucgucauuauu

SEQ ID NO: 31909 - RNA, 18 nt, Artificial Sequence
  Description of Artificial Sequence: Synthetic oligonucleotide
gucagguccucaucguca

SEQ ID NO: 31910 - RNA, 18 nt, Artificial Sequence
  Description of Artificial Sequence: Synthetic oligonucleotide
cuggugucagguccucau

SEQ ID NO: 31911 - RNA, 18 nt, Artificial Sequence
  Description of Artificial Sequence: Synthetic oligonucleotide
cugcucuggugucagguc

SEQ ID NO: 31912 - RNA, 18 nt, Artificial Sequence
  Description of Artificial Sequence: Synthetic oligonucleotide
gccuucugcucugguguc

SEQ ID NO: 31913 - RNA, 18 nt, Artificial Sequence
  Description of Artificial Sequence: Synthetic oligonucleotide
gcucugccuucugcucug

SEQ ID NO: 31914 - RNA, 18 nt, Artificial Sequence
  Description of Artificial Sequence: Synthetic oligonucleotide
cucacgcucugccuucug

SEQ ID NO: 31915 - RNA, 18 nt, Artificial Sequence
  Description of Artificial Sequence: Synthetic oligonucleotide
uccuucucacgcucugcc

SEQ ID NO: 31916 - RNA, 18 nt, Artificial Sequence
  Description of Artificial Sequence: Synthetic oligonucleotide
uccgcuccuucucacgcu

SEQ ID NO: 31917 - RNA, 18 nt, Artificial Sequence
  Description of Artificial Sequence: Synthetic oligonucleotide
cauccuccgcuccuucuc

SEQ ID NO: 31918 - RNA, 18 nt, Artificial Sequence
  Description of Artificial Sequence: Synthetic oligonucleotide
uuggccauccuccgcucc

SEQ ID NO: 31919 - RNA, 18 nt, Artificial Sequence
  Description of Artificial Sequence: Synthetic oligonucleotide
cauuguuggccauccucc

SEQ ID NO: 31920 - RNA, 18 nt, Artificial Sequence
  Description of Artificial Sequence: Synthetic oligonucleotide
ucgggcauuguuggccau

SEQ ID NO: 31921 - RNA, 18 nt, Artificial Sequence
  Description of Artificial Sequence: Synthetic oligonucleotide
cgcucucgggcauuguug

SEQ ID NO: 31922 - RNA, 18 nt, Artificial Sequence
  Description of Artificial Sequence: Synthetic oligonucleotide
gcagacgcucucgggcau

SEQ ID NO: 31923 - RNA, 18 nt, Artificial Sequence
  Description of Artificial Sequence: Synthetic oligonucleotide
gacccgcagacgcucucg

SEQ ID NO: 31924 - RNA, 18 nt, Artificial Sequence
  Description of Artificial Sequence: Synthetic oligonucleotide
ucacggacccgcagacgc

SEQ ID NO: 31925 - RNA, 18 nt, Artificial Sequence
  Description of Artificial Sequence: Synthetic oligonucleotide
ugaugucacggacccgca

SEQ ID NO: 31926 - RNA, 18 nt, Artificial Sequence
  Description of Artificial Sequence: Synthetic oligonucleotide
cucguugaugucacggac

SEQ ID NO: 31927 - RNA, 18 nt, Artificial Sequence
  Description of Artificial Sequence: Synthetic oligonucleotide
aaagccucguugauguca

SEQ ID NO: 31928 - RNA, 18 nt, Artificial Sequence
  Description of Artificial Sequence: Synthetic oligonucleotide
cuuugaaagccucguuga

SEQ ID NO: 31929 - RNA, 18 nt, Artificial Sequence
  Description of Artificial Sequence: Synthetic oligonucleotide
gagcucuuugaaagccuc

SEQ ID NO: 31930 - RNA, 18 nt, Artificial Sequence
  Description of Artificial Sequence: Synthetic oligonucleotide
cggccgagcucuuugaaa

SEQ ID NO: 31931 - RNA, 18 nt, Artificial Sequence
  Description of Artificial Sequence: Synthetic oligonucleotide
ccaugcggccgagcucuu

SEQ ID NO: 31932 - RNA, 18 nt, Artificial Sequence
  Description of Artificial Sequence: Synthetic oligonucleotide
cugcaccaugcggccgag

SEQ ID NO: 31933 - RNA, 18 nt, Artificial Sequence
  Description of Artificial Sequence: Synthetic oligonucleotide
uggagcugcaccaugcgg

SEQ ID NO: 31934 - RNA, 18 nt, Artificial Sequence
  Description of Artificial Sequence: Synthetic oligonucleotide
ugagguggagcugcacca

SEQ ID NO: 31935 - RNA, 18 nt, Artificial Sequence
  Description of Artificial Sequence: Synthetic oligonucleotide
acucuugagguggagcug

SEQ ID NO: 31936 - RNA, 18 nt, Artificial Sequence
  Description of Artificial Sequence: Synthetic oligonucleotide
uugucacucuugaggugg

SEQ ID NO: 31937 - RNA, 18 nt, Artificial Sequence
  Description of Artificial Sequence: Synthetic oligonucleotide
gggcuugucacucuugag

SEQ ID NO: 31938 - RNA, 18 nt, Artificial Sequence
  Description of Artificial Sequence: Synthetic oligonucleotide
ucaggagcuuggucuggg

SEQ ID NO: 31939 - RNA, 18 nt, Artificial Sequence
  Description of Artificial Sequence: Synthetic oligonucleotide
gaggaucaggagcuuggu

SEQ ID NO: 31940 - RNA, 18 nt, Artificial Sequence
  Description of Artificial Sequence: Synthetic oligonucleotide
ugguggaggaucaggagc

SEQ ID NO: 31941 - RNA, 18 nt, Artificial Sequence
  Description of Artificial Sequence: Synthetic oligonucleotide
ccgccugguggaggauca

SEQ ID NO: 31942 - RNA, 18 nt, Artificial Sequence
  Description of Artificial Sequence: Synthetic oligonucleotide
ggccaccgccugguggag

SEQ ID NO: 31943 - RNA, 18 nt, Artificial Sequence
  Description of Artificial Sequence: Synthetic oligonucleotide
augacggccaccgccugg

SEQ ID NO: 31944 - RNA, 18 nt, Artificial Sequence
  Description of Artificial Sequence: Synthetic oligonucleotide
ugaggaugacggccaccg

SEQ ID NO: 31945 - RNA, 18 nt, Artificial Sequence
  Description of Artificial Sequence: Synthetic oligonucleotide
cagacugaggaugacggc

SEQ ID NO: 31946 - RNA, 18 nt, Artificial Sequence
  Description of Artificial Sequence: Synthetic oligonucleotide
ugcuccagacugaggaug

SEQ ID NO: 31947 - RNA, 18 nt, Artificial Sequence
  Description of Artificial Sequence: Synthetic oligonucleotide
cuugcugcuccagacuga

SEQ ID NO: 31948 - RNA, 18 nt, Artificial Sequence
  Description of Artificial Sequence: Synthetic oligonucleotide
ucggacuugcugcuccag

SEQ ID NO: 31949 - RNA, 18 nt, Artificial Sequence
  Description of Artificial Sequence: Synthetic oligonucleotide
guaguccugguggcaugc

SEQ ID NO: 31950 - RNA, 18 nt, Artificial Sequence
  Description of Artificial Sequence: Synthetic oligonucleotide
ccccuguaguccuggugg

SEQ ID NO: 31951 - RNA, 18 nt, Artificial Sequence
  Description of Artificial Sequence: Synthetic oligonucleotide
cucugccccuguaguccu

SEQ ID NO: 31952 - RNA, 18 nt, Artificial Sequence
  Description of Artificial Sequence: Synthetic oligonucleotide
agacacucugccccugua

SEQ ID NO: 31953 - RNA, 18 nt, Artificial Sequence
  Description of Artificial Sequence: Synthetic oligonucleotide
agaggagacacucugccc

SEQ ID NO: 31954 - RNA, 18 nt, Artificial Sequence
  Description of Artificial Sequence: Synthetic oligonucleotide
cugccagaggagacacuc

SEQ ID NO: 31955 - RNA, 18 nt, Artificial Sequence
  Description of Artificial Sequence: Synthetic oligonucleotide
cagagcugccagaggaga

SEQ ID NO: 31956 - RNA, 18 nt, Artificial Sequence
  Description of Artificial Sequence: Synthetic oligonucleotide
gaucucagagcugccaga

SEQ ID NO: 31957 - RNA, 18 nt, Artificial Sequence
  Description of Artificial Sequence: Synthetic oligonucleotide
gauuugaucucagagcug

SEQ ID NO: 31958 - RNA, 18 nt, Artificial Sequence
  Description of Artificial Sequence: Synthetic oligonucleotide
caucggauuugaucucag

SEQ ID NO: 31959 - RNA, 18 nt, Artificial Sequence
  Description of Artificial Sequence: Synthetic oligonucleotide
cucgucaucggauuugau

SEQ ID NO: 31960 - RNA, 18 nt, Artificial Sequence
  Description of Artificial Sequence: Synthetic oligonucleotide
ucacccucgucaucggau

SEQ ID NO: 31961 - RNA, 18 nt, Artificial Sequence
  Description of Artificial Sequence: Synthetic oligonucleotide
ucucaucacccucgucau

SEQ ID NO: 31962 - RNA, 18 nt, Artificial Sequence
  Description of Artificial Sequence: Synthetic oligonucleotide
cagguucucaucacccuc

SEQ ID NO: 31963 - RNA, 18 nt, Artificial Sequence
  Description of Artificial Sequence: Synthetic oligonucleotide
ucuugcagguucucauca

SEQ ID NO: 31964 - RNA, 18 nt, Artificial Sequence
  Description of Artificial Sequence: Synthetic oligonucleotide
ucgugucuugcagguucu

SEQ ID NO: 31965 - RNA, 18 nt, Artificial Sequence
  Description of Artificial Sequence: Synthetic oligonucleotide
agauuucgugucuugcag

SEQ ID NO: 31966 - RNA, 18 nt, Artificial Sequence
  Description of Artificial Sequence: Synthetic oligonucleotide
uccgaagauuucgugucu

SEQ ID NO: 31967 - RNA, 18 nt, Artificial Sequence
  Description of Artificial Sequence: Synthetic oligonucleotide
uguccuccgaagauuucg

SEQ ID NO: 31968 - RNA, 18 nt, Artificial Sequence
  Description of Artificial Sequence: Synthetic oligonucleotide
uuucuuguccuccgaaga

SEQ ID NO: 31969 - RNA, 18 nt, Artificial Sequence
  Description of Artificial Sequence: Synthetic oligonucleotide
ucuaauuucuuguccucc

SEQ ID NO: 31970 - RNA, 18 nt, Artificial Sequence
  Description of Artificial Sequence: Synthetic oligonucleotide
cgucaucuaauuucuugu

SEQ ID NO: 31971 - RNA, 18 nt, Artificial Sequence
  Description of Artificial Sequence: Synthetic oligonucleotide
cuugucgucaucuaauuu

SEQ ID NO: 31972 - RNA, 18 nt, Artificial Sequence
  Description of Artificial Sequence: Synthetic oligonucleotide
uccuucuugucgucaucu

SEQ ID NO: 31973 - RNA, 18 nt, Artificial Sequence
  Description of Artificial Sequence: Synthetic oligonucleotide
ugauauccuucuugucgu

SEQ ID NO: 31974 - RNA, 18 nt, Artificial Sequence
  Description of Artificial Sequence: Synthetic oligonucleotide
ugauuugauauccuucuu

SEQ ID NO: 31975 - RNA, 18 nt, Artificial Sequence
  Description of Artificial Sequence: Synthetic oligonucleotide
guaauugauuugauaucc

SEQ ID NO: 31976 - RNA, 18 nt, Artificial Sequence
  Description of Artificial Sequence: Synthetic oligonucleotide
uauacuguuaccuagauc

SEQ ID NO: 31977 - RNA, 18 nt, Artificial Sequence
  Description of Artificial Sequence: Synthetic oligonucleotide
uauuauauacuguuaccu

SEQ ID NO: 31978 - RNA, 18 nt, Artificial Sequence
  Description of Artificial Sequence: Synthetic oligonucleotide
gacaguauuauauacugu

SEQ ID NO: 31979 - RNA, 18 nt, Artificial Sequence
  Description of Artificial Sequence: Synthetic oligonucleotide
gaagcgacaguauuauau

SEQ ID NO: 31980 - RNA, 18 nt, Artificial Sequence
  Description of Artificial Sequence: Synthetic oligonucleotide
uaaaugaagcgacaguau

SEQ ID NO: 31981 - RNA, 18 nt, Artificial Sequence
  Description of Artificial Sequence: Synthetic oligonucleotide
ggaauuaaaugaagcgac

SEQ ID NO: 31982 - RNA, 18 nt, Artificial Sequence
  Description of Artificial Sequence: Synthetic oligonucleotide
auaaaggaauuaaaugaa

SEQ ID NO: 31983 - RNA, 18 nt, Artificial Sequence
  Description of Artificial Sequence: Synthetic oligonucleotide
guccaauaaaggaauuaa

SEQ ID NO: 31984 - RNA, 18 nt, Artificial Sequence
  Description of Artificial Sequence: Synthetic oligonucleotide
ucaaaguccaauaaagga

SEQ ID NO: 31985 - RNA, 18 nt, Artificial Sequence
  Description of Artificial Sequence: Synthetic oligonucleotide
cuucaucaaaguccaaua

SEQ ID NO: 31986 - RNA, 18 nt, Artificial Sequence
  Description of Artificial Sequence: Synthetic oligonucleotide
guucacuucaucaaaguc

SEQ ID NO: 31987 - RNA, 18 nt, Artificial Sequence
  Description of Artificial Sequence: Synthetic oligonucleotide
guucuguucacuucauca

SEQ ID NO: 31988 - RNA, 18 nt, Artificial Sequence
  Description of Artificial Sequence: Synthetic oligonucleotide
uucccguucuguucacuu

SEQ ID NO: 31989 - RNA, 18 nt, Artificial Sequence
  Description of Artificial Sequence: Synthetic oligonucleotide
guuucuucccguucuguu

SEQ ID NO: 31990 - RNA, 18 nt, Artificial Sequence
  Description of Artificial Sequence: Synthetic oligonucleotide
gaauaguuucuucccguu

SEQ ID NO: 31991 - RNA, 18 nt, Artificial Sequence
  Description of Artificial Sequence: Synthetic oligonucleotide
aaacugaauaguuucuuc

SEQ ID NO: 31992 - RNA, 18 nt, Artificial Sequence
  Description of Artificial Sequence: Synthetic oligonucleotide
ggaaaaaacugaauaguu

SEQ ID NO: 31993 - RNA, 18 nt, Artificial Sequence
  Description of Artificial Sequence: Synthetic oligonucleotide
ugccaggaaaaaacugaa

SEQ ID NO: 31994 - RNA, 18 nt, Artificial Sequence
  Description of Artificial Sequence: Synthetic oligonucleotide
uuaccugccaggaaaaaa

SEQ ID NO: 31995 - RNA, 18 nt, Artificial Sequence
  Description of Artificial Sequence: Synthetic oligonucleotide
uaaauuuaccugccagga

SEQ ID NO: 31996 - RNA, 18 nt, Artificial Sequence
  Description of Artificial Sequence: Synthetic oligonucleotide
agcuguaaauuuaccugc

SEQ ID NO: 31997 - RNA, 18 nt, Artificial Sequence
  Description of Artificial Sequence: Synthetic oligonucleotide
uuuucagcuguaaauuua

SEQ ID NO: 31998 - RNA, 18 nt, Artificial Sequence
  Description of Artificial Sequence: Synthetic oligonucleotide
uuuucuuuucagcuguaa

SEQ ID NO: 31999 - RNA, 18 nt, Artificial Sequence
  Description of Artificial Sequence: Synthetic oligonucleotide
uuuaauuuucuuuucagc

SEQ ID NO: 32000 - RNA, 18 nt, Artificial Sequence
  Description of Artificial Sequence: Synthetic oligonucleotide
aggccuuuaauuuucuuu

SEQ ID NO: 32001 - RNA, 18 nt, Artificial Sequence
  Description of Artificial Sequence: Synthetic oligonucleotide
agaguaggccuuuaauuu

SEQ ID NO: 32002 - RNA, 18 nt, Artificial Sequence
  Description of Artificial Sequence: Synthetic oligonucleotide
cuucuagaguaggccuuu

SEQ ID NO: 32003 - RNA, 18 nt, Artificial Sequence
  Description of Artificial Sequence: Synthetic oligonucleotide
uaguacuucuagaguagg

SEQ ID NO: 32004 - RNA, 18 nt, Artificial Sequence
  Description of Artificial Sequence: Synthetic oligonucleotide
acuuuuaguacuucuaga

SEQ ID NO: 32005 - RNA, 18 nt, Artificial Sequence
  Description of Artificial Sequence: Synthetic oligonucleotide
acgauacuuuuaguacuu

SEQ ID NO: 32006 - RNA, 18 nt, Artificial Sequence
  Description of Artificial Sequence: Synthetic oligonucleotide
cugaaacgauacuuuuag

SEQ ID NO: 32007 - RNA, 18 nt, Artificial Sequence
  Description of Artificial Sequence: Synthetic oligonucleotide
gguaucugaaacgauacu

SEQ ID NO: 32008 - RNA, 18 nt, Artificial Sequence
  Description of Artificial Sequence: Synthetic oligonucleotide
guacagguaucugaaacg

SEQ ID NO: 32009 - RNA, 18 nt, Artificial Sequence
  Description of Artificial Sequence: Synthetic oligonucleotide
auagaguacagguaucug

SEQ ID NO: 32010 - RNA, 18 nt, Artificial Sequence
  Description of Artificial Sequence: Synthetic oligonucleotide
cuccaauagaguacaggu

SEQ ID NO: 32011 - RNA, 18 nt, Artificial Sequence
  Description of Artificial Sequence: Synthetic oligonucleotide
uuaggcuccaauagagua

SEQ ID NO: 32012 - RNA, 18 nt, Artificial Sequence
  Description of Artificial Sequence: Synthetic oligonucleotide
acaguuuaggcuccaaua

SEQ ID NO: 32013 - RNA, 18 nt, Artificial Sequence
  Description of Artificial Sequence: Synthetic oligonucleotide
ccaaaacaguuuaggcuc

SEQ ID NO: 32014 - RNA, 18 nt, Artificial Sequence
  Description of Artificial Sequence: Synthetic oligonucleotide
aaaugccaaaacaguuua

SEQ ID NO: 32015 - RNA, 18 nt, Artificial Sequence
  Description of Artificial Sequence: Synthetic oligonucleotide
uucauaaaugccaaaaca

SEQ ID NO: 32016 - RNA, 18 nt, Artificial Sequence
  Description of Artificial Sequence: Synthetic oligonucleotide
ccagauucauaaaugcca

SEQ ID NO: 32017 - RNA, 18 nt, Artificial Sequence
  Description of Artificial Sequence: Synthetic oligonucleotide
uggguccagauucauaaa

SEQ ID NO: 32018 - RNA, 18 nt, Artificial Sequence
  Description of Artificial Sequence: Synthetic oligonucleotide
agcauuggguccagauuc

SEQ ID NO: 32019 - RNA, 18 nt, Artificial Sequence
  Description of Artificial Sequence: Synthetic oligonucleotide
ucauuagcauugggucca

SEQ ID NO: 32020 - RNA, 18 nt, Artificial Sequence
  Description of Artificial Sequence: Synthetic oligonucleotide
gugugucauuagcauugg

SEQ ID NO: 32021 - RNA, 18 nt, Artificial Sequence
  Description of Artificial Sequence: Synthetic oligonucleotide
ucacugugugucauuagc

SEQ ID NO: 32022 - RNA, 18 nt, Artificial Sequence
  Description of Artificial Sequence: Synthetic oligonucleotide
uuuuuucacuguguguca

SEQ ID NO: 32023 - RNA, 18 nt, Artificial Sequence
  Description of Artificial Sequence: Synthetic oligonucleotide
acaaauuuuuucacugug

SEQ ID NO: 32024 - RNA, 18 nt, Artificial Sequence
  Description of Artificial Sequence: Synthetic oligonucleotide
cagagacaaauuuuuuca

SEQ ID NO: 32025 - RNA, 18 nt, Artificial Sequence
  Description of Artificial Sequence: Synthetic oligonucleotide
ugaaucagagacaaauuu

SEQ ID NO: 32026 - RNA, 18 nt, Artificial Sequence
  Description of Artificial Sequence: Synthetic oligonucleotide
guacuugaaucagagaca

SEQ ID NO: 32027 - RNA, 18 nt, Artificial Sequence
  Description of Artificial Sequence: Synthetic oligonucleotide
aaacuguacuugaaucag

SEQ ID NO: 32028 - RNA, 18 nt, Artificial Sequence
  Description of Artificial Sequence: Synthetic oligonucleotide
caaauaaacuguacuuga

SEQ ID NO: 32029 - RNA, 18 nt, Artificial Sequence
  Description of Artificial Sequence: Synthetic oligonucleotide
uuuuacaaauaaacugua

SEQ ID NO: 32030 - RNA, 18 nt, Artificial Sequence
  Description of Artificial Sequence: Synthetic oligonucleotide
uauaguuuuacaaauaaa

SEQ ID NO: 32031 - RNA, 18 nt, Artificial Sequence
  Description of Artificial Sequence: Synthetic oligonucleotide
auaaguauaguuuuacaa

SEQ ID NO: 32032 - RNA, 18 nt, Artificial Sequence
  Description of Artificial Sequence: Synthetic oligonucleotide
guagaauaaguauaguuu

SEQ ID NO: 32033 - RNA, 18 nt, Artificial Sequence
  Description of Artificial Sequence: Synthetic oligonucleotide
aauuuguagaauaaguau

SEQ ID NO: 32034 - RNA, 18 nt, Artificial Sequence
  Description of Artificial Sequence: Synthetic oligonucleotide
gaccaaauuuguagaaua

SEQ ID NO: 32035 - RNA, 18 nt, Artificial Sequence
  Description of Artificial Sequence: Synthetic oligonucleotide
uuucugaccaaauuugua

SEQ ID NO: 32036 - RNA, 18 nt, Artificial Sequence
  Description of Artificial Sequence: Synthetic oligonucleotide
caacauuucugaccaaau

SEQ ID NO: 32037 - RNA, 18 nt, Artificial Sequence
  Description of Artificial Sequence: Synthetic oligonucleotide
agacacaacauuucugac

SEQ ID NO: 32038 - RNA, 18 nt, Artificial Sequence
  Description of Artificial Sequence: Synthetic oligonucleotide
auuauagacacaacauuu

SEQ ID NO: 32039 - RNA, 18 nt, Artificial Sequence
  Description of Artificial Sequence: Synthetic oligonucleotide
gaaauauuauagacacaa

SEQ ID NO: 32040 - RNA, 18 nt, Artificial Sequence
  Description of Artificial Sequence: Synthetic oligonucleotide
uuuuagaaauauuauaga

SEQ ID NO: 32041 - RNA, 18 nt, Artificial Sequence
  Description of Artificial Sequence: Synthetic oligonucleotide
ucucuuuuuagaaauauu

SEQ ID NO: 32042 - RNA, 18 nt, Artificial Sequence
  Description of Artificial Sequence: Synthetic oligonucleotide
uacaaucucuuuuuagaa

SEQ ID NO: 32043 - RNA, 18 nt, Artificial Sequence
  Description of Artificial Sequence: Synthetic oligonucleotide
auggcuacaaucucuuuu

SEQ ID NO: 32044 - RNA, 18 nt, Artificial Sequence
  Description of Artificial Sequence: Synthetic oligonucleotide
uuaacauggcuacaaucu

SEQ ID NO: 32045 - RNA, 18 nt, Artificial Sequence
  Description of Artificial Sequence: Synthetic oligonucleotide
aguuuuuaacauggcuac

SEQ ID NO: 32046 - RNA, 18 nt, Artificial Sequence
  Description of Artificial Sequence: Synthetic oligonucleotide
aguugaguuuuuaacaug

SEQ ID NO: 32047 - RNA, 18 nt, Artificial Sequence
  Description of Artificial Sequence: Synthetic oligonucleotide
acaucaguugaguuuuua

SEQ ID NO: 32048 - RNA, 18 nt, Artificial Sequence
  Description of Artificial Sequence: Synthetic oligonucleotide
cacauacaucaguugagu

SEQ ID NO: 32049 - RNA, 18 nt, Artificial Sequence
  Description of Artificial Sequence: Synthetic oligonucleotide
guuggcacauacaucagu

SEQ ID NO: 32050 - RNA, 18 nt, Artificial Sequence
  Description of Artificial Sequence: Synthetic oligonucleotide
uuauaguuggcacauaca

SEQ ID NO: 32051 - RNA, 18 nt, Artificial Sequence
  Description of Artificial Sequence: Synthetic oligonucleotide
aagaguuauaguuggcac

SEQ ID NO: 32052 - RNA, 18 nt, Artificial Sequence
  Description of Artificial Sequence: Synthetic oligonucleotide
aagaaaagaguuauaguu

SEQ ID NO: 32053 - RNA, 18 nt, Artificial Sequence
  Description of Artificial Sequence: Synthetic oligonucleotide
gagguaagaaaagaguua

SEQ ID NO: 32054 - RNA, 18 nt, Artificial Sequence
  Description of Artificial Sequence: Synthetic oligonucleotide
cuuuagagguaagaaaag

SEQ ID NO: 32055 - RNA, 18 nt, Artificial Sequence
  Description of Artificial Sequence: Synthetic oligonucleotide
ucuuacuuuagagguaag

SEQ ID NO: 32056 - RNA, 18 nt, Artificial Sequence
  Description of Artificial Sequence: Synthetic oligonucleotide
uauuuucuuacuuuagag

SEQ ID NO: 32057 - RNA, 18 nt, Artificial Sequence
  Description of Artificial Sequence: Synthetic oligonucleotide
gaaauuauuuucuuacuu

SEQ ID NO: 32058 - RNA, 18 nt, Artificial Sequence
  Description of Artificial Sequence: Synthetic oligonucleotide
ucuaggaaauuauuuucu

SEQ ID NO: 32059 - RNA, 18 nt, Artificial Sequence
  Description of Artificial Sequence: Synthetic oligonucleotide
auaaaucuaggaaauuau

SEQ ID NO: 32060 - RNA, 18 nt, Artificial Sequence
  Description of Artificial Sequence: Synthetic oligonucleotide
uuaggauaaaucuaggaa

SEQ ID NO: 32061 - RNA, 18 nt, Artificial Sequence
  Description of Artificial Sequence: Synthetic oligonucleotide
cauguuuaggauaaaucu

SEQ ID NO: 32062 - RNA, 18 nt, Artificial Sequence
  Description of Artificial Sequence: Synthetic oligonucleotide
aucagcauguuuaggaua

SEQ ID NO: 32063 - RNA, 18 nt, Artificial Sequence
  Description of Artificial Sequence: Synthetic oligonucleotide
uauacaucagcauguuua

SEQ ID NO: 32064 - RNA, 18 nt, Artificial Sequence
  Description of Artificial Sequence: Synthetic oligonucleotide
ucuuauauacaucagcau

SEQ ID NO: 32065 - RNA, 18 nt, Artificial Sequence
  Description of Artificial Sequence: Synthetic oligonucleotide
auuacucuuauauacauc

SEQ ID NO: 32066 - RNA, 18 nt, Artificial Sequence
  Description of Artificial Sequence: Synthetic oligonucleotide
aagguauuacucuuauau

SEQ ID NO: 32067 - RNA, 18 nt, Artificial Sequence
  Description of Artificial Sequence: Synthetic oligonucleotide
caauuaagguauuacucu

SEQ ID NO: 32068 - RNA, 18 nt, Artificial Sequence
  Description of Artificial Sequence: Synthetic oligonucleotide
auaaacaauuaagguauu

SEQ ID NO: 32069 - RNA, 18 nt, Artificial Sequence
  Description of Artificial Sequence: Synthetic oligonucleotide
aaaccauaaacaauuaag

SEQ ID NO: 32070 - RNA, 18 nt, Artificial Sequence
  Description of Artificial Sequence: Synthetic oligonucleotide
aagaaaaaccauaaacaa

SEQ ID NO: 32071 - RNA, 18 nt, Artificial Sequence
  Description of Artificial Sequence: Synthetic oligonucleotide
ccaggaagaaaaaccaua

SEQ ID NO: 32072 - RNA, 18 nt, Artificial Sequence
  Description of Artificial Sequence: Synthetic oligonucleotide
aguguccaggaagaaaaa

SEQ ID NO: 32073 - RNA, 18 nt, Artificial Sequence
  Description of Artificial Sequence: Synthetic oligonucleotide
aaaagaguguccaggaag

SEQ ID NO: 32074 - RNA, 18 nt, Artificial Sequence
  Description of Artificial Sequence: Synthetic oligonucleotide
uguagaaaagagugucca

SEQ ID NO: 32075 - RNA, 18 nt, Artificial Sequence
  Description of Artificial Sequence: Synthetic oligonucleotide
caaaaaaauacaaggcag

SEQ ID NO: 32076 - RNA, 18 nt, Artificial Sequence
  Description of Artificial Sequence: Synthetic oligonucleotide
uaggucaaaaaaauacaa

SEQ ID NO: 32077 - RNA, 18 nt, Artificial Sequence
  Description of Artificial Sequence: Synthetic oligonucleotide
uuugauaggucaaaaaaa

SEQ ID NO: 32078 - RNA, 18 nt, Artificial Sequence
  Description of Artificial Sequence: Synthetic oligonucleotide
augauuuugauaggucaa

SEQ ID NO: 32079 - RNA, 18 nt, Artificial Sequence
  Description of Artificial Sequence: Synthetic oligonucleotide
gaaaaaugauuuugauag

SEQ ID NO: 32080 - RNA, 18 nt, Artificial Sequence
  Description of Artificial Sequence: Synthetic oligonucleotide
uaauugaaaaaugauuuu

SEQ ID NO: 32081 - RNA, 18 nt, Artificial Sequence
  Description of Artificial Sequence: Synthetic oligonucleotide
acaaguaauugaaaaaug

SEQ ID NO: 32082 - RNA, 18 nt, Artificial Sequence
  Description of Artificial Sequence: Synthetic oligonucleotide
gggaaacaaguaauugaa

SEQ ID NO: 32083 - RNA, 18 nt, Artificial Sequence
  Description of Artificial Sequence: Synthetic oligonucleotide
gacaucugaaaucuaggg

SEQ ID NO: 32084 - RNA, 18 nt, Artificial Sequence
  Description of Artificial Sequence: Synthetic oligonucleotide
ccgugacaucugaaaucu

SEQ ID NO: 32085 - RNA, 18 nt, Artificial Sequence
  Description of Artificial Sequence: Synthetic oligonucleotide
ucauaccgugacaucuga

SEQ ID NO: 32086 - RNA, 18 nt, Artificial Sequence
  Description of Artificial Sequence: Synthetic oligonucleotide
accuuucauaccgugaca

SEQ ID NO: 32087 - RNA, 18 nt, Artificial Sequence
  Description of Artificial Sequence: Synthetic oligonucleotide
auaaaaccuuucauaccg

SEQ ID NO: 32088 - RNA, 18 nt, Artificial Sequence
  Description of Artificial Sequence: Synthetic oligonucleotide
uauauauaaaaccuuuca

SEQ ID NO: 32089 - RNA, 18 nt, Artificial Sequence
  Description of Artificial Sequence: Synthetic oligonucleotide
uuaaauauauauaaaacc

SEQ ID NO: 32090 - RNA, 18 nt, Artificial Sequence
  Description of Artificial Sequence: Synthetic oligonucleotide
auuuuuuaaauauauaua

SEQ ID NO: 32091 - RNA, 18 nt, Artificial Sequence
  Description of Artificial Sequence: Synthetic oligonucleotide
acuuuauuuuuuaaauau

SEQ ID NO: 32092 - RNA, 18 nt, Artificial Sequence
  Description of Artificial Sequence: Synthetic oligonucleotide
uuuauacuuuauuuuuua

SEQ ID NO: 32093 - RNA, 18 nt, Artificial Sequence
  Description of Artificial Sequence: Synthetic oligonucleotide
uuauguuuauacuuuauu

SEQ ID NO: 32094 - RNA, 18 nt, Artificial Sequence
  Description of Artificial Sequence: Synthetic oligonucleotide
agacuuuauguuuauacu

SEQ ID NO: 32095 - RNA, 18 nt, Artificial Sequence
  Description of Artificial Sequence: Synthetic oligonucleotide
caaaaagacuuuauguuu

SEQ ID NO: 32096 - RNA, 18 nt, Artificial Sequence
  Description of Artificial Sequence: Synthetic oligonucleotide
cgcuucaaaaagacuuua

SEQ ID NO: 32097 - RNA, 18 nt, Artificial Sequence
  Description of Artificial Sequence: Synthetic oligonucleotide
aaccacgcuucaaaaaga

SEQ ID NO: 32098 - RNA, 18 nt, Artificial Sequence
  Description of Artificial Sequence: Synthetic oligonucleotide
ugcauaaccacgcuucaa

SEQ ID NO: 32099 - RNA, 18 nt, Artificial Sequence
  Description of Artificial Sequence: Synthetic oligonucleotide
uauguugcauaaccacgc

SEQ ID NO: 32100 - RNA, 18 nt, Artificial Sequence
  Description of Artificial Sequence: Synthetic oligonucleotide
uagcauauguugcauaac

SEQ ID NO: 32101 - RNA, 18 nt, Artificial Sequence
  Description of Artificial Sequence: Synthetic oligonucleotide
acgccuagcauauguugc

SEQ ID NO: 32102 - RNA, 18 nt, Artificial Sequence
  Description of Artificial Sequence: Synthetic oligonucleotide
aacuuacgccuagcauau

SEQ ID NO: 32103 - RNA, 18 nt, Artificial Sequence
  Description of Artificial Sequence: Synthetic oligonucleotide
ucaccaacuuacgccuag

SEQ ID NO: 32104 - RNA, 18 nt, Artificial Sequence
  Description of Artificial Sequence: Synthetic oligonucleotide
ggcauucaccaacuuacg

SEQ ID NO: 32105 - RNA, 18 nt, Artificial Sequence
  Description of Artificial Sequence: Synthetic oligonucleotide
aagcaggcauucaccaac

SEQ ID NO: 32106 - RNA, 18 nt, Artificial Sequence
  Description of Artificial Sequence: Synthetic oligonucleotide
cugcaaagcaggcauuca

SEQ ID NO: 32107 - RNA, 18 nt, Artificial Sequence
  Description of Artificial Sequence: Synthetic oligonucleotide
acacucugcaaagcaggc

SEQ ID NO: 32108 - RNA, 18 nt, Artificial Sequence
  Description of Artificial Sequence: Synthetic oligonucleotide
ggguuacacucugcaaag

SEQ ID NO: 32109 - RNA, 18 nt, Artificial Sequence
  Description of Artificial Sequence: Synthetic oligonucleotide
cuuuuuuuauucaauggg

SEQ ID NO: 32110 - RNA, 18 nt, Artificial Sequence
  Description of Artificial Sequence: Synthetic oligonucleotide
gcuuuuuuuauucaaugg

SEQ ID NO: 32111 - RNA, 18 nt, Artificial Sequence
  Description of Artificial Sequence: Synthetic oligonucleotide
acaaagcuuuuuuuauuc

SEQ ID NO: 32112 - RNA, 18 nt, Artificial Sequence
  Description of Artificial Sequence: Synthetic oligonucleotide
ggaaaacaaagcuuuuuu

SEQ ID NO: 32113 - RNA, 18 nt, Artificial Sequence
  Description of Artificial Sequence: Synthetic oligonucleotide
gaaagggaaaacaaagcu

SEQ ID NO: 32114 - RNA, 18 nt, Artificial Sequence
  Description of Artificial Sequence: Synthetic oligonucleotide
gggcagaaagggaaaaca

SEQ ID NO: 32115 - RNA, 18 nt, Artificial Sequence
  Description of Artificial Sequence: Synthetic oligonucleotide
gcccauacugauacaggg

SEQ ID NO: 32116 - RNA, 18 nt, Artificial Sequence
  Description of Artificial Sequence: Synthetic oligonucleotide
ugcccauacugauacagg

SEQ ID NO: 32117 - RNA, 18 nt, Artificial Sequence
  Description of Artificial Sequence: Synthetic oligonucleotide
gggugugcccauacugau

SEQ ID NO: 32118 - RNA, 18 nt, Artificial Sequence
  Description of Artificial Sequence: Synthetic oligonucleotide
gugcagggugugcccaua

SEQ ID NO: 32119 - RNA, 18 nt, Artificial Sequence
  Description of Artificial Sequence: Synthetic oligonucleotide
uuagagugcagggugugc

SEQ ID NO: 32120 - RNA, 18 nt, Artificial Sequence
  Description of Artificial Sequence: Synthetic oligonucleotide
uaaaguuagagugcaggg

SEQ ID NO: 32121 - RNA, 18 nt, Artificial Sequence
  Description of Artificial Sequence: Synthetic oligonucleotide
uagauuaaaguuagagug

SEQ ID NO: 32122 - RNA, 18 nt, Artificial Sequence
  Description of Artificial Sequence: Synthetic oligonucleotide
ugacguagauuaaaguua

SEQ ID NO: 32123 - RNA, 18 nt, Artificial Sequence
  Description of Artificial Sequence: Synthetic oligonucleotide
gagggugacguagauuaa

SEQ ID NO: 32124 - RNA, 18 nt, Artificial Sequence
  Description of Artificial Sequence: Synthetic oligonucleotide
caggugagggugacguag

SEQ ID NO: 32125 - RNA, 18 nt, Artificial Sequence
  Description of Artificial Sequence: Synthetic oligonucleotide
ccaaacaggugaggguga

SEQ ID NO: 32126 - RNA, 18 nt, Artificial Sequence
  Description of Artificial Sequence: Synthetic oligonucleotide
ccaaaccaaacaggugag

SEQ ID NO: 32127 - RNA, 18 nt, Artificial Sequence
  Description of Artificial Sequence: Synthetic oligonucleotide
uaaacccaaaccaaacag

SEQ ID NO: 32128 - RNA, 18 nt, Artificial Sequence
  Description of Artificial Sequence: Synthetic oligonucleotide
gacauuaaacccaaacca

SEQ ID NO: 32129 - RNA, 18 nt, Artificial Sequence
  Description of Artificial Sequence: Synthetic oligonucleotide
ucgcagacauuaaaccca

SEQ ID NO: 32130 - RNA, 18 nt, Artificial Sequence
  Description of Artificial Sequence: Synthetic oligonucleotide
uuuucucgcagacauuaa

SEQ ID NO: 32131 - RNA, 18 nt, Artificial Sequence
  Description of Artificial Sequence: Synthetic oligonucleotide
uuugguuuucucgcagac

SEQ ID NO: 32132 - RNA, 18 nt, Artificial Sequence
  Description of Artificial Sequence: Synthetic oligonucleotide
agauauuugguuuucucg

SEQ ID NO: 32133 - RNA, 18 nt, Artificial Sequence
  Description of Artificial Sequence: Synthetic oligonucleotide
acacaagauauuugguuu

SEQ ID NO: 32134 - RNA, 18 nt, Artificial Sequence
  Description of Artificial Sequence: Synthetic oligonucleotide
acaauacacaagauauuu

SEQ ID NO: 32135 - RNA, 18 nt, Artificial Sequence
  Description of Artificial Sequence: Synthetic oligonucleotide
aguucacaauacacaaga

SEQ ID NO: 32136 - RNA, 18 nt, Artificial Sequence
  Description of Artificial Sequence: Synthetic oligonucleotide
uugacaguucacaauaca

SEQ ID NO: 32137 - RNA, 18 nt, Artificial Sequence
  Description of Artificial Sequence: Synthetic oligonucleotide
uggcuuugacaguucaca

SEQ ID NO: 32138 - RNA, 18 nt, Artificial Sequence
  Description of Artificial Sequence: Synthetic oligonucleotide
uuagauggcuuugacagu

SEQ ID NO: 32139 - RNA, 18 nt, Artificial Sequence
  Description of Artificial Sequence: Synthetic oligonucleotide
uugguuuagauggcuuug

SEQ ID NO: 32140 - RNA, 18 nt, Artificial Sequence
  Description of Artificial Sequence: Synthetic oligonucleotide
ugggauugguuuagaugg

SEQ ID NO: 32141 - RNA, 18 nt, Artificial Sequence
  Description of Artificial Sequence: Synthetic oligonucleotide
gaccuugggauugguuua

SEQ ID NO: 32142 - RNA, 18 nt, Artificial Sequence
  Description of Artificial Sequence: Synthetic oligonucleotide
cacuugaccuugggauug

SEQ ID NO: 32143 - RNA, 18 nt, Artificial Sequence
  Description of Artificial Sequence: Synthetic oligonucleotide
auauccacuugaccuugg

SEQ ID NO: 32144 - RNA, 18 nt, Artificial Sequence
  Description of Artificial Sequence: Synthetic oligonucleotide
uuuuuauauccacuugac

SEQ ID NO: 32145 - RNA, 18 nt, Artificial Sequence
  Description of Artificial Sequence: Synthetic oligonucleotide
cagaauuuuuauauccac

SEQ ID NO: 32146 - RNA, 18 nt, Artificial Sequence
  Description of Artificial Sequence: Synthetic oligonucleotide
uuuggcagaauuuuuaua

SEQ ID NO: 32147 - RNA, 18 nt, Artificial Sequence
  Description of Artificial Sequence: Synthetic oligonucleotide
auguuuuuggcagaauuu

SEQ ID NO: 32148 - RNA, 18 nt, Artificial Sequence
  Description of Artificial Sequence: Synthetic oligonucleotide
augccauguuuuuggcag

SEQ ID NO: 32149 - RNA, 18 nt, Artificial Sequence
  Description of Artificial Sequence: Synthetic oligonucleotide
aucuuaugccauguuuuu

SEQ ID NO: 32150 - RNA, 18 nt, Artificial Sequence
  Description of Artificial Sequence: Synthetic oligonucleotide
uuuccaucuuaugccaug

SEQ ID NO: 32151 - RNA, 18 nt, Artificial Sequence
  Description of Artificial Sequence: Synthetic oligonucleotide
gaacuuuuccaucuuaug

SEQ ID NO: 32152 - RNA, 18 nt, Artificial Sequence
  Description of Artificial Sequence: Synthetic oligonucleotide
ucagggaacuuuuccauc

SEQ ID NO: 32153 - RNA, 18 nt, Artificial Sequence
  Description of Artificial Sequence: Synthetic oligonucleotide
aguuuucagggaacuuuu

SEQ ID NO: 32154 - RNA, 18 nt, Artificial Sequence
  Description of Artificial Sequence: Synthetic oligonucleotide
uccagaguuuucagggaa

SEQ ID NO: 32155 - RNA, 18 nt, Artificial Sequence
  Description of Artificial Sequence: Synthetic oligonucleotide
uuucuuccagaguuuuca

SEQ ID NO: 32156 - RNA, 18 nt, Artificial Sequence
  Description of Artificial Sequence: Synthetic oligonucleotide
uuuguuuucuuccagagu

SEQ ID NO: 32157 - RNA, 18 nt, Artificial Sequence
  Description of Artificial Sequence: Synthetic oligonucleotide
auuacuuuguuuucuucc

SEQ ID NO: 32158 - RNA, 18 nt, Artificial Sequence
  Description of Artificial Sequence: Synthetic oligonucleotide
ucuacauuacuuuguuuu

SEQ ID NO: 32159 - RNA, 18 nt, Artificial Sequence
  Description of Artificial Sequence: Synthetic oligonucleotide
aggugucuacauuacuuu

SEQ ID NO: 32160 - RNA, 18 nt, Artificial Sequence
  Description of Artificial Sequence: Synthetic oligonucleotide
aaagaaggugucuacauu

SEQ ID NO: 32161 - RNA, 18 nt, Artificial Sequence
  Description of Artificial Sequence: Synthetic oligonucleotide
gggaaaaagaaggugucu

SEQ ID NO: 32162 - RNA, 18 nt, Artificial Sequence
  Description of Artificial Sequence: Synthetic oligonucleotide
auuuucuaaugguguggg

SEQ ID NO: 32163 - RNA, 18 nt, Artificial Sequence
  Description of Artificial Sequence: Synthetic oligonucleotide
aacauuuucuaauggugu

SEQ ID NO: 32164 - RNA, 18 nt, Artificial Sequence
  Description of Artificial Sequence: Synthetic oligonucleotide
gaugcaacauuuucuaau

SEQ ID NO: 32165 - RNA, 18 nt, Artificial Sequence
  Description of Artificial Sequence: Synthetic oligonucleotide
guccucaucgucauuauu

SEQ ID NO: 32166 - RNA, 18 nt, Artificial Sequence
  Description of Artificial Sequence: Synthetic oligonucleotide
gucagguccucaucguca

SEQ ID NO: 32167 - RNA, 18 nt, Artificial Sequence
  Description of Artificial Sequence: Synthetic oligonucleotide
cuggugucagguccucau

SEQ ID NO: 32168 - RNA, 18 nt, Artificial Sequence
  Description of Artificial Sequence: Synthetic oligonucleotide
cugcucuggugucagguc

SEQ ID NO: 32169 - RNA, 18 nt, Artificial Sequence
  Description of Artificial Sequence: Synthetic oligonucleotide
gccuucugcucugguguc

SEQ ID NO: 32170 - RNA, 18 nt, Artificial Sequence
  Description of Artificial Sequence: Synthetic oligonucleotide
gcucugccuucugcucug

SEQ ID NO: 32171 - RNA, 18 nt, Artificial Sequence
  Description of Artificial Sequence: Synthetic oligonucleotide
cucacgcucugccuucug

SEQ ID NO: 32172 - RNA, 18 nt, Artificial Sequence
  Description of Artificial Sequence: Synthetic oligonucleotide
uccuucucacgcucugcc

SEQ ID NO: 32173 - RNA, 18 nt, Artificial Sequence
  Description of Artificial Sequence: Synthetic oligonucleotide
uccgcuccuucucacgcu

SEQ ID NO: 32174 - RNA, 18 nt, Artificial Sequence
  Description of Artificial Sequence: Synthetic oligonucleotide
cauccuccgcuccuucuc

SEQ ID NO: 32175 - RNA, 18 nt, Artificial Sequence
  Description of Artificial Sequence: Synthetic oligonucleotide
uuggccauccuccgcucc

SEQ ID NO: 32176 - RNA, 18 nt, Artificial Sequence
  Description of Artificial Sequence: Synthetic oligonucleotide
cauuguuggccauccucc

SEQ ID NO: 32177 - RNA, 18 nt, Artificial Sequence
  Description of Artificial Sequence: Synthetic oligonucleotide
ucgggcauuguuggccau

SEQ ID NO: 32178 - RNA, 18 nt, Artificial Sequence
  Description of Artificial Sequence: Synthetic oligonucleotide
cgcucucgggcauuguug

SEQ ID NO: 32179 - RNA, 18 nt, Artificial Sequence
  Description of Artificial Sequence: Synthetic oligonucleotide
gcagacgcucucgggcau

SEQ ID NO: 32180 - RNA, 18 nt, Artificial Sequence
  Description of Artificial Sequence: Synthetic oligonucleotide
gacccgcagacgcucucg

SEQ ID NO: 32181 - RNA, 18 nt, Artificial Sequence
  Description of Artificial Sequence: Synthetic oligonucleotide
ucacggacccgcagacgc

SEQ ID NO: 32182 - RNA, 18 nt, Artificial Sequence
  Description of Artificial Sequence: Synthetic oligonucleotide
ugaugucacggacccgca

SEQ ID NO: 32183 - RNA, 18 nt, Artificial Sequence
  Description of Artificial Sequence: Synthetic oligonucleotide
cucguugaugucacggac

SEQ ID NO: 32184 - RNA, 18 nt, Artificial Sequence
  Description of Artificial Sequence: Synthetic oligonucleotide
aaagccucguugauguca

SEQ ID NO: 32185 - RNA, 18 nt, Artificial Sequence
  Description of Artificial Sequence: Synthetic oligonucleotide
cuuugaaagccucguuga

SEQ ID NO: 32186 - RNA, 18 nt, Artificial Sequence
  Description of Artificial Sequence: Synthetic oligonucleotide
gagcucuuugaaagccuc

SEQ ID NO: 32187 - RNA, 18 nt, Artificial Sequence
  Description of Artificial Sequence: Synthetic oligonucleotide
cggccgagcucuuugaaa

SEQ ID NO: 32188 - RNA, 18 nt, Artificial Sequence
  Description of Artificial Sequence: Synthetic oligonucleotide
ccaugcggccgagcucuu

SEQ ID NO: 32189 - RNA, 18 nt, Artificial Sequence
  Description of Artificial Sequence: Synthetic oligonucleotide
cugcaccaugcggccgag

SEQ ID NO: 32190 - RNA, 18 nt, Artificial Sequence
  Description of Artificial Sequence: Synthetic oligonucleotide
uggagcugcaccaugcgg

SEQ ID NO: 32191 - RNA, 18 nt, Artificial Sequence
  Description of Artificial Sequence: Synthetic oligonucleotide
ugagguggagcugcacca

SEQ ID NO: 32192 - RNA, 18 nt, Artificial Sequence
  Description of Artificial Sequence: Synthetic oligonucleotide
acucuugagguggagcug

SEQ ID NO: 32193 - RNA, 18 nt, Artificial Sequence
  Description of Artificial Sequence: Synthetic oligonucleotide
uugucacucuugaggugg

SEQ ID NO: 32194 - RNA, 18 nt, Artificial Sequence
  Description of Artificial Sequence: Synthetic oligonucleotide
gggcuugucacucuugag

SEQ ID NO: 32195 - RNA, 18 nt, Artificial Sequence
  Description of Artificial Sequence: Synthetic oligonucleotide
ucaggagcuuggucuggg

SEQ ID NO: 32196 - RNA, 18 nt, Artificial Sequence
  Description of Artificial Sequence: Synthetic oligonucleotide
gaggaucaggagcuuggu

SEQ ID NO: 32197 - RNA, 18 nt, Artificial Sequence
  Description of Artificial Sequence: Synthetic oligonucleotide
ugguggaggaucaggagc

SEQ ID NO: 32198 - RNA, 18 nt, Artificial Sequence
  Description of Artificial Sequence: Synthetic oligonucleotide
ccgccugguggaggauca

SEQ ID NO: 32199 - RNA, 18 nt, Artificial Sequence
  Description of Artificial Sequence: Synthetic oligonucleotide
ggccaccgccugguggag

SEQ ID NO: 32200 - RNA, 18 nt, Artificial Sequence
  Description of Artificial Sequence: Synthetic oligonucleotide
augacggccaccgccugg

SEQ ID NO: 32201 - RNA, 18 nt, Artificial Sequence
  Description of Artificial Sequence: Synthetic oligonucleotide
ugaggaugacggccaccg

SEQ ID NO: 32202 - RNA, 18 nt, Artificial Sequence
  Description of Artificial Sequence: Synthetic oligonucleotide
cagacugaggaugacggc

SEQ ID NO: 32203 - RNA, 18 nt, Artificial Sequence
  Description of Artificial Sequence: Synthetic oligonucleotide
ugcuccagacugaggaug

SEQ ID NO: 32204 - RNA, 18 nt, Artificial Sequence
  Description of Artificial Sequence: Synthetic oligonucleotide
cuugcugcuccagacuga

SEQ ID NO: 32205 - RNA, 18 nt, Artificial Sequence
  Description of Artificial Sequence: Synthetic oligonucleotide
ucggacuugcugcuccag

SEQ ID NO: 32206 - RNA, 18 nt, Artificial Sequence
  Description of Artificial Sequence: Synthetic oligonucleotide
guaguccugguggcaugc

SEQ ID NO: 32207 - RNA, 18 nt, Artificial Sequence
  Description of Artificial Sequence: Synthetic oligonucleotide
ccccuguaguccuggugg

SEQ ID NO: 32208 - RNA, 18 nt, Artificial Sequence
  Description of Artificial Sequence: Synthetic oligonucleotide
cucugccccuguaguccu

SEQ ID NO: 32209 - RNA, 18 nt, Artificial Sequence
  Description of Artificial Sequence: Synthetic oligonucleotide
agacacucugccccugua

SEQ ID NO: 32210 - RNA, 18 nt, Artificial Sequence
  Description of Artificial Sequence: Synthetic oligonucleotide
agaggagacacucugccc

SEQ ID NO: 32211 - RNA, 18 nt, Artificial Sequence
  Description of Artificial Sequence: Synthetic oligonucleotide
cugccagaggagacacuc

SEQ ID NO: 32212 - RNA, 18 nt, Artificial Sequence
  Description of Artificial Sequence: Synthetic oligonucleotide
cagagcugccagaggaga

SEQ ID NO: 32213 - RNA, 18 nt, Artificial Sequence
  Description of Artificial Sequence: Synthetic oligonucleotide
gaucucagagcugccaga

SEQ ID NO: 32214 - RNA, 18 nt, Artificial Sequence
  Description of Artificial Sequence: Synthetic oligonucleotide
gauuugaucucagagcug

SEQ ID NO: 32215 - RNA, 18 nt, Artificial Sequence
  Description of Artificial Sequence: Synthetic oligonucleotide
caucggauuugaucucag

SEQ ID NO: 32216 - RNA, 18 nt, Artificial Sequence
  Description of Artificial Sequence: Synthetic oligonucleotide
cucgucaucggauuugau

SEQ ID NO: 32217 - RNA, 18 nt, Artificial Sequence
  Description of Artificial Sequence: Synthetic oligonucleotide
ucacccucgucaucggau

SEQ ID NO: 32218 - RNA, 18 nt, Artificial Sequence
  Description of Artificial Sequence: Synthetic oligonucleotide
ucucaucacccucgucau

SEQ ID NO: 32219 - RNA, 18 nt, Artificial Sequence
  Description of Artificial Sequence: Synthetic oligonucleotide
cagguucucaucacccuc

SEQ ID NO: 32220 - RNA, 18 nt, Artificial Sequence
  Description of Artificial Sequence: Synthetic oligonucleotide
ucuugcagguucucauca

SEQ ID NO: 32221 - RNA, 18 nt, Artificial Sequence
  Description of Artificial Sequence: Synthetic oligonucleotide
ucgugucuugcagguucu

SEQ ID NO: 32222 - RNA, 18 nt, Artificial Sequence
  Description of Artificial Sequence: Synthetic oligonucleotide
agauuucgugucuugcag

SEQ ID NO: 32223 - RNA, 18 nt, Artificial Sequence
  Description of Artificial Sequence: Synthetic oligonucleotide
uccgaagauuucgugucu

SEQ ID NO: 32224 - RNA, 18 nt, Artificial Sequence
  Description of Artificial Sequence: Synthetic oligonucleotide
uguccuccgaagauuucg

SEQ ID NO: 32225 - RNA, 18 nt, Artificial Sequence
  Description of Artificial Sequence: Synthetic oligonucleotide
uuucuuguccuccgaaga

SEQ ID NO: 32226 - RNA, 18 nt, Artificial Sequence
  Description of Artificial Sequence: Synthetic oligonucleotide
ucuaauuucuuguccucc

SEQ ID NO: 32227 - RNA, 18 nt, Artificial Sequence
  Description of Artificial Sequence: Synthetic oligonucleotide
cgucaucuaauuucuugu

SEQ ID NO: 32228 - RNA, 18 nt, Artificial Sequence
  Description of Artificial Sequence: Synthetic oligonucleotide
cuugucgucaucuaauuu

SEQ ID NO: 32229 - RNA, 18 nt, Artificial Sequence
  Description of Artificial Sequence: Synthetic oligonucleotide
uccuucuugucgucaucu

SEQ ID NO: 32230 - RNA, 18 nt, Artificial Sequence
  Description of Artificial Sequence: Synthetic oligonucleotide
ugauauccuucuugucgu

SEQ ID NO: 32231 - RNA, 18 nt, Artificial Sequence
  Description of Artificial Sequence: Synthetic oligonucleotide
ugauuugauauccuucuu

SEQ ID NO: 32232 - RNA, 18 nt, Artificial Sequence
  Description of Artificial Sequence: Synthetic oligonucleotide
guaauugauuugauaucc

SEQ ID NO: 32233 - RNA, 18 nt, Artificial Sequence
  Description of Artificial Sequence: Synthetic oligonucleotide
uauacuguuaccuagauc

SEQ ID NO: 32234 - RNA, 18 nt, Artificial Sequence
  Description of Artificial Sequence: Synthetic oligonucleotide
uauuauauacuguuaccu

SEQ ID NO: 32235 - RNA, 18 nt, Artificial Sequence
  Description of Artificial Sequence: Synthetic oligonucleotide
gacaguauuauauacugu

SEQ ID NO: 32236 - RNA, 18 nt, Artificial Sequence
  Description of Artificial Sequence: Synthetic oligonucleotide
gaagcgacaguauuauau

SEQ ID NO: 32237 - RNA, 18 nt, Artificial Sequence
  Description of Artificial Sequence: Synthetic oligonucleotide
uaaaugaagcgacaguau

SEQ ID NO: 32238 - RNA, 18 nt, Artificial Sequence
  Description of Artificial Sequence: Synthetic oligonucleotide
ggaauuaaaugaagcgac

SEQ ID NO: 32239 - RNA, 18 nt, Artificial Sequence
  Description of Artificial Sequence: Synthetic oligonucleotide
auaaaggaauuaaaugaa

SEQ ID NO: 32240 - RNA, 18 nt, Artificial Sequence
  Description of Artificial Sequence: Synthetic oligonucleotide
guccaauaaaggaauuaa

SEQ ID NO: 32241 - RNA, 18 nt, Artificial Sequence
  Description of Artificial Sequence: Synthetic oligonucleotide
ucaaaguccaauaaagga

SEQ ID NO: 32242 - RNA, 18 nt, Artificial Sequence
  Description of Artificial Sequence: Synthetic oligonucleotide
cuucaucaaaguccaaua

SEQ ID NO: 32243 - RNA, 18 nt, Artificial Sequence
  Description of Artificial Sequence: Synthetic oligonucleotide
guucacuucaucaaaguc

SEQ ID NO: 32244 - RNA, 18 nt, Artificial Sequence
  Description of Artificial Sequence: Synthetic oligonucleotide
guucuguucacuucauca

SEQ ID NO: 32245 - RNA, 18 nt, Artificial Sequence
  Description of Artificial Sequence: Synthetic oligonucleotide
uucccguucuguucacuu

SEQ ID NO: 32246 - RNA, 18 nt, Artificial Sequence
  Description of Artificial Sequence: Synthetic oligonucleotide
guuucuucccguucuguu

SEQ ID NO: 32247 - RNA, 18 nt, Artificial Sequence
  Description of Artificial Sequence: Synthetic oligonucleotide
gaauaguuucuucccguu

SEQ ID NO: 32248 - RNA, 18 nt, Artificial Sequence
  Description of Artificial Sequence: Synthetic oligonucleotide
aaacugaauaguuucuuc

SEQ ID NO: 32249 - RNA, 18 nt, Artificial Sequence
  Description of Artificial Sequence: Synthetic oligonucleotide
ggaaaaaacugaauaguu

SEQ ID NO: 32250 - RNA, 18 nt, Artificial Sequence
  Description of Artificial Sequence: Synthetic oligonucleotide
ugccaggaaaaaacugaa

SEQ ID NO: 32251 - RNA, 18 nt, Artificial Sequence
  Description of Artificial Sequence: Synthetic oligonucleotide
uuaccugccaggaaaaaa

SEQ ID NO: 32252 - RNA, 18 nt, Artificial Sequence
  Description of Artificial Sequence: Synthetic oligonucleotide
uaaauuuaccugccagga

SEQ ID NO: 32253 - RNA, 18 nt, Artificial Sequence
  Description of Artificial Sequence: Synthetic oligonucleotide
agcuguaaauuuaccugc

SEQ ID NO: 32254 - RNA, 18 nt, Artificial Sequence
  Description of Artificial Sequence: Synthetic oligonucleotide
uuuucagcuguaaauuua

SEQ ID NO: 32255 - RNA, 18 nt, Artificial Sequence
  Description of Artificial Sequence: Synthetic oligonucleotide
uuuucuuuucagcuguaa

SEQ ID NO: 32256 - RNA, 18 nt, Artificial Sequence
  Description of Artificial Sequence: Synthetic oligonucleotide
uuuaauuuucuuuucagc

SEQ ID NO: 32257 - RNA, 18 nt, Artificial Sequence
  Description of Artificial Sequence: Synthetic oligonucleotide
aggccuuuaauuuucuuu

SEQ ID NO: 32258 - RNA, 18 nt, Artificial Sequence
  Description of Artificial Sequence: Synthetic oligonucleotide
agaguaggccuuuaauuu

SEQ ID NO: 32259 - RNA, 18 nt, Artificial Sequence
  Description of Artificial Sequence: Synthetic oligonucleotide
cuucuagaguaggccuuu

SEQ ID NO: 32260 - RNA, 18 nt, Artificial Sequence
  Description of Artificial Sequence: Synthetic oligonucleotide
uaguacuucuagaguagg

SEQ ID NO: 32261 - RNA, 18 nt, Artificial Sequence
  Description of Artificial Sequence: Synthetic oligonucleotide
acuuuuaguacuucuaga

SEQ ID NO: 32262 - RNA, 18 nt, Artificial Sequence
  Description of Artificial Sequence: Synthetic oligonucleotide
acgauacuuuuaguacuu

SEQ ID NO: 32263 - RNA, 18 nt, Artificial Sequence
  Description of Artificial Sequence: Synthetic oligonucleotide
cugaaacgauacuuuuag

SEQ ID NO: 32264 - RNA, 18 nt, Artificial Sequence
  Description of Artificial Sequence: Synthetic oligonucleotide
gguaucugaaacgauacu

SEQ ID NO: 32265 - RNA, 18 nt, Artificial Sequence
  Description of Artificial Sequence: Synthetic oligonucleotide
guacagguaucugaaacg

SEQ ID NO: 32266 - RNA, 18 nt, Artificial Sequence
  Description of Artificial Sequence: Synthetic oligonucleotide
auagaguacagguaucug

SEQ ID NO: 32267 - RNA, 18 nt, Artificial Sequence
  Description of Artificial Sequence: Synthetic oligonucleotide
cuccaauagaguacaggu

SEQ ID NO: 32268 - RNA, 18 nt, Artificial Sequence
  Description of Artificial Sequence: Synthetic oligonucleotide
uuaggcuccaauagagua

SEQ ID NO: 32269 - RNA, 18 nt, Artificial Sequence
  Description of Artificial Sequence: Synthetic oligonucleotide
acaguuuaggcuccaaua

SEQ ID NO: 32270 - RNA, 18 nt, Artificial Sequence
  Description of Artificial Sequence: Synthetic oligonucleotide
ccaaaacaguuuaggcuc

SEQ ID NO: 32271 - RNA, 18 nt, Artificial Sequence
  Description of Artificial Sequence: Synthetic oligonucleotide
aaaugccaaaacaguuua

SEQ ID NO: 32272 - RNA, 18 nt, Artificial Sequence
  Description of Artificial Sequence: Synthetic oligonucleotide
uucauaaaugccaaaaca

SEQ ID NO: 32273 - RNA, 18 nt, Artificial Sequence
  Description of Artificial Sequence: Synthetic oligonucleotide
ccagauucauaaaugcca

SEQ ID NO: 32274 - RNA, 18 nt, Artificial Sequence
  Description of Artificial Sequence: Synthetic oligonucleotide
uggguccagauucauaaa

SEQ ID NO: 32275 - RNA, 18 nt, Artificial Sequence
  Description of Artificial Sequence: Synthetic oligonucleotide
agcauuggguccagauuc

SEQ ID NO: 32276 - RNA, 18 nt, Artificial Sequence
  Description of Artificial Sequence: Synthetic oligonucleotide
ucauuagcauugggucca

SEQ ID NO: 32277 - RNA, 18 nt, Artificial Sequence
  Description of Artificial Sequence: Synthetic oligonucleotide
gugugucauuagcauugg

SEQ ID NO: 32278 - RNA, 18 nt, Artificial Sequence
  Description of Artificial Sequence: Synthetic oligonucleotide
ucacugugugucauuagc

SEQ ID NO: 32279 - RNA, 18 nt, Artificial Sequence
  Description of Artificial Sequence: Synthetic oligonucleotide
uuuuuucacuguguguca

SEQ ID NO: 32280 - RNA, 18 nt, Artificial Sequence
  Description of Artificial Sequence: Synthetic oligonucleotide
acaaauuuuuucacugug

SEQ ID NO: 32281 - RNA, 18 nt, Artificial Sequence
  Description of Artificial Sequence: Synthetic oligonucleotide
cagagacaaauuuuuuca

SEQ ID NO: 32282 - RNA, 18 nt, Artificial Sequence
  Description of Artificial Sequence: Synthetic oligonucleotide
ugaaucagagacaaauuu

SEQ ID NO: 32283 - RNA, 18 nt, Artificial Sequence
  Description of Artificial Sequence: Synthetic oligonucleotide
guacuugaaucagagaca

SEQ ID NO: 32284 - RNA, 18 nt, Artificial Sequence
  Description of Artificial Sequence: Synthetic oligonucleotide
aaacuguacuugaaucag

SEQ ID NO: 32285 - RNA, 18 nt, Artificial Sequence
  Description of Artificial Sequence: Synthetic oligonucleotide
caaauaaacuguacuuga

SEQ ID NO: 32286 - RNA, 18 nt, Artificial Sequence
  Description of Artificial Sequence: Synthetic oligonucleotide
uuuuacaaauaaacugua

SEQ ID NO: 32287 - RNA, 18 nt, Artificial Sequence
  Description of Artificial Sequence: Synthetic oligonucleotide
uauaguuuuacaaauaaa

SEQ ID NO: 32288 - RNA, 18 nt, Artificial Sequence
  Description of Artificial Sequence: Synthetic oligonucleotide
auaaguauaguuuuacaa

SEQ ID NO: 32289 - RNA, 18 nt, Artificial Sequence
  Description of Artificial Sequence: Synthetic oligonucleotide
guagaauaaguauaguuu

SEQ ID NO: 32290 - RNA, 18 nt, Artificial Sequence
  Description of Artificial Sequence: Synthetic oligonucleotide
aauuuguagaauaaguau

SEQ ID NO: 32291 - RNA, 18 nt, Artificial Sequence
  Description of Artificial Sequence: Synthetic oligonucleotide
gaccaaauuuguagaaua

SEQ ID NO: 32292 - RNA, 18 nt, Artificial Sequence
  Description of Artificial Sequence: Synthetic oligonucleotide
uuucugaccaaauuugua

SEQ ID NO: 32293 - RNA, 18 nt, Artificial Sequence
  Description of Artificial Sequence: Synthetic oligonucleotide
caacauuucugaccaaau

SEQ ID NO: 32294 - RNA, 18 nt, Artificial Sequence
  Description of Artificial Sequence: Synthetic oligonucleotide
agacacaacauuucugac

SEQ ID NO: 32295 - RNA, 18 nt, Artificial Sequence
  Description of Artificial Sequence: Synthetic oligonucleotide
auuauagacacaacauuu

SEQ ID NO: 32296 - RNA, 18 nt, Artificial Sequence
  Description of Artificial Sequence: Synthetic oligonucleotide
gaaauauuauagacacaa

SEQ ID NO: 32297 - RNA, 18 nt, Artificial Sequence
  Description of Artificial Sequence: Synthetic oligonucleotide
uuuuagaaauauuauaga

SEQ ID NO: 32298 - RNA, 18 nt, Artificial Sequence
  Description of Artificial Sequence: Synthetic oligonucleotide
ucucuuuuuagaaauauu

SEQ ID NO: 32299 - RNA, 18 nt, Artificial Sequence
  Description of Artificial Sequence: Synthetic oligonucleotide
uacaaucucuuuuuagaa

SEQ ID NO: 32300 - RNA, 18 nt, Artificial Sequence
  Description of Artificial Sequence: Synthetic oligonucleotide
auggcuacaaucucuuuu

SEQ ID NO: 32301 - RNA, 18 nt, Artificial Sequence
  Description of Artificial Sequence: Synthetic oligonucleotide
uuaacauggcuacaaucu

SEQ ID NO: 32302 - RNA, 18 nt, Artificial Sequence
  Description of Artificial Sequence: Synthetic oligonucleotide
aguuuuuaacauggcuac

SEQ ID NO: 32303 - RNA, 18 nt, Artificial Sequence
  Description of Artificial Sequence: Synthetic oligonucleotide
aguugaguuuuuaacaug

SEQ ID NO: 32304 - RNA, 18 nt, Artificial Sequence
  Description of Artificial Sequence: Synthetic oligonucleotide
acaucaguugaguuuuua

SEQ ID NO: 32305 - RNA, 18 nt, Artificial Sequence
  Description of Artificial Sequence: Synthetic oligonucleotide
cacauacaucaguugagu

SEQ ID NO: 32306 - RNA, 18 nt, Artificial Sequence
  Description of Artificial Sequence: Synthetic oligonucleotide
guuggcacauacaucagu

SEQ ID NO: 32307 - RNA, 18 nt, Artificial Sequence
  Description of Artificial Sequence: Synthetic oligonucleotide
uuauaguuggcacauaca

SEQ ID NO: 32308 - RNA, 18 nt, Artificial Sequence
  Description of Artificial Sequence: Synthetic oligonucleotide
aagaguuauaguuggcac

SEQ ID NO: 32309 - RNA, 18 nt, Artificial Sequence
  Description of Artificial Sequence: Synthetic oligonucleotide
aagaaaagaguuauaguu

SEQ ID NO: 32310 - RNA, 18 nt, Artificial Sequence
  Description of Artificial Sequence: Synthetic oligonucleotide
gagguaagaaaagaguua

SEQ ID NO: 32311 - RNA, 18 nt, Artificial Sequence
  Description of Artificial Sequence: Synthetic oligonucleotide
cuuuagagguaagaaaag

SEQ ID NO: 32312 - RNA, 18 nt, Artificial Sequence
  Description of Artificial Sequence: Synthetic oligonucleotide
ucuuacuuuagagguaag

SEQ ID NO: 32313 - RNA, 18 nt, Artificial Sequence
  Description of Artificial Sequence: Synthetic oligonucleotide
uauuuucuuacuuuagag

SEQ ID NO: 32314 - RNA, 18 nt, Artificial Sequence
  Description of Artificial Sequence: Synthetic oligonucleotide
gaaauuauuuucuuacuu

SEQ ID NO: 32315 - RNA, 18 nt, Artificial Sequence
  Description of Artificial Sequence: Synthetic oligonucleotide
ucuaggaaauuauuuucu

SEQ ID NO: 32316 - RNA, 18 nt, Artificial Sequence
  Description of Artificial Sequence: Synthetic oligonucleotide
auaaaucuaggaaauuau

SEQ ID NO: 32317 - RNA, 18 nt, Artificial Sequence
  Description of Artificial Sequence: Synthetic oligonucleotide
uuaggauaaaucuaggaa

SEQ ID NO: 32318 - RNA, 18 nt, Artificial Sequence
  Description of Artificial Sequence: Synthetic oligonucleotide
cauguuuaggauaaaucu

SEQ ID NO: 32319 - RNA, 18 nt, Artificial Sequence
  Description of Artificial Sequence: Synthetic oligonucleotide
aucagcauguuuaggaua

SEQ ID NO: 32320 - RNA, 18 nt, Artificial Sequence
  Description of Artificial Sequence: Synthetic oligonucleotide
uauacaucagcauguuua

SEQ ID NO: 32321 - RNA, 18 nt, Artificial Sequence
  Description of Artificial Sequence: Synthetic oligonucleotide
ucuuauauacaucagcau

SEQ ID NO: 32322 - RNA, 18 nt, Artificial Sequence
  Description of Artificial Sequence: Synthetic oligonucleotide
auuacucuuauauacauc

SEQ ID NO: 32323 - RNA, 18 nt, Artificial Sequence
  Description of Artificial Sequence: Synthetic oligonucleotide
aagguauuacucuuauau

SEQ ID NO: 32324 - RNA, 18 nt, Artificial Sequence
  Description of Artificial Sequence: Synthetic oligonucleotide
caauuaagguauuacucu

SEQ ID NO: 32325 - RNA, 18 nt, Artificial Sequence
  Description of Artificial Sequence: Synthetic oligonucleotide
auaaacaauuaagguauu

SEQ ID NO: 32326 - RNA, 18 nt, Artificial Sequence
  Description of Artificial Sequence: Synthetic oligonucleotide
aaaccauaaacaauuaag

SEQ ID NO: 32327 - RNA, 18 nt, Artificial Sequence
  Description of Artificial Sequence: Synthetic oligonucleotide
aagaaaaaccauaaacaa

SEQ ID NO: 32328 - RNA, 18 nt, Artificial Sequence
  Description of Artificial Sequence: Synthetic oligonucleotide
ccaggaagaaaaaccaua

SEQ ID NO: 32329 - RNA, 18 nt, Artificial Sequence
  Description of Artificial Sequence: Synthetic oligonucleotide
aguguccaggaagaaaaa

SEQ ID NO: 32330 - RNA, 18 nt, Artificial Sequence
  Description of Artificial Sequence: Synthetic oligonucleotide
aaaagaguguccaggaag

SEQ ID NO: 32331 - RNA, 18 nt, Artificial Sequence
  Description of Artificial Sequence: Synthetic oligonucleotide
uguagaaaagagugucca

SEQ ID NO: 32332 - RNA, 18 nt, Artificial Sequence
  Description of Artificial Sequence: Synthetic oligonucleotide
caaaaaaauacaaggcag

SEQ ID NO: 32333 - RNA, 18 nt, Artificial Sequence
  Description of Artificial Sequence: Synthetic oligonucleotide
uaggucaaaaaaauacaa

SEQ ID NO: 32334 - RNA, 18 nt, Artificial Sequence
  Description of Artificial Sequence: Synthetic oligonucleotide
uuugauaggucaaaaaaa

SEQ ID NO: 32335 - RNA, 18 nt, Artificial Sequence
  Description of Artificial Sequence: Synthetic oligonucleotide
augauuuugauaggucaa

SEQ ID NO: 32336 - RNA, 18 nt, Artificial Sequence
  Description of Artificial Sequence: Synthetic oligonucleotide
gaaaaaugauuuugauag

SEQ ID NO: 32337 - RNA, 18 nt, Artificial Sequence
  Description of Artificial Sequence: Synthetic oligonucleotide
uaauugaaaaaugauuuu

SEQ ID NO: 32338 - RNA, 18 nt, Artificial Sequence
  Description of Artificial Sequence: Synthetic oligonucleotide
acaaguaauugaaaaaug

SEQ ID NO: 32339 - RNA, 18 nt, Artificial Sequence
  Description of Artificial Sequence: Synthetic oligonucleotide
gggaaacaaguaauugaa

SEQ ID NO: 32340 - RNA, 18 nt, Artificial Sequence
  Description of Artificial Sequence: Synthetic oligonucleotide
gacaucugaaaucuaggg

SEQ ID NO: 32341 - RNA, 18 nt, Artificial Sequence
  Description of Artificial Sequence: Synthetic oligonucleotide
ccgugacaucugaaaucu

SEQ ID NO: 32342 - RNA, 18 nt, Artificial Sequence
  Description of Artificial Sequence: Synthetic oligonucleotide
ucauaccgugacaucuga

SEQ ID NO: 32343 - RNA, 18 nt, Artificial Sequence
  Description of Artificial Sequence: Synthetic oligonucleotide
accuuucauaccgugaca

SEQ ID NO: 32344 - RNA, 18 nt, Artificial Sequence
  Description of Artificial Sequence: Synthetic oligonucleotide
auaaaaccuuucauaccg

SEQ ID NO: 32345 - RNA, 18 nt, Artificial Sequence
  Description of Artificial Sequence: Synthetic oligonucleotide
uauauauaaaaccuuuca

SEQ ID NO: 32346 - RNA, 18 nt, Artificial Sequence
  Description of Artificial Sequence: Synthetic oligonucleotide
uuaaauauauauaaaacc

SEQ ID NO: 32347 - RNA, 18 nt, Artificial Sequence
  Description of Artificial Sequence: Synthetic oligonucleotide
auuuuuuaaauauauaua

SEQ ID NO: 32348 - RNA, 18 nt, Artificial Sequence
  Description of Artificial Sequence: Synthetic oligonucleotide
acuuuauuuuuuaaauau

SEQ ID NO: 32349 - RNA, 18 nt, Artificial Sequence
  Description of Artificial Sequence: Synthetic oligonucleotide
uuuauacuuuauuuuuua

SEQ ID NO: 32350 - RNA, 18 nt, Artificial Sequence
  Description of Artificial Sequence: Synthetic oligonucleotide
uuauguuuauacuuuauu

SEQ ID NO: 32351 - RNA, 18 nt, Artificial Sequence
  Description of Artificial Sequence: Synthetic oligonucleotide
agacuuuauguuuauacu

SEQ ID NO: 32352 - RNA, 18 nt, Artificial Sequence
  Description of Artificial Sequence: Synthetic oligonucleotide
caaaaagacuuuauguuu

SEQ ID NO: 32353 - RNA, 18 nt, Artificial Sequence
  Description of Artificial Sequence: Synthetic oligonucleotide
cgcuucaaaaagacuuua

SEQ ID NO: 32354 - RNA, 18 nt, Artificial Sequence
  Description of Artificial Sequence: Synthetic oligonucleotide
aaccacgcuucaaaaaga

SEQ ID NO: 32355 - RNA, 18 nt, Artificial Sequence
  Description of Artificial Sequence: Synthetic oligonucleotide
ugcauaaccacgcuucaa

SEQ ID NO: 32356 - RNA, 18 nt, Artificial Sequence
  Description of Artificial Sequence: Synthetic oligonucleotide
uauguugcauaaccacgc

SEQ ID NO: 32357 - RNA, 18 nt, Artificial Sequence
  Description of Artificial Sequence: Synthetic oligonucleotide
uagcauauguugcauaac

SEQ ID NO: 32358 - RNA, 18 nt, Artificial Sequence
  Description of Artificial Sequence: Synthetic oligonucleotide
acgccuagcauauguugc

SEQ ID NO: 32359 - RNA, 18 nt, Artificial Sequence
  Description of Artificial Sequence: Synthetic oligonucleotide
aacuuacgccuagcauau

SEQ ID NO: 32360 - RNA, 18 nt, Artificial Sequence
  Description of Artificial Sequence: Synthetic oligonucleotide
ucaccaacuuacgccuag

SEQ ID NO: 32361 - RNA, 18 nt, Artificial Sequence
  Description of Artificial Sequence: Synthetic oligonucleotide
ggcauucaccaacuuacg

SEQ ID NO: 32362 - RNA, 18 nt, Artificial Sequence
  Description of Artificial Sequence: Synthetic oligonucleotide
aagcaggcauucaccaac

SEQ ID NO: 32363 - RNA, 18 nt, Artificial Sequence
  Description of Artificial Sequence: Synthetic oligonucleotide
cugcaaagcaggcauuca

SEQ ID NO: 32364 - RNA, 18 nt, Artificial Sequence
  Description of Artificial Sequence: Synthetic oligonucleotide
acacucugcaaagcaggc

SEQ ID NO: 32365 - RNA, 18 nt, Artificial Sequence
  Description of Artificial Sequence: Synthetic oligonucleotide
ggguuacacucugcaaag

SEQ ID NO: 32366 - RNA, 18 nt, Artificial Sequence
  Description of Artificial Sequence: Synthetic oligonucleotide
cuuuuuuuauucaauggg

SEQ ID NO: 32367 - RNA, 18 nt, Artificial Sequence
  Description of Artificial Sequence: Synthetic oligonucleotide
gcuuuuuuuauucaaugg

SEQ ID NO: 32368 - RNA, 18 nt, Artificial Sequence
  Description of Artificial Sequence: Synthetic oligonucleotide
acaaagcuuuuuuuauuc

SEQ ID NO: 32369 - RNA, 18 nt, Artificial Sequence
  Description of Artificial Sequence: Synthetic oligonucleotide
ggaaaacaaagcuuuuuu

SEQ ID NO: 32370 - RNA, 18 nt, Artificial Sequence
  Description of Artificial Sequence: Synthetic oligonucleotide
gaaagggaaaacaaagcu

SEQ ID NO: 32371 - RNA, 18 nt, Artificial Sequence
  Description of Artificial Sequence: Synthetic oligonucleotide
gggcagaaagggaaaaca

SEQ ID NO: 32372 - RNA, 18 nt, Artificial Sequence
  Description of Artificial Sequence: Synthetic oligonucleotide
gcccauacugauacaggg

SEQ ID NO: 32373 - RNA, 18 nt, Artificial Sequence
  Description of Artificial Sequence: Synthetic oligonucleotide
ugcccauacugauacagg

SEQ ID NO: 32374 - RNA, 18 nt, Artificial Sequence
  Description of Artificial Sequence: Synthetic oligonucleotide
gggugugcccauacugau

SEQ ID NO: 32375 - RNA, 18 nt, Artificial Sequence
  Description of Artificial Sequence: Synthetic oligonucleotide
gugcagggugugcccaua

SEQ ID NO: 32376 - RNA, 18 nt, Artificial Sequence
  Description of Artificial Sequence: Synthetic oligonucleotide
uuagagugcagggugugc

SEQ ID NO: 32377 - RNA, 18 nt, Artificial Sequence
  Description of Artificial Sequence: Synthetic oligonucleotide
uaaaguuagagugcaggg

SEQ ID NO: 32378 - RNA, 18 nt, Artificial Sequence
  Description of Artificial Sequence: Synthetic oligonucleotide
uagauuaaaguuagagug

SEQ ID NO: 32379 - RNA, 18 nt, Artificial Sequence
  Description of Artificial Sequence: Synthetic oligonucleotide
ugacguagauuaaaguua

SEQ ID NO: 32380 - RNA, 18 nt, Artificial Sequence
  Description of Artificial Sequence: Synthetic oligonucleotide
gagggugacguagauuaa

SEQ ID NO: 32381 - RNA, 18 nt, Artificial Sequence
  Description of Artificial Sequence: Synthetic oligonucleotide
caggugagggugacguag

SEQ ID NO: 32382 - RNA, 18 nt, Artificial Sequence
  Description of Artificial Sequence: Synthetic oligonucleotide
ccaaacaggugaggguga

SEQ ID NO: 32383 - RNA, 18 nt, Artificial Sequence
  Description of Artificial Sequence: Synthetic oligonucleotide
ccaaaccaaacaggugag

SEQ ID NO: 32384 - RNA, 18 nt, Artificial Sequence
  Description of Artificial Sequence: Synthetic oligonucleotide
uaaacccaaaccaaacag

SEQ ID NO: 32385 - RNA, 18 nt, Artificial Sequence
  Description of Artificial Sequence: Synthetic oligonucleotide
gacauuaaacccaaacca

SEQ ID NO: 32386 - RNA, 18 nt, Artificial Sequence
  Description of Artificial Sequence: Synthetic oligonucleotide
ucgcagacauuaaaccca

SEQ ID NO: 32387 - RNA, 18 nt, Artificial Sequence
  Description of Artificial Sequence: Synthetic oligonucleotide
uuuucucgcagacauuaa

SEQ ID NO: 32388 - RNA, 18 nt, Artificial Sequence
  Description of Artificial Sequence: Synthetic oligonucleotide
uuugguuuucucgcagac

SEQ ID NO: 32389 - RNA, 18 nt, Artificial Sequence
  Description of Artificial Sequence: Synthetic oligonucleotide
agauauuugguuuucucg

SEQ ID NO: 32390 - RNA, 18 nt, Artificial Sequence
  Description of Artificial Sequence: Synthetic oligonucleotide
acacaagauauuugguuu

SEQ ID NO: 32391 - RNA, 18 nt, Artificial Sequence
  Description of Artificial Sequence: Synthetic oligonucleotide
acaauacacaagauauuu

SEQ ID NO: 32392 - RNA, 18 nt, Artificial Sequence
  Description of Artificial Sequence: Synthetic oligonucleotide
aguucacaauacacaaga

SEQ ID NO: 32393 - RNA, 18 nt, Artificial Sequence
  Description of Artificial Sequence: Synthetic oligonucleotide
uugacaguucacaauaca

SEQ ID NO: 32394 - RNA, 18 nt, Artificial Sequence
  Description of Artificial Sequence: Synthetic oligonucleotide
uggcuuugacaguucaca

SEQ ID NO: 32395 - RNA, 18 nt, Artificial Sequence
  Description of Artificial Sequence: Synthetic oligonucleotide
uuagauggcuuugacagu

SEQ ID NO: 32396 - RNA, 18 nt, Artificial Sequence
  Description of Artificial Sequence: Synthetic oligonucleotide
uugguuuagauggcuuug

SEQ ID NO: 32397 - RNA, 18 nt, Artificial Sequence
  Description of Artificial Sequence: Synthetic oligonucleotide
ugggauugguuuagaugg

SEQ ID NO: 32398 - RNA, 18 nt, Artificial Sequence
  Description of Artificial Sequence: Synthetic oligonucleotide
gaccuugggauugguuua

SEQ ID NO: 32399 - RNA, 18 nt, Artificial Sequence
  Description of Artificial Sequence: Synthetic oligonucleotide
cacuugaccuugggauug

SEQ ID NO: 32400 - RNA, 18 nt, Artificial Sequence
  Description of Artificial Sequence: Synthetic oligonucleotide
auauccacuugaccuugg

SEQ ID NO: 32401 - RNA, 18 nt, Artificial Sequence
  Description of Artificial Sequence: Synthetic oligonucleotide
uuuuuauauccacuugac

SEQ ID NO: 32402 - RNA, 18 nt, Artificial Sequence
  Description of Artificial Sequence: Synthetic oligonucleotide
cagaauuuuuauauccac

SEQ ID NO: 32403 - RNA, 18 nt, Artificial Sequence
  Description of Artificial Sequence: Synthetic oligonucleotide
uuuggcagaauuuuuaua

SEQ ID NO: 32404 - RNA, 18 nt, Artificial Sequence
  Description of Artificial Sequence: Synthetic oligonucleotide
auguuuuuggcagaauuu

SEQ ID NO: 32405 - RNA, 18 nt, Artificial Sequence
  Description of Artificial Sequence: Synthetic oligonucleotide
augccauguuuuuggcag

SEQ ID NO: 32406 - RNA, 18 nt, Artificial Sequence
  Description of Artificial Sequence: Synthetic oligonucleotide
aucuuaugccauguuuuu

SEQ ID NO: 32407 - RNA, 18 nt, Artificial Sequence
  Description of Artificial Sequence: Synthetic oligonucleotide
uuuccaucuuaugccaug

SEQ ID NO: 32408 - RNA, 18 nt, Artificial Sequence
  Description of Artificial Sequence: Synthetic oligonucleotide
gaacuuuuccaucuuaug

SEQ ID NO: 32409 - RNA, 18 nt, Artificial Sequence
  Description of Artificial Sequence: Synthetic oligonucleotide
ucagggaacuuuuccauc

SEQ ID NO: 32410 - RNA, 18 nt, Artificial Sequence
  Description of Artificial Sequence: Synthetic oligonucleotide
aguuuucagggaacuuuu

SEQ ID NO: 32411 - RNA, 18 nt, Artificial Sequence
  Description of Artificial Sequence: Synthetic oligonucleotide
uccagaguuuucagggaa

SEQ ID NO: 32412 - RNA, 18 nt, Artificial Sequence
  Description of Artificial Sequence: Synthetic oligonucleotide
uuucuuccagaguuuuca

SEQ ID NO: 32413 - RNA, 18 nt, Artificial Sequence
  Description of Artificial Sequence: Synthetic oligonucleotide
uuuguuuucuuccagagu

SEQ ID NO: 32414 - RNA, 18 nt, Artificial Sequence
  Description of Artificial Sequence: Synthetic oligonucleotide
auuacuuuguuuucuucc

SEQ ID NO: 32415 - RNA, 18 nt, Artificial Sequence
  Description of Artificial Sequence: Synthetic oligonucleotide
ucuacauuacuuuguuuu

SEQ ID NO: 32416 - RNA, 18 nt, Artificial Sequence
  Description of Artificial Sequence: Synthetic oligonucleotide
aggugucuacauuacuuu

SEQ ID NO: 32417 - RNA, 18 nt, Artificial Sequence
  Description of Artificial Sequence: Synthetic oligonucleotide
aaagaaggugucuacauu

SEQ ID NO: 32418 - RNA, 18 nt, Artificial Sequence
  Description of Artificial Sequence: Synthetic oligonucleotide
gggaaaaagaaggugucu

SEQ ID NO: 32419 - RNA, 18 nt, Artificial Sequence
  Description of Artificial Sequence: Synthetic oligonucleotide
auuuucuaaugguguggg

SEQ ID NO: 32420 - RNA, 18 nt, Artificial Sequence
  Description of Artificial Sequence: Synthetic oligonucleotide
aacauuuucuaauggugu

SEQ ID NO: 32421 - RNA, 18 nt, Artificial Sequence
  Description of Artificial Sequence: Synthetic oligonucleotide
gaugcaacauuuucuaau

SEQ ID NO: 32422 - RNA, 18 nt, Artificial Sequence
  Description of Artificial Sequence: Synthetic oligonucleotide
guccucaucgucauuauu

SEQ ID NO: 32423 - RNA, 18 nt, Artificial Sequence
  Description of Artificial Sequence: Synthetic oligonucleotide
gucagguccucaucguca

SEQ ID NO: 32424 - RNA, 18 nt, Artificial Sequence
  Description of Artificial Sequence: Synthetic oligonucleotide
cuggugucagguccucau

SEQ ID NO: 32425 - RNA, 18 nt, Artificial Sequence
  Description of Artificial Sequence: Synthetic oligonucleotide
cugcucuggugucagguc

SEQ ID NO: 32426 - RNA, 18 nt, Artificial Sequence
  Description of Artificial Sequence: Synthetic oligonucleotide
gccuucugcucugguguc

SEQ ID NO: 32427 - RNA, 18 nt, Artificial Sequence
  Description of Artificial Sequence: Synthetic oligonucleotide
gcucugccuucugcucug

SEQ ID NO: 32428 - RNA, 18 nt, Artificial Sequence
  Description of Artificial Sequence: Synthetic oligonucleotide
cucacgcucugccuucug

SEQ ID NO: 32429 - RNA, 18 nt, Artificial Sequence
  Description of Artificial Sequence: Synthetic oligonucleotide
uccuucucacgcucugcc

SEQ ID NO: 32430 - RNA, 18 nt, Artificial Sequence
  Description of Artificial Sequence: Synthetic oligonucleotide
uccgcuccuucucacgcu

SEQ ID NO: 32431 - RNA, 18 nt, Artificial Sequence
  Description of Artificial Sequence: Synthetic oligonucleotide
cauccuccgcuccuucuc

SEQ ID NO: 32432 - RNA, 18 nt, Artificial Sequence
  Description of Artificial Sequence: Synthetic oligonucleotide
uuggccauccuccgcucc

SEQ ID NO: 32433 - RNA, 18 nt, Artificial Sequence
  Description of Artificial Sequence: Synthetic oligonucleotide
cauuguuggccauccucc

SEQ ID NO: 32434 - RNA, 18 nt, Artificial Sequence
  Description of Artificial Sequence: Synthetic oligonucleotide
ucgggcauuguuggccau

SEQ ID NO: 32435 - RNA, 18 nt, Artificial Sequence
  Description of Artificial Sequence: Synthetic oligonucleotide
cgcucucgggcauuguug

SEQ ID NO: 32436 - RNA, 18 nt, Artificial Sequence
  Description of Artificial Sequence: Synthetic oligonucleotide
gcagacgcucucgggcau

SEQ ID NO: 32437 - RNA, 18 nt, Artificial Sequence
  Description of Artificial Sequence: Synthetic oligonucleotide
gacccgcagacgcucucg

SEQ ID NO: 32438 - RNA, 18 nt, Artificial Sequence
  Description of Artificial Sequence: Synthetic oligonucleotide
ucacggacccgcagacgc

SEQ ID NO: 32439 - RNA, 18 nt, Artificial Sequence
  Description of Artificial Sequence: Synthetic oligonucleotide
ugaugucacggacccgca

SEQ ID NO: 32440 - RNA, 18 nt, Artificial Sequence
  Description of Artificial Sequence: Synthetic oligonucleotide
cucguugaugucacggac

SEQ ID NO: 32441 - RNA, 18 nt, Artificial Sequence
  Description of Artificial Sequence: Synthetic oligonucleotide
aaagccucguugauguca

SEQ ID NO: 32442 - RNA, 18 nt, Artificial Sequence
  Description of Artificial Sequence: Synthetic oligonucleotide
cuuugaaagccucguuga

SEQ ID NO: 32443 - RNA, 18 nt, Artificial Sequence
  Description of Artificial Sequence: Synthetic oligonucleotide
gagcucuuugaaagccuc

SEQ ID NO: 32444 - RNA, 18 nt, Artificial Sequence
  Description of Artificial Sequence: Synthetic oligonucleotide
cggccgagcucuuugaaa

SEQ ID NO: 32445 - RNA, 18 nt, Artificial Sequence
  Description of Artificial Sequence: Synthetic oligonucleotide
ccaugcggccgagcucuu

SEQ ID NO: 32446 - RNA, 18 nt, Artificial Sequence
  Description of Artificial Sequence: Synthetic oligonucleotide
cugcaccaugcggccgag

SEQ ID NO: 32447 - RNA, 18 nt, Artificial Sequence
  Description of Artificial Sequence: Synthetic oligonucleotide
uggagcugcaccaugcgg

SEQ ID NO: 32448 - RNA, 18 nt, Artificial Sequence
  Description of Artificial Sequence: Synthetic oligonucleotide
ugagguggagcugcacca

SEQ ID NO: 32449 - RNA, 18 nt, Artificial Sequence
  Description of Artificial Sequence: Synthetic oligonucleotide
acucuugagguggagcug

SEQ ID NO: 32450 - RNA, 18 nt, Artificial Sequence
  Description of Artificial Sequence: Synthetic oligonucleotide
uugucacucuugaggugg

SEQ ID NO: 32451 - RNA, 18 nt, Artificial Sequence
  Description of Artificial Sequence: Synthetic oligonucleotide
gggcuugucacucuugag

SEQ ID NO: 32452 - RNA, 18 nt, Artificial Sequence
  Description of Artificial Sequence: Synthetic oligonucleotide
ucaggagcuuggucuggg

SEQ ID NO: 32453 - RNA, 18 nt, Artificial Sequence
  Description of Artificial Sequence: Synthetic oligonucleotide
gaggaucaggagcuuggu

SEQ ID NO: 32454 - RNA, 18 nt, Artificial Sequence
  Description of Artificial Sequence: Synthetic oligonucleotide
ugguggaggaucaggagc

SEQ ID NO: 32455 - RNA, 18 nt, Artificial Sequence
  Description of Artificial Sequence: Synthetic oligonucleotide
ccgccugguggaggauca

SEQ ID NO: 32456 - RNA, 18 nt, Artificial Sequence
  Description of Artificial Sequence: Synthetic oligonucleotide
ggccaccgccugguggag

SEQ ID NO: 32457 - RNA, 18 nt, Artificial Sequence
  Description of Artificial Sequence: Synthetic oligonucleotide
augacggccaccgccugg

SEQ ID NO: 32458 - RNA, 18 nt, Artificial Sequence
  Description of Artificial Sequence: Synthetic oligonucleotide
ugaggaugacggccaccg

SEQ ID NO: 32459 - RNA, 18 nt, Artificial Sequence
  Description of Artificial Sequence: Synthetic oligonucleotide
cagacugaggaugacggc

SEQ ID NO: 32460 - RNA, 18 nt, Artificial Sequence
  Description of Artificial Sequence: Synthetic oligonucleotide
ugcuccagacugaggaug

SEQ ID NO: 32461 - RNA, 18 nt, Artificial Sequence
  Description of Artificial Sequence: Synthetic oligonucleotide
cuugcugcuccagacuga

SEQ ID NO: 32462 - RNA, 18 nt, Artificial Sequence
  Description of Artificial Sequence: Synthetic oligonucleotide
ucggacuugcugcuccag

SEQ ID NO: 32463 - RNA, 18 nt, Artificial Sequence
  Description of Artificial Sequence: Synthetic oligonucleotide
guaguccugguggcaugc

SEQ ID NO: 32464 - RNA, 18 nt, Artificial Sequence
  Description of Artificial Sequence: Synthetic oligonucleotide
ccccuguaguccuggugg

SEQ ID NO: 32465 - RNA, 18 nt, Artificial Sequence
  Description of Artificial Sequence: Synthetic oligonucleotide
cucugccccuguaguccu

SEQ ID NO: 32466 - RNA, 18 nt, Artificial Sequence
  Description of Artificial Sequence: Synthetic oligonucleotide
agacacucugccccugua

SEQ ID NO: 32467 - RNA, 18 nt, Artificial Sequence
  Description of Artificial Sequence: Synthetic oligonucleotide
agaggagacacucugccc

SEQ ID NO: 32468 - RNA, 18 nt, Artificial Sequence
  Description of Artificial Sequence: Synthetic oligonucleotide
cugccagaggagacacuc

SEQ ID NO: 32469 - RNA, 18 nt, Artificial Sequence
  Description of Artificial Sequence: Synthetic oligonucleotide
cagagcugccagaggaga

SEQ ID NO: 32470 - RNA, 18 nt, Artificial Sequence
  Description of Artificial Sequence: Synthetic oligonucleotide
gaucucagagcugccaga

SEQ ID NO: 32471 - RNA, 18 nt, Artificial Sequence
  Description of Artificial Sequence: Synthetic oligonucleotide
gauuugaucucagagcug

SEQ ID NO: 32472 - RNA, 18 nt, Artificial Sequence
  Description of Artificial Sequence: Synthetic oligonucleotide
caucggauuugaucucag

SEQ ID NO: 32473 - RNA, 18 nt, Artificial Sequence
  Description of Artificial Sequence: Synthetic oligonucleotide
cucgucaucggauuugau

SEQ ID NO: 32474 - RNA, 18 nt, Artificial Sequence
  Description of Artificial Sequence: Synthetic oligonucleotide
ucacccucgucaucggau

SEQ ID NO: 32475 - RNA, 18 nt, Artificial Sequence
  Description of Artificial Sequence: Synthetic oligonucleotide
ucucaucacccucgucau

SEQ ID NO: 32476 - RNA, 18 nt, Artificial Sequence
  Description of Artificial Sequence: Synthetic oligonucleotide
cagguucucaucacccuc

SEQ ID NO: 32477 - RNA, 18 nt, Artificial Sequence
  Description of Artificial Sequence: Synthetic oligonucleotide
ucuugcagguucucauca

SEQ ID NO: 32478 - RNA, 18 nt, Artificial Sequence
  Description of Artificial Sequence: Synthetic oligonucleotide
ucgugucuugcagguucu

SEQ ID NO: 32479 - RNA, 18 nt, Artificial Sequence
  Description of Artificial Sequence: Synthetic oligonucleotide
agauuucgugucuugcag

SEQ ID NO: 32480 - RNA, 18 nt, Artificial Sequence
  Description of Artificial Sequence: Synthetic oligonucleotide
uccgaagauuucgugucu

SEQ ID NO: 32481 - RNA, 18 nt, Artificial Sequence
  Description of Artificial Sequence: Synthetic oligonucleotide
uguccuccgaagauuucg

SEQ ID NO: 32482 - RNA, 18 nt, Artificial Sequence
  Description of Artificial Sequence: Synthetic oligonucleotide
uuucuuguccuccgaaga

SEQ ID NO: 32483 - RNA, 18 nt, Artificial Sequence
  Description of Artificial Sequence: Synthetic oligonucleotide
ucuaauuucuuguccucc

SEQ ID NO: 32484 - RNA, 18 nt, Artificial Sequence
  Description of Artificial Sequence: Synthetic oligonucleotide
cgucaucuaauuucuugu

SEQ ID NO: 32485 - RNA, 18 nt, Artificial Sequence
  Description of Artificial Sequence: Synthetic oligonucleotide
cuugucgucaucuaauuu

SEQ ID NO: 32486 - RNA, 18 nt, Artificial Sequence
  Description of Artificial Sequence: Synthetic oligonucleotide
uccuucuugucgucaucu

SEQ ID NO: 32487 - RNA, 18 nt, Artificial Sequence
  Description of Artificial Sequence: Synthetic oligonucleotide
ugauauccuucuugucgu

SEQ ID NO: 32488 - RNA, 18 nt, Artificial Sequence
  Description of Artificial Sequence: Synthetic oligonucleotide
ugauuugauauccuucuu

SEQ ID NO: 32489 - RNA, 18 nt, Artificial Sequence
  Description of Artificial Sequence: Synthetic oligonucleotide
guaauugauuugauaucc

SEQ ID NO: 32490 - RNA, 18 nt, Artificial Sequence
  Description of Artificial Sequence: Synthetic oligonucleotide
uauacuguuaccuagauc

SEQ ID NO: 32491 - RNA, 18 nt, Artificial Sequence
  Description of Artificial Sequence: Synthetic oligonucleotide
uauuauauacuguuaccu

SEQ ID NO: 32492 - RNA, 18 nt, Artificial Sequence
  Description of Artificial Sequence: Synthetic oligonucleotide
gacaguauuauauacugu

SEQ ID NO: 32493 - RNA, 18 nt, Artificial Sequence
  Description of Artificial Sequence: Synthetic oligonucleotide
gaagcgacaguauuauau

SEQ ID NO: 32494 - RNA, 18 nt, Artificial Sequence
  Description of Artificial Sequence: Synthetic oligonucleotide
uaaaugaagcgacaguau

SEQ ID NO: 32495 - RNA, 18 nt, Artificial Sequence
  Description of Artificial Sequence: Synthetic oligonucleotide
ggaauuaaaugaagcgac

SEQ ID NO: 32496 - RNA, 18 nt, Artificial Sequence
  Description of Artificial Sequence: Synthetic oligonucleotide
auaaaggaauuaaaugaa

SEQ ID NO: 32497 - RNA, 18 nt, Artificial Sequence
  Description of Artificial Sequence: Synthetic oligonucleotide
guccaauaaaggaauuaa

SEQ ID NO: 32498 - RNA, 18 nt, Artificial Sequence
  Description of Artificial Sequence: Synthetic oligonucleotide
ucaaaguccaauaaagga

SEQ ID NO: 32499 - RNA, 18 nt, Artificial Sequence
  Description of Artificial Sequence: Synthetic oligonucleotide
cuucaucaaaguccaaua

SEQ ID NO: 32500 - RNA, 18 nt, Artificial Sequence
  Description of Artificial Sequence: Synthetic oligonucleotide
guucacuucaucaaaguc

SEQ ID NO: 32501 - RNA, 18 nt, Artificial Sequence
  Description of Artificial Sequence: Synthetic oligonucleotide
guucuguucacuucauca

SEQ ID NO: 32502 - RNA, 18 nt, Artificial Sequence
  Description of Artificial Sequence: Synthetic oligonucleotide
uucccguucuguucacuu

SEQ ID NO: 32503 - RNA, 18 nt, Artificial Sequence
  Description of Artificial Sequence: Synthetic oligonucleotide
guuucuucccguucuguu

SEQ ID NO: 32504 - RNA, 18 nt, Artificial Sequence
  Description of Artificial Sequence: Synthetic oligonucleotide
gaauaguuucuucccguu

SEQ ID NO: 32505 - RNA, 18 nt, Artificial Sequence
  Description of Artificial Sequence: Synthetic oligonucleotide
aaacugaauaguuucuuc

SEQ ID NO: 32506 - RNA, 18 nt, Artificial Sequence
  Description of Artificial Sequence: Synthetic oligonucleotide
ggaaaaaacugaauaguu

SEQ ID NO: 32507 - RNA, 18 nt, Artificial Sequence
  Description of Artificial Sequence: Synthetic oligonucleotide
ugccaggaaaaaacugaa

SEQ ID NO: 32508 - RNA, 18 nt, Artificial Sequence
  Description of Artificial Sequence: Synthetic oligonucleotide
uuaccugccaggaaaaaa

SEQ ID NO: 32509 - RNA, 18 nt, Artificial Sequence
  Description of Artificial Sequence: Synthetic oligonucleotide
uaaauuuaccugccagga

SEQ ID NO: 32510 - RNA, 18 nt, Artificial Sequence
  Description of Artificial Sequence: Synthetic oligonucleotide
agcuguaaauuuaccugc

SEQ ID NO: 32511 - RNA, 18 nt, Artificial Sequence
  Description of Artificial Sequence: Synthetic oligonucleotide
uuuucagcuguaaauuua

SEQ ID NO: 32512 - RNA, 18 nt, Artificial Sequence
  Description of Artificial Sequence: Synthetic oligonucleotide
uuuucuuuucagcuguaa

SEQ ID NO: 32513 - RNA, 18 nt, Artificial Sequence
  Description of Artificial Sequence: Synthetic oligonucleotide
uuuaauuuucuuuucagc

SEQ ID NO: 32514 - RNA, 18 nt, Artificial Sequence
  Description of Artificial Sequence: Synthetic oligonucleotide
aggccuuuaauuuucuuu

SEQ ID NO: 32515 - RNA, 18 nt, Artificial Sequence
  Description of Artificial Sequence: Synthetic oligonucleotide
agaguaggccuuuaauuu

SEQ ID NO: 32516 - RNA, 18 nt, Artificial Sequence
  Description of Artificial Sequence: Synthetic oligonucleotide
cuucuagaguaggccuuu

SEQ ID NO: 32517 - RNA, 18 nt, Artificial Sequence
  Description of Artificial Sequence: Synthetic oligonucleotide
uaguacuucuagaguagg

SEQ ID NO: 32518 - RNA, 18 nt, Artificial Sequence
  Description of Artificial Sequence: Synthetic oligonucleotide
acuuuuaguacuucuaga

SEQ ID NO: 32519 - RNA, 18 nt, Artificial Sequence
  Description of Artificial Sequence: Synthetic oligonucleotide
acgauacuuuuaguacuu

SEQ ID NO: 32520 - RNA, 18 nt, Artificial Sequence
  Description of Artificial Sequence: Synthetic oligonucleotide
cugaaacgauacuuuuag

SEQ ID NO: 32521 - RNA, 18 nt, Artificial Sequence
  Description of Artificial Sequence: Synthetic oligonucleotide
gguaucugaaacgauacu

SEQ ID NO: 32522 - RNA, 18 nt, Artificial Sequence
  Description of Artificial Sequence: Synthetic oligonucleotide
guacagguaucugaaacg

SEQ ID NO: 32523 - RNA, 18 nt, Artificial Sequence
  Description of Artificial Sequence: Synthetic oligonucleotide
auagaguacagguaucug

SEQ ID NO: 32524 - RNA, 18 nt, Artificial Sequence
  Description of Artificial Sequence: Synthetic oligonucleotide
cuccaauagaguacaggu

SEQ ID NO: 32525 - RNA, 18 nt, Artificial Sequence
  Description of Artificial Sequence: Synthetic oligonucleotide
uuaggcuccaauagagua

SEQ ID NO: 32526 - RNA, 18 nt, Artificial Sequence
  Description of Artificial Sequence: Synthetic oligonucleotide
acaguuuaggcuccaaua

SEQ ID NO: 32527 - RNA, 18 nt, Artificial Sequence
  Description of Artificial Sequence: Synthetic oligonucleotide
ccaaaacaguuuaggcuc

SEQ ID NO: 32528 - RNA, 18 nt, Artificial Sequence
  Description of Artificial Sequence: Synthetic oligonucleotide
aaaugccaaaacaguuua

SEQ ID NO: 32529 - RNA, 18 nt, Artificial Sequence
  Description of Artificial Sequence: Synthetic oligonucleotide
uucauaaaugccaaaaca

SEQ ID NO: 32530 - RNA, 18 nt, Artificial Sequence
  Description of Artificial Sequence: Synthetic oligonucleotide
ccagauucauaaaugcca

SEQ ID NO: 32531 - RNA, 18 nt, Artificial Sequence
  Description of Artificial Sequence: Synthetic oligonucleotide
uggguccagauucauaaa

SEQ ID NO: 32532 - RNA, 18 nt, Artificial Sequence
  Description of Artificial Sequence: Synthetic oligonucleotide
agcauuggguccagauuc

SEQ ID NO: 32533 - RNA, 18 nt, Artificial Sequence
  Description of Artificial Sequence: Synthetic oligonucleotide
ucauuagcauugggucca

SEQ ID NO: 32534 - RNA, 18 nt, Artificial Sequence
  Description of Artificial Sequence: Synthetic oligonucleotide
gugugucauuagcauugg

SEQ ID NO: 32535 - RNA, 18 nt, Artificial Sequence
  Description of Artificial Sequence: Synthetic oligonucleotide
ucacugugugucauuagc

SEQ ID NO: 32536 - RNA, 18 nt, Artificial Sequence
  Description of Artificial Sequence: Synthetic oligonucleotide
uuuuuucacuguguguca

SEQ ID NO: 32537 - RNA, 18 nt, Artificial Sequence
  Description of Artificial Sequence: Synthetic oligonucleotide
acaaauuuuuucacugug

SEQ ID NO: 32538 - RNA, 18 nt, Artificial Sequence
  Description of Artificial Sequence: Synthetic oligonucleotide
cagagacaaauuuuuuca

SEQ ID NO: 32539 - RNA, 18 nt, Artificial Sequence
  Description of Artificial Sequence: Synthetic oligonucleotide
ugaaucagagacaaauuu

SEQ ID NO: 32540 - RNA, 18 nt, Artificial Sequence
  Description of Artificial Sequence: Synthetic oligonucleotide
guacuugaaucagagaca

SEQ ID NO: 32541 - RNA, 18 nt, Artificial Sequence
  Description of Artificial Sequence: Synthetic oligonucleotide
aaacuguacuugaaucag

SEQ ID NO: 32542 - RNA, 18 nt, Artificial Sequence
  Description of Artificial Sequence: Synthetic oligonucleotide
caaauaaacuguacuuga

SEQ ID NO: 32543 - RNA, 18 nt, Artificial Sequence
  Description of Artificial Sequence: Synthetic oligonucleotide
uuuuacaaauaaacugua

SEQ ID NO: 32544 - RNA, 18 nt, Artificial Sequence
  Description of Artificial Sequence: Synthetic oligonucleotide
uauaguuuuacaaauaaa

SEQ ID NO: 32545 - RNA, 18 nt, Artificial Sequence
  Description of Artificial Sequence: Synthetic oligonucleotide
auaaguauaguuuuacaa

SEQ ID NO: 32546 - RNA, 18 nt, Artificial Sequence
  Description of Artificial Sequence: Synthetic oligonucleotide
guagaauaaguauaguuu

SEQ ID NO: 32547 - RNA, 18 nt, Artificial Sequence
  Description of Artificial Sequence: Synthetic oligonucleotide
aauuuguagaauaaguau

SEQ ID NO: 32548 - RNA, 18 nt, Artificial Sequence
  Description of Artificial Sequence: Synthetic oligonucleotide
gaccaaauuuguagaaua

SEQ ID NO: 32549 - RNA, 18 nt, Artificial Sequence
  Description of Artificial Sequence: Synthetic oligonucleotide
uuucugaccaaauuugua

SEQ ID NO: 32550 - RNA, 18 nt, Artificial Sequence
  Description of Artificial Sequence: Synthetic oligonucleotide
caacauuucugaccaaau

SEQ ID NO: 32551 - RNA, 18 nt, Artificial Sequence
  Description of Artificial Sequence: Synthetic oligonucleotide
agacacaacauuucugac

SEQ ID NO: 32552 - RNA, 18 nt, Artificial Sequence
  Description of Artificial Sequence: Synthetic oligonucleotide
auuauagacacaacauuu

SEQ ID NO: 32553 - RNA, 18 nt, Artificial Sequence
  Description of Artificial Sequence: Synthetic oligonucleotide
gaaauauuauagacacaa

SEQ ID NO: 32554 - RNA, 18 nt, Artificial Sequence
  Description of Artificial Sequence: Synthetic oligonucleotide
uuuuagaaauauuauaga

SEQ ID NO: 32555 - RNA, 18 nt, Artificial Sequence
  Description of Artificial Sequence: Synthetic oligonucleotide
ucucuuuuuagaaauauu

SEQ ID NO: 32556 - RNA, 18 nt, Artificial Sequence
  Description of Artificial Sequence: Synthetic oligonucleotide
uacaaucucuuuuuagaa

SEQ ID NO: 32557 - RNA, 18 nt, Artificial Sequence
  Description of Artificial Sequence: Synthetic oligonucleotide
auggcuacaaucucuuuu

SEQ ID NO: 32558 - RNA, 18 nt, Artificial Sequence
  Description of Artificial Sequence: Synthetic oligonucleotide
uuaacauggcuacaaucu

SEQ ID NO: 32559 - RNA, 18 nt, Artificial Sequence
  Description of Artificial Sequence: Synthetic oligonucleotide
aguuuuuaacauggcuac

SEQ ID NO: 32560 - RNA, 18 nt, Artificial Sequence
  Description of Artificial Sequence: Synthetic oligonucleotide
aguugaguuuuuaacaug

SEQ ID NO: 32561 - RNA, 18 nt, Artificial Sequence
  Description of Artificial Sequence: Synthetic oligonucleotide
acaucaguugaguuuuua

SEQ ID NO: 32562 - RNA, 18 nt, Artificial Sequence
  Description of Artificial Sequence: Synthetic oligonucleotide
cacauacaucaguugagu

SEQ ID NO: 32563 - RNA, 18 nt, Artificial Sequence
  Description of Artificial Sequence: Synthetic oligonucleotide
guuggcacauacaucagu

SEQ ID NO: 32564 - RNA, 18 nt, Artificial Sequence
  Description of Artificial Sequence: Synthetic oligonucleotide
uuauaguuggcacauaca

SEQ ID NO: 32565 - RNA, 18 nt, Artificial Sequence
  Description of Artificial Sequence: Synthetic oligonucleotide
aagaguuauaguuggcac

SEQ ID NO: 32566 - RNA, 18 nt, Artificial Sequence
  Description of Artificial Sequence: Synthetic oligonucleotide
aagaaaagaguuauaguu

SEQ ID NO: 32567 - RNA, 18 nt, Artificial Sequence
  Description of Artificial Sequence: Synthetic oligonucleotide
gagguaagaaaagaguua

SEQ ID NO: 32568 - RNA, 18 nt, Artificial Sequence
  Description of Artificial Sequence: Synthetic oligonucleotide
cuuuagagguaagaaaag

SEQ ID NO: 32569 - RNA, 18 nt, Artificial Sequence
  Description of Artificial Sequence: Synthetic oligonucleotide
ucuuacuuuagagguaag

SEQ ID NO: 32570 - RNA, 18 nt, Artificial Sequence
  Description of Artificial Sequence: Synthetic oligonucleotide
uauuuucuuacuuuagag

SEQ ID NO: 32571 - RNA, 18 nt, Artificial Sequence
  Description of Artificial Sequence: Synthetic oligonucleotide
gaaauuauuuucuuacuu

SEQ ID NO: 32572 - RNA, 18 nt, Artificial Sequence
  Description of Artificial Sequence: Synthetic oligonucleotide
ucuaggaaauuauuuucu

SEQ ID NO: 32573 - RNA, 18 nt, Artificial Sequence
  Description of Artificial Sequence: Synthetic oligonucleotide
auaaaucuaggaaauuau

SEQ ID NO: 32574 - RNA, 18 nt, Artificial Sequence
  Description of Artificial Sequence: Synthetic oligonucleotide
uuaggauaaaucuaggaa

SEQ ID NO: 32575 - RNA, 18 nt, Artificial Sequence
  Description of Artificial Sequence: Synthetic oligonucleotide
cauguuuaggauaaaucu

SEQ ID NO: 32576 - RNA, 18 nt, Artificial Sequence
  Description of Artificial Sequence: Synthetic oligonucleotide
aucagcauguuuaggaua

SEQ ID NO: 32577 - RNA, 18 nt, Artificial Sequence
  Description of Artificial Sequence: Synthetic oligonucleotide
uauacaucagcauguuua

SEQ ID NO: 32578 - RNA, 18 nt, Artificial Sequence
  Description of Artificial Sequence: Synthetic oligonucleotide
ucuuauauacaucagcau

SEQ ID NO: 32579 - RNA, 18 nt, Artificial Sequence
  Description of Artificial Sequence: Synthetic oligonucleotide
auuacucuuauauacauc

SEQ ID NO: 32580 - RNA, 18 nt, Artificial Sequence
  Description of Artificial Sequence: Synthetic oligonucleotide
aagguauuacucuuauau

SEQ ID NO: 32581 - RNA, 18 nt, Artificial Sequence
  Description of Artificial Sequence: Synthetic oligonucleotide
caauuaagguauuacucu

SEQ ID NO: 32582 - RNA, 18 nt, Artificial Sequence
  Description of Artificial Sequence: Synthetic oligonucleotide
auaaacaauuaagguauu

SEQ ID NO: 32583 - RNA, 18 nt, Artificial Sequence
  Description of Artificial Sequence: Synthetic oligonucleotide
aaaccauaaacaauuaag

SEQ ID NO: 32584 - RNA, 18 nt, Artificial Sequence
  Description of Artificial Sequence: Synthetic oligonucleotide
aagaaaaaccauaaacaa

SEQ ID NO: 32585 - RNA, 18 nt, Artificial Sequence
  Description of Artificial Sequence: Synthetic oligonucleotide
ccaggaagaaaaaccaua

SEQ ID NO: 32586 - RNA, 18 nt, Artificial Sequence
  Description of Artificial Sequence: Synthetic oligonucleotide
aguguccaggaagaaaaa

SEQ ID NO: 32587 - RNA, 18 nt, Artificial Sequence
  Description of Artificial Sequence: Synthetic oligonucleotide
aaaagaguguccaggaag

SEQ ID NO: 32588 - RNA, 18 nt, Artificial Sequence
  Description of Artificial Sequence: Synthetic oligonucleotide
uguagaaaagagugucca

SEQ ID NO: 32589 - RNA, 18 nt, Artificial Sequence
  Description of Artificial Sequence: Synthetic oligonucleotide
caaaaaaauacaaggcag

SEQ ID NO: 32590 - RNA, 18 nt, Artificial Sequence
  Description of Artificial Sequence: Synthetic oligonucleotide
uaggucaaaaaaauacaa

SEQ ID NO: 32591 - RNA, 18 nt, Artificial Sequence
  Description of Artificial Sequence: Synthetic oligonucleotide
uuugauaggucaaaaaaa

SEQ ID NO: 32592 - RNA, 18 nt, Artificial Sequence
  Description of Artificial Sequence: Synthetic oligonucleotide
augauuuugauaggucaa

SEQ ID NO: 32593 - RNA, 18 nt, Artificial Sequence
  Description of Artificial Sequence: Synthetic oligonucleotide
gaaaaaugauuuugauag

SEQ ID NO: 32594 - RNA, 18 nt, Artificial Sequence
  Description of Artificial Sequence: Synthetic oligonucleotide
uaauugaaaaaugauuuu

SEQ ID NO: 32595 - RNA, 18 nt, Artificial Sequence
  Description of Artificial Sequence: Synthetic oligonucleotide
acaaguaauugaaaaaug

SEQ ID NO: 32596 - RNA, 18 nt, Artificial Sequence
  Description of Artificial Sequence: Synthetic oligonucleotide
gggaaacaaguaauugaa

SEQ ID NO: 32597 - RNA, 18 nt, Artificial Sequence
  Description of Artificial Sequence: Synthetic oligonucleotide
gacaucugaaaucuaggg

SEQ ID NO: 32598 - RNA, 18 nt, Artificial Sequence
  Description of Artificial Sequence: Synthetic oligonucleotide
ccgugacaucugaaaucu

SEQ ID NO: 32599 - RNA, 18 nt, Artificial Sequence
  Description of Artificial Sequence: Synthetic oligonucleotide
ucauaccgugacaucuga

SEQ ID NO: 32600 - RNA, 18 nt, Artificial Sequence
  Description of Artificial Sequence: Synthetic oligonucleotide
accuuucauaccgugaca

SEQ ID NO: 32601 - RNA, 18 nt, Artificial Sequence
  Description of Artificial Sequence: Synthetic oligonucleotide
auaaaaccuuucauaccg

SEQ ID NO: 32602 - RNA, 18 nt, Artificial Sequence
  Description of Artificial Sequence: Synthetic oligonucleotide
uauauauaaaaccuuuca

SEQ ID NO: 32603 - RNA, 18 nt, Artificial Sequence
  Description of Artificial Sequence: Synthetic oligonucleotide
uuaaauauauauaaaacc

SEQ ID NO: 32604 - RNA, 18 nt, Artificial Sequence
  Description of Artificial Sequence: Synthetic oligonucleotide
auuuuuuaaauauauaua

SEQ ID NO: 32605 - RNA, 18 nt, Artificial Sequence
  Description of Artificial Sequence: Synthetic oligonucleotide
acuuuauuuuuuaaauau

SEQ ID NO: 32606 - RNA, 18 nt, Artificial Sequence
  Description of Artificial Sequence: Synthetic oligonucleotide
uuuauacuuuauuuuuua

SEQ ID NO: 32607 - RNA, 18 nt, Artificial Sequence
  Description of Artificial Sequence: Synthetic oligonucleotide
uuauguuuauacuuuauu

SEQ ID NO: 32608 - RNA, 18 nt, Artificial Sequence
  Description of Artificial Sequence: Synthetic oligonucleotide
agacuuuauguuuauacu

SEQ ID NO: 32609 - RNA, 18 nt, Artificial Sequence
  Description of Artificial Sequence: Synthetic oligonucleotide
caaaaagacuuuauguuu

SEQ ID NO: 32610 - RNA, 18 nt, Artificial Sequence
  Description of Artificial Sequence: Synthetic oligonucleotide
cgcuucaaaaagacuuua

SEQ ID NO: 32611 - RNA, 18 nt, Artificial Sequence
  Description of Artificial Sequence: Synthetic oligonucleotide
aaccacgcuucaaaaaga

SEQ ID NO: 32612 - RNA, 18 nt, Artificial Sequence
  Description of Artificial Sequence: Synthetic oligonucleotide
ugcauaaccacgcuucaa

SEQ ID NO: 32613 - RNA, 18 nt, Artificial Sequence
  Description of Artificial Sequence: Synthetic oligonucleotide
uauguugcauaaccacgc

SEQ ID NO: 32614 - RNA, 18 nt, Artificial Sequence
  Description of Artificial Sequence: Synthetic oligonucleotide
uagcauauguugcauaac

SEQ ID NO: 32615 - RNA, 18 nt, Artificial Sequence
  Description of Artificial Sequence: Synthetic oligonucleotide
acgccuagcauauguugc

SEQ ID NO: 32616 - RNA, 18 nt, Artificial Sequence
  Description of Artificial Sequence: Synthetic oligonucleotide
aacuuacgccuagcauau

SEQ ID NO: 32617 - RNA, 18 nt, Artificial Sequence
  Description of Artificial Sequence: Synthetic oligonucleotide
ucaccaacuuacgccuag

SEQ ID NO: 32618 - RNA, 18 nt, Artificial Sequence
  Description of Artificial Sequence: Synthetic oligonucleotide
ggcauucaccaacuuacg

SEQ ID NO: 32619 - RNA, 18 nt, Artificial Sequence
  Description of Artificial Sequence: Synthetic oligonucleotide
aagcaggcauucaccaac

SEQ ID NO: 32620 - RNA, 18 nt, Artificial Sequence
  Description of Artificial Sequence: Synthetic oligonucleotide
cugcaaagcaggcauuca

SEQ ID NO: 32621 - RNA, 18 nt, Artificial Sequence
  Description of Artificial Sequence: Synthetic oligonucleotide
acacucugcaaagcaggc

SEQ ID NO: 32622 - RNA, 18 nt, Artificial Sequence
  Description of Artificial Sequence: Synthetic oligonucleotide
ggguuacacucugcaaag

SEQ ID NO: 32623 - RNA, 18 nt, Artificial Sequence
  Description of Artificial Sequence: Synthetic oligonucleotide
cuuuuuuuauucaauggg

SEQ ID NO: 32624 - RNA, 18 nt, Artificial Sequence
  Description of Artificial Sequence: Synthetic oligonucleotide
gcuuuuuuuauucaaugg

SEQ ID NO: 32625 - RNA, 18 nt, Artificial Sequence
  Description of Artificial Sequence: Synthetic oligonucleotide
acaaagcuuuuuuuauuc

SEQ ID NO: 32626 - RNA, 18 nt, Artificial Sequence
  Description of Artificial Sequence: Synthetic oligonucleotide
ggaaaacaaagcuuuuuu

SEQ ID NO: 32627 - RNA, 18 nt, Artificial Sequence
  Description of Artificial Sequence: Synthetic oligonucleotide
gaaagggaaaacaaagcu

SEQ ID NO: 32628 - RNA, 18 nt, Artificial Sequence
  Description of Artificial Sequence: Synthetic oligonucleotide
gggcagaaagggaaaaca

SEQ ID NO: 32629 - RNA, 18 nt, Artificial Sequence
  Description of Artificial Sequence: Synthetic oligonucleotide
gcccauacugauacaggg

SEQ ID NO: 32630 - RNA, 18 nt, Artificial Sequence
  Description of Artificial Sequence: Synthetic oligonucleotide
ugcccauacugauacagg

SEQ ID NO: 32631 - RNA, 18 nt, Artificial Sequence
  Description of Artificial Sequence: Synthetic oligonucleotide
gggugugcccauacugau

SEQ ID NO: 32632 - RNA, 18 nt, Artificial Sequence
  Description of Artificial Sequence: Synthetic oligonucleotide
gugcagggugugcccaua

SEQ ID NO: 32633 - RNA, 18 nt, Artificial Sequence
  Description of Artificial Sequence: Synthetic oligonucleotide
uuagagugcagggugugc

SEQ ID NO: 32634 - RNA, 18 nt, Artificial Sequence
  Description of Artificial Sequence: Synthetic oligonucleotide
uaaaguuagagugcaggg

SEQ ID NO: 32635 - RNA, 18 nt, Artificial Sequence
  Description of Artificial Sequence: Synthetic oligonucleotide
uagauuaaaguuagagug

SEQ ID NO: 32636 - RNA, 18 nt, Artificial Sequence
  Description of Artificial Sequence: Synthetic oligonucleotide
ugacguagauuaaaguua

SEQ ID NO: 32637 - RNA, 18 nt, Artificial Sequence
  Description of Artificial Sequence: Synthetic oligonucleotide
gagggugacguagauuaa

SEQ ID NO: 32638 - RNA, 18 nt, Artificial Sequence
  Description of Artificial Sequence: Synthetic oligonucleotide
caggugagggugacguag

SEQ ID NO: 32639 - RNA, 18 nt, Artificial Sequence
  Description of Artificial Sequence: Synthetic oligonucleotide
ccaaacaggugaggguga

SEQ ID NO: 32640 - RNA, 18 nt, Artificial Sequence
  Description of Artificial Sequence: Synthetic oligonucleotide
ccaaaccaaacaggugag

SEQ ID NO: 32641 - RNA, 18 nt, Artificial Sequence
  Description of Artificial Sequence: Synthetic oligonucleotide
uaaacccaaaccaaacag

SEQ ID NO: 32642 - RNA, 18 nt, Artificial Sequence
  Description of Artificial Sequence: Synthetic oligonucleotide
gacauuaaacccaaacca

SEQ ID NO: 32643 - RNA, 18 nt, Artificial Sequence
  Description of Artificial Sequence: Synthetic oligonucleotide
ucgcagacauuaaaccca

SEQ ID NO: 32644 - RNA, 18 nt, Artificial Sequence
  Description of Artificial Sequence: Synthetic oligonucleotide
uuuucucgcagacauuaa

SEQ ID NO: 32645 - RNA, 18 nt, Artificial Sequence
  Description of Artificial Sequence: Synthetic oligonucleotide
uuugguuuucucgcagac

SEQ ID NO: 32646 - RNA, 18 nt, Artificial Sequence
  Description of Artificial Sequence: Synthetic oligonucleotide
agauauuugguuuucucg

SEQ ID NO: 32647 - RNA, 18 nt, Artificial Sequence
  Description of Artificial Sequence: Synthetic oligonucleotide
acacaagauauuugguuu

SEQ ID NO: 32648 - RNA, 18 nt, Artificial Sequence
  Description of Artificial Sequence: Synthetic oligonucleotide
acaauacacaagauauuu

SEQ ID NO: 32649 - RNA, 18 nt, Artificial Sequence
  Description of Artificial Sequence: Synthetic oligonucleotide
aguucacaauacacaaga

SEQ ID NO: 32650 - RNA, 18 nt, Artificial Sequence
  Description of Artificial Sequence: Synthetic oligonucleotide
uugacaguucacaauaca

SEQ ID NO: 32651 - RNA, 18 nt, Artificial Sequence
  Description of Artificial Sequence: Synthetic oligonucleotide
uggcuuugacaguucaca

SEQ ID NO: 32652 - RNA, 18 nt, Artificial Sequence
  Description of Artificial Sequence: Synthetic oligonucleotide
uuagauggcuuugacagu

SEQ ID NO: 32653 - RNA, 18 nt, Artificial Sequence
  Description of Artificial Sequence: Synthetic oligonucleotide
uugguuuagauggcuuug

SEQ ID NO: 32654 - RNA, 18 nt, Artificial Sequence
  Description of Artificial Sequence: Synthetic oligonucleotide
ugggauugguuuagaugg

SEQ ID NO: 32655 - RNA, 18 nt, Artificial Sequence
  Description of Artificial Sequence: Synthetic oligonucleotide
gaccuugggauugguuua

SEQ ID NO: 32656 - RNA, 18 nt, Artificial Sequence
  Description of Artificial Sequence: Synthetic oligonucleotide
cacuugaccuugggauug

SEQ ID NO: 32657 - RNA, 18 nt, Artificial Sequence
  Description of Artificial Sequence: Synthetic oligonucleotide
auauccacuugaccuugg

SEQ ID NO: 32658 - RNA, 18 nt, Artificial Sequence
  Description of Artificial Sequence: Synthetic oligonucleotide
uuuuuauauccacuugac

SEQ ID NO: 32659 - RNA, 18 nt, Artificial Sequence
  Description of Artificial Sequence: Synthetic oligonucleotide
cagaauuuuuauauccac

SEQ ID NO: 32660 - RNA, 18 nt, Artificial Sequence
  Description of Artificial Sequence: Synthetic oligonucleotide
uuuggcagaauuuuuaua

SEQ ID NO: 32661 - RNA, 18 nt, Artificial Sequence
  Description of Artificial Sequence: Synthetic oligonucleotide
auguuuuuggcagaauuu

SEQ ID NO: 32662 - RNA, 18 nt, Artificial Sequence
  Description of Artificial Sequence: Synthetic oligonucleotide
augccauguuuuuggcag

SEQ ID NO: 32663 - RNA, 18 nt, Artificial Sequence
  Description of Artificial Sequence: Synthetic oligonucleotide
aucuuaugccauguuuuu

SEQ ID NO: 32664 - RNA, 18 nt, Artificial Sequence
  Description of Artificial Sequence: Synthetic oligonucleotide
uuuccaucuuaugccaug

SEQ ID NO: 32665 - RNA, 18 nt, Artificial Sequence
  Description of Artificial Sequence: Synthetic oligonucleotide
gaacuuuuccaucuuaug

SEQ ID NO: 32666 - RNA, 18 nt, Artificial Sequence
  Description of Artificial Sequence: Synthetic oligonucleotide
ucagggaacuuuuccauc

SEQ ID NO: 32667 - RNA, 18 nt, Artificial Sequence
  Description of Artificial Sequence: Synthetic oligonucleotide
aguuuucagggaacuuuu

SEQ ID NO: 32668 - RNA, 18 nt, Artificial Sequence
  Description of Artificial Sequence: Synthetic oligonucleotide
uccagaguuuucagggaa

SEQ ID NO: 32669 - RNA, 18 nt, Artificial Sequence
  Description of Artificial Sequence: Synthetic oligonucleotide
uuucuuccagaguuuuca

SEQ ID NO: 32670 - RNA, 18 nt, Artificial Sequence
  Description of Artificial Sequence: Synthetic oligonucleotide
uuuguuuucuuccagagu

SEQ ID NO: 32671 - RNA, 18 nt, Artificial Sequence
  Description of Artificial Sequence: Synthetic oligonucleotide
auuacuuuguuuucuucc

SEQ ID NO: 32672 - RNA, 18 nt, Artificial Sequence
  Description of Artificial Sequence: Synthetic oligonucleotide
ucuacauuacuuuguuuu

SEQ ID NO: 32673 - RNA, 18 nt, Artificial Sequence
  Description of Artificial Sequence: Synthetic oligonucleotide
aggugucuacauuacuuu

SEQ ID NO: 32674 - RNA, 18 nt, Artificial Sequence
  Description of Artificial Sequence: Synthetic oligonucleotide
aaagaaggugucuacauu

SEQ ID NO: 32675 - RNA, 18 nt, Artificial Sequence
  Description of Artificial Sequence: Synthetic oligonucleotide
gggaaaaagaaggugucu

SEQ ID NO: 32676 - RNA, 18 nt, Artificial Sequence
  Description of Artificial Sequence: Synthetic oligonucleotide
auuuucuaaugguguggg

SEQ ID NO: 32677 - RNA, 18 nt, Artificial Sequence
  Description of Artificial Sequence: Synthetic oligonucleotide
aacauuuucuaauggugu

SEQ ID NO: 32678 - RNA, 18 nt, Artificial Sequence
  Description of Artificial Sequence: Synthetic oligonucleotide
gaugcaacauuuucuaau

SEQ ID NO: 32679 - RNA, 18 nt, Artificial Sequence
  Description of Artificial Sequence: Synthetic oligonucleotide
guccucaucgucauuauu

SEQ ID NO: 32680 - RNA, 18 nt, Artificial Sequence
  Description of Artificial Sequence: Synthetic oligonucleotide
gucagguccucaucguca

SEQ ID NO: 32681 - RNA, 18 nt, Artificial Sequence
  Description of Artificial Sequence: Synthetic oligonucleotide
cuggugucagguccucau

SEQ ID NO: 32682 - RNA, 18 nt, Artificial Sequence
  Description of Artificial Sequence: Synthetic oligonucleotide
cugcucuggugucagguc

SEQ ID NO: 32683 - RNA, 18 nt, Artificial Sequence
  Description of Artificial Sequence: Synthetic oligonucleotide
gccuucugcucugguguc

SEQ ID NO: 32684 - RNA, 18 nt, Artificial Sequence
  Description of Artificial Sequence: Synthetic oligonucleotide
gcucugccuucugcucug

SEQ ID NO: 32685 - RNA, 18 nt, Artificial Sequence
  Description of Artificial Sequence: Synthetic oligonucleotide
cucacgcucugccuucug

SEQ ID NO: 32686 - RNA, 18 nt, Artificial Sequence
  Description of Artificial Sequence: Synthetic oligonucleotide
uccuucucacgcucugcc

SEQ ID NO: 32687 - RNA, 18 nt, Artificial Sequence
  Description of Artificial Sequence: Synthetic oligonucleotide
uccgcuccuucucacgcu

SEQ ID NO: 32688 - RNA, 18 nt, Artificial Sequence
  Description of Artificial Sequence: Synthetic oligonucleotide
cauccuccgcuccuucuc

SEQ ID NO: 32689 - RNA, 18 nt, Artificial Sequence
  Description of Artificial Sequence: Synthetic oligonucleotide
uuggccauccuccgcucc

SEQ ID NO: 32690 - RNA, 18 nt, Artificial Sequence
  Description of Artificial Sequence: Synthetic oligonucleotide
cauuguuggccauccucc

SEQ ID NO: 32691 - RNA, 18 nt, Artificial Sequence
  Description of Artificial Sequence: Synthetic oligonucleotide
ucgggcauuguuggccau

SEQ ID NO: 32692 - RNA, 18 nt, Artificial Sequence
  Description of Artificial Sequence: Synthetic oligonucleotide
cgcucucgggcauuguug

SEQ ID NO: 32693 - RNA, 18 nt, Artificial Sequence
  Description of Artificial Sequence: Synthetic oligonucleotide
gcagacgcucucgggcau

SEQ ID NO: 32694 - RNA, 18 nt, Artificial Sequence
  Description of Artificial Sequence: Synthetic oligonucleotide
gacccgcagacgcucucg

SEQ ID NO: 32695 - RNA, 18 nt, Artificial Sequence
  Description of Artificial Sequence: Synthetic oligonucleotide
ucacggacccgcagacgc

SEQ ID NO: 32696 - RNA, 18 nt, Artificial Sequence
  Description of Artificial Sequence: Synthetic oligonucleotide
ugaugucacggacccgca

SEQ ID NO: 32697 - RNA, 18 nt, Artificial Sequence
  Description of Artificial Sequence: Synthetic oligonucleotide
cucguugaugucacggac

SEQ ID NO: 32698 - RNA, 18 nt, Artificial Sequence
  Description of Artificial Sequence: Synthetic oligonucleotide
aaagccucguugauguca

SEQ ID NO: 32699 - RNA, 18 nt, Artificial Sequence
  Description of Artificial Sequence: Synthetic oligonucleotide
cuuugaaagccucguuga

SEQ ID NO: 32700 - RNA, 18 nt, Artificial Sequence
  Description of Artificial Sequence: Synthetic oligonucleotide
gagcucuuugaaagccuc

SEQ ID NO: 32701 - RNA, 18 nt, Artificial Sequence
  Description of Artificial Sequence: Synthetic oligonucleotide
cggccgagcucuuugaaa

SEQ ID NO: 32702 - RNA, 18 nt, Artificial Sequence
  Description of Artificial Sequence: Synthetic oligonucleotide
ccaugcggccgagcucuu

SEQ ID NO: 32703 - RNA, 18 nt, Artificial Sequence
  Description of Artificial Sequence: Synthetic oligonucleotide
cugcaccaugcggccgag

SEQ ID NO: 32704 - RNA, 18 nt, Artificial Sequence
  Description of Artificial Sequence: Synthetic oligonucleotide
uggagcugcaccaugcgg

SEQ ID NO: 32705 - RNA, 18 nt, Artificial Sequence
  Description of Artificial Sequence: Synthetic oligonucleotide
ugagguggagcugcacca

SEQ ID NO: 32706 - RNA, 18 nt, Artificial Sequence
  Description of Artificial Sequence: Synthetic oligonucleotide
acucuugagguggagcug

SEQ ID NO: 32707 - RNA, 18 nt, Artificial Sequence
  Description of Artificial Sequence: Synthetic oligonucleotide
uugucacucuugaggugg

SEQ ID NO: 32708 - RNA, 18 nt, Artificial Sequence
  Description of Artificial Sequence: Synthetic oligonucleotide
gggcuugucacucuugag

SEQ ID NO: 32709 - RNA, 18 nt, Artificial Sequence
  Description of Artificial Sequence: Synthetic oligonucleotide
ucaggagcuuggucuggg

SEQ ID NO: 32710 - RNA, 18 nt, Artificial Sequence
  Description of Artificial Sequence: Synthetic oligonucleotide
gaggaucaggagcuuggu

SEQ ID NO: 32711 - RNA, 18 nt, Artificial Sequence
  Description of Artificial Sequence: Synthetic oligonucleotide
ugguggaggaucaggagc

SEQ ID NO: 32712 - RNA, 18 nt, Artificial Sequence
  Description of Artificial Sequence: Synthetic oligonucleotide
ccgccugguggaggauca

SEQ ID NO: 32713 - RNA, 18 nt, Artificial Sequence
  Description of Artificial Sequence: Synthetic oligonucleotide
ggccaccgccugguggag

SEQ ID NO: 32714 - RNA, 18 nt, Artificial Sequence
  Description of Artificial Sequence: Synthetic oligonucleotide
augacggccaccgccugg

SEQ ID NO: 32715 - RNA, 18 nt, Artificial Sequence
  Description of Artificial Sequence: Synthetic oligonucleotide
ugaggaugacggccaccg

SEQ ID NO: 32716 - RNA, 18 nt, Artificial Sequence
  Description of Artificial Sequence: Synthetic oligonucleotide
cagacugaggaugacggc

SEQ ID NO: 32717 - RNA, 18 nt, Artificial Sequence
  Description of Artificial Sequence: Synthetic oligonucleotide
ugcuccagacugaggaug

SEQ ID NO: 32718 - RNA, 18 nt, Artificial Sequence
  Description of Artificial Sequence: Synthetic oligonucleotide
cuugcugcuccagacuga

SEQ ID NO: 32719 - RNA, 18 nt, Artificial Sequence
  Description of Artificial Sequence: Synthetic oligonucleotide
ucggacuugcugcuccag

SEQ ID NO: 32720 - RNA, 18 nt, Artificial Sequence
  Description of Artificial Sequence: Synthetic oligonucleotide
guaguccugguggcaugc

SEQ ID NO: 32721 - RNA, 18 nt, Artificial Sequence
  Description of Artificial Sequence: Synthetic oligonucleotide
ccccuguaguccuggugg

SEQ ID NO: 32722 - RNA, 18 nt, Artificial Sequence
  Description of Artificial Sequence: Synthetic oligonucleotide
cucugccccuguaguccu

SEQ ID NO: 32723 - RNA, 18 nt, Artificial Sequence
  Description of Artificial Sequence: Synthetic oligonucleotide
agacacucugccccugua

SEQ ID NO: 32724 - RNA, 18 nt, Artificial Sequence
  Description of Artificial Sequence: Synthetic oligonucleotide
agaggagacacucugccc

SEQ ID NO: 32725 - RNA, 18 nt, Artificial Sequence
  Description of Artificial Sequence: Synthetic oligonucleotide
cugccagaggagacacuc

SEQ ID NO: 32726 - RNA, 18 nt, Artificial Sequence
  Description of Artificial Sequence: Synthetic oligonucleotide
cagagcugccagaggaga

SEQ ID NO: 32727 - RNA, 18 nt, Artificial Sequence
  Description of Artificial Sequence: Synthetic oligonucleotide
gaucucagagcugccaga

SEQ ID NO: 32728 - RNA, 18 nt, Artificial Sequence
  Description of Artificial Sequence: Synthetic oligonucleotide
gauuugaucucagagcug

SEQ ID NO: 32729 - RNA, 18 nt, Artificial Sequence
  Description of Artificial Sequence: Synthetic oligonucleotide
caucggauuugaucucag

SEQ ID NO: 32730 - RNA, 18 nt, Artificial Sequence
  Description of Artificial Sequence: Synthetic oligonucleotide
cucgucaucggauuugau

SEQ ID NO: 32731 - RNA, 18 nt, Artificial Sequence
  Description of Artificial Sequence: Synthetic oligonucleotide
ucacccucgucaucggau

SEQ ID NO: 32732 - RNA, 18 nt, Artificial Sequence
  Description of Artificial Sequence: Synthetic oligonucleotide
ucucaucacccucgucau

SEQ ID NO: 32733 - RNA, 18 nt, Artificial Sequence
  Description of Artificial Sequence: Synthetic oligonucleotide
cagguucucaucacccuc

SEQ ID NO: 32734 - RNA, 18 nt, Artificial Sequence
  Description of Artificial Sequence: Synthetic oligonucleotide
ucuugcagguucucauca

SEQ ID NO: 32735 - RNA, 18 nt, Artificial Sequence
  Description of Artificial Sequence: Synthetic oligonucleotide
ucgugucuugcagguucu

SEQ ID NO: 32736 - RNA, 18 nt, Artificial Sequence
  Description of Artificial Sequence: Synthetic oligonucleotide
agauuucgugucuugcag

SEQ ID NO: 32737 - RNA, 18 nt, Artificial Sequence
  Description of Artificial Sequence: Synthetic oligonucleotide
uccgaagauuucgugucu

SEQ ID NO: 32738 - RNA, 18 nt, Artificial Sequence
  Description of Artificial Sequence: Synthetic oligonucleotide
uguccuccgaagauuucg

SEQ ID NO: 32739 - RNA, 18 nt, Artificial Sequence
  Description of Artificial Sequence: Synthetic oligonucleotide
uuucuuguccuccgaaga

SEQ ID NO: 32740 - RNA, 18 nt, Artificial Sequence
  Description of Artificial Sequence: Synthetic oligonucleotide
ucuaauuucuuguccucc

SEQ ID NO: 32741 - RNA, 18 nt, Artificial Sequence
  Description of Artificial Sequence: Synthetic oligonucleotide
cgucaucuaauuucuugu

SEQ ID NO: 32742 - RNA, 18 nt, Artificial Sequence
  Description of Artificial Sequence: Synthetic oligonucleotide
cuugucgucaucuaauuu

SEQ ID NO: 32743 - RNA, 18 nt, Artificial Sequence
  Description of Artificial Sequence: Synthetic oligonucleotide
uccuucuugucgucaucu

SEQ ID NO: 32744 - RNA, 18 nt, Artificial Sequence
  Description of Artificial Sequence: Synthetic oligonucleotide
ugauauccuucuugucgu

SEQ ID NO: 32745 - RNA, 18 nt, Artificial Sequence
  Description of Artificial Sequence: Synthetic oligonucleotide
ugauuugauauccuucuu

SEQ ID NO: 32746 - RNA, 18 nt, Artificial Sequence
  Description of Artificial Sequence: Synthetic oligonucleotide
guaauugauuugauaucc

SEQ ID NO: 32747 - RNA, 18 nt, Artificial Sequence
  Description of Artificial Sequence: Synthetic oligonucleotide
uauacuguuaccuagauc

SEQ ID NO: 32748 - RNA, 18 nt, Artificial Sequence
  Description of Artificial Sequence: Synthetic oligonucleotide
uauuauauacuguuaccu

SEQ ID NO: 32749 - RNA, 18 nt, Artificial Sequence
  Description of Artificial Sequence: Synthetic oligonucleotide
gacaguauuauauacugu

SEQ ID NO: 32750 - RNA, 18 nt, Artificial Sequence
  Description of Artificial Sequence: Synthetic oligonucleotide
gaagcgacaguauuauau

SEQ ID NO: 32751 - RNA, 18 nt, Artificial Sequence
  Description of Artificial Sequence: Synthetic oligonucleotide
uaaaugaagcgacaguau

SEQ ID NO: 32752 - RNA, 18 nt, Artificial Sequence
  Description of Artificial Sequence: Synthetic oligonucleotide
ggaauuaaaugaagcgac

SEQ ID NO: 32753 - RNA, 18 nt, Artificial Sequence
  Description of Artificial Sequence: Synthetic oligonucleotide
auaaaggaauuaaaugaa

SEQ ID NO: 32754 - RNA, 18 nt, Artificial Sequence
  Description of Artificial Sequence: Synthetic oligonucleotide
guccaauaaaggaauuaa

SEQ ID NO: 32755 - RNA, 18 nt, Artificial Sequence
  Description of Artificial Sequence: Synthetic oligonucleotide
ucaaaguccaauaaagga

SEQ ID NO: 32756 - RNA, 18 nt, Artificial Sequence
  Description of Artificial Sequence: Synthetic oligonucleotide
cuucaucaaaguccaaua

SEQ ID NO: 32757 - RNA, 18 nt, Artificial Sequence
  Description of Artificial Sequence: Synthetic oligonucleotide
guucacuucaucaaaguc

SEQ ID NO: 32758 - RNA, 18 nt, Artificial Sequence
  Description of Artificial Sequence: Synthetic oligonucleotide
guucuguucacuucauca

SEQ ID NO: 32759 - RNA, 18 nt, Artificial Sequence
  Description of Artificial Sequence: Synthetic oligonucleotide
uucccguucuguucacuu

SEQ ID NO: 32760 - RNA, 18 nt, Artificial Sequence
  Description of Artificial Sequence: Synthetic oligonucleotide
guuucuucccguucuguu

SEQ ID NO: 32761 - RNA, 18 nt, Artificial Sequence
  Description of Artificial Sequence: Synthetic oligonucleotide
gaauaguuucuucccguu

SEQ ID NO: 32762 - RNA, 18 nt, Artificial Sequence
  Description of Artificial Sequence: Synthetic oligonucleotide
aaacugaauaguuucuuc

SEQ ID NO: 32763 - RNA, 18 nt, Artificial Sequence
  Description of Artificial Sequence: Synthetic oligonucleotide
ggaaaaaacugaauaguu

SEQ ID NO: 32764 - RNA, 18 nt, Artificial Sequence
  Description of Artificial Sequence: Synthetic oligonucleotide
ugccaggaaaaaacugaa

SEQ ID NO: 32765 - RNA, 18 nt, Artificial Sequence
  Description of Artificial Sequence: Synthetic oligonucleotide
uuaccugccaggaaaaaa

SEQ ID NO: 32766 - RNA, 18 nt, Artificial Sequence
  Description of Artificial Sequence: Synthetic oligonucleotide
uaaauuuaccugccagga

SEQ ID NO: 32767 - RNA, 18 nt, Artificial Sequence
  Description of Artificial Sequence: Synthetic oligonucleotide
agcuguaaauuuaccugc

SEQ ID NO: 32768 - RNA, 18 nt, Artificial Sequence
  Description of Artificial Sequence: Synthetic oligonucleotide
uuuucagcuguaaauuua

SEQ ID NO: 32769 - RNA, 18 nt, Artificial Sequence
  Description of Artificial Sequence: Synthetic oligonucleotide
uuuucuuuucagcuguaa

SEQ ID NO: 32770 - RNA, 18 nt, Artificial Sequence
  Description of Artificial Sequence: Synthetic oligonucleotide
uuuaauuuucuuuucagc

SEQ ID NO: 32771 - RNA, 18 nt, Artificial Sequence
  Description of Artificial Sequence: Synthetic oligonucleotide
aggccuuuaauuuucuuu

SEQ ID NO: 32772 - RNA, 18 nt, Artificial Sequence
  Description of Artificial Sequence: Synthetic oligonucleotide
agaguaggccuuuaauuu

SEQ ID NO: 32773 - RNA, 18 nt, Artificial Sequence
  Description of Artificial Sequence: Synthetic oligonucleotide
cuucuagaguaggccuuu

SEQ ID NO: 32774 - RNA, 18 nt, Artificial Sequence
  Description of Artificial Sequence: Synthetic oligonucleotide
uaguacuucuagaguagg

SEQ ID NO: 32775 - RNA, 18 nt, Artificial Sequence
  Description of Artificial Sequence: Synthetic oligonucleotide
acuuuuaguacuucuaga

SEQ ID NO: 32776 - RNA, 18 nt, Artificial Sequence
  Description of Artificial Sequence: Synthetic oligonucleotide
acgauacuuuuaguacuu

SEQ ID NO: 32777 - RNA, 18 nt, Artificial Sequence
  Description of Artificial Sequence: Synthetic oligonucleotide
cugaaacgauacuuuuag

SEQ ID NO: 32778 - RNA, 18 nt, Artificial Sequence
  Description of Artificial Sequence: Synthetic oligonucleotide
gguaucugaaacgauacu

SEQ ID NO: 32779 - RNA, 18 nt, Artificial Sequence
  Description of Artificial Sequence: Synthetic oligonucleotide
guacagguaucugaaacg

SEQ ID NO: 32780 - RNA, 18 nt, Artificial Sequence
  Description of Artificial Sequence: Synthetic oligonucleotide
auagaguacagguaucug

SEQ ID NO: 32781 - RNA, 18 nt, Artificial Sequence
  Description of Artificial Sequence: Synthetic oligonucleotide
cuccaauagaguacaggu

SEQ ID NO: 32782 - RNA, 18 nt, Artificial Sequence
  Description of Artificial Sequence: Synthetic oligonucleotide
uuaggcuccaauagagua

SEQ ID NO: 32783 - RNA, 18 nt, Artificial Sequence
  Description of Artificial Sequence: Synthetic oligonucleotide
acaguuuaggcuccaaua

SEQ ID NO: 32784 - RNA, 18 nt, Artificial Sequence
  Description of Artificial Sequence: Synthetic oligonucleotide
ccaaaacaguuuaggcuc

SEQ ID NO: 32785 - RNA, 18 nt, Artificial Sequence
  Description of Artificial Sequence: Synthetic oligonucleotide
aaaugccaaaacaguuua

SEQ ID NO: 32786 - RNA, 18 nt, Artificial Sequence
  Description of Artificial Sequence: Synthetic oligonucleotide
uucauaaaugccaaaaca

SEQ ID NO: 32787 - RNA, 18 nt, Artificial Sequence
  Description of Artificial Sequence: Synthetic oligonucleotide
ccagauucauaaaugcca

SEQ ID NO: 32788 - RNA, 18 nt, Artificial Sequence
  Description of Artificial Sequence: Synthetic oligonucleotide
uggguccagauucauaaa

SEQ ID NO: 32789 - RNA, 18 nt, Artificial Sequence
  Description of Artificial Sequence: Synthetic oligonucleotide
agcauuggguccagauuc

SEQ ID NO: 32790 - RNA, 18 nt, Artificial Sequence
  Description of Artificial Sequence: Synthetic oligonucleotide
ucauuagcauugggucca

SEQ ID NO: 32791 - RNA, 18 nt, Artificial Sequence
  Description of Artificial Sequence: Synthetic oligonucleotide
gugugucauuagcauugg

SEQ ID NO: 32792 - RNA, 18 nt, Artificial Sequence
  Description of Artificial Sequence: Synthetic oligonucleotide
ucacugugugucauuagc

SEQ ID NO: 32793 - RNA, 18 nt, Artificial Sequence
  Description of Artificial Sequence: Synthetic oligonucleotide
uuuuuucacuguguguca

SEQ ID NO: 32794 - RNA, 18 nt, Artificial Sequence
  Description of Artificial Sequence: Synthetic oligonucleotide
acaaauuuuuucacugug

SEQ ID NO: 32795 - RNA, 18 nt, Artificial Sequence
  Description of Artificial Sequence: Synthetic oligonucleotide
cagagacaaauuuuuuca

SEQ ID NO: 32796 - RNA, 18 nt, Artificial Sequence
  Description of Artificial Sequence: Synthetic oligonucleotide
ugaaucagagacaaauuu

SEQ ID NO: 32797 - RNA, 18 nt, Artificial Sequence
  Description of Artificial Sequence: Synthetic oligonucleotide
guacuugaaucagagaca

SEQ ID NO: 32798 - RNA, 18 nt, Artificial Sequence
  Description of Artificial Sequence: Synthetic oligonucleotide
aaacuguacuugaaucag

SEQ ID NO: 32799 - RNA, 18 nt, Artificial Sequence
  Description of Artificial Sequence: Synthetic oligonucleotide
caaauaaacuguacuuga

SEQ ID NO: 32800 - RNA, 18 nt, Artificial Sequence
  Description of Artificial Sequence: Synthetic oligonucleotide
uuuuacaaauaaacugua

SEQ ID NO: 32801 - RNA, 18 nt, Artificial Sequence
  Description of Artificial Sequence: Synthetic oligonucleotide
uauaguuuuacaaauaaa

SEQ ID NO: 32802 - RNA, 18 nt, Artificial Sequence
  Description of Artificial Sequence: Synthetic oligonucleotide
auaaguauaguuuuacaa

SEQ ID NO: 32803 - RNA, 18 nt, Artificial Sequence
  Description of Artificial Sequence: Synthetic oligonucleotide
guagaauaaguauaguuu

SEQ ID NO: 32804 - RNA, 18 nt, Artificial Sequence
  Description of Artificial Sequence: Synthetic oligonucleotide
aauuuguagaauaaguau

SEQ ID NO: 32805 - RNA, 18 nt, Artificial Sequence
  Description of Artificial Sequence: Synthetic oligonucleotide
gaccaaauuuguagaaua

SEQ ID NO: 32806 - RNA, 18 nt, Artificial Sequence
  Description of Artificial Sequence: Synthetic oligonucleotide
uuucugaccaaauuugua

SEQ ID NO: 32807 - RNA, 18 nt, Artificial Sequence
  Description of Artificial Sequence: Synthetic oligonucleotide
caacauuucugaccaaau

SEQ ID NO: 32808 - RNA, 18 nt, Artificial Sequence
  Description of Artificial Sequence: Synthetic oligonucleotide
agacacaacauuucugac

SEQ ID NO: 32809 - RNA, 18 nt, Artificial Sequence
  Description of Artificial Sequence: Synthetic oligonucleotide
auuauagacacaacauuu

SEQ ID NO: 32810 - RNA, 18 nt, Artificial Sequence
  Description of Artificial Sequence: Synthetic oligonucleotide
gaaauauuauagacacaa

SEQ ID NO: 32811 - RNA, 18 nt, Artificial Sequence
  Description of Artificial Sequence: Synthetic oligonucleotide
uuuuagaaauauuauaga

SEQ ID NO: 32812 - RNA, 18 nt, Artificial Sequence
  Description of Artificial Sequence: Synthetic oligonucleotide
ucucuuuuuagaaauauu

SEQ ID NO: 32813 - RNA, 18 nt, Artificial Sequence
  Description of Artificial Sequence: Synthetic oligonucleotide
uacaaucucuuuuuagaa

SEQ ID NO: 32814 - RNA, 18 nt, Artificial Sequence
  Description of Artificial Sequence: Synthetic oligonucleotide
auggcuacaaucucuuuu

SEQ ID NO: 32815 - RNA, 18 nt, Artificial Sequence
  Description of Artificial Sequence: Synthetic oligonucleotide
uuaacauggcuacaaucu

SEQ ID NO: 32816 - RNA, 18 nt, Artificial Sequence
  Description of Artificial Sequence: Synthetic oligonucleotide
aguuuuuaacauggcuac

SEQ ID NO: 32817 - RNA, 18 nt, Artificial Sequence
  Description of Artificial Sequence: Synthetic oligonucleotide
aguugaguuuuuaacaug

SEQ ID NO: 32818 - RNA, 18 nt, Artificial Sequence
  Description of Artificial Sequence: Synthetic oligonucleotide
acaucaguugaguuuuua

SEQ ID NO: 32819 - RNA, 18 nt, Artificial Sequence
  Description of Artificial Sequence: Synthetic oligonucleotide
cacauacaucaguugagu

SEQ ID NO: 32820 - RNA, 18 nt, Artificial Sequence
  Description of Artificial Sequence: Synthetic oligonucleotide
guuggcacauacaucagu

SEQ ID NO: 32821 - RNA, 18 nt, Artificial Sequence
  Description of Artificial Sequence: Synthetic oligonucleotide
uuauaguuggcacauaca

SEQ ID NO: 32822 - RNA, 18 nt, Artificial Sequence
  Description of Artificial Sequence: Synthetic oligonucleotide
aagaguuauaguuggcac

SEQ ID NO: 32823 - RNA, 18 nt, Artificial Sequence
  Description of Artificial Sequence: Synthetic oligonucleotide
aagaaaagaguuauaguu

SEQ ID NO: 32824 - RNA, 18 nt, Artificial Sequence
  Description of Artificial Sequence: Synthetic oligonucleotide
gagguaagaaaagaguua

SEQ ID NO: 32825 - RNA, 18 nt, Artificial Sequence
  Description of Artificial Sequence: Synthetic oligonucleotide
cuuuagagguaagaaaag

SEQ ID NO: 32826 - RNA, 18 nt, Artificial Sequence
  Description of Artificial Sequence: Synthetic oligonucleotide
ucuuacuuuagagguaag

SEQ ID NO: 32827 - RNA, 18 nt, Artificial Sequence
  Description of Artificial Sequence: Synthetic oligonucleotide
uauuuucuuacuuuagag

SEQ ID NO: 32828 - RNA, 18 nt, Artificial Sequence
  Description of Artificial Sequence: Synthetic oligonucleotide
gaaauuauuuucuuacuu

SEQ ID NO: 32829 - RNA, 18 nt, Artificial Sequence
  Description of Artificial Sequence: Synthetic oligonucleotide
ucuaggaaauuauuuucu

SEQ ID NO: 32830 - RNA, 18 nt, Artificial Sequence
  Description of Artificial Sequence: Synthetic oligonucleotide
auaaaucuaggaaauuau

SEQ ID NO: 32831 - RNA, 18 nt, Artificial Sequence
  Description of Artificial Sequence: Synthetic oligonucleotide
uuaggauaaaucuaggaa

SEQ ID NO: 32832 - RNA, 18 nt, Artificial Sequence
  Description of Artificial Sequence: Synthetic oligonucleotide
cauguuuaggauaaaucu

SEQ ID NO: 32833 - RNA, 18 nt, Artificial Sequence
  Description of Artificial Sequence: Synthetic oligonucleotide
aucagcauguuuaggaua

SEQ ID NO: 32834 - RNA, 18 nt, Artificial Sequence
  Description of Artificial Sequence: Synthetic oligonucleotide
uauacaucagcauguuua

SEQ ID NO: 32835 - RNA, 18 nt, Artificial Sequence
  Description of Artificial Sequence: Synthetic oligonucleotide
ucuuauauacaucagcau

SEQ ID NO: 32836 - RNA, 18 nt, Artificial Sequence
  Description of Artificial Sequence: Synthetic oligonucleotide
auuacucuuauauacauc

SEQ ID NO: 32837 - RNA, 18 nt, Artificial Sequence
  Description of Artificial Sequence: Synthetic oligonucleotide
aagguauuacucuuauau

SEQ ID NO: 32838 - RNA, 18 nt, Artificial Sequence
  Description of Artificial Sequence: Synthetic oligonucleotide
caauuaagguauuacucu

SEQ ID NO: 32839 - RNA, 18 nt, Artificial Sequence
  Description of Artificial Sequence: Synthetic oligonucleotide
auaaacaauuaagguauu

SEQ ID NO: 32840 - RNA, 18 nt, Artificial Sequence
  Description of Artificial Sequence: Synthetic oligonucleotide
aaaccauaaacaauuaag

SEQ ID NO: 32841 - RNA, 18 nt, Artificial Sequence
  Description of Artificial Sequence: Synthetic oligonucleotide
aagaaaaaccauaaacaa

SEQ ID NO: 32842 - RNA, 18 nt, Artificial Sequence
  Description of Artificial Sequence: Synthetic oligonucleotide
ccaggaagaaaaaccaua

SEQ ID NO: 32843 - RNA, 18 nt, Artificial Sequence
  Description of Artificial Sequence: Synthetic oligonucleotide
aguguccaggaagaaaaa

SEQ ID NO: 32844 - RNA, 18 nt, Artificial Sequence
  Description of Artificial Sequence: Synthetic oligonucleotide
aaaagaguguccaggaag

SEQ ID NO: 32845 - RNA, 18 nt, Artificial Sequence
  Description of Artificial Sequence: Synthetic oligonucleotide
uguagaaaagagugucca

SEQ ID NO: 32846 - RNA, 18 nt, Artificial Sequence
  Description of Artificial Sequence: Synthetic oligonucleotide
caaaaaaauacaaggcag

SEQ ID NO: 32847 - RNA, 18 nt, Artificial Sequence
  Description of Artificial Sequence: Synthetic oligonucleotide
uaggucaaaaaaauacaa

SEQ ID NO: 32848 - RNA, 18 nt, Artificial Sequence
  Description of Artificial Sequence: Synthetic oligonucleotide
uuugauaggucaaaaaaa

SEQ ID NO: 32849 - RNA, 18 nt, Artificial Sequence
  Description of Artificial Sequence: Synthetic oligonucleotide
augauuuugauaggucaa

SEQ ID NO: 32850 - RNA, 18 nt, Artificial Sequence
  Description of Artificial Sequence: Synthetic oligonucleotide
gaaaaaugauuuugauag

SEQ ID NO: 32851 - RNA, 18 nt, Artificial Sequence
  Description of Artificial Sequence: Synthetic oligonucleotide
uaauugaaaaaugauuuu

SEQ ID NO: 32852 - RNA, 18 nt, Artificial Sequence
  Description of Artificial Sequence: Synthetic oligonucleotide
acaaguaauugaaaaaug

SEQ ID NO: 32853 - RNA, 18 nt, Artificial Sequence
  Description of Artificial Sequence: Synthetic oligonucleotide
gggaaacaaguaauugaa

SEQ ID NO: 32854 - RNA, 18 nt, Artificial Sequence
  Description of Artificial Sequence: Synthetic oligonucleotide
gacaucugaaaucuaggg

SEQ ID NO: 32855 - RNA, 18 nt, Artificial Sequence
  Description of Artificial Sequence: Synthetic oligonucleotide
ccgugacaucugaaaucu

SEQ ID NO: 32856 - RNA, 18 nt, Artificial Sequence
  Description of Artificial Sequence: Synthetic oligonucleotide
ucauaccgugacaucuga

SEQ ID NO: 32857 - RNA, 18 nt, Artificial Sequence
  Description of Artificial Sequence: Synthetic oligonucleotide
accuuucauaccgugaca

SEQ ID NO: 32858 - RNA, 18 nt, Artificial Sequence
  Description of Artificial Sequence: Synthetic oligonucleotide
auaaaaccuuucauaccg

SEQ ID NO: 32859 - RNA, 18 nt, Artificial Sequence
  Description of Artificial Sequence: Synthetic oligonucleotide
uauauauaaaaccuuuca

SEQ ID NO: 32860 - RNA, 18 nt, Artificial Sequence
  Description of Artificial Sequence: Synthetic oligonucleotide
uuaaauauauauaaaacc

SEQ ID NO: 32861 - RNA, 18 nt, Artificial Sequence
  Description of Artificial Sequence: Synthetic oligonucleotide
auuuuuuaaauauauaua

SEQ ID NO: 32862 - RNA, 18 nt, Artificial Sequence
  Description of Artificial Sequence: Synthetic oligonucleotide
acuuuauuuuuuaaauau

SEQ ID NO: 32863 - RNA, 18 nt, Artificial Sequence
  Description of Artificial Sequence: Synthetic oligonucleotide
uuuauacuuuauuuuuua

SEQ ID NO: 32864 - RNA, 18 nt, Artificial Sequence
  Description of Artificial Sequence: Synthetic oligonucleotide
uuauguuuauacuuuauu

SEQ ID NO: 32865 - RNA, 18 nt, Artificial Sequence
  Description of Artificial Sequence: Synthetic oligonucleotide
agacuuuauguuuauacu

SEQ ID NO: 32866 - RNA, 18 nt, Artificial Sequence
  Description of Artificial Sequence: Synthetic oligonucleotide
caaaaagacuuuauguuu

SEQ ID NO: 32867 - RNA, 18 nt, Artificial Sequence
  Description of Artificial Sequence: Synthetic oligonucleotide
cgcuucaaaaagacuuua

SEQ ID NO: 32868 - RNA, 18 nt, Artificial Sequence
  Description of Artificial Sequence: Synthetic oligonucleotide
aaccacgcuucaaaaaga

SEQ ID NO: 32869 - RNA, 18 nt, Artificial Sequence
  Description of Artificial Sequence: Synthetic oligonucleotide
ugcauaaccacgcuucaa

SEQ ID NO: 32870 - RNA, 18 nt, Artificial Sequence
  Description of Artificial Sequence: Synthetic oligonucleotide
uauguugcauaaccacgc

SEQ ID NO: 32871 - RNA, 18 nt, Artificial Sequence
  Description of Artificial Sequence: Synthetic oligonucleotide
uagcauauguugcauaac

SEQ ID NO: 32872 - RNA, 18 nt, Artificial Sequence
  Description of Artificial Sequence: Synthetic oligonucleotide
acgccuagcauauguugc

SEQ ID NO: 32873 - RNA, 18 nt, Artificial Sequence
  Description of Artificial Sequence: Synthetic oligonucleotide
aacuuacgccuagcauau

SEQ ID NO: 32874 - RNA, 18 nt, Artificial Sequence
  Description of Artificial Sequence: Synthetic oligonucleotide
ucaccaacuuacgccuag

SEQ ID NO: 32875 - RNA, 18 nt, Artificial Sequence
  Description of Artificial Sequence: Synthetic oligonucleotide
ggcauucaccaacuuacg

SEQ ID NO: 32876 - RNA, 18 nt, Artificial Sequence
  Description of Artificial Sequence: Synthetic oligonucleotide
aagcaggcauucaccaac

SEQ ID NO: 32877 - RNA, 18 nt, Artificial Sequence
  Description of Artificial Sequence: Synthetic oligonucleotide
cugcaaagcaggcauuca

SEQ ID NO: 32878 - RNA, 18 nt, Artificial Sequence
  Description of Artificial Sequence: Synthetic oligonucleotide
acacucugcaaagcaggc

SEQ ID NO: 32879 - RNA, 18 nt, Artificial Sequence
  Description of Artificial Sequence: Synthetic oligonucleotide
ggguuacacucugcaaag

SEQ ID NO: 32880 - RNA, 18 nt, Artificial Sequence
  Description of Artificial Sequence: Synthetic oligonucleotide
cuuuuuuuauucaauggg

SEQ ID NO: 32881 - RNA, 18 nt, Artificial Sequence
  Description of Artificial Sequence: Synthetic oligonucleotide
gcuuuuuuuauucaaugg

SEQ ID NO: 32882 - RNA, 18 nt, Artificial Sequence
  Description of Artificial Sequence: Synthetic oligonucleotide
acaaagcuuuuuuuauuc

SEQ ID NO: 32883 - RNA, 18 nt, Artificial Sequence
  Description of Artificial Sequence: Synthetic oligonucleotide
ggaaaacaaagcuuuuuu

SEQ ID NO: 32884 - RNA, 18 nt, Artificial Sequence
  Description of Artificial Sequence: Synthetic oligonucleotide
gaaagggaaaacaaagcu

SEQ ID NO: 32885 - RNA, 18 nt, Artificial Sequence
  Description of Artificial Sequence: Synthetic oligonucleotide
gggcagaaagggaaaaca

SEQ ID NO: 32886 - RNA, 18 nt, Artificial Sequence
  Description of Artificial Sequence: Synthetic oligonucleotide
gcccauacugauacaggg

SEQ ID NO: 32887 - RNA, 18 nt, Artificial Sequence
  Description of Artificial Sequence: Synthetic oligonucleotide
ugcccauacugauacagg

SEQ ID NO: 32888 - RNA, 18 nt, Artificial Sequence
  Description of Artificial Sequence: Synthetic oligonucleotide
gggugugcccauacugau

SEQ ID NO: 32889 - RNA, 18 nt, Artificial Sequence
  Description of Artificial Sequence: Synthetic oligonucleotide
gugcagggugugcccaua

SEQ ID NO: 32890 - RNA, 18 nt, Artificial Sequence
  Description of Artificial Sequence: Synthetic oligonucleotide
uuagagugcagggugugc

SEQ ID NO: 32891 - RNA, 18 nt, Artificial Sequence
  Description of Artificial Sequence: Synthetic oligonucleotide
uaaaguuagagugcaggg

SEQ ID NO: 32892 - RNA, 18 nt, Artificial Sequence
  Description of Artificial Sequence: Synthetic oligonucleotide
uagauuaaaguuagagug

SEQ ID NO: 32893 - RNA, 18 nt, Artificial Sequence
  Description of Artificial Sequence: Synthetic oligonucleotide
ugacguagauuaaaguua

SEQ ID NO: 32894 - RNA, 18 nt, Artificial Sequence
  Description of Artificial Sequence: Synthetic oligonucleotide
gagggugacguagauuaa

SEQ ID NO: 32895 - RNA, 18 nt, Artificial Sequence
  Description of Artificial Sequence: Synthetic oligonucleotide
caggugagggugacguag

SEQ ID NO: 32896 - RNA, 18 nt, Artificial Sequence
  Description of Artificial Sequence: Synthetic oligonucleotide
ccaaacaggugaggguga

SEQ ID NO: 32897 - RNA, 18 nt, Artificial Sequence
  Description of Artificial Sequence: Synthetic oligonucleotide
ccaaaccaaacaggugag

SEQ ID NO: 32898 - RNA, 18 nt, Artificial Sequence
  Description of Artificial Sequence: Synthetic oligonucleotide
uaaacccaaaccaaacag

SEQ ID NO: 32899 - RNA, 18 nt, Artificial Sequence
  Description of Artificial Sequence: Synthetic oligonucleotide
gacauuaaacccaaacca

SEQ ID NO: 32900 - RNA, 18 nt, Artificial Sequence
  Description of Artificial Sequence: Synthetic oligonucleotide
ucgcagacauuaaaccca

SEQ ID NO: 32901 - RNA, 18 nt, Artificial Sequence
  Description of Artificial Sequence: Synthetic oligonucleotide
uuuucucgcagacauuaa

SEQ ID NO: 32902 - RNA, 18 nt, Artificial Sequence
  Description of Artificial Sequence: Synthetic oligonucleotide
uuugguuuucucgcagac

SEQ ID NO: 32903 - RNA, 18 nt, Artificial Sequence
  Description of Artificial Sequence: Synthetic oligonucleotide
agauauuugguuuucucg

SEQ ID NO: 32904 - RNA, 18 nt, Artificial Sequence
  Description of Artificial Sequence: Synthetic oligonucleotide
acacaagauauuugguuu

SEQ ID NO: 32905 - RNA, 18 nt, Artificial Sequence
  Description of Artificial Sequence: Synthetic oligonucleotide
acaauacacaagauauuu

SEQ ID NO: 32906 - RNA, 18 nt, Artificial Sequence
  Description of Artificial Sequence: Synthetic oligonucleotide
aguucacaauacacaaga

SEQ ID NO: 32907 - RNA, 18 nt, Artificial Sequence
  Description of Artificial Sequence: Synthetic oligonucleotide
uugacaguucacaauaca

SEQ ID NO: 32908 - RNA, 18 nt, Artificial Sequence
  Description of Artificial Sequence: Synthetic oligonucleotide
uggcuuugacaguucaca

SEQ ID NO: 32909 - RNA, 18 nt, Artificial Sequence
  Description of Artificial Sequence: Synthetic oligonucleotide
uuagauggcuuugacagu

SEQ ID NO: 32910 - RNA, 18 nt, Artificial Sequence
  Description of Artificial Sequence: Synthetic oligonucleotide
uugguuuagauggcuuug

SEQ ID NO: 32911 - RNA, 18 nt, Artificial Sequence
  Description of Artificial Sequence: Synthetic oligonucleotide
ugggauugguuuagaugg

SEQ ID NO: 32912 - RNA, 18 nt, Artificial Sequence
  Description of Artificial Sequence: Synthetic oligonucleotide
gaccuugggauugguuua

SEQ ID NO: 32913 - RNA, 18 nt, Artificial Sequence
  Description of Artificial Sequence: Synthetic oligonucleotide
cacuugaccuugggauug

SEQ ID NO: 32914 - RNA, 18 nt, Artificial Sequence
  Description of Artificial Sequence: Synthetic oligonucleotide
auauccacuugaccuugg

SEQ ID NO: 32915 - RNA, 18 nt, Artificial Sequence
  Description of Artificial Sequence: Synthetic oligonucleotide
uuuuuauauccacuugac

SEQ ID NO: 32916 - RNA, 18 nt, Artificial Sequence
  Description of Artificial Sequence: Synthetic oligonucleotide
cagaauuuuuauauccac

SEQ ID NO: 32917 - RNA, 18 nt, Artificial Sequence
  Description of Artificial Sequence: Synthetic oligonucleotide
uuuggcagaauuuuuaua

SEQ ID NO: 32918 - RNA, 18 nt, Artificial Sequence
  Description of Artificial Sequence: Synthetic oligonucleotide
auguuuuuggcagaauuu

SEQ ID NO: 32919 - RNA, 18 nt, Artificial Sequence
  Description of Artificial Sequence: Synthetic oligonucleotide
augccauguuuuuggcag

SEQ ID NO: 32920 - RNA, 18 nt, Artificial Sequence
  Description of Artificial Sequence: Synthetic oligonucleotide
aucuuaugccauguuuuu

SEQ ID NO: 32921 - RNA, 18 nt, Artificial Sequence
  Description of Artificial Sequence: Synthetic oligonucleotide
uuuccaucuuaugccaug

SEQ ID NO: 32922 - RNA, 18 nt, Artificial Sequence
  Description of Artificial Sequence: Synthetic oligonucleotide
gaacuuuuccaucuuaug

SEQ ID NO: 32923 - RNA, 18 nt, Artificial Sequence
  Description of Artificial Sequence: Synthetic oligonucleotide
ucagggaacuuuuccauc

SEQ ID NO: 32924 - RNA, 18 nt, Artificial Sequence
  Description of Artificial Sequence: Synthetic oligonucleotide
aguuuucagggaacuuuu

SEQ ID NO: 32925 - RNA, 18 nt, Artificial Sequence
  Description of Artificial Sequence: Synthetic oligonucleotide
uccagaguuuucagggaa

SEQ ID NO: 32926 - RNA, 18 nt, Artificial Sequence
  Description of Artificial Sequence: Synthetic oligonucleotide
uuucuuccagaguuuuca

SEQ ID NO: 32927 - RNA, 18 nt, Artificial Sequence
  Description of Artificial Sequence: Synthetic oligonucleotide
uuuguuuucuuccagagu

SEQ ID NO: 32928 - RNA, 18 nt, Artificial Sequence
  Description of Artificial Sequence: Synthetic oligonucleotide
auuacuuuguuuucuucc

SEQ ID NO: 32929 - RNA, 18 nt, Artificial Sequence
  Description of Artificial Sequence: Synthetic oligonucleotide
ucuacauuacuuuguuuu

SEQ ID NO: 32930 - RNA, 18 nt, Artificial Sequence
  Description of Artificial Sequence: Synthetic oligonucleotide
aggugucuacauuacuuu

SEQ ID NO: 32931 - RNA, 18 nt, Artificial Sequence
  Description of Artificial Sequence: Synthetic oligonucleotide
aaagaaggugucuacauu

SEQ ID NO: 32932 - RNA, 18 nt, Artificial Sequence
  Description of Artificial Sequence: Synthetic oligonucleotide
gggaaaaagaaggugucu

SEQ ID NO: 32933 - RNA, 18 nt, Artificial Sequence
  Description of Artificial Sequence: Synthetic oligonucleotide
auuuucuaaugguguggg

SEQ ID NO: 32934 - RNA, 18 nt, Artificial Sequence
  Description of Artificial Sequence: Synthetic oligonucleotide
aacauuuucuaauggugu

SEQ ID NO: 32935 - RNA, 18 nt, Artificial Sequence
  Description of Artificial Sequence: Synthetic oligonucleotide
gaugcaacauuuucuaau

SEQ ID NO: 32936 - RNA, 18 nt, Artificial Sequence
  Description of Artificial Sequence: Synthetic oligonucleotide
guccucaucgucauuauu

SEQ ID NO: 32937 - RNA, 18 nt, Artificial Sequence
  Description of Artificial Sequence: Synthetic oligonucleotide
gucagguccucaucguca

SEQ ID NO: 32938 - RNA, 18 nt, Artificial Sequence
  Description of Artificial Sequence: Synthetic oligonucleotide
cuggugucagguccucau

SEQ ID NO: 32939 - RNA, 18 nt, Artificial Sequence
  Description of Artificial Sequence: Synthetic oligonucleotide
cugcucuggugucagguc

SEQ ID NO: 32940 - RNA, 18 nt, Artificial Sequence
  Description of Artificial Sequence: Synthetic oligonucleotide
gccuucugcucugguguc

SEQ ID NO: 32941 - RNA, 18 nt, Artificial Sequence
  Description of Artificial Sequence: Synthetic oligonucleotide
gcucugccuucugcucug

SEQ ID NO: 32942 - RNA, 18 nt, Artificial Sequence
  Description of Artificial Sequence: Synthetic oligonucleotide
cucacgcucugccuucug

SEQ ID NO: 32943 - RNA, 18 nt, Artificial Sequence
  Description of Artificial Sequence: Synthetic oligonucleotide
uccuucucacgcucugcc

SEQ ID NO: 32944 - RNA, 18 nt, Artificial Sequence
  Description of Artificial Sequence: Synthetic oligonucleotide
uccgcuccuucucacgcu

SEQ ID NO: 32945 - RNA, 18 nt, Artificial Sequence
  Description of Artificial Sequence: Synthetic oligonucleotide
cauccuccgcuccuucuc

SEQ ID NO: 32946 - RNA, 18 nt, Artificial Sequence
  Description of Artificial Sequence: Synthetic oligonucleotide
uuggccauccuccgcucc

SEQ ID NO: 32947 - RNA, 18 nt, Artificial Sequence
  Description of Artificial Sequence: Synthetic oligonucleotide
cauuguuggccauccucc

SEQ ID NO: 32948 - RNA, 18 nt, Artificial Sequence
  Description of Artificial Sequence: Synthetic oligonucleotide
ucgggcauuguuggccau

SEQ ID NO: 32949 - RNA, 18 nt, Artificial Sequence
  Description of Artificial Sequence: Synthetic oligonucleotide
cgcucucgggcauuguug

SEQ ID NO: 32950 - RNA, 18 nt, Artificial Sequence
  Description of Artificial Sequence: Synthetic oligonucleotide
gcagacgcucucgggcau

SEQ ID NO: 32951 - RNA, 18 nt, Artificial Sequence
  Description of Artificial Sequence: Synthetic oligonucleotide
gacccgcagacgcucucg

SEQ ID NO: 32952 - RNA, 18 nt, Artificial Sequence
  Description of Artificial Sequence: Synthetic oligonucleotide
ucacggacccgcagacgc

SEQ ID NO: 32953 - RNA, 18 nt, Artificial Sequence
  Description of Artificial Sequence: Synthetic oligonucleotide
ugaugucacggacccgca

SEQ ID NO: 32954 - RNA, 18 nt, Artificial Sequence
  Description of Artificial Sequence: Synthetic oligonucleotide
cucguugaugucacggac

SEQ ID NO: 32955 - RNA, 18 nt, Artificial Sequence
  Description of Artificial Sequence: Synthetic oligonucleotide
aaagccucguugauguca

SEQ ID NO: 32956 - RNA, 18 nt, Artificial Sequence
  Description of Artificial Sequence: Synthetic oligonucleotide
cuuugaaagccucguuga

SEQ ID NO: 32957 - RNA, 18 nt, Artificial Sequence
  Description of Artificial Sequence: Synthetic oligonucleotide
gagcucuuugaaagccuc

SEQ ID NO: 32958 - RNA, 18 nt, Artificial Sequence
  Description of Artificial Sequence: Synthetic oligonucleotide
cggccgagcucuuugaaa

SEQ ID NO: 32959 - RNA, 18 nt, Artificial Sequence
  Description of Artificial Sequence: Synthetic oligonucleotide
ccaugcggccgagcucuu

SEQ ID NO: 32960 - RNA, 18 nt, Artificial Sequence
  Description of Artificial Sequence: Synthetic oligonucleotide
cugcaccaugcggccgag

SEQ ID NO: 32961 - RNA, 18 nt, Artificial Sequence
  Description of Artificial Sequence: Synthetic oligonucleotide
uggagcugcaccaugcgg

SEQ ID NO: 32962 - RNA, 18 nt, Artificial Sequence
  Description of Artificial Sequence: Synthetic oligonucleotide
ugagguggagcugcacca

SEQ ID NO: 32963 - RNA, 18 nt, Artificial Sequence
  Description of Artificial Sequence: Synthetic oligonucleotide
acucuugagguggagcug

SEQ ID NO: 32964 - RNA, 18 nt, Artificial Sequence
  Description of Artificial Sequence: Synthetic oligonucleotide
uugucacucuugaggugg

SEQ ID NO: 32965 - RNA, 18 nt, Artificial Sequence
  Description of Artificial Sequence: Synthetic oligonucleotide
gggcuugucacucuugag

SEQ ID NO: 32966 - RNA, 18 nt, Artificial Sequence
  Description of Artificial Sequence: Synthetic oligonucleotide
ucaggagcuuggucuggg

SEQ ID NO: 32967 - RNA, 18 nt, Artificial Sequence
  Description of Artificial Sequence: Synthetic oligonucleotide
gaggaucaggagcuuggu

SEQ ID NO: 32968 - RNA, 18 nt, Artificial Sequence
  Description of Artificial Sequence: Synthetic oligonucleotide
ugguggaggaucaggagc

SEQ ID NO: 32969 - RNA, 18 nt, Artificial Sequence
  Description of Artificial Sequence: Synthetic oligonucleotide
ccgccugguggaggauca

SEQ ID NO: 32970 - RNA, 18 nt, Artificial Sequence
  Description of Artificial Sequence: Synthetic oligonucleotide
ggccaccgccugguggag

SEQ ID NO: 32971 - RNA, 18 nt, Artificial Sequence
  Description of Artificial Sequence: Synthetic oligonucleotide
augacggccaccgccugg

SEQ ID NO: 32972 - RNA, 18 nt, Artificial Sequence
  Description of Artificial Sequence: Synthetic oligonucleotide
ugaggaugacggccaccg

SEQ ID NO: 32973 - RNA, 18 nt, Artificial Sequence
  Description of Artificial Sequence: Synthetic oligonucleotide
cagacugaggaugacggc

SEQ ID NO: 32974 - RNA, 18 nt, Artificial Sequence
  Description of Artificial Sequence: Synthetic oligonucleotide
ugcuccagacugaggaug

SEQ ID NO: 32975 - RNA, 18 nt, Artificial Sequence
  Description of Artificial Sequence: Synthetic oligonucleotide
cuugcugcuccagacuga

SEQ ID NO: 32976 - RNA, 18 nt, Artificial Sequence
  Description of Artificial Sequence: Synthetic oligonucleotide
ucggacuugcugcuccag

SEQ ID NO: 32977 - RNA, 18 nt, Artificial Sequence
  Description of Artificial Sequence: Synthetic oligonucleotide
cuguaguccugguggcau

SEQ ID NO: 32978 - RNA, 18 nt, Artificial Sequence
  Description of Artificial Sequence: Synthetic oligonucleotide
ugccccuguaguccuggu

SEQ ID NO: 32979 - RNA, 18 nt, Artificial Sequence
  Description of Artificial Sequence: Synthetic oligonucleotide
cacucugccccuguaguc

SEQ ID NO: 32980 - RNA, 18 nt, Artificial Sequence
  Description of Artificial Sequence: Synthetic oligonucleotide
ggagacacucugccccug

SEQ ID NO: 32981 - RNA, 18 nt, Artificial Sequence
  Description of Artificial Sequence: Synthetic oligonucleotide
ccagaggagacacucugc

SEQ ID NO: 32982 - RNA, 18 nt, Artificial Sequence
  Description of Artificial Sequence: Synthetic oligonucleotide
agcugccagaggagacac

SEQ ID NO: 32983 - RNA, 18 nt, Artificial Sequence
  Description of Artificial Sequence: Synthetic oligonucleotide
cucagagcugccagagga

SEQ ID NO: 32984 - RNA, 18 nt, Artificial Sequence
  Description of Artificial Sequence: Synthetic oligonucleotide
uugaucucagagcugcca

SEQ ID NO: 32985 - RNA, 18 nt, Artificial Sequence
  Description of Artificial Sequence: Synthetic oligonucleotide
cggauuugaucucagagc

SEQ ID NO: 32986 - RNA, 18 nt, Artificial Sequence
  Description of Artificial Sequence: Synthetic oligonucleotide
gucaucggauuugaucuc

SEQ ID NO: 32987 - RNA, 18 nt, Artificial Sequence
  Description of Artificial Sequence: Synthetic oligonucleotide
cccucgucaucggauuug

SEQ ID NO: 32988 - RNA, 18 nt, Artificial Sequence
  Description of Artificial Sequence: Synthetic oligonucleotide
caucacccucgucaucgg

SEQ ID NO: 32989 - RNA, 18 nt, Artificial Sequence
  Description of Artificial Sequence: Synthetic oligonucleotide
guucucaucacccucguc

SEQ ID NO: 32990 - RNA, 18 nt, Artificial Sequence
  Description of Artificial Sequence: Synthetic oligonucleotide
ugcagguucucaucaccc

SEQ ID NO: 32991 - RNA, 18 nt, Artificial Sequence
  Description of Artificial Sequence: Synthetic oligonucleotide
ugucuugcagguucucau

SEQ ID NO: 32992 - RNA, 18 nt, Artificial Sequence
  Description of Artificial Sequence: Synthetic oligonucleotide
uuucgugucuugcagguu

SEQ ID NO: 32993 - RNA, 18 nt, Artificial Sequence
  Description of Artificial Sequence: Synthetic oligonucleotide
gaagauuucgugucuugc

SEQ ID NO: 32994 - RNA, 18 nt, Artificial Sequence
  Description of Artificial Sequence: Synthetic oligonucleotide
ccuccgaagauuucgugu

SEQ ID NO: 32995 - RNA, 18 nt, Artificial Sequence
  Description of Artificial Sequence: Synthetic oligonucleotide
cuuguccuccgaagauuu

SEQ ID NO: 32996 - RNA, 18 nt, Artificial Sequence
  Description of Artificial Sequence: Synthetic oligonucleotide
aauuucuuguccuccgaa

SEQ ID NO: 32997 - RNA, 18 nt, Artificial Sequence
  Description of Artificial Sequence: Synthetic oligonucleotide
caucuaauuucuuguccu

SEQ ID NO: 32998 - RNA, 18 nt, Artificial Sequence
  Description of Artificial Sequence: Synthetic oligonucleotide
gucgucaucuaauuucuu

SEQ ID NO: 32999 - RNA, 18 nt, Artificial Sequence
  Description of Artificial Sequence: Synthetic oligonucleotide
uucuugucgucaucuaau

SEQ ID NO: 33000 - RNA, 18 nt, Artificial Sequence
  Description of Artificial Sequence: Synthetic oligonucleotide
uauccuucuugucgucau

SEQ ID NO: 33001 - RNA, 18 nt, Artificial Sequence
  Description of Artificial Sequence: Synthetic oligonucleotide
uuugauauccuucuuguc

SEQ ID NO: 33002 - RNA, 18 nt, Artificial Sequence
  Description of Artificial Sequence: Synthetic oligonucleotide
auugauuugauauccuuc

SEQ ID NO: 33003 - RNA, 18 nt, Artificial Sequence
  Description of Artificial Sequence: Synthetic oligonucleotide
uaguaauugauuugauau

SEQ ID NO: 33004 - RNA, 18 nt, Artificial Sequence
  Description of Artificial Sequence: Synthetic oligonucleotide
ugaccuaguaauugauuu

SEQ ID NO: 33005 - RNA, 18 nt, Artificial Sequence
  Description of Artificial Sequence: Synthetic oligonucleotide
gaucuugaccuaguaauu

SEQ ID NO: 33006 - RNA, 18 nt, Artificial Sequence
  Description of Artificial Sequence: Synthetic oligonucleotide
gcgacaguauuauauacu

SEQ ID NO: 33007 - RNA, 18 nt, Artificial Sequence
  Description of Artificial Sequence: Synthetic oligonucleotide
augaagcgacaguauuau

SEQ ID NO: 33008 - RNA, 18 nt, Artificial Sequence
  Description of Artificial Sequence: Synthetic oligonucleotide
auuaaaugaagcgacagu

SEQ ID NO: 33009 - RNA, 18 nt, Artificial Sequence
  Description of Artificial Sequence: Synthetic oligonucleotide
aaggaauuaaaugaagcg

SEQ ID NO: 33010 - RNA, 18 nt, Artificial Sequence
  Description of Artificial Sequence: Synthetic oligonucleotide
caauaaaggaauuaaaug

SEQ ID NO: 33011 - RNA, 18 nt, Artificial Sequence
  Description of Artificial Sequence: Synthetic oligonucleotide
aaguccaauaaaggaauu

SEQ ID NO: 33012 - RNA, 18 nt, Artificial Sequence
  Description of Artificial Sequence: Synthetic oligonucleotide
caucaaaguccaauaaag

SEQ ID NO: 33013 - RNA, 18 nt, Artificial Sequence
  Description of Artificial Sequence: Synthetic oligonucleotide
cacuucaucaaaguccaa

SEQ ID NO: 33014 - RNA, 18 nt, Artificial Sequence
  Description of Artificial Sequence: Synthetic oligonucleotide
cuguucacuucaucaaag

SEQ ID NO: 33015 - RNA, 18 nt, Artificial Sequence
  Description of Artificial Sequence: Synthetic oligonucleotide
ccguucuguucacuucau

SEQ ID NO: 33016 - RNA, 18 nt, Artificial Sequence
  Description of Artificial Sequence: Synthetic oligonucleotide
ucuucccguucuguucac

SEQ ID NO: 33017 - RNA, 18 nt, Artificial Sequence
  Description of Artificial Sequence: Synthetic oligonucleotide
uaguuucuucccguucug

SEQ ID NO: 33018 - RNA, 18 nt, Artificial Sequence
  Description of Artificial Sequence: Synthetic oligonucleotide
cugaauaguuucuucccg

SEQ ID NO: 33019 - RNA, 18 nt, Artificial Sequence
  Description of Artificial Sequence: Synthetic oligonucleotide
aaaaacugaauaguuucu

SEQ ID NO: 33020 - RNA, 18 nt, Artificial Sequence
  Description of Artificial Sequence: Synthetic oligonucleotide
caggaaaaaacugaauag

SEQ ID NO: 33021 - RNA, 18 nt, Artificial Sequence
  Description of Artificial Sequence: Synthetic oligonucleotide
ccugccaggaaaaaacug

SEQ ID NO: 33022 - RNA, 18 nt, Artificial Sequence
  Description of Artificial Sequence: Synthetic oligonucleotide
auuuaccugccaggaaaa

SEQ ID NO: 33023 - RNA, 18 nt, Artificial Sequence
  Description of Artificial Sequence: Synthetic oligonucleotide
uguaaauuuaccugccag

SEQ ID NO: 33024 - RNA, 18 nt, Artificial Sequence
  Description of Artificial Sequence: Synthetic oligonucleotide
ucagcuguaaauuuaccu

SEQ ID NO: 33025 - RNA, 18 nt, Artificial Sequence
  Description of Artificial Sequence: Synthetic oligonucleotide
ucuuuucagcuguaaauu

SEQ ID NO: 33026 - RNA, 18 nt, Artificial Sequence
  Description of Artificial Sequence: Synthetic oligonucleotide
aauuuucuuuucagcugu

SEQ ID NO: 33027 - RNA, 18 nt, Artificial Sequence
  Description of Artificial Sequence: Synthetic oligonucleotide
ccuuuaauuuucuuuuca

SEQ ID NO: 33028 - RNA, 18 nt, Artificial Sequence
  Description of Artificial Sequence: Synthetic oligonucleotide
guaggccuuuaauuuucu

SEQ ID NO: 33029 - RNA, 18 nt, Artificial Sequence
  Description of Artificial Sequence: Synthetic oligonucleotide
cuagaguaggccuuuaau

SEQ ID NO: 33030 - RNA, 18 nt, Artificial Sequence
  Description of Artificial Sequence: Synthetic oligonucleotide
uacuucuagaguaggccu

SEQ ID NO: 33031 - RNA, 18 nt, Artificial Sequence
  Description of Artificial Sequence: Synthetic oligonucleotide
uuuaguacuucuagagua

SEQ ID NO: 33032 - RNA, 18 nt, Artificial Sequence
  Description of Artificial Sequence: Synthetic oligonucleotide
auacuuuuaguacuucua

SEQ ID NO: 33033 - RNA, 18 nt, Artificial Sequence
  Description of Artificial Sequence: Synthetic oligonucleotide
aaacgauacuuuuaguac

SEQ ID NO: 33034 - RNA, 18 nt, Artificial Sequence
  Description of Artificial Sequence: Synthetic oligonucleotide
aucugaaacgauacuuuu

SEQ ID NO: 33035 - RNA, 18 nt, Artificial Sequence
  Description of Artificial Sequence: Synthetic oligonucleotide
cagguaucugaaacgaua

SEQ ID NO: 33036 - RNA, 18 nt, Artificial Sequence
  Description of Artificial Sequence: Synthetic oligonucleotide
gaguacagguaucugaaa

SEQ ID NO: 33037 - RNA, 18 nt, Artificial Sequence
  Description of Artificial Sequence: Synthetic oligonucleotide
caauagaguacagguauc

SEQ ID NO: 33038 - RNA, 18 nt, Artificial Sequence
  Description of Artificial Sequence: Synthetic oligonucleotide
ggcuccaauagaguacag

SEQ ID NO: 33039 - RNA, 18 nt, Artificial Sequence
  Description of Artificial Sequence: Synthetic oligonucleotide
guuuaggcuccaauagag

SEQ ID NO: 33040 - RNA, 18 nt, Artificial Sequence
  Description of Artificial Sequence: Synthetic oligonucleotide
aaacaguuuaggcuccaa

SEQ ID NO: 33041 - RNA, 18 nt, Artificial Sequence
  Description of Artificial Sequence: Synthetic oligonucleotide
ugccaaaacaguuuaggc

SEQ ID NO: 33042 - RNA, 18 nt, Artificial Sequence
  Description of Artificial Sequence: Synthetic oligonucleotide
auaaaugccaaaacaguu

SEQ ID NO: 33043 - RNA, 18 nt, Artificial Sequence
  Description of Artificial Sequence: Synthetic oligonucleotide
gauucauaaaugccaaaa

SEQ ID NO: 33044 - RNA, 18 nt, Artificial Sequence
  Description of Artificial Sequence: Synthetic oligonucleotide
guccagauucauaaaugc

SEQ ID NO: 33045 - RNA, 18 nt, Artificial Sequence
  Description of Artificial Sequence: Synthetic oligonucleotide
auuggguccagauucaua

SEQ ID NO: 33046 - RNA, 18 nt, Artificial Sequence
  Description of Artificial Sequence: Synthetic oligonucleotide
uuagcauuggguccagau

SEQ ID NO: 33047 - RNA, 18 nt, Artificial Sequence
  Description of Artificial Sequence: Synthetic oligonucleotide
ugucauuagcauuggguc

SEQ ID NO: 33048 - RNA, 18 nt, Artificial Sequence
  Description of Artificial Sequence: Synthetic oligonucleotide
cugugugucauuagcauu

SEQ ID NO: 33049 - RNA, 18 nt, Artificial Sequence
  Description of Artificial Sequence: Synthetic oligonucleotide
uuucacugugugucauua

SEQ ID NO: 33050 - RNA, 18 nt, Artificial Sequence
  Description of Artificial Sequence: Synthetic oligonucleotide
aauuuuuucacugugugu

SEQ ID NO: 33051 - RNA, 18 nt, Artificial Sequence
  Description of Artificial Sequence: Synthetic oligonucleotide
agacaaauuuuuucacug

SEQ ID NO: 33052 - RNA, 18 nt, Artificial Sequence
  Description of Artificial Sequence: Synthetic oligonucleotide
aucagagacaaauuuuuu

SEQ ID NO: 33053 - RNA, 18 nt, Artificial Sequence
  Description of Artificial Sequence: Synthetic oligonucleotide
cuugaaucagagacaaau

SEQ ID NO: 33054 - RNA, 18 nt, Artificial Sequence
  Description of Artificial Sequence: Synthetic oligonucleotide
cuguacuugaaucagaga

SEQ ID NO: 33055 - RNA, 18 nt, Artificial Sequence
  Description of Artificial Sequence: Synthetic oligonucleotide
auaaacuguacuugaauc

SEQ ID NO: 33056 - RNA, 18 nt, Artificial Sequence
  Description of Artificial Sequence: Synthetic oligonucleotide
uacaaauaaacuguacuu

SEQ ID NO: 33057 - RNA, 18 nt, Artificial Sequence
  Description of Artificial Sequence: Synthetic oligonucleotide
aguuuuacaaauaaacug

SEQ ID NO: 33058 - RNA, 18 nt, Artificial Sequence
  Description of Artificial Sequence: Synthetic oligonucleotide
aguauaguuuuacaaaua

SEQ ID NO: 33059 - RNA, 18 nt, Artificial Sequence
  Description of Artificial Sequence: Synthetic oligonucleotide
gaauaaguauaguuuuac

SEQ ID NO: 33060 - RNA, 18 nt, Artificial Sequence
  Description of Artificial Sequence: Synthetic oligonucleotide
uuguagaauaaguauagu

SEQ ID NO: 33061 - RNA, 18 nt, Artificial Sequence
  Description of Artificial Sequence: Synthetic oligonucleotide
caaauuuguagaauaagu

SEQ ID NO: 33062 - RNA, 18 nt, Artificial Sequence
  Description of Artificial Sequence: Synthetic oligonucleotide
cugaccaaauuuguagaa

SEQ ID NO: 33063 - RNA, 18 nt, Artificial Sequence
  Description of Artificial Sequence: Synthetic oligonucleotide
cauuucugaccaaauuug

SEQ ID NO: 33064 - RNA, 18 nt, Artificial Sequence
  Description of Artificial Sequence: Synthetic oligonucleotide
cacaacauuucugaccaa

SEQ ID NO: 33065 - RNA, 18 nt, Artificial Sequence
  Description of Artificial Sequence: Synthetic oligonucleotide
auagacacaacauuucug

SEQ ID NO: 33066 - RNA, 18 nt, Artificial Sequence
  Description of Artificial Sequence: Synthetic oligonucleotide
auauuauagacacaacau

SEQ ID NO: 33067 - RNA, 18 nt, Artificial Sequence
  Description of Artificial Sequence: Synthetic oligonucleotide
uagaaauauuauagacac

SEQ ID NO: 33068 - RNA, 18 nt, Artificial Sequence
  Description of Artificial Sequence: Synthetic oligonucleotide
cuuuuuagaaauauuaua

SEQ ID NO: 33069 - RNA, 18 nt, Artificial Sequence
  Description of Artificial Sequence: Synthetic oligonucleotide
aaucucuuuuuagaaaua

SEQ ID NO: 33070 - RNA, 18 nt, Artificial Sequence
  Description of Artificial Sequence: Synthetic oligonucleotide
gcuacaaucucuuuuuag

SEQ ID NO: 33071 - RNA, 18 nt, Artificial Sequence
  Description of Artificial Sequence: Synthetic oligonucleotide
acauggcuacaaucucuu

SEQ ID NO: 33072 - RNA, 18 nt, Artificial Sequence
  Description of Artificial Sequence: Synthetic oligonucleotide
uuuuaacauggcuacaau

SEQ ID NO: 33073 - RNA, 18 nt, Artificial Sequence
  Description of Artificial Sequence: Synthetic oligonucleotide
ugaguuuuuaacauggcu

SEQ ID NO: 33074 - RNA, 18 nt, Artificial Sequence
  Description of Artificial Sequence: Synthetic oligonucleotide
ucaguugaguuuuuaaca

SEQ ID NO: 33075 - RNA, 18 nt, Artificial Sequence
  Description of Artificial Sequence: Synthetic oligonucleotide
auacaucaguugaguuuu

SEQ ID NO: 33076 - RNA, 18 nt, Artificial Sequence
  Description of Artificial Sequence: Synthetic oligonucleotide
ggcacauacaucaguuga

SEQ ID NO: 33077 - RNA, 18 nt, Artificial Sequence
  Description of Artificial Sequence: Synthetic oligonucleotide
uaguuggcacauacauca

SEQ ID NO: 33078 - RNA, 18 nt, Artificial Sequence
  Description of Artificial Sequence: Synthetic oligonucleotide
aguuauaguuggcacaua

SEQ ID NO: 33079 - RNA, 18 nt, Artificial Sequence
  Description of Artificial Sequence: Synthetic oligonucleotide
aaaagaguuauaguuggc

SEQ ID NO: 33080 - RNA, 18 nt, Artificial Sequence
  Description of Artificial Sequence: Synthetic oligonucleotide
guaagaaaagaguuauag

SEQ ID NO: 33081 - RNA, 18 nt, Artificial Sequence
  Description of Artificial Sequence: Synthetic oligonucleotide
uagagguaagaaaagagu

SEQ ID NO: 33082 - RNA, 18 nt, Artificial Sequence
  Description of Artificial Sequence: Synthetic oligonucleotide
uacuuuagagguaagaaa

SEQ ID NO: 33083 - RNA, 18 nt, Artificial Sequence
  Description of Artificial Sequence: Synthetic oligonucleotide
uuucuuacuuuagaggua

SEQ ID NO: 33084 - RNA, 18 nt, Artificial Sequence
  Description of Artificial Sequence: Synthetic oligonucleotide
auuauuuucuuacuuuag

SEQ ID NO: 33085 - RNA, 18 nt, Artificial Sequence
  Description of Artificial Sequence: Synthetic oligonucleotide
aggaaauuauuuucuuac

SEQ ID NO: 33086 - RNA, 18 nt, Artificial Sequence
  Description of Artificial Sequence: Synthetic oligonucleotide
aaucuaggaaauuauuuu

SEQ ID NO: 33087 - RNA, 18 nt, Artificial Sequence
  Description of Artificial Sequence: Synthetic oligonucleotide
ggauaaaucuaggaaauu

SEQ ID NO: 33088 - RNA, 18 nt, Artificial Sequence
  Description of Artificial Sequence: Synthetic oligonucleotide
guuuaggauaaaucuagg

SEQ ID NO: 33089 - RNA, 18 nt, Artificial Sequence
  Description of Artificial Sequence: Synthetic oligonucleotide
agcauguuuaggauaaau

SEQ ID NO: 33090 - RNA, 18 nt, Artificial Sequence
  Description of Artificial Sequence: Synthetic oligonucleotide
acaucagcauguuuagga

SEQ ID NO: 33091 - RNA, 18 nt, Artificial Sequence
  Description of Artificial Sequence: Synthetic oligonucleotide
uauauacaucagcauguu

SEQ ID NO: 33092 - RNA, 18 nt, Artificial Sequence
  Description of Artificial Sequence: Synthetic oligonucleotide
acucuuauauacaucagc

SEQ ID NO: 33093 - RNA, 18 nt, Artificial Sequence
  Description of Artificial Sequence: Synthetic oligonucleotide
guauuacucuuauauaca

SEQ ID NO: 33094 - RNA, 18 nt, Artificial Sequence
  Description of Artificial Sequence: Synthetic oligonucleotide
uuaagguauuacucuuau

SEQ ID NO: 33095 - RNA, 18 nt, Artificial Sequence
  Description of Artificial Sequence: Synthetic oligonucleotide
aacaauuaagguauuacu

SEQ ID NO: 33096 - RNA, 18 nt, Artificial Sequence
  Description of Artificial Sequence: Synthetic oligonucleotide
ccauaaacaauuaaggua

SEQ ID NO: 33097 - RNA, 18 nt, Artificial Sequence
  Description of Artificial Sequence: Synthetic oligonucleotide
aaaaaccauaaacaauua

SEQ ID NO: 33098 - RNA, 18 nt, Artificial Sequence
  Description of Artificial Sequence: Synthetic oligonucleotide
ggaagaaaaaccauaaac

SEQ ID NO: 33099 - RNA, 18 nt, Artificial Sequence
  Description of Artificial Sequence: Synthetic oligonucleotide
guccaggaagaaaaacca

SEQ ID NO: 33100 - RNA, 18 nt, Artificial Sequence
  Description of Artificial Sequence: Synthetic oligonucleotide
agaguguccaggaagaaa

SEQ ID NO: 33101 - RNA, 18 nt, Artificial Sequence
  Description of Artificial Sequence: Synthetic oligonucleotide
agaaaagaguguccagga

SEQ ID NO: 33102 - RNA, 18 nt, Artificial Sequence
  Description of Artificial Sequence: Synthetic oligonucleotide
ucuguagaaaagaguguc

SEQ ID NO: 33103 - RNA, 18 nt, Artificial Sequence
  Description of Artificial Sequence: Synthetic oligonucleotide
uguuuucuguagaaaaga

SEQ ID NO: 33104 - RNA, 18 nt, Artificial Sequence
  Description of Artificial Sequence: Synthetic oligonucleotide
aguuguguuuucuguaga

SEQ ID NO: 33105 - RNA, 18 nt, Artificial Sequence
  Description of Artificial Sequence: Synthetic oligonucleotide
caaaaaaauacaaggcag

SEQ ID NO: 33106 - RNA, 18 nt, Artificial Sequence
  Description of Artificial Sequence: Synthetic oligonucleotide
uaggucaaaaaaauacaa

SEQ ID NO: 33107 - RNA, 18 nt, Artificial Sequence
  Description of Artificial Sequence: Synthetic oligonucleotide
uuugauaggucaaaaaaa

SEQ ID NO: 33108 - RNA, 18 nt, Artificial Sequence
  Description of Artificial Sequence: Synthetic oligonucleotide
augauuuugauaggucaa

SEQ ID NO: 33109 - RNA, 18 nt, Artificial Sequence
  Description of Artificial Sequence: Synthetic oligonucleotide
gaaaaaugauuuugauag

SEQ ID NO: 33110 - RNA, 18 nt, Artificial Sequence
  Description of Artificial Sequence: Synthetic oligonucleotide
uaauugaaaaaugauuuu

SEQ ID NO: 33111 - RNA, 18 nt, Artificial Sequence
  Description of Artificial Sequence: Synthetic oligonucleotide
acaaguaauugaaaaaug

SEQ ID NO: 33112 - RNA, 18 nt, Artificial Sequence
  Description of Artificial Sequence: Synthetic oligonucleotide
gggaaacaaguaauugaa

SEQ ID NO: 33113 - RNA, 18 nt, Artificial Sequence
  Description of Artificial Sequence: Synthetic oligonucleotide
gacaucugaaaucuaggg

SEQ ID NO: 33114 - RNA, 18 nt, Artificial Sequence
  Description of Artificial Sequence: Synthetic oligonucleotide
ccgugacaucugaaaucu

SEQ ID NO: 33115 - RNA, 18 nt, Artificial Sequence
  Description of Artificial Sequence: Synthetic oligonucleotide
ucauaccgugacaucuga

SEQ ID NO: 33116 - RNA, 18 nt, Artificial Sequence
  Description of Artificial Sequence: Synthetic oligonucleotide
accuuucauaccgugaca

SEQ ID NO: 33117 - RNA, 18 nt, Artificial Sequence
  Description of Artificial Sequence: Synthetic oligonucleotide
auaaaaccuuucauaccg

SEQ ID NO: 33118 - RNA, 18 nt, Artificial Sequence
  Description of Artificial Sequence: Synthetic oligonucleotide
uauauauaaaaccuuuca

SEQ ID NO: 33119 - RNA, 18 nt, Artificial Sequence
  Description of Artificial Sequence: Synthetic oligonucleotide
uuaaauauauauaaaacc

SEQ ID NO: 33120 - RNA, 18 nt, Artificial Sequence
  Description of Artificial Sequence: Synthetic oligonucleotide
auuuuuuaaauauauaua

SEQ ID NO: 33121 - RNA, 18 nt, Artificial Sequence
  Description of Artificial Sequence: Synthetic oligonucleotide
acuuuauuuuuuaaauau

SEQ ID NO: 33122 - RNA, 18 nt, Artificial Sequence
  Description of Artificial Sequence: Synthetic oligonucleotide
uuuauacuuuauuuuuua

SEQ ID NO: 33123 - RNA, 18 nt, Artificial Sequence
  Description of Artificial Sequence: Synthetic oligonucleotide
uuauguuuauacuuuauu

SEQ ID NO: 33124 - RNA, 18 nt, Artificial Sequence
  Description of Artificial Sequence: Synthetic oligonucleotide
agacuuuauguuuauacu

SEQ ID NO: 33125 - RNA, 18 nt, Artificial Sequence
  Description of Artificial Sequence: Synthetic oligonucleotide
caaaaagacuuuauguuu

SEQ ID NO: 33126 - RNA, 18 nt, Artificial Sequence
  Description of Artificial Sequence: Synthetic oligonucleotide
cgcuucaaaaagacuuua

SEQ ID NO: 33127 - RNA, 18 nt, Artificial Sequence
  Description of Artificial Sequence: Synthetic oligonucleotide
aaccacgcuucaaaaaga

SEQ ID NO: 33128 - RNA, 18 nt, Artificial Sequence
  Description of Artificial Sequence: Synthetic oligonucleotide
ugcauaaccacgcuucaa

SEQ ID NO: 33129 - RNA, 18 nt, Artificial Sequence
  Description of Artificial Sequence: Synthetic oligonucleotide
uauguugcauaaccacgc

SEQ ID NO: 33130 - RNA, 18 nt, Artificial Sequence
  Description of Artificial Sequence: Synthetic oligonucleotide
uagcauauguugcauaac

SEQ ID NO: 33131 - RNA, 18 nt, Artificial Sequence
  Description of Artificial Sequence: Synthetic oligonucleotide
acgccuagcauauguugc

SEQ ID NO: 33132 - RNA, 18 nt, Artificial Sequence
  Description of Artificial Sequence: Synthetic oligonucleotide
aacuuacgccuagcauau

SEQ ID NO: 33133 - RNA, 18 nt, Artificial Sequence
  Description of Artificial Sequence: Synthetic oligonucleotide
ucaccaacuuacgccuag

SEQ ID NO: 33134 - RNA, 18 nt, Artificial Sequence
  Description of Artificial Sequence: Synthetic oligonucleotide
ggcauucaccaacuuacg

SEQ ID NO: 33135 - RNA, 18 nt, Artificial Sequence
  Description of Artificial Sequence: Synthetic oligonucleotide
aagcaggcauucaccaac

SEQ ID NO: 33136 - RNA, 18 nt, Artificial Sequence
  Description of Artificial Sequence: Synthetic oligonucleotide
cugcaaagcaggcauuca

SEQ ID NO: 33137 - RNA, 18 nt, Artificial Sequence
  Description of Artificial Sequence: Synthetic oligonucleotide
acacucugcaaagcaggc

SEQ ID NO: 33138 - RNA, 18 nt, Artificial Sequence
  Description of Artificial Sequence: Synthetic oligonucleotide
ggguuacacucugcaaag

SEQ ID NO: 33139 - RNA, 18 nt, Artificial Sequence
  Description of Artificial Sequence: Synthetic oligonucleotide
cuuuuuuuauucaauggg

SEQ ID NO: 33140 - RNA, 18 nt, Artificial Sequence
  Description of Artificial Sequence: Synthetic oligonucleotide
gcuuuuuuuauucaaugg

SEQ ID NO: 33141 - RNA, 18 nt, Artificial Sequence
  Description of Artificial Sequence: Synthetic oligonucleotide
acaaagcuuuuuuuauuc

SEQ ID NO: 33142 - RNA, 18 nt, Artificial Sequence
  Description of Artificial Sequence: Synthetic oligonucleotide
ggaaaacaaagcuuuuuu

SEQ ID NO: 33143 - RNA, 18 nt, Artificial Sequence
  Description of Artificial Sequence: Synthetic oligonucleotide
gaaagggaaaacaaagcu

SEQ ID NO: 33144 - RNA, 18 nt, Artificial Sequence
  Description of Artificial Sequence: Synthetic oligonucleotide
gggcagaaagggaaaaca

SEQ ID NO: 33145 - RNA, 18 nt, Artificial Sequence
  Description of Artificial Sequence: Synthetic oligonucleotide
gcccauacugauacaggg

SEQ ID NO: 33146 - RNA, 18 nt, Artificial Sequence
  Description of Artificial Sequence: Synthetic oligonucleotide
ugcccauacugauacagg

SEQ ID NO: 33147 - RNA, 18 nt, Artificial Sequence
  Description of Artificial Sequence: Synthetic oligonucleotide
gggugugcccauacugau

SEQ ID NO: 33148 - RNA, 18 nt, Artificial Sequence
  Description of Artificial Sequence: Synthetic oligonucleotide
gugcagggugugcccaua

SEQ ID NO: 33149 - RNA, 18 nt, Artificial Sequence
  Description of Artificial Sequence: Synthetic oligonucleotide
uuagagugcagggugugc

SEQ ID NO: 33150 - RNA, 18 nt, Artificial Sequence
  Description of Artificial Sequence: Synthetic oligonucleotide
uaaaguuagagugcaggg

SEQ ID NO: 33151 - RNA, 18 nt, Artificial Sequence
  Description of Artificial Sequence: Synthetic oligonucleotide
uagauuaaaguuagagug

SEQ ID NO: 33152 - RNA, 18 nt, Artificial Sequence
  Description of Artificial Sequence: Synthetic oligonucleotide
ugacguagauuaaaguua

SEQ ID NO: 33153 - RNA, 18 nt, Artificial Sequence
  Description of Artificial Sequence: Synthetic oligonucleotide
gagggugacguagauuaa

SEQ ID NO: 33154 - RNA, 18 nt, Artificial Sequence
  Description of Artificial Sequence: Synthetic oligonucleotide
caggugagggugacguag

SEQ ID NO: 33155 - RNA, 18 nt, Artificial Sequence
  Description of Artificial Sequence: Synthetic oligonucleotide
ccaaacaggugaggguga

SEQ ID NO: 33156 - RNA, 18 nt, Artificial Sequence
  Description of Artificial Sequence: Synthetic oligonucleotide
ccaaaccaaacaggugag

SEQ ID NO: 33157 - RNA, 18 nt, Artificial Sequence
  Description of Artificial Sequence: Synthetic oligonucleotide
uaaacccaaaccaaacag

SEQ ID NO: 33158 - RNA, 18 nt, Artificial Sequence
  Description of Artificial Sequence: Synthetic oligonucleotide
gacauuaaacccaaacca

SEQ ID NO: 33159 - RNA, 18 nt, Artificial Sequence
  Description of Artificial Sequence: Synthetic oligonucleotide
ucgcagacauuaaaccca

SEQ ID NO: 33160 - RNA, 18 nt, Artificial Sequence
  Description of Artificial Sequence: Synthetic oligonucleotide
uuuucucgcagacauuaa

SEQ ID NO: 33161 - RNA, 18 nt, Artificial Sequence
  Description of Artificial Sequence: Synthetic oligonucleotide
uuugguuuucucgcagac

SEQ ID NO: 33162 - RNA, 18 nt, Artificial Sequence
  Description of Artificial Sequence: Synthetic oligonucleotide
agauauuugguuuucucg

SEQ ID NO: 33163 - RNA, 18 nt, Artificial Sequence
  Description of Artificial Sequence: Synthetic oligonucleotide
acacaagauauuugguuu

SEQ ID NO: 33164 - RNA, 18 nt, Artificial Sequence
  Description of Artificial Sequence: Synthetic oligonucleotide
acaauacacaagauauuu

SEQ ID NO: 33165 - RNA, 18 nt, Artificial Sequence
  Description of Artificial Sequence: Synthetic oligonucleotide
aguucacaauacacaaga

SEQ ID NO: 33166 - RNA, 18 nt, Artificial Sequence
  Description of Artificial Sequence: Synthetic oligonucleotide
uugacaguucacaauaca

SEQ ID NO: 33167 - RNA, 18 nt, Artificial Sequence
  Description of Artificial Sequence: Synthetic oligonucleotide
uggcuuugacaguucaca

SEQ ID NO: 33168 - RNA, 18 nt, Artificial Sequence
  Description of Artificial Sequence: Synthetic oligonucleotide
uuagauggcuuugacagu

SEQ ID NO: 33169 - RNA, 18 nt, Artificial Sequence
  Description of Artificial Sequence: Synthetic oligonucleotide
uugguuuagauggcuuug

SEQ ID NO: 33170 - RNA, 18 nt, Artificial Sequence
  Description of Artificial Sequence: Synthetic oligonucleotide
ugggauugguuuagaugg

SEQ ID NO: 33171 - RNA, 18 nt, Artificial Sequence
  Description of Artificial Sequence: Synthetic oligonucleotide
gaccuugggauugguuua

SEQ ID NO: 33172 - RNA, 18 nt, Artificial Sequence
  Description of Artificial Sequence: Synthetic oligonucleotide
cacuugaccuugggauug

SEQ ID NO: 33173 - RNA, 18 nt, Artificial Sequence
  Description of Artificial Sequence: Synthetic oligonucleotide
auauccacuugaccuugg

SEQ ID NO: 33174 - RNA, 18 nt, Artificial Sequence
  Description of Artificial Sequence: Synthetic oligonucleotide
uuuuuauauccacuugac

SEQ ID NO: 33175 - RNA, 18 nt, Artificial Sequence
  Description of Artificial Sequence: Synthetic oligonucleotide
cagaauuuuuauauccac

SEQ ID NO: 33176 - RNA, 18 nt, Artificial Sequence
  Description of Artificial Sequence: Synthetic oligonucleotide
uuuggcagaauuuuuaua

SEQ ID NO: 33177 - RNA, 18 nt, Artificial Sequence
  Description of Artificial Sequence: Synthetic oligonucleotide
auguuuuuggcagaauuu

SEQ ID NO: 33178 - RNA, 18 nt, Artificial Sequence
  Description of Artificial Sequence: Synthetic oligonucleotide
augccauguuuuuggcag

SEQ ID NO: 33179 - RNA, 18 nt, Artificial Sequence
  Description of Artificial Sequence: Synthetic oligonucleotide
aucuuaugccauguuuuu

SEQ ID NO: 33180 - RNA, 18 nt, Artificial Sequence
  Description of Artificial Sequence: Synthetic oligonucleotide
uuuccaucuuaugccaug

SEQ ID NO: 33181 - RNA, 18 nt, Artificial Sequence
  Description of Artificial Sequence: Synthetic oligonucleotide
gaacuuuuccaucuuaug

SEQ ID NO: 33182 - RNA, 18 nt, Artificial Sequence
  Description of Artificial Sequence: Synthetic oligonucleotide
ucagggaacuuuuccauc

SEQ ID NO: 33183 - RNA, 18 nt, Artificial Sequence
  Description of Artificial Sequence: Synthetic oligonucleotide
aguuuucagggaacuuuu

SEQ ID NO: 33184 - RNA, 18 nt, Artificial Sequence
  Description of Artificial Sequence: Synthetic oligonucleotide
uccagaguuuucagggaa

SEQ ID NO: 33185 - RNA, 18 nt, Artificial Sequence
  Description of Artificial Sequence: Synthetic oligonucleotide
uuucuuccagaguuuuca

SEQ ID NO: 33186 - RNA, 18 nt, Artificial Sequence
  Description of Artificial Sequence: Synthetic oligonucleotide
uuuguuuucuuccagagu

SEQ ID NO: 33187 - RNA, 18 nt, Artificial Sequence
  Description of Artificial Sequence: Synthetic oligonucleotide
auuacuuuguuuucuucc

SEQ ID NO: 33188 - RNA, 18 nt, Artificial Sequence
  Description of Artificial Sequence: Synthetic oligonucleotide
ucuacauuacuuuguuuu

SEQ ID NO: 33189 - RNA, 18 nt, Artificial Sequence
  Description of Artificial Sequence: Synthetic oligonucleotide
aggugucuacauuacuuu

SEQ ID NO: 33190 - RNA, 18 nt, Artificial Sequence
  Description of Artificial Sequence: Synthetic oligonucleotide
aaagaaggugucuacauu

SEQ ID NO: 33191 - RNA, 18 nt, Artificial Sequence
  Description of Artificial Sequence: Synthetic oligonucleotide
gggaaaaagaaggugucu

SEQ ID NO: 33192 - RNA, 18 nt, Artificial Sequence
  Description of Artificial Sequence: Synthetic oligonucleotide
auuuucuaaugguguggg

SEQ ID NO: 33193 - RNA, 18 nt, Artificial Sequence
  Description of Artificial Sequence: Synthetic oligonucleotide
aacauuuucuaauggugu

SEQ ID NO: 33194 - RNA, 18 nt, Artificial Sequence
  Description of Artificial Sequence: Synthetic oligonucleotide
gaugcaacauuuucuaau

SEQ ID NO: 33195 - RNA, 18 nt, Artificial Sequence
  Description of Artificial Sequence: Synthetic oligonucleotide
guccucaucgucauuauu

SEQ ID NO: 33196 - RNA, 18 nt, Artificial Sequence
  Description of Artificial Sequence: Synthetic oligonucleotide
gucagguccucaucguca

SEQ ID NO: 33197 - RNA, 18 nt, Artificial Sequence
  Description of Artificial Sequence: Synthetic oligonucleotide
cuggugucagguccucau

SEQ ID NO: 33198 - RNA, 18 nt, Artificial Sequence
  Description of Artificial Sequence: Synthetic oligonucleotide
cugcucuggugucagguc

SEQ ID NO: 33199 - RNA, 18 nt, Artificial Sequence
  Description of Artificial Sequence: Synthetic oligonucleotide
gccuucugcucugguguc

SEQ ID NO: 33200 - RNA, 18 nt, Artificial Sequence
  Description of Artificial Sequence: Synthetic oligonucleotide
gcucugccuucugcucug

SEQ ID NO: 33201 - RNA, 18 nt, Artificial Sequence
  Description of Artificial Sequence: Synthetic oligonucleotide
cucacgcucugccuucug

SEQ ID NO: 33202 - RNA, 18 nt, Artificial Sequence
  Description of Artificial Sequence: Synthetic oligonucleotide
uccuucucacgcucugcc

SEQ ID NO: 33203 - RNA, 18 nt, Artificial Sequence
  Description of Artificial Sequence: Synthetic oligonucleotide
uccgcuccuucucacgcu

SEQ ID NO: 33204 - RNA, 18 nt, Artificial Sequence
  Description of Artificial Sequence: Synthetic oligonucleotide
cauccuccgcuccuucuc

SEQ ID NO: 33205 - RNA, 18 nt, Artificial Sequence
  Description of Artificial Sequence: Synthetic oligonucleotide
uuggccauccuccgcucc

SEQ ID NO: 33206 - RNA, 18 nt, Artificial Sequence
  Description of Artificial Sequence: Synthetic oligonucleotide
cauuguuggccauccucc

SEQ ID NO: 33207 - RNA, 18 nt, Artificial Sequence
  Description of Artificial Sequence: Synthetic oligonucleotide
ucgggcauuguuggccau

SEQ ID NO: 33208 - RNA, 18 nt, Artificial Sequence
  Description of Artificial Sequence: Synthetic oligonucleotide
cgcucucgggcauuguug

SEQ ID NO: 33209 - RNA, 18 nt, Artificial Sequence
  Description of Artificial Sequence: Synthetic oligonucleotide
gcagacgcucucgggcau

SEQ ID NO: 33210 - RNA, 18 nt, Artificial Sequence
  Description of Artificial Sequence: Synthetic oligonucleotide
gacccgcagacgcucucg

SEQ ID NO: 33211 - RNA, 18 nt, Artificial Sequence
  Description of Artificial Sequence: Synthetic oligonucleotide
ucacggacccgcagacgc

SEQ ID NO: 33212 - RNA, 18 nt, Artificial Sequence
  Description of Artificial Sequence: Synthetic oligonucleotide
ugaugucacggacccgca

SEQ ID NO: 33213 - RNA, 18 nt, Artificial Sequence
  Description of Artificial Sequence: Synthetic oligonucleotide
cucguugaugucacggac

SEQ ID NO: 33214 - RNA, 18 nt, Artificial Sequence
  Description of Artificial Sequence: Synthetic oligonucleotide
aaagccucguugauguca

SEQ ID NO: 33215 - RNA, 18 nt, Artificial Sequence
  Description of Artificial Sequence: Synthetic oligonucleotide
cuuugaaagccucguuga

SEQ ID NO: 33216 - RNA, 18 nt, Artificial Sequence
  Description of Artificial Sequence: Synthetic oligonucleotide
gagcucuuugaaagccuc

SEQ ID NO: 33217 - RNA, 18 nt, Artificial Sequence
  Description of Artificial Sequence: Synthetic oligonucleotide
cggccgagcucuuugaaa

SEQ ID NO: 33218 - RNA, 18 nt, Artificial Sequence
  Description of Artificial Sequence: Synthetic oligonucleotide
ccaugcggccgagcucuu

SEQ ID NO: 33219 - RNA, 18 nt, Artificial Sequence
  Description of Artificial Sequence: Synthetic oligonucleotide
cugcaccaugcggccgag

SEQ ID NO: 33220 - RNA, 18 nt, Artificial Sequence
  Description of Artificial Sequence: Synthetic oligonucleotide
uggagcugcaccaugcgg

SEQ ID NO: 33221 - RNA, 18 nt, Artificial Sequence
  Description of Artificial Sequence: Synthetic oligonucleotide
ugagguggagcugcacca

SEQ ID NO: 33222 - RNA, 18 nt, Artificial Sequence
  Description of Artificial Sequence: Synthetic oligonucleotide
acucuugagguggagcug

SEQ ID NO: 33223 - RNA, 18 nt, Artificial Sequence
  Description of Artificial Sequence: Synthetic oligonucleotide
uugucacucuugaggugg

SEQ ID NO: 33224 - RNA, 18 nt, Artificial Sequence
  Description of Artificial Sequence: Synthetic oligonucleotide
gggcuugucacucuugag

SEQ ID NO: 33225 - RNA, 18 nt, Artificial Sequence
  Description of Artificial Sequence: Synthetic oligonucleotide
ucaggagcuuggucuggg

SEQ ID NO: 33226 - RNA, 18 nt, Artificial Sequence
  Description of Artificial Sequence: Synthetic oligonucleotide
gaggaucaggagcuuggu

SEQ ID NO: 33227 - RNA, 18 nt, Artificial Sequence
  Description of Artificial Sequence: Synthetic oligonucleotide
ugguggaggaucaggagc

SEQ ID NO: 33228 - RNA, 18 nt, Artificial Sequence
  Description of Artificial Sequence: Synthetic oligonucleotide
ccgccugguggaggauca

SEQ ID NO: 33229 - RNA, 18 nt, Artificial Sequence
  Description of Artificial Sequence: Synthetic oligonucleotide
ggccaccgccugguggag

SEQ ID NO: 33230 - RNA, 18 nt, Artificial Sequence
  Description of Artificial Sequence: Synthetic oligonucleotide
augacggccaccgccugg

SEQ ID NO: 33231 - RNA, 18 nt, Artificial Sequence
  Description of Artificial Sequence: Synthetic oligonucleotide
ugaggaugacggccaccg

SEQ ID NO: 33232 - RNA, 18 nt, Artificial Sequence
  Description of Artificial Sequence: Synthetic oligonucleotide
cagacugaggaugacggc

SEQ ID NO: 33233 - RNA, 18 nt, Artificial Sequence
  Description of Artificial Sequence: Synthetic oligonucleotide
ugcuccagacugaggaug

SEQ ID NO: 33234 - RNA, 18 nt, Artificial Sequence
  Description of Artificial Sequence: Synthetic oligonucleotide
cuugcugcuccagacuga

SEQ ID NO: 33235 - RNA, 18 nt, Artificial Sequence
  Description of Artificial Sequence: Synthetic oligonucleotide
ucggacuugcugcuccag

SEQ ID NO: 33236 - RNA, 18 nt, Artificial Sequence
  Description of Artificial Sequence: Synthetic oligonucleotide
cuguaguccugguggcau

SEQ ID NO: 33237 - RNA, 18 nt, Artificial Sequence
  Description of Artificial Sequence: Synthetic oligonucleotide
ugccccuguaguccuggu

SEQ ID NO: 33238 - RNA, 18 nt, Artificial Sequence
  Description of Artificial Sequence: Synthetic oligonucleotide
cacucugccccuguaguc

SEQ ID NO: 33239 - RNA, 18 nt, Artificial Sequence
  Description of Artificial Sequence: Synthetic oligonucleotide
ggagacacucugccccug

SEQ ID NO: 33240 - RNA, 18 nt, Artificial Sequence
  Description of Artificial Sequence: Synthetic oligonucleotide
ccagaggagacacucugc

SEQ ID NO: 33241 - RNA, 18 nt, Artificial Sequence
  Description of Artificial Sequence: Synthetic oligonucleotide
agcugccagaggagacac

SEQ ID NO: 33242 - RNA, 18 nt, Artificial Sequence
  Description of Artificial Sequence: Synthetic oligonucleotide
cucagagcugccagagga

SEQ ID NO: 33243 - RNA, 18 nt, Artificial Sequence
  Description of Artificial Sequence: Synthetic oligonucleotide
uugaucucagagcugcca

SEQ ID NO: 33244 - RNA, 18 nt, Artificial Sequence
  Description of Artificial Sequence: Synthetic oligonucleotide
cggauuugaucucagagc

SEQ ID NO: 33245 - RNA, 18 nt, Artificial Sequence
  Description of Artificial Sequence: Synthetic oligonucleotide
gucaucggauuugaucuc

SEQ ID NO: 33246 - RNA, 18 nt, Artificial Sequence
  Description of Artificial Sequence: Synthetic oligonucleotide
cccucgucaucggauuug

SEQ ID NO: 33247 - RNA, 18 nt, Artificial Sequence
  Description of Artificial Sequence: Synthetic oligonucleotide
caucacccucgucaucgg

SEQ ID NO: 33248 - RNA, 18 nt, Artificial Sequence
  Description of Artificial Sequence: Synthetic oligonucleotide
guucucaucacccucguc

SEQ ID NO: 33249 - RNA, 18 nt, Artificial Sequence
  Description of Artificial Sequence: Synthetic oligonucleotide
ugcagguucucaucaccc

SEQ ID NO: 33250 - RNA, 18 nt, Artificial Sequence
  Description of Artificial Sequence: Synthetic oligonucleotide
ugucuugcagguucucau

SEQ ID NO: 33251 - RNA, 18 nt, Artificial Sequence
  Description of Artificial Sequence: Synthetic oligonucleotide
uuucgugucuugcagguu

SEQ ID NO: 33252 - RNA, 18 nt, Artificial Sequence
  Description of Artificial Sequence: Synthetic oligonucleotide
gaagauuucgugucuugc

SEQ ID NO: 33253 - RNA, 18 nt, Artificial Sequence
  Description of Artificial Sequence: Synthetic oligonucleotide
ccuccgaagauuucgugu

SEQ ID NO: 33254 - RNA, 18 nt, Artificial Sequence
  Description of Artificial Sequence: Synthetic oligonucleotide
cuuguccuccgaagauuu

SEQ ID NO: 33255 - RNA, 18 nt, Artificial Sequence
  Description of Artificial Sequence: Synthetic oligonucleotide
aauuucuuguccuccgaa

SEQ ID NO: 33256 - RNA, 18 nt, Artificial Sequence
  Description of Artificial Sequence: Synthetic oligonucleotide
caucuaauuucuuguccu

SEQ ID NO: 33257 - RNA, 18 nt, Artificial Sequence
  Description of Artificial Sequence: Synthetic oligonucleotide
gucgucaucuaauuucuu

SEQ ID NO: 33258 - RNA, 18 nt, Artificial Sequence
  Description of Artificial Sequence: Synthetic oligonucleotide
uucuugucgucaucuaau

SEQ ID NO: 33259 - RNA, 18 nt, Artificial Sequence
  Description of Artificial Sequence: Synthetic oligonucleotide
uauccuucuugucgucau

SEQ ID NO: 33260 - RNA, 18 nt, Artificial Sequence
  Description of Artificial Sequence: Synthetic oligonucleotide
uuugauauccuucuuguc

SEQ ID NO: 33261 - RNA, 18 nt, Artificial Sequence
  Description of Artificial Sequence: Synthetic oligonucleotide
auugauuugauauccuuc

SEQ ID NO: 33262 - RNA, 18 nt, Artificial Sequence
  Description of Artificial Sequence: Synthetic oligonucleotide
uaguaauugauuugauau

SEQ ID NO: 33263 - RNA, 18 nt, Artificial Sequence
  Description of Artificial Sequence: Synthetic oligonucleotide
ugaccuaguaauugauuu

SEQ ID NO: 33264 - RNA, 18 nt, Artificial Sequence
  Description of Artificial Sequence: Synthetic oligonucleotide
gaucuugaccuaguaauu

SEQ ID NO: 33265 - RNA, 18 nt, Artificial Sequence
  Description of Artificial Sequence: Synthetic oligonucleotide
gcgacaguauuauauacu

SEQ ID NO: 33266 - RNA, 18 nt, Artificial Sequence
  Description of Artificial Sequence: Synthetic oligonucleotide
augaagcgacaguauuau

SEQ ID NO: 33267 - RNA, 18 nt, Artificial Sequence
  Description of Artificial Sequence: Synthetic oligonucleotide
auuaaaugaagcgacagu

SEQ ID NO: 33268 - RNA, 18 nt, Artificial Sequence
  Description of Artificial Sequence: Synthetic oligonucleotide
aaggaauuaaaugaagcg

SEQ ID NO: 33269 - RNA, 18 nt, Artificial Sequence
  Description of Artificial Sequence: Synthetic oligonucleotide
caauaaaggaauuaaaug

SEQ ID NO: 33270 - RNA, 18 nt, Artificial Sequence
  Description of Artificial Sequence: Synthetic oligonucleotide
aaguccaauaaaggaauu

SEQ ID NO: 33271 - RNA, 18 nt, Artificial Sequence
  Description of Artificial Sequence: Synthetic oligonucleotide
caucaaaguccaauaaag

SEQ ID NO: 33272 - RNA, 18 nt, Artificial Sequence
  Description of Artificial Sequence: Synthetic oligonucleotide
cacuucaucaaaguccaa

SEQ ID NO: 33273 - RNA, 18 nt, Artificial Sequence
  Description of Artificial Sequence: Synthetic oligonucleotide
cuguucacuucaucaaag

SEQ ID NO: 33274 - RNA, 18 nt, Artificial Sequence
  Description of Artificial Sequence: Synthetic oligonucleotide
ccguucuguucacuucau

SEQ ID NO: 33275 - RNA, 18 nt, Artificial Sequence
  Description of Artificial Sequence: Synthetic oligonucleotide
ucuucccguucuguucac

SEQ ID NO: 33276 - RNA, 18 nt, Artificial Sequence
  Description of Artificial Sequence: Synthetic oligonucleotide
uaguuucuucccguucug

SEQ ID NO: 33277 - RNA, 18 nt, Artificial Sequence
  Description of Artificial Sequence: Synthetic oligonucleotide
cugaauaguuucuucccg

SEQ ID NO: 33278 - RNA, 18 nt, Artificial Sequence
  Description of Artificial Sequence: Synthetic oligonucleotide
aaaaacugaauaguuucu

SEQ ID NO: 33279 - RNA, 18 nt, Artificial Sequence
  Description of Artificial Sequence: Synthetic oligonucleotide
caggaaaaaacugaauag

SEQ ID NO: 33280 - RNA, 18 nt, Artificial Sequence
  Description of Artificial Sequence: Synthetic oligonucleotide
ccugccaggaaaaaacug

SEQ ID NO: 33281 - RNA, 18 nt, Artificial Sequence
  Description of Artificial Sequence: Synthetic oligonucleotide
auuuaccugccaggaaaa

SEQ ID NO: 33282 - RNA, 18 nt, Artificial Sequence
  Description of Artificial Sequence: Synthetic oligonucleotide
uguaaauuuaccugccag

SEQ ID NO: 33283 - RNA, 18 nt, Artificial Sequence
  Description of Artificial Sequence: Synthetic oligonucleotide
ucagcuguaaauuuaccu

SEQ ID NO: 33284 - RNA, 18 nt, Artificial Sequence
  Description of Artificial Sequence: Synthetic oligonucleotide
ucuuuucagcuguaaauu

SEQ ID NO: 33285 - RNA, 18 nt, Artificial Sequence
  Description of Artificial Sequence: Synthetic oligonucleotide
aauuuucuuuucagcugu

SEQ ID NO: 33286 - RNA, 18 nt, Artificial Sequence
  Description of Artificial Sequence: Synthetic oligonucleotide
ccuuuaauuuucuuuuca

SEQ ID NO: 33287 - RNA, 18 nt, Artificial Sequence
  Description of Artificial Sequence: Synthetic oligonucleotide
guaggccuuuaauuuucu

SEQ ID NO: 33288 - RNA, 18 nt, Artificial Sequence
  Description of Artificial Sequence: Synthetic oligonucleotide
cuagaguaggccuuuaau

SEQ ID NO: 33289 - RNA, 18 nt, Artificial Sequence
  Description of Artificial Sequence: Synthetic oligonucleotide
uacuucuagaguaggccu

SEQ ID NO: 33290 - RNA, 18 nt, Artificial Sequence
  Description of Artificial Sequence: Synthetic oligonucleotide
uuuaguacuucuagagua

SEQ ID NO: 33291 - RNA, 18 nt, Artificial Sequence
  Description of Artificial Sequence: Synthetic oligonucleotide
auacuuuuaguacuucua

SEQ ID NO: 33292 - RNA, 18 nt, Artificial Sequence
  Description of Artificial Sequence: Synthetic oligonucleotide
aaacgauacuuuuaguac

SEQ ID NO: 33293 - RNA, 18 nt, Artificial Sequence
  Description of Artificial Sequence: Synthetic oligonucleotide
aucugaaacgauacuuuu

SEQ ID NO: 33294 - RNA, 18 nt, Artificial Sequence
  Description of Artificial Sequence: Synthetic oligonucleotide
cagguaucugaaacgaua

SEQ ID NO: 33295 - RNA, 18 nt, Artificial Sequence
  Description of Artificial Sequence: Synthetic oligonucleotide
gaguacagguaucugaaa

SEQ ID NO: 33296 - RNA, 18 nt, Artificial Sequence
  Description of Artificial Sequence: Synthetic oligonucleotide
caauagaguacagguauc

SEQ ID NO: 33297 - RNA, 18 nt, Artificial Sequence
  Description of Artificial Sequence: Synthetic oligonucleotide
ggcuccaauagaguacag

SEQ ID NO: 33298 - RNA, 18 nt, Artificial Sequence
  Description of Artificial Sequence: Synthetic oligonucleotide
guuuaggcuccaauagag

SEQ ID NO: 33299 - RNA, 18 nt, Artificial Sequence
  Description of Artificial Sequence: Synthetic oligonucleotide
aaacaguuuaggcuccaa

SEQ ID NO: 33300 - RNA, 18 nt, Artificial Sequence
  Description of Artificial Sequence: Synthetic oligonucleotide
ugccaaaacaguuuaggc

SEQ ID NO: 33301 - RNA, 18 nt, Artificial Sequence
  Description of Artificial Sequence: Synthetic oligonucleotide
auaaaugccaaaacaguu

SEQ ID NO: 33302 - RNA, 18 nt, Artificial Sequence
  Description of Artificial Sequence: Synthetic oligonucleotide
gauucauaaaugccaaaa

SEQ ID NO: 33303 - RNA, 18 nt, Artificial Sequence
  Description of Artificial Sequence: Synthetic oligonucleotide
guccagauucauaaaugc

SEQ ID NO: 33304 - RNA, 18 nt, Artificial Sequence
  Description of Artificial Sequence: Synthetic oligonucleotide
auuggguccagauucaua

SEQ ID NO: 33305 - RNA, 18 nt, Artificial Sequence
  Description of Artificial Sequence: Synthetic oligonucleotide
uuagcauuggguccagau

SEQ ID NO: 33306 - RNA, 18 nt, Artificial Sequence
  Description of Artificial Sequence: Synthetic oligonucleotide
ugucauuagcauuggguc

SEQ ID NO: 33307 - RNA, 18 nt, Artificial Sequence
  Description of Artificial Sequence: Synthetic oligonucleotide
cugugugucauuagcauu

SEQ ID NO: 33308 - RNA, 18 nt, Artificial Sequence
  Description of Artificial Sequence: Synthetic oligonucleotide
uuucacugugugucauua

SEQ ID NO: 33309 - RNA, 18 nt, Artificial Sequence
  Description of Artificial Sequence: Synthetic oligonucleotide
aauuuuuucacugugugu

SEQ ID NO: 33310 - RNA, 18 nt, Artificial Sequence
  Description of Artificial Sequence: Synthetic oligonucleotide
agacaaauuuuuucacug

SEQ ID NO: 33311 - RNA, 18 nt, Artificial Sequence
  Description of Artificial Sequence: Synthetic oligonucleotide
aucagagacaaauuuuuu

SEQ ID NO: 33312 - RNA, 18 nt, Artificial Sequence
  Description of Artificial Sequence: Synthetic oligonucleotide
cuugaaucagagacaaau

SEQ ID NO: 33313 - RNA, 18 nt, Artificial Sequence
  Description of Artificial Sequence: Synthetic oligonucleotide
cuguacuugaaucagaga

SEQ ID NO: 33314 - RNA, 18 nt, Artificial Sequence
  Description of Artificial Sequence: Synthetic oligonucleotide
auaaacuguacuugaauc

SEQ ID NO: 33315 - RNA, 18 nt, Artificial Sequence
  Description of Artificial Sequence: Synthetic oligonucleotide
uacaaauaaacuguacuu

SEQ ID NO: 33316 - RNA, 18 nt, Artificial Sequence
  Description of Artificial Sequence: Synthetic oligonucleotide
aguuuuacaaauaaacug

SEQ ID NO: 33317 - RNA, 18 nt, Artificial Sequence
  Description of Artificial Sequence: Synthetic oligonucleotide
aguauaguuuuacaaaua

SEQ ID NO: 33318 - RNA, 18 nt, Artificial Sequence
  Description of Artificial Sequence: Synthetic oligonucleotide
gaauaaguauaguuuuac

SEQ ID NO: 33319 - RNA, 18 nt, Artificial Sequence
  Description of Artificial Sequence: Synthetic oligonucleotide
uuguagaauaaguauagu

SEQ ID NO: 33320 - RNA, 18 nt, Artificial Sequence
  Description of Artificial Sequence: Synthetic oligonucleotide
caaauuuguagaauaagu

SEQ ID NO: 33321 - RNA, 18 nt, Artificial Sequence
  Description of Artificial Sequence: Synthetic oligonucleotide
cugaccaaauuuguagaa

SEQ ID NO: 33322 - RNA, 18 nt, Artificial Sequence
  Description of Artificial Sequence: Synthetic oligonucleotide
cauuucugaccaaauuug

SEQ ID NO: 33323 - RNA, 18 nt, Artificial Sequence
  Description of Artificial Sequence: Synthetic oligonucleotide
cacaacauuucugaccaa

SEQ ID NO: 33324 - RNA, 18 nt, Artificial Sequence
  Description of Artificial Sequence: Synthetic oligonucleotide
auagacacaacauuucug

SEQ ID NO: 33325 - RNA, 18 nt, Artificial Sequence
  Description of Artificial Sequence: Synthetic oligonucleotide
auauuauagacacaacau

SEQ ID NO: 33326 - RNA, 18 nt, Artificial Sequence
  Description of Artificial Sequence: Synthetic oligonucleotide
uagaaauauuauagacac

SEQ ID NO: 33327 - RNA, 18 nt, Artificial Sequence
  Description of Artificial Sequence: Synthetic oligonucleotide
cuuuuuagaaauauuaua

SEQ ID NO: 33328 - RNA, 18 nt, Artificial Sequence
  Description of Artificial Sequence: Synthetic oligonucleotide
aaucucuuuuuagaaaua

SEQ ID NO: 33329 - RNA, 18 nt, Artificial Sequence
  Description of Artificial Sequence: Synthetic oligonucleotide
gcuacaaucucuuuuuag

SEQ ID NO: 33330 - RNA, 18 nt, Artificial Sequence
  Description of Artificial Sequence: Synthetic oligonucleotide
acauggcuacaaucucuu

SEQ ID NO: 33331 - RNA, 18 nt, Artificial Sequence
  Description of Artificial Sequence: Synthetic oligonucleotide
uuuuaacauggcuacaau

SEQ ID NO: 33332 - RNA, 18 nt, Artificial Sequence
  Description of Artificial Sequence: Synthetic oligonucleotide
ugaguuuuuaacauggcu

SEQ ID NO: 33333 - RNA, 18 nt, Artificial Sequence
  Description of Artificial Sequence: Synthetic oligonucleotide
ucaguugaguuuuuaaca

SEQ ID NO: 33334 - RNA, 18 nt, Artificial Sequence
  Description of Artificial Sequence: Synthetic oligonucleotide
auacaucaguugaguuuu

SEQ ID NO: 33335 - RNA, 18 nt, Artificial Sequence
  Description of Artificial Sequence: Synthetic oligonucleotide
ggcacauacaucaguuga

SEQ ID NO: 33336 - RNA, 18 nt, Artificial Sequence
  Description of Artificial Sequence: Synthetic oligonucleotide
uaguuggcacauacauca

SEQ ID NO: 33337 - RNA, 18 nt, Artificial Sequence
  Description of Artificial Sequence: Synthetic oligonucleotide
aguuauaguuggcacaua

SEQ ID NO: 33338 - RNA, 18 nt, Artificial Sequence
  Description of Artificial Sequence: Synthetic oligonucleotide
aaaagaguuauaguuggc

SEQ ID NO: 33339 - RNA, 18 nt, Artificial Sequence
  Description of Artificial Sequence: Synthetic oligonucleotide
guaagaaaagaguuauag

SEQ ID NO: 33340 - RNA, 18 nt, Artificial Sequence
  Description of Artificial Sequence: Synthetic oligonucleotide
uagagguaagaaaagagu

SEQ ID NO: 33341 - RNA, 18 nt, Artificial Sequence
  Description of Artificial Sequence: Synthetic oligonucleotide
uacuuuagagguaagaaa

SEQ ID NO: 33342 - RNA, 18 nt, Artificial Sequence
  Description of Artificial Sequence: Synthetic oligonucleotide
uuucuuacuuuagaggua

SEQ ID NO: 33343 - RNA, 18 nt, Artificial Sequence
  Description of Artificial Sequence: Synthetic oligonucleotide
auuauuuucuuacuuuag

SEQ ID NO: 33344 - RNA, 18 nt, Artificial Sequence
  Description of Artificial Sequence: Synthetic oligonucleotide
aggaaauuauuuucuuac

SEQ ID NO: 33345 - RNA, 18 nt, Artificial Sequence
  Description of Artificial Sequence: Synthetic oligonucleotide
aaucuaggaaauuauuuu

SEQ ID NO: 33346 - RNA, 18 nt, Artificial Sequence
  Description of Artificial Sequence: Synthetic oligonucleotide
ggauaaaucuaggaaauu

SEQ ID NO: 33347 - RNA, 18 nt, Artificial Sequence
  Description of Artificial Sequence: Synthetic oligonucleotide
guuuaggauaaaucuagg

SEQ ID NO: 33348 - RNA, 18 nt, Artificial Sequence
  Description of Artificial Sequence: Synthetic oligonucleotide
agcauguuuaggauaaau

SEQ ID NO: 33349 - RNA, 18 nt, Artificial Sequence
  Description of Artificial Sequence: Synthetic oligonucleotide
acaucagcauguuuagga

SEQ ID NO: 33350 - RNA, 18 nt, Artificial Sequence
  Description of Artificial Sequence: Synthetic oligonucleotide
uauauacaucagcauguu

SEQ ID NO: 33351 - RNA, 18 nt, Artificial Sequence
  Description of Artificial Sequence: Synthetic oligonucleotide
acucuuauauacaucagc

SEQ ID NO: 33352 - RNA, 18 nt, Artificial Sequence
  Description of Artificial Sequence: Synthetic oligonucleotide
guauuacucuuauauaca

SEQ ID NO: 33353 - RNA, 18 nt, Artificial Sequence
  Description of Artificial Sequence: Synthetic oligonucleotide
uuaagguauuacucuuau

SEQ ID NO: 33354 - RNA, 18 nt, Artificial Sequence
  Description of Artificial Sequence: Synthetic oligonucleotide
aacaauuaagguauuacu

SEQ ID NO: 33355 - RNA, 18 nt, Artificial Sequence
  Description of Artificial Sequence: Synthetic oligonucleotide
ccauaaacaauuaaggua

SEQ ID NO: 33356 - RNA, 18 nt, Artificial Sequence
  Description of Artificial Sequence: Synthetic oligonucleotide
aaaaaccauaaacaauua

SEQ ID NO: 33357 - RNA, 18 nt, Artificial Sequence
  Description of Artificial Sequence: Synthetic oligonucleotide
ggaagaaaaaccauaaac

SEQ ID NO: 33358 - RNA, 18 nt, Artificial Sequence
  Description of Artificial Sequence: Synthetic oligonucleotide
guccaggaagaaaaacca

SEQ ID NO: 33359 - RNA, 18 nt, Artificial Sequence
  Description of Artificial Sequence: Synthetic oligonucleotide
agaguguccaggaagaaa

SEQ ID NO: 33360 - RNA, 18 nt, Artificial Sequence
  Description of Artificial Sequence: Synthetic oligonucleotide
agaaaagaguguccagga

SEQ ID NO: 33361 - RNA, 18 nt, Artificial Sequence
  Description of Artificial Sequence: Synthetic oligonucleotide
ucuguagaaaagaguguc

SEQ ID NO: 33362 - RNA, 18 nt, Artificial Sequence
  Description of Artificial Sequence: Synthetic oligonucleotide
uguuuucuguagaaaaga

SEQ ID NO: 33363 - RNA, 18 nt, Artificial Sequence
  Description of Artificial Sequence: Synthetic oligonucleotide
aguuguguuuucuguaga

SEQ ID NO: 33364 - RNA, 18 nt, Artificial Sequence
  Description of Artificial Sequence: Synthetic oligonucleotide
caaaaaaauacaaggcag

SEQ ID NO: 33365 - RNA, 18 nt, Artificial Sequence
  Description of Artificial Sequence: Synthetic oligonucleotide
uaggucaaaaaaauacaa

SEQ ID NO: 33366 - RNA, 18 nt, Artificial Sequence
  Description of Artificial Sequence: Synthetic oligonucleotide
uuugauaggucaaaaaaa

SEQ ID NO: 33367 - RNA, 18 nt, Artificial Sequence
  Description of Artificial Sequence: Synthetic oligonucleotide
augauuuugauaggucaa

SEQ ID NO: 33368 - RNA, 18 nt, Artificial Sequence
  Description of Artificial Sequence: Synthetic oligonucleotide
gaaaaaugauuuugauag

SEQ ID NO: 33369 - RNA, 18 nt, Artificial Sequence
  Description of Artificial Sequence: Synthetic oligonucleotide
uaauugaaaaaugauuuu

SEQ ID NO: 33370 - RNA, 18 nt, Artificial Sequence
  Description of Artificial Sequence: Synthetic oligonucleotide
acaaguaauugaaaaaug

SEQ ID NO: 33371 - RNA, 18 nt, Artificial Sequence
  Description of Artificial Sequence: Synthetic oligonucleotide
gggaaacaaguaauugaa

SEQ ID NO: 33372 - RNA, 18 nt, Artificial Sequence
  Description of Artificial Sequence: Synthetic oligonucleotide
gacaucugaaaucuaggg

SEQ ID NO: 33373 - RNA, 18 nt, Artificial Sequence
  Description of Artificial Sequence: Synthetic oligonucleotide
ccgugacaucugaaaucu

SEQ ID NO: 33374 - RNA, 18 nt, Artificial Sequence
  Description of Artificial Sequence: Synthetic oligonucleotide
ucauaccgugacaucuga

SEQ ID NO: 33375 - RNA, 18 nt, Artificial Sequence
  Description of Artificial Sequence: Synthetic oligonucleotide
accuuucauaccgugaca

SEQ ID NO: 33376 - RNA, 18 nt, Artificial Sequence
  Description of Artificial Sequence: Synthetic oligonucleotide
auaaaaccuuucauaccg

SEQ ID NO: 33377 - RNA, 18 nt, Artificial Sequence
  Description of Artificial Sequence: Synthetic oligonucleotide
uauauauaaaaccuuuca

SEQ ID NO: 33378 - RNA, 18 nt, Artificial Sequence
  Description of Artificial Sequence: Synthetic oligonucleotide
uuaaauauauauaaaacc

SEQ ID NO: 33379 - RNA, 18 nt, Artificial Sequence
  Description of Artificial Sequence: Synthetic oligonucleotide
auuuuuuaaauauauaua

SEQ ID NO: 33380 - RNA, 18 nt, Artificial Sequence
  Description of Artificial Sequence: Synthetic oligonucleotide
acuuuauuuuuuaaauau

SEQ ID NO: 33381 - RNA, 18 nt, Artificial Sequence
  Description of Artificial Sequence: Synthetic oligonucleotide
uuuauacuuuauuuuuua

SEQ ID NO: 33382 - RNA, 18 nt, Artificial Sequence
  Description of Artificial Sequence: Synthetic oligonucleotide
uuauguuuauacuuuauu

SEQ ID NO: 33383 - RNA, 18 nt, Artificial Sequence
  Description of Artificial Sequence: Synthetic oligonucleotide
agacuuuauguuuauacu

SEQ ID NO: 33384 - RNA, 18 nt, Artificial Sequence
  Description of Artificial Sequence: Synthetic oligonucleotide
caaaaagacuuuauguuu

SEQ ID NO: 33385 - RNA, 18 nt, Artificial Sequence
  Description of Artificial Sequence: Synthetic oligonucleotide
cgcuucaaaaagacuuua

SEQ ID NO: 33386 - RNA, 18 nt, Artificial Sequence
  Description of Artificial Sequence: Synthetic oligonucleotide
aaccacgcuucaaaaaga

SEQ ID NO: 33387 - RNA, 18 nt, Artificial Sequence
  Description of Artificial Sequence: Synthetic oligonucleotide
ugcauaaccacgcuucaa

SEQ ID NO: 33388 - RNA, 18 nt, Artificial Sequence
  Description of Artificial Sequence: Synthetic oligonucleotide
uauguugcauaaccacgc

SEQ ID NO: 33389 - RNA, 18 nt, Artificial Sequence
  Description of Artificial Sequence: Synthetic oligonucleotide
uagcauauguugcauaac

SEQ ID NO: 33390 - RNA, 18 nt, Artificial Sequence
  Description of Artificial Sequence: Synthetic oligonucleotide
acgccuagcauauguugc

SEQ ID NO: 33391 - RNA, 18 nt, Artificial Sequence
  Description of Artificial Sequence: Synthetic oligonucleotide
aacuuacgccuagcauau

SEQ ID NO: 33392 - RNA, 18 nt, Artificial Sequence
  Description of Artificial Sequence: Synthetic oligonucleotide
ucaccaacuuacgccuag

SEQ ID NO: 33393 - RNA, 18 nt, Artificial Sequence
  Description of Artificial Sequence: Synthetic oligonucleotide
ggcauucaccaacuuacg

SEQ ID NO: 33394 - RNA, 18 nt, Artificial Sequence
  Description of Artificial Sequence: Synthetic oligonucleotide
aagcaggcauucaccaac

SEQ ID NO: 33395 - RNA, 18 nt, Artificial Sequence
  Description of Artificial Sequence: Synthetic oligonucleotide
cugcaaagcaggcauuca

SEQ ID NO: 33396 - RNA, 18 nt, Artificial Sequence
  Description of Artificial Sequence: Synthetic oligonucleotide
acacucugcaaagcaggc

SEQ ID NO: 33397 - RNA, 18 nt, Artificial Sequence
  Description of Artificial Sequence: Synthetic oligonucleotide
ggguuacacucugcaaag

SEQ ID NO: 33398 - RNA, 18 nt, Artificial Sequence
  Description of Artificial Sequence: Synthetic oligonucleotide
cuuuuuuuauucaauggg

SEQ ID NO: 33399 - RNA, 18 nt, Artificial Sequence
  Description of Artificial Sequence: Synthetic oligonucleotide
gcuuuuuuuauucaaugg

SEQ ID NO: 33400 - RNA, 18 nt, Artificial Sequence
  Description of Artificial Sequence: Synthetic oligonucleotide
acaaagcuuuuuuuauuc

SEQ ID NO: 33401 - RNA, 18 nt, Artificial Sequence
  Description of Artificial Sequence: Synthetic oligonucleotide
ggaaaacaaagcuuuuuu

SEQ ID NO: 33402 - RNA, 18 nt, Artificial Sequence
  Description of Artificial Sequence: Synthetic oligonucleotide
gaaagggaaaacaaagcu

SEQ ID NO: 33403 - RNA, 18 nt, Artificial Sequence
  Description of Artificial Sequence: Synthetic oligonucleotide
gggcagaaagggaaaaca

SEQ ID NO: 33404 - RNA, 18 nt, Artificial Sequence
  Description of Artificial Sequence: Synthetic oligonucleotide
gcccauacugauacaggg

SEQ ID NO: 33405 - RNA, 18 nt, Artificial Sequence
  Description of Artificial Sequence: Synthetic oligonucleotide
ugcccauacugauacagg

SEQ ID NO: 33406 - RNA, 18 nt, Artificial Sequence
  Description of Artificial Sequence: Synthetic oligonucleotide
gggugugcccauacugau

SEQ ID NO: 33407 - RNA, 18 nt, Artificial Sequence
  Description of Artificial Sequence: Synthetic oligonucleotide
gugcagggugugcccaua

SEQ ID NO: 33408 - RNA, 18 nt, Artificial Sequence
  Description of Artificial Sequence: Synthetic oligonucleotide
uuagagugcagggugugc

SEQ ID NO: 33409 - RNA, 18 nt, Artificial Sequence
  Description of Artificial Sequence: Synthetic oligonucleotide
uaaaguuagagugcaggg

SEQ ID NO: 33410 - RNA, 18 nt, Artificial Sequence
  Description of Artificial Sequence: Synthetic oligonucleotide
uagauuaaaguuagagug

SEQ ID NO: 33411 - RNA, 18 nt, Artificial Sequence
  Description of Artificial Sequence: Synthetic oligonucleotide
ugacguagauuaaaguua

SEQ ID NO: 33412 - RNA, 18 nt, Artificial Sequence
  Description of Artificial Sequence: Synthetic oligonucleotide
gagggugacguagauuaa

SEQ ID NO: 33413 - RNA, 18 nt, Artificial Sequence
  Description of Artificial Sequence: Synthetic oligonucleotide
caggugagggugacguag

SEQ ID NO: 33414 - RNA, 18 nt, Artificial Sequence
  Description of Artificial Sequence: Synthetic oligonucleotide
ccaaacaggugaggguga

SEQ ID NO: 33415 - RNA, 18 nt, Artificial Sequence
  Description of Artificial Sequence: Synthetic oligonucleotide
ccaaaccaaacaggugag

SEQ ID NO: 33416 - RNA, 18 nt, Artificial Sequence
  Description of Artificial Sequence: Synthetic oligonucleotide
uaaacccaaaccaaacag

SEQ ID NO: 33417 - RNA, 18 nt, Artificial Sequence
  Description of Artificial Sequence: Synthetic oligonucleotide
gacauuaaacccaaacca

SEQ ID NO: 33418 - RNA, 18 nt, Artificial Sequence
  Description of Artificial Sequence: Synthetic oligonucleotide
ucgcagacauuaaaccca

SEQ ID NO: 33419 - RNA, 18 nt, Artificial Sequence
  Description of Artificial Sequence: Synthetic oligonucleotide
uuuucucgcagacauuaa

SEQ ID NO: 33420 - RNA, 18 nt, Artificial Sequence
  Description of Artificial Sequence: Synthetic oligonucleotide
uuugguuuucucgcagac

SEQ ID NO: 33421 - RNA, 18 nt, Artificial Sequence
  Description of Artificial Sequence: Synthetic oligonucleotide
agauauuugguuuucucg

SEQ ID NO: 33422 - RNA, 18 nt, Artificial Sequence
  Description of Artificial Sequence: Synthetic oligonucleotide
acacaagauauuugguuu

SEQ ID NO: 33423 - RNA, 18 nt, Artificial Sequence
  Description of Artificial Sequence: Synthetic oligonucleotide
acaauacacaagauauuu

SEQ ID NO: 33424 - RNA, 18 nt, Artificial Sequence
  Description of Artificial Sequence: Synthetic oligonucleotide
aguucacaauacacaaga

SEQ ID NO: 33425 - RNA, 18 nt, Artificial Sequence
  Description of Artificial Sequence: Synthetic oligonucleotide
uugacaguucacaauaca

SEQ ID NO: 33426 - RNA, 18 nt, Artificial Sequence
  Description of Artificial Sequence: Synthetic oligonucleotide
uggcuuugacaguucaca

SEQ ID NO: 33427 - RNA, 18 nt, Artificial Sequence
  Description of Artificial Sequence: Synthetic oligonucleotide
uuagauggcuuugacagu

SEQ ID NO: 33428 - RNA, 18 nt, Artificial Sequence
  Description of Artificial Sequence: Synthetic oligonucleotide
uugguuuagauggcuuug

SEQ ID NO: 33429 - RNA, 18 nt, Artificial Sequence
  Description of Artificial Sequence: Synthetic oligonucleotide
ugggauugguuuagaugg

SEQ ID NO: 33430 - RNA, 18 nt, Artificial Sequence
  Description of Artificial Sequence: Synthetic oligonucleotide
gaccuugggauugguuua

SEQ ID NO: 33431 - RNA, 18 nt, Artificial Sequence
  Description of Artificial Sequence: Synthetic oligonucleotide
cacuugaccuugggauug

SEQ ID NO: 33432 - RNA, 18 nt, Artificial Sequence
  Description of Artificial Sequence: Synthetic oligonucleotide
auauccacuugaccuugg

SEQ ID NO: 33433 - RNA, 18 nt, Artificial Sequence
  Description of Artificial Sequence: Synthetic oligonucleotide
uuuuuauauccacuugac

SEQ ID NO: 33434 - RNA, 18 nt, Artificial Sequence
  Description of Artificial Sequence: Synthetic oligonucleotide
cagaauuuuuauauccac

SEQ ID NO: 33435 - RNA, 18 nt, Artificial Sequence
  Description of Artificial Sequence: Synthetic oligonucleotide
uuuggcagaauuuuuaua

SEQ ID NO: 33436 - RNA, 18 nt, Artificial Sequence
  Description of Artificial Sequence: Synthetic oligonucleotide
auguuuuuggcagaauuu

SEQ ID NO: 33437 - RNA, 18 nt, Artificial Sequence
  Description of Artificial Sequence: Synthetic oligonucleotide
augccauguuuuuggcag

SEQ ID NO: 33438 - RNA, 18 nt, Artificial Sequence
  Description of Artificial Sequence: Synthetic oligonucleotide
aucuuaugccauguuuuu

SEQ ID NO: 33439 - RNA, 18 nt, Artificial Sequence
  Description of Artificial Sequence: Synthetic oligonucleotide
uuuccaucuuaugccaug

SEQ ID NO: 33440 - RNA, 18 nt, Artificial Sequence
  Description of Artificial Sequence: Synthetic oligonucleotide
gaacuuuuccaucuuaug

SEQ ID NO: 33441 - RNA, 18 nt, Artificial Sequence
  Description of Artificial Sequence: Synthetic oligonucleotide
ucagggaacuuuuccauc

SEQ ID NO: 33442 - RNA, 18 nt, Artificial Sequence
  Description of Artificial Sequence: Synthetic oligonucleotide
aguuuucagggaacuuuu

SEQ ID NO: 33443 - RNA, 18 nt, Artificial Sequence
  Description of Artificial Sequence: Synthetic oligonucleotide
uccagaguuuucagggaa

SEQ ID NO: 33444 - RNA, 18 nt, Artificial Sequence
  Description of Artificial Sequence: Synthetic oligonucleotide
uuucuuccagaguuuuca

SEQ ID NO: 33445 - RNA, 18 nt, Artificial Sequence
  Description of Artificial Sequence: Synthetic oligonucleotide
uuuguuuucuuccagagu

SEQ ID NO: 33446 - RNA, 18 nt, Artificial Sequence
  Description of Artificial Sequence: Synthetic oligonucleotide
auuacuuuguuuucuucc

SEQ ID NO: 33447 - RNA, 18 nt, Artificial Sequence
  Description of Artificial Sequence: Synthetic oligonucleotide
ucuacauuacuuuguuuu

SEQ ID NO: 33448 - RNA, 18 nt, Artificial Sequence
  Description of Artificial Sequence: Synthetic oligonucleotide
aggugucuacauuacuuu

SEQ ID NO: 33449 - RNA, 18 nt, Artificial Sequence
  Description of Artificial Sequence: Synthetic oligonucleotide
aaagaaggugucuacauu

SEQ ID NO: 33450 - RNA, 18 nt, Artificial Sequence
  Description of Artificial Sequence: Synthetic oligonucleotide
gggaaaaagaaggugucu

SEQ ID NO: 33451 - RNA, 18 nt, Artificial Sequence
  Description of Artificial Sequence: Synthetic oligonucleotide
auuuucuaaugguguggg

SEQ ID NO: 33452 - RNA, 18 nt, Artificial Sequence
  Description of Artificial Sequence: Synthetic oligonucleotide
aacauuuucuaauggugu

SEQ ID NO: 33453 - RNA, 18 nt, Artificial Sequence
  Description of Artificial Sequence: Synthetic oligonucleotide
gaugcaacauuuucuaau

SEQ ID NO: 33454 - RNA, 18 nt, Artificial Sequence
  Description of Artificial Sequence: Synthetic oligonucleotide
guccucaucgucauuauu

SEQ ID NO: 33455 - RNA, 18 nt, Artificial Sequence
  Description of Artificial Sequence: Synthetic oligonucleotide
gucagguccucaucguca

SEQ ID NO: 33456 - RNA, 18 nt, Artificial Sequence
  Description of Artificial Sequence: Synthetic oligonucleotide
cuggugucagguccucau

SEQ ID NO: 33457 - RNA, 18 nt, Artificial Sequence
  Description of Artificial Sequence: Synthetic oligonucleotide
cugcucuggugucagguc

SEQ ID NO: 33458 - RNA, 18 nt, Artificial Sequence
  Description of Artificial Sequence: Synthetic oligonucleotide
gccuucugcucugguguc

SEQ ID NO: 33459 - RNA, 18 nt, Artificial Sequence
  Description of Artificial Sequence: Synthetic oligonucleotide
gcucugccuucugcucug

SEQ ID NO: 33460 - RNA, 18 nt, Artificial Sequence
  Description of Artificial Sequence: Synthetic oligonucleotide
cucacgcucugccuucug

SEQ ID NO: 33461 - RNA, 18 nt, Artificial Sequence
  Description of Artificial Sequence: Synthetic oligonucleotide
uccuucucacgcucugcc

SEQ ID NO: 33462 - RNA, 18 nt, Artificial Sequence
  Description of Artificial Sequence: Synthetic oligonucleotide
uccgcuccuucucacgcu

SEQ ID NO: 33463 - RNA, 18 nt, Artificial Sequence
  Description of Artificial Sequence: Synthetic oligonucleotide
cauccuccgcuccuucuc

SEQ ID NO: 33464 - RNA, 18 nt, Artificial Sequence
  Description of Artificial Sequence: Synthetic oligonucleotide
uuggccauccuccgcucc

SEQ ID NO: 33465 - RNA, 18 nt, Artificial Sequence
  Description of Artificial Sequence: Synthetic oligonucleotide
cauuguuggccauccucc

SEQ ID NO: 33466 - RNA, 18 nt, Artificial Sequence
  Description of Artificial Sequence: Synthetic oligonucleotide
ucgggcauuguuggccau

SEQ ID NO: 33467 - RNA, 18 nt, Artificial Sequence
  Description of Artificial Sequence: Synthetic oligonucleotide
cgcucucgggcauuguug

SEQ ID NO: 33468 - RNA, 18 nt, Artificial Sequence
  Description of Artificial Sequence: Synthetic oligonucleotide
gcagacgcucucgggcau

SEQ ID NO: 33469 - RNA, 18 nt, Artificial Sequence
  Description of Artificial Sequence: Synthetic oligonucleotide
gacccgcagacgcucucg

SEQ ID NO: 33470 - RNA, 18 nt, Artificial Sequence
  Description of Artificial Sequence: Synthetic oligonucleotide
ucacggacccgcagacgc

SEQ ID NO: 33471 - RNA, 18 nt, Artificial Sequence
  Description of Artificial Sequence: Synthetic oligonucleotide
ugaugucacggacccgca

SEQ ID NO: 33472 - RNA, 18 nt, Artificial Sequence
  Description of Artificial Sequence: Synthetic oligonucleotide
cucguugaugucacggac

SEQ ID NO: 33473 - RNA, 18 nt, Artificial Sequence
  Description of Artificial Sequence: Synthetic oligonucleotide
aaagccucguugauguca

SEQ ID NO: 33474 - RNA, 18 nt, Artificial Sequence
  Description of Artificial Sequence: Synthetic oligonucleotide
cuuugaaagccucguuga

SEQ ID NO: 33475 - RNA, 18 nt, Artificial Sequence
  Description of Artificial Sequence: Synthetic oligonucleotide
gagcucuuugaaagccuc

SEQ ID NO: 33476 - RNA, 18 nt, Artificial Sequence
  Description of Artificial Sequence: Synthetic oligonucleotide
cggccgagcucuuugaaa

SEQ ID NO: 33477 - RNA, 18 nt, Artificial Sequence
  Description of Artificial Sequence: Synthetic oligonucleotide
ccaugcggccgagcucuu

SEQ ID NO: 33478 - RNA, 18 nt, Artificial Sequence
  Description of Artificial Sequence: Synthetic oligonucleotide
cugcaccaugcggccgag

SEQ ID NO: 33479 - RNA, 18 nt, Artificial Sequence
  Description of Artificial Sequence: Synthetic oligonucleotide
uggagcugcaccaugcgg

SEQ ID NO: 33480 - RNA, 18 nt, Artificial Sequence
  Description of Artificial Sequence: Synthetic oligonucleotide
ugagguggagcugcacca

SEQ ID NO: 33481 - RNA, 18 nt, Artificial Sequence
  Description of Artificial Sequence: Synthetic oligonucleotide
acucuugagguggagcug

SEQ ID NO: 33482 - RNA, 18 nt, Artificial Sequence
  Description of Artificial Sequence: Synthetic oligonucleotide
uugucacucuugaggugg

SEQ ID NO: 33483 - RNA, 18 nt, Artificial Sequence
  Description of Artificial Sequence: Synthetic oligonucleotide
gggcuugucacucuugag

SEQ ID NO: 33484 - RNA, 18 nt, Artificial Sequence
  Description of Artificial Sequence: Synthetic oligonucleotide
ucaggagcuuggucuggg

SEQ ID NO: 33485 - RNA, 18 nt, Artificial Sequence
  Description of Artificial Sequence: Synthetic oligonucleotide
gaggaucaggagcuuggu

SEQ ID NO: 33486 - RNA, 18 nt, Artificial Sequence
  Description of Artificial Sequence: Synthetic oligonucleotide
ugguggaggaucaggagc

SEQ ID NO: 33487 - RNA, 18 nt, Artificial Sequence
  Description of Artificial Sequence: Synthetic oligonucleotide
ccgccugguggaggauca

SEQ ID NO: 33488 - RNA, 18 nt, Artificial Sequence
  Description of Artificial Sequence: Synthetic oligonucleotide
ggccaccgccugguggag

SEQ ID NO: 33489 - RNA, 18 nt, Artificial Sequence
  Description of Artificial Sequence: Synthetic oligonucleotide
augacggccaccgccugg

SEQ ID NO: 33490 - RNA, 18 nt, Artificial Sequence
  Description of Artificial Sequence: Synthetic oligonucleotide
ugaggaugacggccaccg

SEQ ID NO: 33491 - RNA, 18 nt, Artificial Sequence
  Description of Artificial Sequence: Synthetic oligonucleotide
cagacugaggaugacggc

SEQ ID NO: 33492 - RNA, 18 nt, Artificial Sequence
  Description of Artificial Sequence: Synthetic oligonucleotide
ugcuccagacugaggaug

SEQ ID NO: 33493 - RNA, 18 nt, Artificial Sequence
  Description of Artificial Sequence: Synthetic oligonucleotide
cuugcugcuccagacuga

SEQ ID NO: 33494 - RNA, 18 nt, Artificial Sequence
  Description of Artificial Sequence: Synthetic oligonucleotide
ucggacuugcugcuccag

SEQ ID NO: 33495 - RNA, 18 nt, Artificial Sequence
  Description of Artificial Sequence: Synthetic oligonucleotide
guaguccugguggcaugc

SEQ ID NO: 33496 - RNA, 18 nt, Artificial Sequence
  Description of Artificial Sequence: Synthetic oligonucleotide
ccccuguaguccuggugg

SEQ ID NO: 33497 - RNA, 18 nt, Artificial Sequence
  Description of Artificial Sequence: Synthetic oligonucleotide
cucugccccuguaguccu

SEQ ID NO: 33498 - RNA, 18 nt, Artificial Sequence
  Description of Artificial Sequence: Synthetic oligonucleotide
agacacucugccccugua

SEQ ID NO: 33499 - RNA, 18 nt, Artificial Sequence
  Description of Artificial Sequence: Synthetic oligonucleotide
agaggagacacucugccc

SEQ ID NO: 33500 - RNA, 18 nt, Artificial Sequence
  Description of Artificial Sequence: Synthetic oligonucleotide
cugccagaggagacacuc

SEQ ID NO: 33501 - RNA, 18 nt, Artificial Sequence
  Description of Artificial Sequence: Synthetic oligonucleotide
cagagcugccagaggaga

SEQ ID NO: 33502 - RNA, 18 nt, Artificial Sequence
  Description of Artificial Sequence: Synthetic oligonucleotide
gaucucagagcugccaga

SEQ ID NO: 33503 - RNA, 18 nt, Artificial Sequence
  Description of Artificial Sequence: Synthetic oligonucleotide
gauuugaucucagagcug

SEQ ID NO: 33504 - RNA, 18 nt, Artificial Sequence
  Description of Artificial Sequence: Synthetic oligonucleotide
caucggauuugaucucag

SEQ ID NO: 33505 - RNA, 18 nt, Artificial Sequence
  Description of Artificial Sequence: Synthetic oligonucleotide
cucgucaucggauuugau

SEQ ID NO: 33506 - RNA, 18 nt, Artificial Sequence
  Description of Artificial Sequence: Synthetic oligonucleotide
ucacccucgucaucggau

SEQ ID NO: 33507 - RNA, 18 nt, Artificial Sequence
  Description of Artificial Sequence: Synthetic oligonucleotide
ucucaucacccucgucau

SEQ ID NO: 33508 - RNA, 18 nt, Artificial Sequence
  Description of Artificial Sequence: Synthetic oligonucleotide
cagguucucaucacccuc

SEQ ID NO: 33509 - RNA, 18 nt, Artificial Sequence
  Description of Artificial Sequence: Synthetic oligonucleotide
ucuugcagguucucauca

SEQ ID NO: 33510 - RNA, 18 nt, Artificial Sequence
  Description of Artificial Sequence: Synthetic oligonucleotide
ucgugucuugcagguucu

SEQ ID NO: 33511 - RNA, 18 nt, Artificial Sequence
  Description of Artificial Sequence: Synthetic oligonucleotide
agauuucgugucuugcag

SEQ ID NO: 33512 - RNA, 18 nt, Artificial Sequence
  Description of Artificial Sequence: Synthetic oligonucleotide
uccgaagauuucgugucu

SEQ ID NO: 33513 - RNA, 18 nt, Artificial Sequence
  Description of Artificial Sequence: Synthetic oligonucleotide
uguccuccgaagauuucg

SEQ ID NO: 33514 - RNA, 18 nt, Artificial Sequence
  Description of Artificial Sequence: Synthetic oligonucleotide
uuucuuguccuccgaaga

SEQ ID NO: 33515 - RNA, 18 nt, Artificial Sequence
  Description of Artificial Sequence: Synthetic oligonucleotide
ucuaauuucuuguccucc

SEQ ID NO: 33516 - RNA, 18 nt, Artificial Sequence
  Description of Artificial Sequence: Synthetic oligonucleotide
cgucaucuaauuucuugu

SEQ ID NO: 33517 - RNA, 18 nt, Artificial Sequence
  Description of Artificial Sequence: Synthetic oligonucleotide
cuugucgucaucuaauuu

SEQ ID NO: 33518 - RNA, 18 nt, Artificial Sequence
  Description of Artificial Sequence: Synthetic oligonucleotide
uccuucuugucgucaucu

SEQ ID NO: 33519 - RNA, 18 nt, Artificial Sequence
  Description of Artificial Sequence: Synthetic oligonucleotide
ugauauccuucuugucgu

SEQ ID NO: 33520 - RNA, 18 nt, Artificial Sequence
  Description of Artificial Sequence: Synthetic oligonucleotide
ugauuugauauccuucuu

SEQ ID NO: 33521 - RNA, 18 nt, Artificial Sequence
  Description of Artificial Sequence: Synthetic oligonucleotide
guaauugauuugauaucc

SEQ ID NO: 33522 - RNA, 18 nt, Artificial Sequence
  Description of Artificial Sequence: Synthetic oligonucleotide
uauacuguuaccuagauc

SEQ ID NO: 33523 - RNA, 18 nt, Artificial Sequence
  Description of Artificial Sequence: Synthetic oligonucleotide
uauuauauacuguuaccu

SEQ ID NO: 33524 - RNA, 18 nt, Artificial Sequence
  Description of Artificial Sequence: Synthetic oligonucleotide
gacaguauuauauacugu

SEQ ID NO: 33525 - RNA, 18 nt, Artificial Sequence
  Description of Artificial Sequence: Synthetic oligonucleotide
gaagcgacaguauuauau

SEQ ID NO: 33526 - RNA, 18 nt, Artificial Sequence
  Description of Artificial Sequence: Synthetic oligonucleotide
uaaaugaagcgacaguau

SEQ ID NO: 33527 - RNA, 18 nt, Artificial Sequence
  Description of Artificial Sequence: Synthetic oligonucleotide
ggaauuaaaugaagcgac

SEQ ID NO: 33528 - RNA, 18 nt, Artificial Sequence
  Description of Artificial Sequence: Synthetic oligonucleotide
auaaaggaauuaaaugaa

SEQ ID NO: 33529 - RNA, 18 nt, Artificial Sequence
  Description of Artificial Sequence: Synthetic oligonucleotide
guccaauaaaggaauuaa

SEQ ID NO: 33530 - RNA, 18 nt, Artificial Sequence
  Description of Artificial Sequence: Synthetic oligonucleotide
ucaaaguccaauaaagga

SEQ ID NO: 33531 - RNA, 18 nt, Artificial Sequence
  Description of Artificial Sequence: Synthetic oligonucleotide
cuucaucaaaguccaaua

SEQ ID NO: 33532 - RNA, 18 nt, Artificial Sequence
  Description of Artificial Sequence: Synthetic oligonucleotide
guucacuucaucaaaguc

SEQ ID NO: 33533 - RNA, 18 nt, Artificial Sequence
  Description of Artificial Sequence: Synthetic oligonucleotide
guucuguucacuucauca

SEQ ID NO: 33534 - RNA, 18 nt, Artificial Sequence
  Description of Artificial Sequence: Synthetic oligonucleotide
uucccguucuguucacuu

SEQ ID NO: 33535 - RNA, 18 nt, Artificial Sequence
  Description of Artificial Sequence: Synthetic oligonucleotide
guuucuucccguucuguu

SEQ ID NO: 33536 - RNA, 18 nt, Artificial Sequence
  Description of Artificial Sequence: Synthetic oligonucleotide
gaauaguuucuucccguu

SEQ ID NO: 33537 - RNA, 18 nt, Artificial Sequence
  Description of Artificial Sequence: Synthetic oligonucleotide
aaacugaauaguuucuuc

SEQ ID NO: 33538 - RNA, 18 nt, Artificial Sequence
  Description of Artificial Sequence: Synthetic oligonucleotide
ggaaaaaacugaauaguu

SEQ ID NO: 33539 - RNA, 18 nt, Artificial Sequence
  Description of Artificial Sequence: Synthetic oligonucleotide
ugccaggaaaaaacugaa

SEQ ID NO: 33540 - RNA, 18 nt, Artificial Sequence
  Description of Artificial Sequence: Synthetic oligonucleotide
uuaccugccaggaaaaaa

SEQ ID NO: 33541 - RNA, 18 nt, Artificial Sequence
  Description of Artificial Sequence: Synthetic oligonucleotide
uaaauuuaccugccagga

SEQ ID NO: 33542 - RNA, 18 nt, Artificial Sequence
  Description of Artificial Sequence: Synthetic oligonucleotide
agcuguaaauuuaccugc

SEQ ID NO: 33543 - RNA, 18 nt, Artificial Sequence
  Description of Artificial Sequence: Synthetic oligonucleotide
uuuucagcuguaaauuua

SEQ ID NO: 33544 - RNA, 18 nt, Artificial Sequence
  Description of Artificial Sequence: Synthetic oligonucleotide
uuuucuuuucagcuguaa

SEQ ID NO: 33545 - RNA, 18 nt, Artificial Sequence
  Description of Artificial Sequence: Synthetic oligonucleotide
uuuaauuuucuuuucagc

SEQ ID NO: 33546 - RNA, 18 nt, Artificial Sequence
  Description of Artificial Sequence: Synthetic oligonucleotide
aggccuuuaauuuucuuu

SEQ ID NO: 33547 - RNA, 18 nt, Artificial Sequence
  Description of Artificial Sequence: Synthetic oligonucleotide
agaguaggccuuuaauuu

SEQ ID NO: 33548 - RNA, 18 nt, Artificial Sequence
  Description of Artificial Sequence: Synthetic oligonucleotide
cuucuagaguaggccuuu

SEQ ID NO: 33549 - RNA, 18 nt, Artificial Sequence
  Description of Artificial Sequence: Synthetic oligonucleotide
uaguacuucuagaguagg

SEQ ID NO: 33550 - RNA, 18 nt, Artificial Sequence
  Description of Artificial Sequence: Synthetic oligonucleotide
acuuuuaguacuucuaga

SEQ ID NO: 33551 - RNA, 18 nt, Artificial Sequence
  Description of Artificial Sequence: Synthetic oligonucleotide
acgauacuuuuaguacuu

SEQ ID NO: 33552 - RNA, 18 nt, Artificial Sequence
  Description of Artificial Sequence: Synthetic oligonucleotide
cugaaacgauacuuuuag

SEQ ID NO: 33553 - RNA, 18 nt, Artificial Sequence
  Description of Artificial Sequence: Synthetic oligonucleotide
gguaucugaaacgauacu

SEQ ID NO: 33554 - RNA, 18 nt, Artificial Sequence
  Description of Artificial Sequence: Synthetic oligonucleotide
guacagguaucugaaacg

SEQ ID NO: 33555 - RNA, 18 nt, Artificial Sequence
  Description of Artificial Sequence: Synthetic oligonucleotide
auagaguacagguaucug

SEQ ID NO: 33556 - RNA, 18 nt, Artificial Sequence
  Description of Artificial Sequence: Synthetic oligonucleotide
cuccaauagaguacaggu

SEQ ID NO: 33557 - RNA, 18 nt, Artificial Sequence
  Description of Artificial Sequence: Synthetic oligonucleotide
uuaggcuccaauagagua

SEQ ID NO: 33558 - RNA, 18 nt, Artificial Sequence
  Description of Artificial Sequence: Synthetic oligonucleotide
acaguuuaggcuccaaua

SEQ ID NO: 33559 - RNA, 18 nt, Artificial Sequence
  Description of Artificial Sequence: Synthetic oligonucleotide
ccaaaacaguuuaggcuc

SEQ ID NO: 33560 - RNA, 18 nt, Artificial Sequence
  Description of Artificial Sequence: Synthetic oligonucleotide
aaaugccaaaacaguuua

SEQ ID NO: 33561 - RNA, 18 nt, Artificial Sequence
  Description of Artificial Sequence: Synthetic oligonucleotide
uucauaaaugccaaaaca

SEQ ID NO: 33562 - RNA, 18 nt, Artificial Sequence
  Description of Artificial Sequence: Synthetic oligonucleotide
ccagauucauaaaugcca

SEQ ID NO: 33563 - RNA, 18 nt, Artificial Sequence
  Description of Artificial Sequence: Synthetic oligonucleotide
uggguccagauucauaaa

SEQ ID NO: 33564 - RNA, 18 nt, Artificial Sequence
  Description of Artificial Sequence: Synthetic oligonucleotide
agcauuggguccagauuc

SEQ ID NO: 33565 - RNA, 18 nt, Artificial Sequence
  Description of Artificial Sequence: Synthetic oligonucleotide
ucauuagcauugggucca

SEQ ID NO: 33566 - RNA, 18 nt, Artificial Sequence
  Description of Artificial Sequence: Synthetic oligonucleotide
gugugucauuagcauugg

SEQ ID NO: 33567 - RNA, 18 nt, Artificial Sequence
  Description of Artificial Sequence: Synthetic oligonucleotide
ucacugugugucauuagc

SEQ ID NO: 33568 - RNA, 18 nt, Artificial Sequence
  Description of Artificial Sequence: Synthetic oligonucleotide
uuuuuucacuguguguca

SEQ ID NO: 33569 - RNA, 18 nt, Artificial Sequence
  Description of Artificial Sequence: Synthetic oligonucleotide
acaaauuuuuucacugug

SEQ ID NO: 33570 - RNA, 18 nt, Artificial Sequence
  Description of Artificial Sequence: Synthetic oligonucleotide
cagagacaaauuuuuuca

SEQ ID NO: 33571 - RNA, 18 nt, Artificial Sequence
  Description of Artificial Sequence: Synthetic oligonucleotide
ugaaucagagacaaauuu

SEQ ID NO: 33572 - RNA, 18 nt, Artificial Sequence
  Description of Artificial Sequence: Synthetic oligonucleotide
guacuugaaucagagaca

SEQ ID NO: 33573 - RNA, 18 nt, Artificial Sequence
  Description of Artificial Sequence: Synthetic oligonucleotide
aaacuguacuugaaucag

SEQ ID NO: 33574 - RNA, 18 nt, Artificial Sequence
  Description of Artificial Sequence: Synthetic oligonucleotide
caaauaaacuguacuuga

SEQ ID NO: 33575 - RNA, 18 nt, Artificial Sequence
  Description of Artificial Sequence: Synthetic oligonucleotide
uuuuacaaauaaacugua

SEQ ID NO: 33576 - RNA, 18 nt, Artificial Sequence
  Description of Artificial Sequence: Synthetic oligonucleotide
uauaguuuuacaaauaaa

SEQ ID NO: 33577 - RNA, 18 nt, Artificial Sequence
  Description of Artificial Sequence: Synthetic oligonucleotide
auaaguauaguuuuacaa

SEQ ID NO: 33578 - RNA, 18 nt, Artificial Sequence
  Description of Artificial Sequence: Synthetic oligonucleotide
guagaauaaguauaguuu

SEQ ID NO: 33579 - RNA, 18 nt, Artificial Sequence
  Description of Artificial Sequence: Synthetic oligonucleotide
aauuuguagaauaaguau

SEQ ID NO: 33580 - RNA, 18 nt, Artificial Sequence
  Description of Artificial Sequence: Synthetic oligonucleotide
gaccaaauuuguagaaua

SEQ ID NO: 33581 - RNA, 18 nt, Artificial Sequence
  Description of Artificial Sequence: Synthetic oligonucleotide
uuucugaccaaauuugua

SEQ ID NO: 33582 - RNA, 18 nt, Artificial Sequence
  Description of Artificial Sequence: Synthetic oligonucleotide
caacauuucugaccaaau

SEQ ID NO: 33583 - RNA, 18 nt, Artificial Sequence
  Description of Artificial Sequence: Synthetic oligonucleotide
agacacaacauuucugac

SEQ ID NO: 33584 - RNA, 18 nt, Artificial Sequence
  Description of Artificial Sequence: Synthetic oligonucleotide
auuauagacacaacauuu

SEQ ID NO: 33585 - RNA, 18 nt, Artificial Sequence
  Description of Artificial Sequence: Synthetic oligonucleotide
gaaauauuauagacacaa

SEQ ID NO: 33586 - RNA, 18 nt, Artificial Sequence
  Description of Artificial Sequence: Synthetic oligonucleotide
uuuuagaaauauuauaga

SEQ ID NO: 33587 - RNA, 18 nt, Artificial Sequence
  Description of Artificial Sequence: Synthetic oligonucleotide
ucucuuuuuagaaauauu

SEQ ID NO: 33588 - RNA, 18 nt, Artificial Sequence
  Description of Artificial Sequence: Synthetic oligonucleotide
uacaaucucuuuuuagaa

SEQ ID NO: 33589 - RNA, 18 nt, Artificial Sequence
  Description of Artificial Sequence: Synthetic oligonucleotide
auggcuacaaucucuuuu

SEQ ID NO: 33590 - RNA, 18 nt, Artificial Sequence
  Description of Artificial Sequence: Synthetic oligonucleotide
uuaacauggcuacaaucu

SEQ ID NO: 33591 - RNA, 18 nt, Artificial Sequence
  Description of Artificial Sequence: Synthetic oligonucleotide
aguuuuuaacauggcuac

SEQ ID NO: 33592 - RNA, 18 nt, Artificial Sequence
  Description of Artificial Sequence: Synthetic oligonucleotide
aguugaguuuuuaacaug

SEQ ID NO: 33593 - RNA, 18 nt, Artificial Sequence
  Description of Artificial Sequence: Synthetic oligonucleotide
acaucaguugaguuuuua

SEQ ID NO: 33594 - RNA, 18 nt, Artificial Sequence
  Description of Artificial Sequence: Synthetic oligonucleotide
cacauacaucaguugagu

SEQ ID NO: 33595 - RNA, 18 nt, Artificial Sequence
  Description of Artificial Sequence: Synthetic oligonucleotide
guuggcacauacaucagu

SEQ ID NO: 33596 - RNA, 18 nt, Artificial Sequence
  Description of Artificial Sequence: Synthetic oligonucleotide
uuauaguuggcacauaca

SEQ ID NO: 33597 - RNA, 18 nt, Artificial Sequence
  Description of Artificial Sequence: Synthetic oligonucleotide
aagaguuauaguuggcac

SEQ ID NO: 33598 - RNA, 18 nt, Artificial Sequence
  Description of Artificial Sequence: Synthetic oligonucleotide
aagaaaagaguuauaguu

SEQ ID NO: 33599 - RNA, 18 nt, Artificial Sequence
  Description of Artificial Sequence: Synthetic oligonucleotide
gagguaagaaaagaguua

SEQ ID NO: 33600 - RNA, 18 nt, Artificial Sequence
  Description of Artificial Sequence: Synthetic oligonucleotide
cuuuagagguaagaaaag

SEQ ID NO: 33601 - RNA, 18 nt, Artificial Sequence
  Description of Artificial Sequence: Synthetic oligonucleotide
ucuuacuuuagagguaag

SEQ ID NO: 33602 - RNA, 18 nt, Artificial Sequence
  Description of Artificial Sequence: Synthetic oligonucleotide
uauuuucuuacuuuagag

SEQ ID NO: 33603 - RNA, 18 nt, Artificial Sequence
  Description of Artificial Sequence: Synthetic oligonucleotide
gaaauuauuuucuuacuu

SEQ ID NO: 33604 - RNA, 18 nt, Artificial Sequence
  Description of Artificial Sequence: Synthetic oligonucleotide
ucuaggaaauuauuuucu

SEQ ID NO: 33605 - RNA, 18 nt, Artificial Sequence
  Description of Artificial Sequence: Synthetic oligonucleotide
auaaaucuaggaaauuau

SEQ ID NO: 33606 - RNA, 18 nt, Artificial Sequence
  Description of Artificial Sequence: Synthetic oligonucleotide
uuaggauaaaucuaggaa

SEQ ID NO: 33607 - RNA, 18 nt, Artificial Sequence
  Description of Artificial Sequence: Synthetic oligonucleotide
cauguuuaggauaaaucu

SEQ ID NO: 33608 - RNA, 18 nt, Artificial Sequence
  Description of Artificial Sequence: Synthetic oligonucleotide
aucagcauguuuaggaua

SEQ ID NO: 33609 - RNA, 18 nt, Artificial Sequence
  Description of Artificial Sequence: Synthetic oligonucleotide
uauacaucagcauguuua

SEQ ID NO: 33610 - RNA, 18 nt, Artificial Sequence
  Description of Artificial Sequence: Synthetic oligonucleotide
ucuuauauacaucagcau

SEQ ID NO: 33611 - RNA, 18 nt, Artificial Sequence
  Description of Artificial Sequence: Synthetic oligonucleotide
auuacucuuauauacauc

SEQ ID NO: 33612 - RNA, 18 nt, Artificial Sequence
  Description of Artificial Sequence: Synthetic oligonucleotide
aagguauuacucuuauau

SEQ ID NO: 33613 - RNA, 18 nt, Artificial Sequence
  Description of Artificial Sequence: Synthetic oligonucleotide
caauuaagguauuacucu

SEQ ID NO: 33614 - RNA, 18 nt, Artificial Sequence
  Description of Artificial Sequence: Synthetic oligonucleotide
auaaacaauuaagguauu

SEQ ID NO: 33615 - RNA, 18 nt, Artificial Sequence
  Description of Artificial Sequence: Synthetic oligonucleotide
aaaccauaaacaauuaag

SEQ ID NO: 33616 - RNA, 18 nt, Artificial Sequence
  Description of Artificial Sequence: Synthetic oligonucleotide
aagaaaaaccauaaacaa

SEQ ID NO: 33617 - RNA, 18 nt, Artificial Sequence
  Description of Artificial Sequence: Synthetic oligonucleotide
ccaggaagaaaaaccaua

SEQ ID NO: 33618 - RNA, 18 nt, Artificial Sequence
  Description of Artificial Sequence: Synthetic oligonucleotide
aguguccaggaagaaaaa

SEQ ID NO: 33619 - RNA, 18 nt, Artificial Sequence
  Description of Artificial Sequence: Synthetic oligonucleotide
aaaagaguguccaggaag

SEQ ID NO: 33620 - RNA, 18 nt, Artificial Sequence
  Description of Artificial Sequence: Synthetic oligonucleotide
uguagaaaagagugucca

SEQ ID NO: 33621 - RNA, 18 nt, Artificial Sequence
  Description of Artificial Sequence: Synthetic oligonucleotide
caaaaaaauacaaggcag

SEQ ID NO: 33622 - RNA, 18 nt, Artificial Sequence
  Description of Artificial Sequence: Synthetic oligonucleotide
uaggucaaaaaaauacaa

SEQ ID NO: 33623 - RNA, 18 nt, Artificial Sequence
  Description of Artificial Sequence: Synthetic oligonucleotide
uuugauaggucaaaaaaa

SEQ ID NO: 33624 - RNA, 18 nt, Artificial Sequence
  Description of Artificial Sequence: Synthetic oligonucleotide
augauuuugauaggucaa

SEQ ID NO: 33625 - RNA, 18 nt, Artificial Sequence
  Description of Artificial Sequence: Synthetic oligonucleotide
gaaaaaugauuuugauag

SEQ ID NO: 33626 - RNA, 18 nt, Artificial Sequence
  Description of Artificial Sequence: Synthetic oligonucleotide
uaauugaaaaaugauuuu

SEQ ID NO: 33627 - RNA, 18 nt, Artificial Sequence
  Description of Artificial Sequence: Synthetic oligonucleotide
acaaguaauugaaaaaug

SEQ ID NO: 33628 - RNA, 18 nt, Artificial Sequence
  Description of Artificial Sequence: Synthetic oligonucleotide
gggaaacaaguaauugaa

SEQ ID NO: 33629 - RNA, 18 nt, Artificial Sequence
  Description of Artificial Sequence: Synthetic oligonucleotide
gacaucugaaaucuaggg

SEQ ID NO: 33630 - RNA, 18 nt, Artificial Sequence
  Description of Artificial Sequence: Synthetic oligonucleotide
ccgugacaucugaaaucu

SEQ ID NO: 33631 - RNA, 18 nt, Artificial Sequence
  Description of Artificial Sequence: Synthetic oligonucleotide
ucauaccgugacaucuga

SEQ ID NO: 33632 - RNA, 18 nt, Artificial Sequence
  Description of Artificial Sequence: Synthetic oligonucleotide
accuuucauaccgugaca

SEQ ID NO: 33633 - RNA, 18 nt, Artificial Sequence
  Description of Artificial Sequence: Synthetic oligonucleotide
auaaaaccuuucauaccg

SEQ ID NO: 33634 - RNA, 18 nt, Artificial Sequence
  Description of Artificial Sequence: Synthetic oligonucleotide
uauauauaaaaccuuuca

SEQ ID NO: 33635 - RNA, 18 nt, Artificial Sequence
  Description of Artificial Sequence: Synthetic oligonucleotide
uuaaauauauauaaaacc

SEQ ID NO: 33636 - RNA, 18 nt, Artificial Sequence
  Description of Artificial Sequence: Synthetic oligonucleotide
auuuuuuaaauauauaua

SEQ ID NO: 33637 - RNA, 18 nt, Artificial Sequence
  Description of Artificial Sequence: Synthetic oligonucleotide
acuuuauuuuuuaaauau

SEQ ID NO: 33638 - RNA, 18 nt, Artificial Sequence
  Description of Artificial Sequence: Synthetic oligonucleotide
uuuauacuuuauuuuuua

SEQ ID NO: 33639 - RNA, 18 nt, Artificial Sequence
  Description of Artificial Sequence: Synthetic oligonucleotide
uuauguuuauacuuuauu

SEQ ID NO: 33640 - RNA, 18 nt, Artificial Sequence
  Description of Artificial Sequence: Synthetic oligonucleotide
agacuuuauguuuauacu

SEQ ID NO: 33641 - RNA, 18 nt, Artificial Sequence
  Description of Artificial Sequence: Synthetic oligonucleotide
caaaaagacuuuauguuu

SEQ ID NO: 33642 - RNA, 18 nt, Artificial Sequence
  Description of Artificial Sequence: Synthetic oligonucleotide
cgcuucaaaaagacuuua

SEQ ID NO: 33643 - RNA, 18 nt, Artificial Sequence
  Description of Artificial Sequence: Synthetic oligonucleotide
aaccacgcuucaaaaaga

SEQ ID NO: 33644 - RNA, 18 nt, Artificial Sequence
  Description of Artificial Sequence: Synthetic oligonucleotide
ugcauaaccacgcuucaa

SEQ ID NO: 33645 - RNA, 18 nt, Artificial Sequence
  Description of Artificial Sequence: Synthetic oligonucleotide
uauguugcauaaccacgc

SEQ ID NO: 33646 - RNA, 18 nt, Artificial Sequence
  Description of Artificial Sequence: Synthetic oligonucleotide
uagcauauguugcauaac

SEQ ID NO: 33647 - RNA, 18 nt, Artificial Sequence
  Description of Artificial Sequence: Synthetic oligonucleotide
acgccuagcauauguugc

SEQ ID NO: 33648 - RNA, 18 nt, Artificial Sequence
  Description of Artificial Sequence: Synthetic oligonucleotide
aacuuacgccuagcauau

SEQ ID NO: 33649 - RNA, 18 nt, Artificial Sequence
  Description of Artificial Sequence: Synthetic oligonucleotide
ucaccaacuuacgccuag

SEQ ID NO: 33650 - RNA, 18 nt, Artificial Sequence
  Description of Artificial Sequence: Synthetic oligonucleotide
ggcauucaccaacuuacg

SEQ ID NO: 33651 - RNA, 18 nt, Artificial Sequence
  Description of Artificial Sequence: Synthetic oligonucleotide
aagcaggcauucaccaac

SEQ ID NO: 33652 - RNA, 18 nt, Artificial Sequence
  Description of Artificial Sequence: Synthetic oligonucleotide
cugcaaagcaggcauuca

SEQ ID NO: 33653 - RNA, 18 nt, Artificial Sequence
  Description of Artificial Sequence: Synthetic oligonucleotide
acacucugcaaagcaggc

SEQ ID NO: 33654 - RNA, 18 nt, Artificial Sequence
  Description of Artificial Sequence: Synthetic oligonucleotide
ggguuacacucugcaaag

SEQ ID NO: 33655 - RNA, 18 nt, Artificial Sequence
  Description of Artificial Sequence: Synthetic oligonucleotide
cuuuuuuuauucaauggg

SEQ ID NO: 33656 - RNA, 18 nt, Artificial Sequence
  Description of Artificial Sequence: Synthetic oligonucleotide
gcuuuuuuuauucaaugg

SEQ ID NO: 33657 - RNA, 18 nt, Artificial Sequence
  Description of Artificial Sequence: Synthetic oligonucleotide
acaaagcuuuuuuuauuc

SEQ ID NO: 33658 - RNA, 18 nt, Artificial Sequence
  Description of Artificial Sequence: Synthetic oligonucleotide
ggaaaacaaagcuuuuuu

SEQ ID NO: 33659 - RNA, 18 nt, Artificial Sequence
  Description of Artificial Sequence: Synthetic oligonucleotide
gaaagggaaaacaaagcu

SEQ ID NO: 33660 - RNA, 18 nt, Artificial Sequence
  Description of Artificial Sequence: Synthetic oligonucleotide
gggcagaaagggaaaaca

SEQ ID NO: 33661 - RNA, 18 nt, Artificial Sequence
  Description of Artificial Sequence: Synthetic oligonucleotide
gcccauacugauacaggg

SEQ ID NO: 33662 - RNA, 18 nt, Artificial Sequence
  Description of Artificial Sequence: Synthetic oligonucleotide
ugcccauacugauacagg

SEQ ID NO: 33663 - RNA, 18 nt, Artificial Sequence
  Description of Artificial Sequence: Synthetic oligonucleotide
gggugugcccauacugau

SEQ ID NO: 33664 - RNA, 18 nt, Artificial Sequence
  Description of Artificial Sequence: Synthetic oligonucleotide
gugcagggugugcccaua

SEQ ID NO: 33665 - RNA, 18 nt, Artificial Sequence
  Description of Artificial Sequence: Synthetic oligonucleotide
uuagagugcagggugugc

SEQ ID NO: 33666 - RNA, 18 nt, Artificial Sequence
  Description of Artificial Sequence: Synthetic oligonucleotide
uaaaguuagagugcaggg

SEQ ID NO: 33667 - RNA, 18 nt, Artificial Sequence
  Description of Artificial Sequence: Synthetic oligonucleotide
uagauuaaaguuagagug

SEQ ID NO: 33668 - RNA, 18 nt, Artificial Sequence
  Description of Artificial Sequence: Synthetic oligonucleotide
ugacguagauuaaaguua

SEQ ID NO: 33669 - RNA, 18 nt, Artificial Sequence
  Description of Artificial Sequence: Synthetic oligonucleotide
gagggugacguagauuaa

SEQ ID NO: 33670 - RNA, 18 nt, Artificial Sequence
  Description of Artificial Sequence: Synthetic oligonucleotide
caggugagggugacguag

SEQ ID NO: 33671 - RNA, 18 nt, Artificial Sequence
  Description of Artificial Sequence: Synthetic oligonucleotide
ccaaacaggugaggguga

SEQ ID NO: 33672 - RNA, 18 nt, Artificial Sequence
  Description of Artificial Sequence: Synthetic oligonucleotide
ccaaaccaaacaggugag

SEQ ID NO: 33673 - RNA, 18 nt, Artificial Sequence
  Description of Artificial Sequence: Synthetic oligonucleotide
uaaacccaaaccaaacag

SEQ ID NO: 33674 - RNA, 18 nt, Artificial Sequence
  Description of Artificial Sequence: Synthetic oligonucleotide
gacauuaaacccaaacca

SEQ ID NO: 33675 - RNA, 18 nt, Artificial Sequence
  Description of Artificial Sequence: Synthetic oligonucleotide
ucgcagacauuaaaccca

SEQ ID NO: 33676 - RNA, 18 nt, Artificial Sequence
  Description of Artificial Sequence: Synthetic oligonucleotide
uuuucucgcagacauuaa

SEQ ID NO: 33677 - RNA, 18 nt, Artificial Sequence
  Description of Artificial Sequence: Synthetic oligonucleotide
uuugguuuucucgcagac

SEQ ID NO: 33678 - RNA, 18 nt, Artificial Sequence
  Description of Artificial Sequence: Synthetic oligonucleotide
agauauuugguuuucucg

SEQ ID NO: 33679 - RNA, 18 nt, Artificial Sequence
  Description of Artificial Sequence: Synthetic oligonucleotide
acacaagauauuugguuu

SEQ ID NO: 33680 - RNA, 18 nt, Artificial Sequence
  Description of Artificial Sequence: Synthetic oligonucleotide
acaauacacaagauauuu

SEQ ID NO: 33681 - RNA, 18 nt, Artificial Sequence
  Description of Artificial Sequence: Synthetic oligonucleotide
aguucacaauacacaaga

SEQ ID NO: 33682 - RNA, 18 nt, Artificial Sequence
  Description of Artificial Sequence: Synthetic oligonucleotide
uugacaguucacaauaca

SEQ ID NO: 33683 - RNA, 18 nt, Artificial Sequence
  Description of Artificial Sequence: Synthetic oligonucleotide
uggcuuugacaguucaca

SEQ ID NO: 33684 - RNA, 18 nt, Artificial Sequence
  Description of Artificial Sequence: Synthetic oligonucleotide
uuagauggcuuugacagu

SEQ ID NO: 33685 - RNA, 18 nt, Artificial Sequence
  Description of Artificial Sequence: Synthetic oligonucleotide
uugguuuagauggcuuug

SEQ ID NO: 33686 - RNA, 18 nt, Artificial Sequence
  Description of Artificial Sequence: Synthetic oligonucleotide
ugggauugguuuagaugg

SEQ ID NO: 33687 - RNA, 18 nt, Artificial Sequence
  Description of Artificial Sequence: Synthetic oligonucleotide
gaccuugggauugguuua

SEQ ID NO: 33688 - RNA, 18 nt, Artificial Sequence
  Description of Artificial Sequence: Synthetic oligonucleotide
cacuugaccuugggauug

SEQ ID NO: 33689 - RNA, 18 nt, Artificial Sequence
  Description of Artificial Sequence: Synthetic oligonucleotide
auauccacuugaccuugg

SEQ ID NO: 33690 - RNA, 18 nt, Artificial Sequence
  Description of Artificial Sequence: Synthetic oligonucleotide
uuuuuauauccacuugac

SEQ ID NO: 33691 - RNA, 18 nt, Artificial Sequence
  Description of Artificial Sequence: Synthetic oligonucleotide
cagaauuuuuauauccac

SEQ ID NO: 33692 - RNA, 18 nt, Artificial Sequence
  Description of Artificial Sequence: Synthetic oligonucleotide
uuuggcagaauuuuuaua

SEQ ID NO: 33693 - RNA, 18 nt, Artificial Sequence
  Description of Artificial Sequence: Synthetic oligonucleotide
auguuuuuggcagaauuu

SEQ ID NO: 33694 - RNA, 18 nt, Artificial Sequence
  Description of Artificial Sequence: Synthetic oligonucleotide
augccauguuuuuggcag

SEQ ID NO: 33695 - RNA, 18 nt, Artificial Sequence
  Description of Artificial Sequence: Synthetic oligonucleotide
aucuuaugccauguuuuu

SEQ ID NO: 33696 - RNA, 18 nt, Artificial Sequence
  Description of Artificial Sequence: Synthetic oligonucleotide
uuuccaucuuaugccaug

SEQ ID NO: 33697 - RNA, 18 nt, Artificial Sequence
  Description of Artificial Sequence: Synthetic oligonucleotide
gaacuuuuccaucuuaug

SEQ ID NO: 33698 - RNA, 18 nt, Artificial Sequence
  Description of Artificial Sequence: Synthetic oligonucleotide
ucagggaacuuuuccauc

SEQ ID NO: 33699 - RNA, 18 nt, Artificial Sequence
  Description of Artificial Sequence: Synthetic oligonucleotide
aguuuucagggaacuuuu

SEQ ID NO: 33700 - RNA, 18 nt, Artificial Sequence
  Description of Artificial Sequence: Synthetic oligonucleotide
uccagaguuuucagggaa

SEQ ID NO: 33701 - RNA, 18 nt, Artificial Sequence
  Description of Artificial Sequence: Synthetic oligonucleotide
uuucuuccagaguuuuca

SEQ ID NO: 33702 - RNA, 18 nt, Artificial Sequence
  Description of Artificial Sequence: Synthetic oligonucleotide
uuuguuuucuuccagagu

SEQ ID NO: 33703 - RNA, 18 nt, Artificial Sequence
  Description of Artificial Sequence: Synthetic oligonucleotide
auuacuuuguuuucuucc

SEQ ID NO: 33704 - RNA, 18 nt, Artificial Sequence
  Description of Artificial Sequence: Synthetic oligonucleotide
ucuacauuacuuuguuuu

SEQ ID NO: 33705 - RNA, 18 nt, Artificial Sequence
  Description of Artificial Sequence: Synthetic oligonucleotide
aggugucuacauuacuuu

SEQ ID NO: 33706 - RNA, 18 nt, Artificial Sequence
  Description of Artificial Sequence: Synthetic oligonucleotide
aaagaaggugucuacauu

SEQ ID NO: 33707 - RNA, 18 nt, Artificial Sequence
  Description of Artificial Sequence: Synthetic oligonucleotide
gggaaaaagaaggugucu

SEQ ID NO: 33708 - RNA, 18 nt, Artificial Sequence
  Description of Artificial Sequence: Synthetic oligonucleotide
auuuucuaaugguguggg

SEQ ID NO: 33709 - RNA, 18 nt, Artificial Sequence
  Description of Artificial Sequence: Synthetic oligonucleotide
aacauuuucuaauggugu

SEQ ID NO: 33710 - RNA, 18 nt, Artificial Sequence
  Description of Artificial Sequence: Synthetic oligonucleotide
gaugcaacauuuucuaau

SEQ ID NO: 33711 - RNA, 18 nt, Artificial Sequence
  Description of Artificial Sequence: Synthetic oligonucleotide
guccucaucgucauuauu

SEQ ID NO: 33712 - RNA, 18 nt, Artificial Sequence
  Description of Artificial Sequence: Synthetic oligonucleotide
gucagguccucaucguca

SEQ ID NO: 33713 - RNA, 18 nt, Artificial Sequence
  Description of Artificial Sequence: Synthetic oligonucleotide
cuggugucagguccucau

SEQ ID NO: 33714 - RNA, 18 nt, Artificial Sequence
  Description of Artificial Sequence: Synthetic oligonucleotide
cugcucuggugucagguc

SEQ ID NO: 33715 - RNA, 18 nt, Artificial Sequence
  Description of Artificial Sequence: Synthetic oligonucleotide
gccuucugcucugguguc

SEQ ID NO: 33716 - RNA, 18 nt, Artificial Sequence
  Description of Artificial Sequence: Synthetic oligonucleotide
gcucugccuucugcucug

SEQ ID NO: 33717 - RNA, 18 nt, Artificial Sequence
  Description of Artificial Sequence: Synthetic oligonucleotide
cucacgcucugccuucug

SEQ ID NO: 33718 - RNA, 18 nt, Artificial Sequence
  Description of Artificial Sequence: Synthetic oligonucleotide
uccuucucacgcucugcc

SEQ ID NO: 33719 - RNA, 18 nt, Artificial Sequence
  Description of Artificial Sequence: Synthetic oligonucleotide
uccgcuccuucucacgcu

SEQ ID NO: 33720 - RNA, 18 nt, Artificial Sequence
  Description of Artificial Sequence: Synthetic oligonucleotide
cauccuccgcuccuucuc

SEQ ID NO: 33721 - RNA, 18 nt, Artificial Sequence
  Description of Artificial Sequence: Synthetic oligonucleotide
uuggccauccuccgcucc

SEQ ID NO: 33722 - RNA, 18 nt, Artificial Sequence
  Description of Artificial Sequence: Synthetic oligonucleotide
cauuguuggccauccucc

SEQ ID NO: 33723 - RNA, 18 nt, Artificial Sequence
  Description of Artificial Sequence: Synthetic oligonucleotide
ucgggcauuguuggccau

SEQ ID NO: 33724 - RNA, 18 nt, Artificial Sequence
  Description of Artificial Sequence: Synthetic oligonucleotide
cgcucucgggcauuguug

SEQ ID NO: 33725 - RNA, 18 nt, Artificial Sequence
  Description of Artificial Sequence: Synthetic oligonucleotide
gcagacgcucucgggcau

SEQ ID NO: 33726 - RNA, 18 nt, Artificial Sequence
  Description of Artificial Sequence: Synthetic oligonucleotide
gacccgcagacgcucucg

SEQ ID NO: 33727 - RNA, 18 nt, Artificial Sequence
  Description of Artificial Sequence: Synthetic oligonucleotide
ucacggacccgcagacgc

SEQ ID NO: 33728 - RNA, 18 nt, Artificial Sequence
  Description of Artificial Sequence: Synthetic oligonucleotide
ugaugucacggacccgca

SEQ ID NO: 33729 - RNA, 18 nt, Artificial Sequence
  Description of Artificial Sequence: Synthetic oligonucleotide
cucguugaugucacggac

SEQ ID NO: 33730 - RNA, 18 nt, Artificial Sequence
  Description of Artificial Sequence: Synthetic oligonucleotide
aaagccucguugauguca

SEQ ID NO: 33731 - RNA, 18 nt, Artificial Sequence
  Description of Artificial Sequence: Synthetic oligonucleotide
cuuugaaagccucguuga

SEQ ID NO: 33732 - RNA, 18 nt, Artificial Sequence
  Description of Artificial Sequence: Synthetic oligonucleotide
gagcucuuugaaagccuc

SEQ ID NO: 33733 - RNA, 18 nt, Artificial Sequence
  Description of Artificial Sequence: Synthetic oligonucleotide
cggccgagcucuuugaaa

SEQ ID NO: 33734 - RNA, 18 nt, Artificial Sequence
  Description of Artificial Sequence: Synthetic oligonucleotide
ccaugcggccgagcucuu

SEQ ID NO: 33735 - RNA, 18 nt, Artificial Sequence
  Description of Artificial Sequence: Synthetic oligonucleotide
cugcaccaugcggccgag

SEQ ID NO: 33736 - RNA, 18 nt, Artificial Sequence
  Description of Artificial Sequence: Synthetic oligonucleotide
uggagcugcaccaugcgg

SEQ ID NO: 33737 - RNA, 18 nt, Artificial Sequence
  Description of Artificial Sequence: Synthetic oligonucleotide
ugagguggagcugcacca

SEQ ID NO: 33738 - RNA, 18 nt, Artificial Sequence
  Description of Artificial Sequence: Synthetic oligonucleotide
acucuugagguggagcug

SEQ ID NO: 33739 - RNA, 18 nt, Artificial Sequence
  Description of Artificial Sequence: Synthetic oligonucleotide
uugucacucuugaggugg

SEQ ID NO: 33740 - RNA, 18 nt, Artificial Sequence
  Description of Artificial Sequence: Synthetic oligonucleotide
gggcuugucacucuugag

SEQ ID NO: 33741 - RNA, 18 nt, Artificial Sequence
  Description of Artificial Sequence: Synthetic oligonucleotide
ucaggagcuuggucuggg

SEQ ID NO: 33742 - RNA, 18 nt, Artificial Sequence
  Description of Artificial Sequence: Synthetic oligonucleotide
gaggaucaggagcuuggu

SEQ ID NO: 33743 - RNA, 18 nt, Artificial Sequence
  Description of Artificial Sequence: Synthetic oligonucleotide
ugguggaggaucaggagc

SEQ ID NO: 33744 - RNA, 18 nt, Artificial Sequence
  Description of Artificial Sequence: Synthetic oligonucleotide
ccgccugguggaggauca

SEQ ID NO: 33745 - RNA, 18 nt, Artificial Sequence
  Description of Artificial Sequence: Synthetic oligonucleotide
ggccaccgccugguggag

SEQ ID NO: 33746 - RNA, 18 nt, Artificial Sequence
  Description of Artificial Sequence: Synthetic oligonucleotide
augacggccaccgccugg

SEQ ID NO: 33747 - RNA, 18 nt, Artificial Sequence
  Description of Artificial Sequence: Synthetic oligonucleotide
ugaggaugacggccaccg

SEQ ID NO: 33748 - RNA, 18 nt, Artificial Sequence
  Description of Artificial Sequence: Synthetic oligonucleotide
cagacugaggaugacggc

SEQ ID NO: 33749 - RNA, 18 nt, Artificial Sequence
  Description of Artificial Sequence: Synthetic oligonucleotide
ugcuccagacugaggaug

SEQ ID NO: 33750 - RNA, 18 nt, Artificial Sequence
  Description of Artificial Sequence: Synthetic oligonucleotide
cuugcugcuccagacuga

SEQ ID NO: 33751 - RNA, 18 nt, Artificial Sequence
  Description of Artificial Sequence: Synthetic oligonucleotide
ucggacuugcugcuccag

SEQ ID NO: 33752 - RNA, 18 nt, Artificial Sequence
  Description of Artificial Sequence: Synthetic oligonucleotide
cuguaguccugguggcau

SEQ ID NO: 33753 - RNA, 18 nt, Artificial Sequence
  Description of Artificial Sequence: Synthetic oligonucleotide
ugccccuguaguccuggu

SEQ ID NO: 33754 - RNA, 18 nt, Artificial Sequence
  Description of Artificial Sequence: Synthetic oligonucleotide
cacucugccccuguaguc

SEQ ID NO: 33755 - RNA, 18 nt, Artificial Sequence
  Description of Artificial Sequence: Synthetic oligonucleotide
ggagacacucugccccug

SEQ ID NO: 33756 - RNA, 18 nt, Artificial Sequence
  Description of Artificial Sequence: Synthetic oligonucleotide
ccagaggagacacucugc

SEQ ID NO: 33757 - RNA, 18 nt, Artificial Sequence
  Description of Artificial Sequence: Synthetic oligonucleotide
agcugccagaggagacac

SEQ ID NO: 33758 - RNA, 18 nt, Artificial Sequence
  Description of Artificial Sequence: Synthetic oligonucleotide
cucagagcugccagagga

SEQ ID NO: 33759 - RNA, 18 nt, Artificial Sequence
  Description of Artificial Sequence: Synthetic oligonucleotide
uugaucucagagcugcca

SEQ ID NO: 33760 - RNA, 18 nt, Artificial Sequence
  Description of Artificial Sequence: Synthetic oligonucleotide
cggauuugaucucagagc

SEQ ID NO: 33761 - RNA, 18 nt, Artificial Sequence
  Description of Artificial Sequence: Synthetic oligonucleotide
gucaucggauuugaucuc

SEQ ID NO: 33762 - RNA, 18 nt, Artificial Sequence
  Description of Artificial Sequence: Synthetic oligonucleotide
cccucgucaucggauuug

SEQ ID NO: 33763 - RNA, 18 nt, Artificial Sequence
  Description of Artificial Sequence: Synthetic oligonucleotide
caucacccucgucaucgg

SEQ ID NO: 33764 - RNA, 18 nt, Artificial Sequence
  Description of Artificial Sequence: Synthetic oligonucleotide
guucucaucacccucguc

SEQ ID NO: 33765 - RNA, 18 nt, Artificial Sequence
  Description of Artificial Sequence: Synthetic oligonucleotide
ugcagguucucaucaccc

SEQ ID NO: 33766 - RNA, 18 nt, Artificial Sequence
  Description of Artificial Sequence: Synthetic oligonucleotide
ugucuugcagguucucau

SEQ ID NO: 33767 - RNA, 18 nt, Artificial Sequence
  Description of Artificial Sequence: Synthetic oligonucleotide
uuucgugucuugcagguu

SEQ ID NO: 33768 - RNA, 18 nt, Artificial Sequence
  Description of Artificial Sequence: Synthetic oligonucleotide
gaagauuucgugucuugc

SEQ ID NO: 33769 - RNA, 18 nt, Artificial Sequence
  Description of Artificial Sequence: Synthetic oligonucleotide
ccuccgaagauuucgugu

SEQ ID NO: 33770 - RNA, 18 nt, Artificial Sequence
  Description of Artificial Sequence: Synthetic oligonucleotide
cuuguccuccgaagauuu

SEQ ID NO: 33771 - RNA, 18 nt, Artificial Sequence
  Description of Artificial Sequence: Synthetic oligonucleotide
aauuucuuguccuccgaa

SEQ ID NO: 33772 - RNA, 18 nt, Artificial Sequence
  Description of Artificial Sequence: Synthetic oligonucleotide
caucuaauuucuuguccu

SEQ ID NO: 33773 - RNA, 18 nt, Artificial Sequence
  Description of Artificial Sequence: Synthetic oligonucleotide
gucgucaucuaauuucuu

SEQ ID NO: 33774 - RNA, 18 nt, Artificial Sequence
  Description of Artificial Sequence: Synthetic oligonucleotide
uucuugucgucaucuaau

SEQ ID NO: 33775 - RNA, 18 nt, Artificial Sequence
  Description of Artificial Sequence: Synthetic oligonucleotide
uauccuucuugucgucau

SEQ ID NO: 33776 - RNA, 18 nt, Artificial Sequence
  Description of Artificial Sequence: Synthetic oligonucleotide
uuugauauccuucuuguc

SEQ ID NO: 33777 - RNA, 18 nt, Artificial Sequence
  Description of Artificial Sequence: Synthetic oligonucleotide
auugauuugauauccuuc

SEQ ID NO: 33778 - RNA, 18 nt, Artificial Sequence
  Description of Artificial Sequence: Synthetic oligonucleotide
uaguaauugauuugauau

SEQ ID NO: 33779 - RNA, 18 nt, Artificial Sequence
  Description of Artificial Sequence: Synthetic oligonucleotide
ugaccuaguaauugauuu

SEQ ID NO: 33780 - RNA, 18 nt, Artificial Sequence
  Description of Artificial Sequence: Synthetic oligonucleotide
gaucuugaccuaguaauu

SEQ ID NO: 33781 - RNA, 18 nt, Artificial Sequence
  Description of Artificial Sequence: Synthetic oligonucleotide
gcgacaguauuauauacu

SEQ ID NO: 33782 - RNA, 18 nt, Artificial Sequence
  Description of Artificial Sequence: Synthetic oligonucleotide
augaagcgacaguauuau

SEQ ID NO: 33783 - RNA, 18 nt, Artificial Sequence
  Description of Artificial Sequence: Synthetic oligonucleotide
auuaaaugaagcgacagu

SEQ ID NO: 33784 - RNA, 18 nt, Artificial Sequence
  Description of Artificial Sequence: Synthetic oligonucleotide
aaggaauuaaaugaagcg

SEQ ID NO: 33785 - RNA, 18 nt, Artificial Sequence
  Description of Artificial Sequence: Synthetic oligonucleotide
caauaaaggaauuaaaug

SEQ ID NO: 33786 - RNA, 18 nt, Artificial Sequence
  Description of Artificial Sequence: Synthetic oligonucleotide
aaguccaauaaaggaauu

SEQ ID NO: 33787 - RNA, 18 nt, Artificial Sequence
  Description of Artificial Sequence: Synthetic oligonucleotide
caucaaaguccaauaaag

SEQ ID NO: 33788 - RNA, 18 nt, Artificial Sequence
  Description of Artificial Sequence: Synthetic oligonucleotide
cacuucaucaaaguccaa

SEQ ID NO: 33789 - RNA, 18 nt, Artificial Sequence
  Description of Artificial Sequence: Synthetic oligonucleotide
cuguucacuucaucaaag

SEQ ID NO: 33790 - RNA, 18 nt, Artificial Sequence
  Description of Artificial Sequence: Synthetic oligonucleotide
ccguucuguucacuucau

SEQ ID NO: 33791 - RNA, 18 nt, Artificial Sequence
  Description of Artificial Sequence: Synthetic oligonucleotide
ucuucccguucuguucac

SEQ ID NO: 33792 - RNA, 18 nt, Artificial Sequence
  Description of Artificial Sequence: Synthetic oligonucleotide
uaguuucuucccguucug

SEQ ID NO: 33793 - RNA, 18 nt, Artificial Sequence
  Description of Artificial Sequence: Synthetic oligonucleotide
cugaauaguuucuucccg

SEQ ID NO: 33794 - RNA, 18 nt, Artificial Sequence
  Description of Artificial Sequence: Synthetic oligonucleotide
aaaaacugaauaguuucu

SEQ ID NO: 33795 - RNA, 18 nt, Artificial Sequence
  Description of Artificial Sequence: Synthetic oligonucleotide
caggaaaaaacugaauag

SEQ ID NO: 33796 - RNA, 18 nt, Artificial Sequence
  Description of Artificial Sequence: Synthetic oligonucleotide
ccugccaggaaaaaacug

SEQ ID NO: 33797 - RNA, 18 nt, Artificial Sequence
  Description of Artificial Sequence: Synthetic oligonucleotide
auuuaccugccaggaaaa

SEQ ID NO: 33798 - RNA, 18 nt, Artificial Sequence
  Description of Artificial Sequence: Synthetic oligonucleotide
uguaaauuuaccugccag

SEQ ID NO: 33799 - RNA, 18 nt, Artificial Sequence
  Description of Artificial Sequence: Synthetic oligonucleotide
ucagcuguaaauuuaccu

SEQ ID NO: 33800 - RNA, 18 nt, Artificial Sequence
  Description of Artificial Sequence: Synthetic oligonucleotide
ucuuuucagcuguaaauu

SEQ ID NO: 33801 - RNA, 18 nt, Artificial Sequence
  Description of Artificial Sequence: Synthetic oligonucleotide
aauuuucuuuucagcugu

SEQ ID NO: 33802 - RNA, 18 nt, Artificial Sequence
  Description of Artificial Sequence: Synthetic oligonucleotide
ccuuuaauuuucuuuuca

SEQ ID NO: 33803 - RNA, 18 nt, Artificial Sequence
  Description of Artificial Sequence: Synthetic oligonucleotide
guaggccuuuaauuuucu

SEQ ID NO: 33804 - RNA, 18 nt, Artificial Sequence
  Description of Artificial Sequence: Synthetic oligonucleotide
cuagaguaggccuuuaau

SEQ ID NO: 33805 - RNA, 18 nt, Artificial Sequence
  Description of Artificial Sequence: Synthetic oligonucleotide
uacuucuagaguaggccu

SEQ ID NO: 33806 - RNA, 18 nt, Artificial Sequence
  Description of Artificial Sequence: Synthetic oligonucleotide
uuuaguacuucuagagua

SEQ ID NO: 33807 - RNA, 18 nt, Artificial Sequence
  Description of Artificial Sequence: Synthetic oligonucleotide
auacuuuuaguacuucua

SEQ ID NO: 33808 - RNA, 18 nt, Artificial Sequence
  Description of Artificial Sequence: Synthetic oligonucleotide
aaacgauacuuuuaguac

SEQ ID NO: 33809 - RNA, 18 nt, Artificial Sequence
  Description of Artificial Sequence: Synthetic oligonucleotide
aucugaaacgauacuuuu

SEQ ID NO: 33810 - RNA, 18 nt, Artificial Sequence
  Description of Artificial Sequence: Synthetic oligonucleotide
cagguaucugaaacgaua

SEQ ID NO: 33811 - RNA, 18 nt, Artificial Sequence
  Description of Artificial Sequence: Synthetic oligonucleotide
gaguacagguaucugaaa

SEQ ID NO: 33812 - RNA, 18 nt, Artificial Sequence
  Description of Artificial Sequence: Synthetic oligonucleotide
caauagaguacagguauc

SEQ ID NO: 33813 - RNA, 18 nt, Artificial Sequence
  Description of Artificial Sequence: Synthetic oligonucleotide
ggcuccaauagaguacag

SEQ ID NO: 33814 - RNA, 18 nt, Artificial Sequence
  Description of Artificial Sequence: Synthetic oligonucleotide
guuuaggcuccaauagag

SEQ ID NO: 33815 - RNA, 18 nt, Artificial Sequence
  Description of Artificial Sequence: Synthetic oligonucleotide
aaacaguuuaggcuccaa

SEQ ID NO: 33816 - RNA, 18 nt, Artificial Sequence
  Description of Artificial Sequence: Synthetic oligonucleotide
ugccaaaacaguuuaggc

SEQ ID NO: 33817 - RNA, 18 nt, Artificial Sequence
  Description of Artificial Sequence: Synthetic oligonucleotide
auaaaugccaaaacaguu

SEQ ID NO: 33818 - RNA, 18 nt, Artificial Sequence
  Description of Artificial Sequence: Synthetic oligonucleotide
gauucauaaaugccaaaa

SEQ ID NO: 33819 - RNA, 18 nt, Artificial Sequence
  Description of Artificial Sequence: Synthetic oligonucleotide
guccagauucauaaaugc

SEQ ID NO: 33820 - RNA, 18 nt, Artificial Sequence
  Description of Artificial Sequence: Synthetic oligonucleotide
auuggguccagauucaua

SEQ ID NO: 33821 - RNA, 18 nt, Artificial Sequence
  Description of Artificial Sequence: Synthetic oligonucleotide
uuagcauuggguccagau

SEQ ID NO: 33822 - RNA, 18 nt, Artificial Sequence
  Description of Artificial Sequence: Synthetic oligonucleotide
ugucauuagcauuggguc

SEQ ID NO: 33823 - RNA, 18 nt, Artificial Sequence
  Description of Artificial Sequence: Synthetic oligonucleotide
cugugugucauuagcauu

SEQ ID NO: 33824 - RNA, 18 nt, Artificial Sequence
  Description of Artificial Sequence: Synthetic oligonucleotide
uuucacugugugucauua

SEQ ID NO: 33825 - RNA, 18 nt, Artificial Sequence
  Description of Artificial Sequence: Synthetic oligonucleotide
aauuuuuucacugugugu

SEQ ID NO: 33826 - RNA, 18 nt, Artificial Sequence
  Description of Artificial Sequence: Synthetic oligonucleotide
agacaaauuuuuucacug

SEQ ID NO: 33827 - RNA, 18 nt, Artificial Sequence
  Description of Artificial Sequence: Synthetic oligonucleotide
aucagagacaaauuuuuu

SEQ ID NO: 33828 - RNA, 18 nt, Artificial Sequence
  Description of Artificial Sequence: Synthetic oligonucleotide
cuugaaucagagacaaau

SEQ ID NO: 33829 - RNA, 18 nt, Artificial Sequence
  Description of Artificial Sequence: Synthetic oligonucleotide
cuguacuugaaucagaga

SEQ ID NO: 33830 - RNA, 18 nt, Artificial Sequence
  Description of Artificial Sequence: Synthetic oligonucleotide
auaaacuguacuugaauc

SEQ ID NO: 33831 - RNA, 18 nt, Artificial Sequence
  Description of Artificial Sequence: Synthetic oligonucleotide
uacaaauaaacuguacuu

SEQ ID NO: 33832 - RNA, 18 nt, Artificial Sequence
  Description of Artificial Sequence: Synthetic oligonucleotide
aguuuuacaaauaaacug

SEQ ID NO: 33833 - RNA, 18 nt, Artificial Sequence
  Description of Artificial Sequence: Synthetic oligonucleotide
aguauaguuuuacaaaua

SEQ ID NO: 33834 - RNA, 18 nt, Artificial Sequence
  Description of Artificial Sequence: Synthetic oligonucleotide
gaauaaguauaguuuuac

SEQ ID NO: 33835 - RNA, 18 nt, Artificial Sequence
  Description of Artificial Sequence: Synthetic oligonucleotide
uuguagaauaaguauagu

SEQ ID NO: 33836 - RNA, 18 nt, Artificial Sequence
  Description of Artificial Sequence: Synthetic oligonucleotide
caaauuuguagaauaagu

SEQ ID NO: 33837 - RNA, 18 nt, Artificial Sequence
  Description of Artificial Sequence: Synthetic oligonucleotide
cugaccaaauuuguagaa

SEQ ID NO: 33838 - RNA, 18 nt, Artificial Sequence
  Description of Artificial Sequence: Synthetic oligonucleotide
cauuucugaccaaauuug

SEQ ID NO: 33839 - RNA, 18 nt, Artificial Sequence
  Description of Artificial Sequence: Synthetic oligonucleotide
cacaacauuucugaccaa

SEQ ID NO: 33840 - RNA, 18 nt, Artificial Sequence
  Description of Artificial Sequence: Synthetic oligonucleotide
auagacacaacauuucug

SEQ ID NO: 33841 - RNA, 18 nt, Artificial Sequence
  Description of Artificial Sequence: Synthetic oligonucleotide
auauuauagacacaacau

SEQ ID NO: 33842 - RNA, 18 nt, Artificial Sequence
  Description of Artificial Sequence: Synthetic oligonucleotide
uagaaauauuauagacac

SEQ ID NO: 33843 - RNA, 18 nt, Artificial Sequence
  Description of Artificial Sequence: Synthetic oligonucleotide
cuuuuuagaaauauuaua

SEQ ID NO: 33844 - RNA, 18 nt, Artificial Sequence
  Description of Artificial Sequence: Synthetic oligonucleotide
aaucucuuuuuagaaaua

SEQ ID NO: 33845 - RNA, 18 nt, Artificial Sequence
  Description of Artificial Sequence: Synthetic oligonucleotide
gcuacaaucucuuuuuag

SEQ ID NO: 33846 - RNA, 18 nt, Artificial Sequence
  Description of Artificial Sequence: Synthetic oligonucleotide
acauggcuacaaucucuu

SEQ ID NO: 33847 - RNA, 18 nt, Artificial Sequence
  Description of Artificial Sequence: Synthetic oligonucleotide
uuuuaacauggcuacaau

SEQ ID NO: 33848 - RNA, 18 nt, Artificial Sequence
  Description of Artificial Sequence: Synthetic oligonucleotide
ugaguuuuuaacauggcu

SEQ ID NO: 33849 - RNA, 18 nt, Artificial Sequence
  Description of Artificial Sequence: Synthetic oligonucleotide
ucaguugaguuuuuaaca

SEQ ID NO: 33850 - RNA, 18 nt, Artificial Sequence
  Description of Artificial Sequence: Synthetic oligonucleotide
auacaucaguugaguuuu

SEQ ID NO: 33851 - RNA, 18 nt, Artificial Sequence
  Description of Artificial Sequence: Synthetic oligonucleotide
ggcacauacaucaguuga

SEQ ID NO: 33852 - RNA, 18 nt, Artificial Sequence
  Description of Artificial Sequence: Synthetic oligonucleotide
uaguuggcacauacauca

SEQ ID NO: 33853 - RNA, 18 nt, Artificial Sequence
  Description of Artificial Sequence: Synthetic oligonucleotide
aguuauaguuggcacaua

SEQ ID NO: 33854 - RNA, 18 nt, Artificial Sequence
  Description of Artificial Sequence: Synthetic oligonucleotide
aaaagaguuauaguuggc

SEQ ID NO: 33855 - RNA, 18 nt, Artificial Sequence
  Description of Artificial Sequence: Synthetic oligonucleotide
guaagaaaagaguuauag

SEQ ID NO: 33856 - RNA, 18 nt, Artificial Sequence
  Description of Artificial Sequence: Synthetic oligonucleotide
uagagguaagaaaagagu

SEQ ID NO: 33857 - RNA, 18 nt, Artificial Sequence
  Description of Artificial Sequence: Synthetic oligonucleotide
uacuuuagagguaagaaa

SEQ ID NO: 33858 - RNA, 18 nt, Artificial Sequence
  Description of Artificial Sequence: Synthetic oligonucleotide
uuucuuacuuuagaggua

SEQ ID NO: 33859 - RNA, 18 nt, Artificial Sequence
  Description of Artificial Sequence: Synthetic oligonucleotide
auuauuuucuuacuuuag

SEQ ID NO: 33860 - RNA, 18 nt, Artificial Sequence
  Description of Artificial Sequence: Synthetic oligonucleotide
aggaaauuauuuucuuac

SEQ ID NO: 33861 - RNA, 18 nt, Artificial Sequence
  Description of Artificial Sequence: Synthetic oligonucleotide
aaucuaggaaauuauuuu

SEQ ID NO: 33862 - RNA, 18 nt, Artificial Sequence
  Description of Artificial Sequence: Synthetic oligonucleotide
ggauaaaucuaggaaauu

SEQ ID NO: 33863 - RNA, 18 nt, Artificial Sequence
  Description of Artificial Sequence: Synthetic oligonucleotide
guuuaggauaaaucuagg

SEQ ID NO: 33864 - RNA, 18 nt, Artificial Sequence
  Description of Artificial Sequence: Synthetic oligonucleotide
agcauguuuaggauaaau

SEQ ID NO: 33865 - RNA, 18 nt, Artificial Sequence
  Description of Artificial Sequence: Synthetic oligonucleotide
acaucagcauguuuagga

SEQ ID NO: 33866 - RNA, 18 nt, Artificial Sequence
  Description of Artificial Sequence: Synthetic oligonucleotide
uauauacaucagcauguu

SEQ ID NO: 33867 - RNA, 18 nt, Artificial Sequence
  Description of Artificial Sequence: Synthetic oligonucleotide
acucuuauauacaucagc

SEQ ID NO: 33868 - RNA, 18 nt, Artificial Sequence
  Description of Artificial Sequence: Synthetic oligonucleotide
guauuacucuuauauaca

SEQ ID NO: 33869 - RNA, 18 nt, Artificial Sequence
  Description of Artificial Sequence: Synthetic oligonucleotide
uuaagguauuacucuuau

SEQ ID NO: 33870 - RNA, 18 nt, Artificial Sequence
  Description of Artificial Sequence: Synthetic oligonucleotide
aacaauuaagguauuacu

SEQ ID NO: 33871 - RNA, 18 nt, Artificial Sequence
  Description of Artificial Sequence: Synthetic oligonucleotide
ccauaaacaauuaaggua

SEQ ID NO: 33872 - RNA, 18 nt, Artificial Sequence
  Description of Artificial Sequence: Synthetic oligonucleotide
aaaaaccauaaacaauua

SEQ ID NO: 33873 - RNA, 18 nt, Artificial Sequence
  Description of Artificial Sequence: Synthetic oligonucleotide
ggaagaaaaaccauaaac

SEQ ID NO: 33874 - RNA, 18 nt, Artificial Sequence
  Description of Artificial Sequence: Synthetic oligonucleotide
guccaggaagaaaaacca

SEQ ID NO: 33875 - RNA, 18 nt, Artificial Sequence
  Description of Artificial Sequence: Synthetic oligonucleotide
agaguguccaggaagaaa

SEQ ID NO: 33876 - RNA, 18 nt, Artificial Sequence
  Description of Artificial Sequence: Synthetic oligonucleotide
agaaaagaguguccagga

SEQ ID NO: 33877 - RNA, 18 nt, Artificial Sequence
  Description of Artificial Sequence: Synthetic oligonucleotide
ucuguagaaaagaguguc

SEQ ID NO: 33878 - RNA, 18 nt, Artificial Sequence
  Description of Artificial Sequence: Synthetic oligonucleotide
uguuuucuguagaaaaga

SEQ ID NO: 33879 - RNA, 18 nt, Artificial Sequence
  Description of Artificial Sequence: Synthetic oligonucleotide
aguuguguuuucuguaga

SEQ ID NO: 33880 - RNA, 18 nt, Artificial Sequence
  Description of Artificial Sequence: Synthetic oligonucleotide
caaaaaaauacaaggcag

SEQ ID NO: 33881 - RNA, 18 nt, Artificial Sequence
  Description of Artificial Sequence: Synthetic oligonucleotide
uaggucaaaaaaauacaa

SEQ ID NO: 33882 - RNA, 18 nt, Artificial Sequence
  Description of Artificial Sequence: Synthetic oligonucleotide
uuugauaggucaaaaaaa

SEQ ID NO: 33883 - RNA, 18 nt, Artificial Sequence
  Description of Artificial Sequence: Synthetic oligonucleotide
augauuuugauaggucaa

SEQ ID NO: 33884 - RNA, 18 nt, Artificial Sequence
  Description of Artificial Sequence: Synthetic oligonucleotide
gaaaaaugauuuugauag

SEQ ID NO: 33885 - RNA, 18 nt, Artificial Sequence
  Description of Artificial Sequence: Synthetic oligonucleotide
uaauugaaaaaugauuuu

SEQ ID NO: 33886 - RNA, 18 nt, Artificial Sequence
  Description of Artificial Sequence: Synthetic oligonucleotide
acaaguaauugaaaaaug

SEQ ID NO: 33887 - RNA, 18 nt, Artificial Sequence
  Description of Artificial Sequence: Synthetic oligonucleotide
gggaaacaaguaauugaa

SEQ ID NO: 33888 - RNA, 18 nt, Artificial Sequence
  Description of Artificial Sequence: Synthetic oligonucleotide
gacaucugaaaucuaggg

SEQ ID NO: 33889 - RNA, 18 nt, Artificial Sequence
  Description of Artificial Sequence: Synthetic oligonucleotide
ccgugacaucugaaaucu

SEQ ID NO: 33890 - RNA, 18 nt, Artificial Sequence
  Description of Artificial Sequence: Synthetic oligonucleotide
ucauaccgugacaucuga

SEQ ID NO: 33891 - RNA, 18 nt, Artificial Sequence
  Description of Artificial Sequence: Synthetic oligonucleotide
accuuucauaccgugaca

SEQ ID NO: 33892 - RNA, 18 nt, Artificial Sequence
  Description of Artificial Sequence: Synthetic oligonucleotide
auaaaaccuuucauaccg

SEQ ID NO: 33893 - RNA, 18 nt, Artificial Sequence
  Description of Artificial Sequence: Synthetic oligonucleotide
uauauauaaaaccuuuca

SEQ ID NO: 33894 - RNA, 18 nt, Artificial Sequence
  Description of Artificial Sequence: Synthetic oligonucleotide
uuaaauauauauaaaacc

SEQ ID NO: 33895 - RNA, 18 nt, Artificial Sequence
  Description of Artificial Sequence: Synthetic oligonucleotide
auuuuuuaaauauauaua

SEQ ID NO: 33896 - RNA, 18 nt, Artificial Sequence
  Description of Artificial Sequence: Synthetic oligonucleotide
acuuuauuuuuuaaauau

SEQ ID NO: 33897 - RNA, 18 nt, Artificial Sequence
  Description of Artificial Sequence: Synthetic oligonucleotide
uuuauacuuuauuuuuua

SEQ ID NO: 33898 - RNA, 18 nt, Artificial Sequence
  Description of Artificial Sequence: Synthetic oligonucleotide
uuauguuuauacuuuauu

SEQ ID NO: 33899 - RNA, 18 nt, Artificial Sequence
  Description of Artificial Sequence: Synthetic oligonucleotide
agacuuuauguuuauacu

SEQ ID NO: 33900 - RNA, 18 nt, Artificial Sequence
  Description of Artificial Sequence: Synthetic oligonucleotide
caaaaagacuuuauguuu

SEQ ID NO: 33901 - RNA, 18 nt, Artificial Sequence
  Description of Artificial Sequence: Synthetic oligonucleotide
cgcuucaaaaagacuuua

SEQ ID NO: 33902 - RNA, 18 nt, Artificial Sequence
  Description of Artificial Sequence: Synthetic oligonucleotide
aaccacgcuucaaaaaga

SEQ ID NO: 33903 - RNA, 18 nt, Artificial Sequence
  Description of Artificial Sequence: Synthetic oligonucleotide
ugcauaaccacgcuucaa

SEQ ID NO: 33904 - RNA, 18 nt, Artificial Sequence
  Description of Artificial Sequence: Synthetic oligonucleotide
uauguugcauaaccacgc

SEQ ID NO: 33905 - RNA, 18 nt, Artificial Sequence
  Description of Artificial Sequence: Synthetic oligonucleotide
uagcauauguugcauaac

SEQ ID NO: 33906 - RNA, 18 nt, Artificial Sequence
  Description of Artificial Sequence: Synthetic oligonucleotide
acgccuagcauauguugc

SEQ ID NO: 33907 - RNA, 18 nt, Artificial Sequence
  Description of Artificial Sequence: Synthetic oligonucleotide
aacuuacgccuagcauau

SEQ ID NO: 33908 - RNA, 18 nt, Artificial Sequence
  Description of Artificial Sequence: Synthetic oligonucleotide
ucaccaacuuacgccuag

SEQ ID NO: 33909 - RNA, 18 nt, Artificial Sequence
  Description of Artificial Sequence: Synthetic oligonucleotide
ggcauucaccaacuuacg

SEQ ID NO: 33910 - RNA, 18 nt, Artificial Sequence
  Description of Artificial Sequence: Synthetic oligonucleotide
aagcaggcauucaccaac

SEQ ID NO: 33911 - RNA, 18 nt, Artificial Sequence
  Description of Artificial Sequence: Synthetic oligonucleotide
cugcaaagcaggcauuca

SEQ ID NO: 33912 - RNA, 18 nt, Artificial Sequence
  Description of Artificial Sequence: Synthetic oligonucleotide
acacucugcaaagcaggc

SEQ ID NO: 33913 - RNA, 18 nt, Artificial Sequence
  Description of Artificial Sequence: Synthetic oligonucleotide
ggguuacacucugcaaag

SEQ ID NO: 33914 - RNA, 18 nt, Artificial Sequence
  Description of Artificial Sequence: Synthetic oligonucleotide
cuuuuuuuauucaauggg

SEQ ID NO: 33915 - RNA, 18 nt, Artificial Sequence
  Description of Artificial Sequence: Synthetic oligonucleotide
gcuuuuuuuauucaaugg

SEQ ID NO: 33916 - RNA, 18 nt, Artificial Sequence
  Description of Artificial Sequence: Synthetic oligonucleotide
acaaagcuuuuuuuauuc

SEQ ID NO: 33917 - RNA, 18 nt, Artificial Sequence
  Description of Artificial Sequence: Synthetic oligonucleotide
ggaaaacaaagcuuuuuu

SEQ ID NO: 33918 - RNA, 18 nt, Artificial Sequence
  Description of Artificial Sequence: Synthetic oligonucleotide
gaaagggaaaacaaagcu

SEQ ID NO: 33919 - RNA, 18 nt, Artificial Sequence
  Description of Artificial Sequence: Synthetic oligonucleotide
gggcagaaagggaaaaca

SEQ ID NO: 33920 - RNA, 18 nt, Artificial Sequence
  Description of Artificial Sequence: Synthetic oligonucleotide
gcccauacugauacaggg

SEQ ID NO: 33921 - RNA, 18 nt, Artificial Sequence
  Description of Artificial Sequence: Synthetic oligonucleotide
ugcccauacugauacagg

SEQ ID NO: 33922 - RNA, 18 nt, Artificial Sequence
  Description of Artificial Sequence: Synthetic oligonucleotide
gggugugcccauacugau

SEQ ID NO: 33923 - RNA, 18 nt, Artificial Sequence
  Description of Artificial Sequence: Synthetic oligonucleotide
gugcagggugugcccaua

SEQ ID NO: 33924 - RNA, 18 nt, Artificial Sequence
  Description of Artificial Sequence: Synthetic oligonucleotide
uuagagugcagggugugc

SEQ ID NO: 33925 - RNA, 18 nt, Artificial Sequence
  Description of Artificial Sequence: Synthetic oligonucleotide
uaaaguuagagugcaggg

SEQ ID NO: 33926 - RNA, 18 nt, Artificial Sequence
  Description of Artificial Sequence: Synthetic oligonucleotide
uagauuaaaguuagagug

SEQ ID NO: 33927 - RNA, 18 nt, Artificial Sequence
  Description of Artificial Sequence: Synthetic oligonucleotide
ugacguagauuaaaguua

SEQ ID NO: 33928 - RNA, 18 nt, Artificial Sequence
  Description of Artificial Sequence: Synthetic oligonucleotide
gagggugacguagauuaa

SEQ ID NO: 33929 - RNA, 18 nt, Artificial Sequence
  Description of Artificial Sequence: Synthetic oligonucleotide
caggugagggugacguag

SEQ ID NO: 33930 - RNA, 18 nt, Artificial Sequence
  Description of Artificial Sequence: Synthetic oligonucleotide
ccaaacaggugaggguga

SEQ ID NO: 33931 - RNA, 18 nt, Artificial Sequence
  Description of Artificial Sequence: Synthetic oligonucleotide
ccaaaccaaacaggugag

SEQ ID NO: 33932 - RNA, 18 nt, Artificial Sequence
  Description of Artificial Sequence: Synthetic oligonucleotide
uaaacccaaaccaaacag

SEQ ID NO: 33933 - RNA, 18 nt, Artificial Sequence
  Description of Artificial Sequence: Synthetic oligonucleotide
gacauuaaacccaaacca

SEQ ID NO: 33934 - RNA, 18 nt, Artificial Sequence
  Description of Artificial Sequence: Synthetic oligonucleotide
ucgcagacauuaaaccca

SEQ ID NO: 33935 - RNA, 18 nt, Artificial Sequence
  Description of Artificial Sequence: Synthetic oligonucleotide
uuuucucgcagacauuaa

SEQ ID NO: 33936 - RNA, 18 nt, Artificial Sequence
  Description of Artificial Sequence: Synthetic oligonucleotide
uuugguuuucucgcagac

SEQ ID NO: 33937 - RNA, 18 nt, Artificial Sequence
  Description of Artificial Sequence: Synthetic oligonucleotide
agauauuugguuuucucg

SEQ ID NO: 33938 - RNA, 18 nt, Artificial Sequence
  Description of Artificial Sequence: Synthetic oligonucleotide
acacaagauauuugguuu

SEQ ID NO: 33939 - RNA, 18 nt, Artificial Sequence
  Description of Artificial Sequence: Synthetic oligonucleotide
acaauacacaagauauuu

SEQ ID NO: 33940 - RNA, 18 nt, Artificial Sequence
  Description of Artificial Sequence: Synthetic oligonucleotide
aguucacaauacacaaga

SEQ ID NO: 33941 - RNA, 18 nt, Artificial Sequence
  Description of Artificial Sequence: Synthetic oligonucleotide
uugacaguucacaauaca

SEQ ID NO: 33942 - RNA, 18 nt, Artificial Sequence
  Description of Artificial Sequence: Synthetic oligonucleotide
uggcuuugacaguucaca

SEQ ID NO: 33943 - RNA, 18 nt, Artificial Sequence
  Description of Artificial Sequence: Synthetic oligonucleotide
uuagauggcuuugacagu

SEQ ID NO: 33944 - RNA, 18 nt, Artificial Sequence
  Description of Artificial Sequence: Synthetic oligonucleotide
uugguuuagauggcuuug

SEQ ID NO: 33945 - RNA, 18 nt, Artificial Sequence
  Description of Artificial Sequence: Synthetic oligonucleotide
ugggauugguuuagaugg

SEQ ID NO: 33946 - RNA, 18 nt, Artificial Sequence
  Description of Artificial Sequence: Synthetic oligonucleotide
gaccuugggauugguuua

SEQ ID NO: 33947 - RNA, 18 nt, Artificial Sequence
  Description of Artificial Sequence: Synthetic oligonucleotide
cacuugaccuugggauug

SEQ ID NO: 33948 - RNA, 18 nt, Artificial Sequence
  Description of Artificial Sequence: Synthetic oligonucleotide
auauccacuugaccuugg

SEQ ID NO: 33949 - RNA, 18 nt, Artificial Sequence
  Description of Artificial Sequence: Synthetic oligonucleotide
uuuuuauauccacuugac

SEQ ID NO: 33950 - RNA, 18 nt, Artificial Sequence
  Description of Artificial Sequence: Synthetic oligonucleotide
cagaauuuuuauauccac

SEQ ID NO: 33951 - RNA, 18 nt, Artificial Sequence
  Description of Artificial Sequence: Synthetic oligonucleotide
uuuggcagaauuuuuaua

SEQ ID NO: 33952 - RNA, 18 nt, Artificial Sequence
  Description of Artificial Sequence: Synthetic oligonucleotide
auguuuuuggcagaauuu

SEQ ID NO: 33953 - RNA, 18 nt, Artificial Sequence
  Description of Artificial Sequence: Synthetic oligonucleotide
augccauguuuuuggcag

SEQ ID NO: 33954 - RNA, 18 nt, Artificial Sequence
  Description of Artificial Sequence: Synthetic oligonucleotide
aucuuaugccauguuuuu

SEQ ID NO: 33955 - RNA, 18 nt, Artificial Sequence
  Description of Artificial Sequence: Synthetic oligonucleotide
uuuccaucuuaugccaug

SEQ ID NO: 33956 - RNA, 18 nt, Artificial Sequence
  Description of Artificial Sequence: Synthetic oligonucleotide
gaacuuuuccaucuuaug

SEQ ID NO: 33957 - RNA, 18 nt, Artificial Sequence
  Description of Artificial Sequence: Synthetic oligonucleotide
ucagggaacuuuuccauc

SEQ ID NO: 33958 - RNA, 18 nt, Artificial Sequence
  Description of Artificial Sequence: Synthetic oligonucleotide
aguuuucagggaacuuuu

SEQ ID NO: 33959 - RNA, 18 nt, Artificial Sequence
  Description of Artificial Sequence: Synthetic oligonucleotide
uccagaguuuucagggaa

SEQ ID NO: 33960 - RNA, 18 nt, Artificial Sequence
  Description of Artificial Sequence: Synthetic oligonucleotide
uuucuuccagaguuuuca

SEQ ID NO: 33961 - RNA, 18 nt, Artificial Sequence
  Description of Artificial Sequence: Synthetic oligonucleotide
uuuguuuucuuccagagu

SEQ ID NO: 33962 - RNA, 18 nt, Artificial Sequence
  Description of Artificial Sequence: Synthetic oligonucleotide
auuacuuuguuuucuucc

SEQ ID NO: 33963 - RNA, 18 nt, Artificial Sequence
  Description of Artificial Sequence: Synthetic oligonucleotide
ucuacauuacuuuguuuu

SEQ ID NO: 33964 - RNA, 18 nt, Artificial Sequence
  Description of Artificial Sequence: Synthetic oligonucleotide
aggugucuacauuacuuu

SEQ ID NO: 33965 - RNA, 18 nt, Artificial Sequence
  Description of Artificial Sequence: Synthetic oligonucleotide
aaagaaggugucuacauu

SEQ ID NO: 33966 - RNA, 18 nt, Artificial Sequence
  Description of Artificial Sequence: Synthetic oligonucleotide
gggaaaaagaaggugucu

SEQ ID NO: 33967 - RNA, 18 nt, Artificial Sequence
  Description of Artificial Sequence: Synthetic oligonucleotide
auuuucuaaugguguggg

SEQ ID NO: 33968 - RNA, 18 nt, Artificial Sequence
  Description of Artificial Sequence: Synthetic oligonucleotide
aacauuuucuaauggugu

SEQ ID NO: 33969 - RNA, 18 nt, Artificial Sequence
  Description of Artificial Sequence: Synthetic oligonucleotide
gaugcaacauuuucuaau

SEQ ID NO: 33970 - RNA, 18 nt, Artificial Sequence
  Description of Artificial Sequence: Synthetic oligonucleotide
guccucaucgucauuauu

SEQ ID NO: 33971 - RNA, 18 nt, Artificial Sequence
  Description of Artificial Sequence: Synthetic oligonucleotide
gucagguccucaucguca

SEQ ID NO: 33972 - RNA, 18 nt, Artificial Sequence
  Description of Artificial Sequence: Synthetic oligonucleotide
cuggugucagguccucau

SEQ ID NO: 33973 - RNA, 18 nt, Artificial Sequence
  Description of Artificial Sequence: Synthetic oligonucleotide
cugcucuggugucagguc

SEQ ID NO: 33974 - RNA, 18 nt, Artificial Sequence
  Description of Artificial Sequence: Synthetic oligonucleotide
gccuucugcucugguguc

SEQ ID NO: 33975 - RNA, 18 nt, Artificial Sequence
  Description of Artificial Sequence: Synthetic oligonucleotide
gcucugccuucugcucug

SEQ ID NO: 33976 - RNA, 18 nt, Artificial Sequence
  Description of Artificial Sequence: Synthetic oligonucleotide
cucacgcucugccuucug

SEQ ID NO: 33977 - RNA, 18 nt, Artificial Sequence
  Description of Artificial Sequence: Synthetic oligonucleotide
uccuucucacgcucugcc

SEQ ID NO: 33978 - RNA, 18 nt, Artificial Sequence
  Description of Artificial Sequence: Synthetic oligonucleotide
uccgcuccuucucacgcu

SEQ ID NO: 33979 - RNA, 18 nt, Artificial Sequence
  Description of Artificial Sequence: Synthetic oligonucleotide
cauccuccgcuccuucuc

SEQ ID NO: 33980 - RNA, 18 nt, Artificial Sequence
  Description of Artificial Sequence: Synthetic oligonucleotide
uuggccauccuccgcucc

SEQ ID NO: 33981 - RNA, 18 nt, Artificial Sequence
  Description of Artificial Sequence: Synthetic oligonucleotide
cauuguuggccauccucc

SEQ ID NO: 33982 - RNA, 18 nt, Artificial Sequence
  Description of Artificial Sequence: Synthetic oligonucleotide
ucgggcauuguuggccau

SEQ ID NO: 33983 - RNA, 18 nt, Artificial Sequence
  Description of Artificial Sequence: Synthetic oligonucleotide
cgcucucgggcauuguug

SEQ ID NO: 33984 - RNA, 18 nt, Artificial Sequence
  Description of Artificial Sequence: Synthetic oligonucleotide
gcagacgcucucgggcau

SEQ ID NO: 33985 - RNA, 18 nt, Artificial Sequence
  Description of Artificial Sequence: Synthetic oligonucleotide
gacccgcagacgcucucg

SEQ ID NO: 33986 - RNA, 18 nt, Artificial Sequence
  Description of Artificial Sequence: Synthetic oligonucleotide
ucacggacccgcagacgc

SEQ ID NO: 33987 - RNA, 18 nt, Artificial Sequence
  Description of Artificial Sequence: Synthetic oligonucleotide
ugaugucacggacccgca

SEQ ID NO: 33988 - RNA, 18 nt, Artificial Sequence
  Description of Artificial Sequence: Synthetic oligonucleotide
cucguugaugucacggac

SEQ ID NO: 33989 - RNA, 18 nt, Artificial Sequence
  Description of Artificial Sequence: Synthetic oligonucleotide
aaagccucguugauguca

SEQ ID NO: 33990 - RNA, 18 nt, Artificial Sequence
  Description of Artificial Sequence: Synthetic oligonucleotide
cuuugaaagccucguuga

SEQ ID NO: 33991 - RNA, 18 nt, Artificial Sequence
  Description of Artificial Sequence: Synthetic oligonucleotide
gagcucuuugaaagccuc

SEQ ID NO: 33992 - RNA, 18 nt, Artificial Sequence
  Description of Artificial Sequence: Synthetic oligonucleotide
cggccgagcucuuugaaa

SEQ ID NO: 33993 - RNA, 18 nt, Artificial Sequence
  Description of Artificial Sequence: Synthetic oligonucleotide
ccaugcggccgagcucuu

SEQ ID NO: 33994 - RNA, 18 nt, Artificial Sequence
  Description of Artificial Sequence: Synthetic oligonucleotide
cugcaccaugcggccgag

SEQ ID NO: 33995 - RNA, 18 nt, Artificial Sequence
  Description of Artificial Sequence: Synthetic oligonucleotide
uggagcugcaccaugcgg

SEQ ID NO: 33996 - RNA, 18 nt, Artificial Sequence
  Description of Artificial Sequence: Synthetic oligonucleotide
ugagguggagcugcacca

SEQ ID NO: 33997 - RNA, 18 nt, Artificial Sequence
  Description of Artificial Sequence: Synthetic oligonucleotide
acucuugagguggagcug

SEQ ID NO: 33998 - RNA, 18 nt, Artificial Sequence
  Description of Artificial Sequence: Synthetic oligonucleotide
uugucacucuugaggugg

SEQ ID NO: 33999 - RNA, 18 nt, Artificial Sequence
  Description of Artificial Sequence: Synthetic oligonucleotide
gggcuugucacucuugag

SEQ ID NO: 34000 - RNA, 18 nt, Artificial Sequence
  Description of Artificial Sequence: Synthetic oligonucleotide
ucaggagcuuggucuggg

SEQ ID NO: 34001 - RNA, 18 nt, Artificial Sequence
  Description of Artificial Sequence: Synthetic oligonucleotide
gaggaucaggagcuuggu

SEQ ID NO: 34002 - RNA, 18 nt, Artificial Sequence
  Description of Artificial Sequence: Synthetic oligonucleotide
ugguggaggaucaggagc

SEQ ID NO: 34003 - RNA, 18 nt, Artificial Sequence
  Description of Artificial Sequence: Synthetic oligonucleotide
ccgccugguggaggauca

SEQ ID NO: 34004 - RNA, 18 nt, Artificial Sequence
  Description of Artificial Sequence: Synthetic oligonucleotide
ggccaccgccugguggag

SEQ ID NO: 34005 - RNA, 18 nt, Artificial Sequence
  Description of Artificial Sequence: Synthetic oligonucleotide
augacggccaccgccugg

SEQ ID NO: 34006 - RNA, 18 nt, Artificial Sequence
  Description of Artificial Sequence: Synthetic oligonucleotide
ugaggaugacggccaccg

SEQ ID NO: 34007 - RNA, 18 nt, Artificial Sequence
  Description of Artificial Sequence: Synthetic oligonucleotide
cagacugaggaugacggc

SEQ ID NO: 34008 - RNA, 18 nt, Artificial Sequence
  Description of Artificial Sequence: Synthetic oligonucleotide
ugcuccagacugaggaug

SEQ ID NO: 34009 - RNA, 18 nt, Artificial Sequence
  Description of Artificial Sequence: Synthetic oligonucleotide
cuugcugcuccagacuga

SEQ ID NO: 34010 - RNA, 18 nt, Artificial Sequence
  Description of Artificial Sequence: Synthetic oligonucleotide
ucggacuugcugcuccag

SEQ ID NO: 34011 - RNA, 18 nt, Artificial Sequence
  Description of Artificial Sequence: Synthetic oligonucleotide
cuguaguccugguggcau

SEQ ID NO: 34012 - RNA, 18 nt, Artificial Sequence
  Description of Artificial Sequence: Synthetic oligonucleotide
ugccccuguaguccuggu

SEQ ID NO: 34013 - RNA, 18 nt, Artificial Sequence
  Description of Artificial Sequence: Synthetic oligonucleotide
cacucugccccuguaguc

SEQ ID NO: 34014 - RNA, 18 nt, Artificial Sequence
  Description of Artificial Sequence: Synthetic oligonucleotide
ggagacacucugccccug

SEQ ID NO: 34015 - RNA, 18 nt, Artificial Sequence
  Description of Artificial Sequence: Synthetic oligonucleotide
ccagaggagacacucugc

SEQ ID NO: 34016 - RNA, 18 nt, Artificial Sequence
  Description of Artificial Sequence: Synthetic oligonucleotide
agcugccagaggagacac

SEQ ID NO: 34017 - RNA, 18 nt, Artificial Sequence
  Description of Artificial Sequence: Synthetic oligonucleotide
cucagagcugccagagga

SEQ ID NO: 34018 - RNA, 18 nt, Artificial Sequence
  Description of Artificial Sequence: Synthetic oligonucleotide
uugaucucagagcugcca

SEQ ID NO: 34019 - RNA, 18 nt, Artificial Sequence
  Description of Artificial Sequence: Synthetic oligonucleotide
cggauuugaucucagagc

SEQ ID NO: 34020 - RNA, 18 nt, Artificial Sequence
  Description of Artificial Sequence: Synthetic oligonucleotide
gucaucggauuugaucuc

SEQ ID NO: 34021 - RNA, 18 nt, Artificial Sequence
  Description of Artificial Sequence: Synthetic oligonucleotide
cccucgucaucggauuug

SEQ ID NO: 34022 - RNA, 18 nt, Artificial Sequence
  Description of Artificial Sequence: Synthetic oligonucleotide
caucacccucgucaucgg

SEQ ID NO: 34023 - RNA, 18 nt, Artificial Sequence
  Description of Artificial Sequence: Synthetic oligonucleotide
guucucaucacccucguc

SEQ ID NO: 34024 - RNA, 18 nt, Artificial Sequence
  Description of Artificial Sequence: Synthetic oligonucleotide
ugcagguucucaucaccc

SEQ ID NO: 34025 - RNA, 18 nt, Artificial Sequence
  Description of Artificial Sequence: Synthetic oligonucleotide
ugucuugcagguucucau

SEQ ID NO: 34026 - RNA, 18 nt, Artificial Sequence
  Description of Artificial Sequence: Synthetic oligonucleotide
uuucgugucuugcagguu

SEQ ID NO: 34027 - RNA, 18 nt, Artificial Sequence
  Description of Artificial Sequence: Synthetic oligonucleotide
gaagauuucgugucuugc

SEQ ID NO: 34028 - RNA, 18 nt, Artificial Sequence
  Description of Artificial Sequence: Synthetic oligonucleotide
ccuccgaagauuucgugu

SEQ ID NO: 34029 - RNA, 18 nt, Artificial Sequence
  Description of Artificial Sequence: Synthetic oligonucleotide
cuuguccuccgaagauuu

SEQ ID NO: 34030 - RNA, 18 nt, Artificial Sequence
  Description of Artificial Sequence: Synthetic oligonucleotide
aauuucuuguccuccgaa

SEQ ID NO: 34031 - RNA, 18 nt, Artificial Sequence
  Description of Artificial Sequence: Synthetic oligonucleotide
caucuaauuucuuguccu

SEQ ID NO: 34032 - RNA, 18 nt, Artificial Sequence
  Description of Artificial Sequence: Synthetic oligonucleotide
gucgucaucuaauuucuu

SEQ ID NO: 34033 - RNA, 18 nt, Artificial Sequence
  Description of Artificial Sequence: Synthetic oligonucleotide
uucuugucgucaucuaau

SEQ ID NO: 34034 - RNA, 18 nt, Artificial Sequence
  Description of Artificial Sequence: Synthetic oligonucleotide
uauccuucuugucgucau

SEQ ID NO: 34035 - RNA, 18 nt, Artificial Sequence
  Description of Artificial Sequence: Synthetic oligonucleotide
uuugauauccuucuuguc

SEQ ID NO: 34036 - RNA, 18 nt, Artificial Sequence
  Description of Artificial Sequence: Synthetic oligonucleotide
auugauuugauauccuuc

SEQ ID NO: 34037 - RNA, 18 nt, Artificial Sequence
  Description of Artificial Sequence: Synthetic oligonucleotide
uaguaauugauuugauau

SEQ ID NO: 34038 - RNA, 18 nt, Artificial Sequence
  Description of Artificial Sequence: Synthetic oligonucleotide
ugaccuaguaauugauuu

SEQ ID NO: 34039 - RNA, 18 nt, Artificial Sequence
  Description of Artificial Sequence: Synthetic oligonucleotide
gaucuugaccuaguaauu

SEQ ID NO: 34040 - RNA, 18 nt, Artificial Sequence
  Description of Artificial Sequence: Synthetic oligonucleotide
gcgacaguauuauauacu

SEQ ID NO: 34041 - RNA, 18 nt, Artificial Sequence
  Description of Artificial Sequence: Synthetic oligonucleotide
augaagcgacaguauuau

SEQ ID NO: 34042 - RNA, 18 nt, Artificial Sequence
  Description of Artificial Sequence: Synthetic oligonucleotide
auuaaaugaagcgacagu

SEQ ID NO: 34043 - RNA, 18 nt, Artificial Sequence
  Description of Artificial Sequence: Synthetic oligonucleotide
aaggaauuaaaugaagcg

SEQ ID NO: 34044 - RNA, 18 nt, Artificial Sequence
  Description of Artificial Sequence: Synthetic oligonucleotide
caauaaaggaauuaaaug

SEQ ID NO: 34045 - RNA, 18 nt, Artificial Sequence
  Description of Artificial Sequence: Synthetic oligonucleotide
aaguccaauaaaggaauu

SEQ ID NO: 34046 - RNA, 18 nt, Artificial Sequence
  Description of Artificial Sequence: Synthetic oligonucleotide
caucaaaguccaauaaag

SEQ ID NO: 34047 - RNA, 18 nt, Artificial Sequence
  Description of Artificial Sequence: Synthetic oligonucleotide
cacuucaucaaaguccaa

SEQ ID NO: 34048 - RNA, 18 nt, Artificial Sequence
  Description of Artificial Sequence: Synthetic oligonucleotide
cuguucacuucaucaaag

SEQ ID NO: 34049 - RNA, 18 nt, Artificial Sequence
  Description of Artificial Sequence: Synthetic oligonucleotide
ccguucuguucacuucau

SEQ ID NO: 34050 - RNA, 18 nt, Artificial Sequence
  Description of Artificial Sequence: Synthetic oligonucleotide
ucuucccguucuguucac

SEQ ID NO: 34051 - RNA, 18 nt, Artificial Sequence
  Description of Artificial Sequence: Synthetic oligonucleotide
uaguuucuucccguucug

SEQ ID NO: 34052 - RNA, 18 nt, Artificial Sequence
  Description of Artificial Sequence: Synthetic oligonucleotide
cugaauaguuucuucccg

SEQ ID NO: 34053 - RNA, 18 nt, Artificial Sequence
  Description of Artificial Sequence: Synthetic oligonucleotide
aaaaacugaauaguuucu

SEQ ID NO: 34054 - RNA, 18 nt, Artificial Sequence
  Description of Artificial Sequence: Synthetic oligonucleotide
caggaaaaaacugaauag

SEQ ID NO: 34055 - RNA, 18 nt, Artificial Sequence
  Description of Artificial Sequence: Synthetic oligonucleotide
ccugccaggaaaaaacug

SEQ ID NO: 34056 - RNA, 18 nt, Artificial Sequence
  Description of Artificial Sequence: Synthetic oligonucleotide
auuuaccugccaggaaaa

SEQ ID NO: 34057 - RNA, 18 nt, Artificial Sequence
  Description of Artificial Sequence: Synthetic oligonucleotide
uguaaauuuaccugccag

SEQ ID NO: 34058 - RNA, 18 nt, Artificial Sequence
  Description of Artificial Sequence: Synthetic oligonucleotide
ucagcuguaaauuuaccu

SEQ ID NO: 34059 - RNA, 18 nt, Artificial Sequence
  Description of Artificial Sequence: Synthetic oligonucleotide
ucuuuucagcuguaaauu

SEQ ID NO: 34060 - RNA, 18 nt, Artificial Sequence
  Description of Artificial Sequence: Synthetic oligonucleotide
aauuuucuuuucagcugu

SEQ ID NO: 34061 - RNA, 18 nt, Artificial Sequence
  Description of Artificial Sequence: Synthetic oligonucleotide
ccuuuaauuuucuuuuca

SEQ ID NO: 34062 - RNA, 18 nt, Artificial Sequence
  Description of Artificial Sequence: Synthetic oligonucleotide
guaggccuuuaauuuucu

SEQ ID NO: 34063 - RNA, 18 nt, Artificial Sequence
  Description of Artificial Sequence: Synthetic oligonucleotide
cuagaguaggccuuuaau
